United States Patent 9,283,287 (MODIFIED POLYNUCLEOTIDES FOR THE PRODUCTION OF NUCLEAR PROTEINS) - sequence listing, part 6

SEQ ID NO: 8464 - DNA, 7077 bp, Artificial Sequence
  Description of Artificial Sequence: Synthetic coding sequence
atgcagggcccctacagcctgaacggctacagagtgagagtgtacagacaggacagcgccacccagtggttcaccggcatcatcacccaccacgacctgttcaccagaaccatgatcgtgatgaacgaccaggtgctggagccccagaacgtggaccccagcatggtgcagatgaccttcctggacgacgtggtgcacagcctgctgaagggcgagaacatcggcatcaccagcagaagaagaagcagagccaaccagaacgtgaacgccgtgcacagccactacaccagagcccaggccaacagccccagacccgccatgaacagccaggccgccgtgcccaagcagaacacccaccagcagcagcagcagagaagcatcagacccaacaagagaaagggcagcgacagcagcatccccgacgaggagaagatgaaggaggagaagtacgactacatcagcagaggcgagaaccccaagggcaagaacaagcacctgatgaacaagagaagaaagcccgaggaggacgagaagaagctgaacatgaagagactgagaaccgacaacgtgagcgacttcagcgagagcagcgacagcgagaacagcaacaagagaatcatcgacaacagcagcgagcagaagcccgagaacgagctgaagaacaagaacaccagcaagatcaacggcgaggagggcaagccccacaacaacgagaaggccggcgaggagaccctgaagaacagccagcccccctgggaccagatccaggaggacaagaagcacgaggaggccgagaagagaaagagcgtggacacccagctgcaggaggacatgatcatccacagcagcgagcagagcaccgtgagcgaccacaacagcaacgacctgctgccccaggagtgcaacatggacaagacccacaccatggagctgctgcccaaggagaagttcgtgagcagaccccccacccccaagtgcgtgatcgacatcaccaacgacaccaacctggagaaggtggcccaggagaacagcagcaccttcggcctgcagaccctgcagaagatggaccccaacgtgagcgacagcaagcacagcatcgccaacgccaagttcctggagaccgccaagaaggacagcgaccagagctgggtgagcgacgtggtgaaggtggacctgacccagagcagcgtgaccaacgccagcagcggcaacgaccacctgaacatggagaaggagaagtacgtgagctacatcagccccctgagcgccgtgagcgtgatggaggacaagctgcacaagagaagccccccccccgagaccatcaagagcaagctgaacaccagcgtggacacccacaagatcaagagcagccccagccccgaggtggtgaagcccaagatcacccacagccccgacagcgtgaagagcaaggccacctacgtgaacagccaggccaccggcgagagaagactggccaacaagatcgagcacgagctgagcagatgcagcttccaccccatccccaccagaagcagcaccctggagaccaccaagagccccctgatcatcgacaagaacgagcacttcaccgtgtacagagaccccgccctgatcggcagcgagaccggcgccaaccacatcagccccttcctgagccagcaccccttccccctgcacagcagcagccacagaacctgcctgaaccccggcacccaccaccccgccctgacccccgccccccacctgctggccggcagcagcagccagacccccctgcccaccatcaacacccaccccctgaccagcggcccccaccacgccgtgcaccacccccacctgctgcccaccgtgctgcccggcgtgcccaccgccagcctgctgggcggccaccccagactggagagcgcccacgccagcagcctgagccacctggccctggcccaccagcagcagcagcagctgctgcagcaccagagcccccacctgctgggccaggcccaccccagcgccagctacaaccagctgggcctgtaccccatcatctggcagtaccccaacggcacccacgcctacagcggcctgggcctgcccagcagcaagtgggtgcaccccgagaacgccgtgaacgccgaggccagcctgagaagaaacagccccagcccctggctgcaccagcccacccccgtgaccagcgccgacggcatcggcctgctgagccacatccccgtgagacccagcagcgccgagccccacagacccctgaagatcaccgcccacagcagcccccccctgaccaagaccctggtggaccaccacaaggaggagctggagagaaaggccttcatggagcccctgagaagcgtggccagcaccagcgccaagaacgacctggacctgaacagaagccagaccggcaaggactgccacctgcacagacacttcgtggaccccgtgctgaaccagctgcagagacccccccaggagaccggcgagagactgaacaagtacaaggaggagcacagaagaatcctgcaggagagcatcgacgtggcccccttcaccaccaagatcaagggcctggagggcgagagagagaactacagcagagtggccagcagcagcagcagccccaagagccacatcatcaagcaggacatggacgtggagagaagcgtgagcgacctgtacaagatgaagcacagcgtgccccagagcctgccccagagcaactacttcaccaccctgagcaacagcgtggtgaacgagccccccagaagctaccccagcaaggaggtgagcaacatctacggcgacaagcagagcaacgccctggccgccgccgccgccaacccccagaccctgaccagcttcatcaccagcctgagcaagcccccccccctgatcaagcaccagcccgagagcgagggcctggtgggcaagatccccgagcacctgccccaccagatcgccagccacagcgtgaccaccttcagaaacgactgcagaagccccacccacctgaccgtgagcagcaccaacaccctgagaagcatgcccgccctgcacagagcccccgtgttccacccccccatccaccacagcctggagagaaaggagggcagctacagcagcctgagcccccccaccctgacccccgtgatgcccgtgaacgccggcggcaaggtgcaggagagccagaagccccccaccctgatccccgagcccaaggacagccaggccaacttcaagagcagcagcgagcagagcctgaccgagatgtggagacccaacaacaacctgagcaaggagaagaccgagtggcacgtggagaagagcagcggcaagctgcaggccgccatggccagcgtgatcgtgagacccagcagcagcaccaagaccgacagcatgcccgccatgcagctggccagcaaggacagagtgagcgagagaagcagcgccggcgcccacaagaccgactgcctgaagctggccgaggccggcgagaccggcagaatcatcctgcccaacgtgaacagcgacagcgtgcacaccaagagcgagaagaacttccaggccgtgagccagggcagcgtgcccagcagcgtgatgagcgccgtgaacaccatgtgcaacaccaagaccgacgtgatcaccagcgccgccgacaccaccagcgtgagcagctggggcggcagcgaggtgatcagcagcctgagcaacaccatcctggccagcaccagcagcgagtgcgtgagcagcaagagcgtgagccagcccgtggcccagaagcaggagtgcaaggtgagcaccaccgcccccgtgaccctggccagcagcaagaccggcagcgtggtgcagcccagcagcggcttcagcggcaccaccgacttcatccacctgaagaagcacaaggccgccctggccgccgcccagtacaagagcagcaacgccagcgagaccgagcccaacgccatcaagaaccagaccctgagcgccagcctgcccctggacagcaccgtgatctgcagcaccatcaacaaggccaacagcgtgggcaacggccaggccagccagaccagccagcccaactaccacaccaagctgaagaaggcctggctgaccagacacagcgaggaggacaagaacaccaacaagatggagaacagcggcaacagcgtgagcgagatcatcaagccctgcagcgtgaacctgatcgccagcaccagcagcgacatccagaacagcgtggacagcaagatcatcgtggacaagtacgtgaaggacgacaaggtgaacagaagaaaggccaagagaacctacgagagcggcagcgagagcggcgacagcgacgagagcgagagcaagagcgagcagagaaccaagagacagcccaagcccacctacaagaagaagcagaacgacctgcagaagagaaagggcgagatcgaggaggacctgaagcccaacggcgtgctgagcagaagcgccaaggagagaagcaagctgaagctgcagagcaacagcaacaccggcatccccagaagcgtgctgaaggactggagaaaggtgaagaagctgaagcagaccggcgagagcttcctgcaggacgacagctgctgcgagatcggccccaacctgcagaagtgcagagagtgcagactgatcagaagcaagaagggcgaggagcccgcccacagccccgtgttctgcagattctactacttcagaagactgagcttcagcaagaacggcgtggtgagaatcgacggcttcagcagccccgaccagtacgacgacgaggccatgagcctgtggacccacgagaacttcgaggacgacgagctggacatcgagaccagcaagtacatcctggacatcatcggcgacaagttctgccagctggtgaccagcgagaagaccgccctgagctgggtgaagaaggacgccaagatcgcctggaagagagccgtgagaggcgtgagagagatgtgcgacgcctgcgaggccaccctgttcaacatccactgggtgtgccagaagtgcggcttcgtggtgtgcctggactgctacaaggccaaggagagaaagagcagcagagacaaggagctgtacgcctggatgaagtgcgtgaagggccagccccacgaccacaagcacctgatgcccacccagatcatccccggcagcgtgctgaccgacctgctggacgccatgcacaccctgagagagaagtacggcatcaagagccactgccactgcaccaacaagcagaacctgcaggtgggcaacttccccaccatgaacggcgtgagccaggtgctgcagaacgtgctgaaccacagcaacaagatcagcctgtgcatgcccgagagccagcagcagaacaccccccccaagagcgagaagaacggcggcagcagccccgagagcgacgtgggcaccgacaacaagctgaccccccccgagagccagagccccctgcactggctggccgacctggccgagcagaaggccagagaggagaagaaggagaacaaggagctgaccctggagaaccagatcaaggaggagagagagcaggacaacagcgagagccccaacggcagaaccagccccctggtgagccagaacaacgagcagggcagcaccctgagagacctgctgaccaccaccgccggcaagctgagagtgggcagcaccgacgccggcatcgccttcgcccccgtgtacagcatgggcgcccccagcagcaagagcggcagaaccatgcccaacatcctggacgacatcatcgccagcgtggtggagaacaagatcccccccagcaagaccagcaagatcaacgtgaagcccgagctgaaggaggagcccgaggagagcatcatcagcgccgtggacgagaacaacaagctgtacagcgacatcccccacagctggatctgcgagaagcacatcctgtggctgaaggactacaagaacagcagcaactggaagctgttcaaggagtgctggaagcagggccagcccgccgtggtgagcggcgtgcacaagaagatgaacatcagcctgtggaaggccgagagcatcagcctggacttcggcgaccaccaggccgacctgctgaactgcaaggacagcatcatcagcaacgccaacgtgaaggagttctgggacggcttcgaggaggtgagcaagagacagaagaacaagagcggcgagaccgtggtgctgaagctgaaggactggcccagcggcgaggacttcaagaccatgatgcccgccagatacgaggacctgctgaagagcctgcccctgcccgagtactgcaaccccgagggcaagttcaacctggccagccacctgcccggcttcttcgtgagacccgacctgggccccagactgtgcagcgcctacggcgtggtggccgccaaggaccacgacatcggcaccaccaacctgcacatcgaggtgagcgacgtggtgaacatcctggtgtacgtgggcatcgccaagggcaacggcatcctgagcaaggccggcatcctgaagaagttcgaggaggaggacctggacgacatcctgagaaagagactgaaggacagcagcgagatccccggcgccctgtggcacatctacgccggcaaggacgtggacaagatcagagagttcctgcagaagatcagcaaggagcagggcctggaggtgctgcccgagcacgaccccatcagagaccagagctggtacgtgaacaagaagctgagacagagactgctggaggagtacggcgtgagaacctgcaccctgatccagttcctgggcgacgccatcgtgctgcccgccggcgccctgcaccaggtgcagaacttccacagctgcatccaggtgaccgaggacttcgtgagccccgagcacctggtggagagcttccacctgacccaggagctgagactgctgaaggaggagatcaactacgacgacaagctgcaggtgaagaacatcctgtaccacgccgtgaaggagatggtgagagccctgaagatccacgaggacgaggtggaggacatggaggagaactag

SEQ ID NO: 8465 - DNA, 3741 bp, Artificial Sequence
  Description of Artificial Sequence: Synthetic coding sequence
atgagcaaggagagacccaagagaaacatcatccagaagaagtacgacgacagcgacggcatcccctggagcgaggagagagtggtgagaaaggtgctgtacctgagcctgaaggagttcaagaacagccagaagagacagcacgccgagggcatcgccggcagcctgaagaccgtgaacggcctgctgggcaacgaccagagcaagggcctgggccccgccagcgagcagagcgagaacgagaaggacgacgccagccaggtgagcagcaccagcaacgacgtgagcagcagcgacttcgaggagggccccagcagaaagagacccagactgcaggcccagagaaagttcgcccagagccagcccaacagccccagcaccacccccgtgaagatcgtggagcccctgctgcccccccccgccacccagatcagcgacctgagcaagagaaagcccaagaccgaggacttcctgaccttcctgtgcctgagaggcagccccgccctgcccaacagcatggtgtacttcggcagcagccaggacgaggaggaggtggaggaggaggacgacgagaccgaggacgtgaagaccgccaccaacaacgccagcagcagctgccagagcacccccagaaagggcaagacccacaagcacgtgcacaacggccacgtgttcaacggcagcagcagaagcaccagagagaaggagcccgtgcagaagcacaagagcaaggaggccacccccgccaaggagaagcacagcgaccacagagccgacagcagaagagagcaggccagcgccaaccaccccgccgccgcccccagcaccggcagcagcgccaagggcctggccgccacccaccaccacccccccctgcacagaagcgcccaggacctgagaaagcaggtgagcaaggtgaacggcgtgaccagaatgagcagcctgggcgccggcgtgaccagcgccaagaagatgagagaggtgagacccagccccagcaagaccgtgaagtacaccgccaccgtgaccaagggcgccgtgacctacaccaaggccaagagagagctggtgaaggacaccaagcccaaccaccacaagcccagcagcgccgtgaaccacaccatcagcggcaagaccgagagcagcaacgccaagaccagaaagcaggtgctgagcctgggcggcgccagcaagagcaccggccccgccgtgaacggcctgaaggtgagcggcagactgaaccccaagagctgcaccaaggaggtgggcggcagacagctgagagagggcctgcagctgagagagggcctgagaaacagcaagagaagactggaggaggcccaccaggccgagaagccccagagcccccccaagaagatgaagggcgccgccggccccgccgagggccccggcaagaaggcccccgccgagagaggcctgctgaacggccacgtgaagaaggaggtgcccgagagaagcctggagagaaacagacccaagagagccaccgccggcaagagcacccccggcagacaggcccacggcaaggccgacagcgccagctgcgagaacagaagcaccagccagcccgagagcgtgcacaagccccaggacagcggcaaggccgagaagggcggcggcaaggccggctgggccgccatggacgagatccccgtgctgagacccagcgccaaggagttccacgaccccctgatctacatcgagagcgtgagagcccaggtggagaagttcggcatgtgcagagtgatccccccccccgactggagacccgagtgcaagctgaacgacgagatgagattcgtgacccagatccagcacatccacaagctgggcagaagatggggccccaacgtgcagagactggcctgcatcaagaagcacctgaagagccagggcatcaccatggacgagctgcccctgatcggcggctgcgagctggacctggcctgcttcttcagactgatcaacgagatgggcggcatgcagcaggtgaccgacctgaagaagtggaacaagctggccgacatgctgagaatccccagaaccgcccaggacagactggccaagctgcaggaggcctactgccagtacctgctgagctacgacagcctgagccccgaggagcacagaagactggagaaggaggtgctgatggagaaggagatcctggagaagagaaagggccccctggagggccacaccgagaacgaccaccacaagttccaccccctgcccagattcgagcccaagaacggcctgatccacggcgtggcccccagaaacggcttcagaagcaagctgaaggaggtgggccaggcccagctgaagaccggcagaagaagactgttcgcccaggagaaggaggtggtgaaggaggaggaggaggacaagggcgtgctgaacgacttccacaagtgcatctacaagggcagaagcgtgagcctgaccaccttctacagaaccgccagaaacatcatgagcatgtgcttcagcaaggagcccgcccccgccgagatcgagcaggagtactggagactggtggaggagaaggactgccacgtggccgtgcactgcggcaaggtggacaccaacacccacggcagcggcttccccgtgggcaagagcgagcccttcagcagacacggctggaacctgaccgtgctgcccaacaacaccggcagcatcctgagacacctgggcgccgtgcccggcgtgaccatcccctggctgaacatcggcatggtgttcagcaccagctgctggagcagagaccagaaccacctgccctacatcgactacctgcacaccggcgccgactgcatctggtactgcatccccgccgaggaggagaacaagctggaggacgtggtgcacaccctgctgcaggccaacggcacccccggcctgcagatgctggagagcaacgtgatgatcagccccgaggtgctgtgcaaggagggcatcaaggtgcacagaaccgtgcagcagagcggccagttcgtggtgtgcttccccggcagcttcgtgagcaaggtgtgctgcggctacagcgtgagcgagaccgtgcacttcgccaccacccagtggaccagcatgggcttcgagaccgccaaggagatgaagagaagacacatcgccaagcccttcagcatggagaagctgctgtaccagatcgcccaggccgaggccaagaaggagaacggccccaccctgagcaccatcagcgccctgctggacgagctgagagacaccgagctgagacagagaagacagctgttcgaggccggcctgcacagcagcgccagatacggcagccacgacggcagcagcaccgtggccgacggcaagaagaagcccagaaagtggctgcagctggagaccagcgagagaagatgccagatctgccagcacctgtgctacctgagcatggtggtgcaggagaacgagaacgtggtgttctgcctggagtgcgccctgagacacgtggagaagcagaagagctgcagaggcctgaagctgatgtacagatacgacgaggagcagatcatcagcctggtgaaccagatctgcggcaaggtgagcggcaagaacggcagcatcgagaactgcctgagcaagcccacccccaagagaggccccagaaagagagccaccgtggacgtgccccccagcagactgagcgccagcagcagcagcaagagcgccagcagcagcagctag

SEQ ID NO: 8466 - DNA, 3225 bp, Artificial Sequence
  Description of Artificial Sequence: Synthetic coding sequence
atggtgtacttcggcagcagccaggacgaggaggaggtggaggaggaggacgacgagaccgaggacgtgaagaccgccaccaacaacgccagcagcagctgccagagcacccccagaaagggcaagacccacaagcacgtgcacaacggccacgtgttcaacggcagcagcagaagcaccagagagaaggagcccgtgcagaagcacaagagcaaggaggccacccccgccaaggagaagcacagcgaccacagagccgacagcagaagagagcaggccagcgccaaccaccccgccgccgcccccagcaccggcagcagcgccaagggcctggccgccacccaccaccacccccccctgcacagaagcgcccaggacctgagaaagcaggtgagcaaggtgaacggcgtgaccagaatgagcagcctgggcgccggcgtgaccagcgccaagaagatgagagaggtgagacccagccccagcaagaccgtgaagtacaccgccaccgtgaccaagggcgccgtgacctacaccaaggccaagagagagctggtgaaggacaccaagcccaaccaccacaagcccagcagcgccgtgaaccacaccatcagcggcaagaccgagagcagcaacgccaagaccagaaagcaggtgctgagcctgggcggcgccagcaagagcaccggccccgccgtgaacggcctgaaggtgagcggcagactgaaccccaagagctgcaccaaggaggtgggcggcagacagctgagagagggcctgcagctgagagagggcctgagaaacagcaagagaagactggaggaggcccaccaggccgagaagccccagagcccccccaagaagatgaagggcgccgccggccccgccgagggccccggcaagaaggcccccgccgagagaggcctgctgaacggccacgtgaagaaggaggtgcccgagagaagcctggagagaaacagacccaagagagccaccgccggcaagagcacccccggcagacaggcccacggcaaggccgacagcgccagctgcgagaacagaagcaccagccagcccgagagcgtgcacaagccccaggacagcggcaaggccgagaagggcggcggcaaggccggctgggccgccatggacgagatccccgtgctgagacccagcgccaaggagttccacgaccccctgatctacatcgagagcgtgagagcccaggtggagaagttcggcatgtgcagagtgatccccccccccgactggagacccgagtgcaagctgaacgacgagatgagattcgtgacccagatccagcacatccacaagctgggcagaagatggggccccaacgtgcagagactggcctgcatcaagaagcacctgaagagccagggcatcaccatggacgagctgcccctgatcggcggctgcgagctggacctggcctgcttcttcagactgatcaacgagatgggcggcatgcagcaggtgaccgacctgaagaagtggaacaagctggccgacatgctgagaatccccagaaccgcccaggacagactggccaagctgcaggaggcctactgccagtacctgctgagctacgacagcctgagccccgaggagcacagaagactggagaaggaggtgctgatggagaaggagatcctggagaagagaaagggccccctggagggccacaccgagaacgaccaccacaagttccaccccctgcccagattcgagcccaagaacggcctgatccacggcgtggcccccagaaacggcttcagaagcaagctgaaggaggtgggccaggcccagctgaagaccggcagaagaagactgttcgcccaggagaaggaggtggtgaaggaggaggaggaggacaagggcgtgctgaacgacttccacaagtgcatctacaagggcagaagcgtgagcctgaccaccttctacagaaccgccagaaacatcatgagcatgtgcttcagcaaggagcccgcccccgccgagatcgagcaggagtactggagactggtggaggagaaggactgccacgtggccgtgcactgcggcaaggtggacaccaacacccacggcagcggcttccccgtgggcaagagcgagcccttcagcagacacggctggaacctgaccgtgctgcccaacaacaccggcagcatcctgagacacctgggcgccgtgcccggcgtgaccatcccctggctgaacatcggcatggtgttcagcaccagctgctggagcagagaccagaaccacctgccctacatcgactacctgcacaccggcgccgactgcatctggtactgcatccccgccgaggaggagaacaagctggaggacgtggtgcacaccctgctgcaggccaacggcacccccggcctgcagatgctggagagcaacgtgatgatcagccccgaggtgctgtgcaaggagggcatcaaggtgcacagaaccgtgcagcagagcggccagttcgtggtgtgcttccccggcagcttcgtgagcaaggtgtgctgcggctacagcgtgagcgagaccgtgcacttcgccaccacccagtggaccagcatgggcttcgagaccgccaaggagatgaagagaagacacatcgccaagcccttcagcatggagaagctgctgtaccagatcgcccaggccgaggccaagaaggagaacggccccaccctgagcaccatcagcgccctgctggacgagctgagagacaccgagctgagacagagaagacagctgttcgaggccggcctgcacagcagcgccagatacggcagccacgacggcagcagcaccgtggccgacggcaagaagaagcccagaaagtggctgcagctggagaccagcgagagaagatgccagatctgccagcacctgtgctacctgagcatggtggtgcaggagaacgagaacgtggtgttctgcctggagtgcgccctgagacacgtggagaagcagaagagctgcagaggcctgaagctgatgtacagatacgacgaggagcagatcatcagcctggtgaaccagatctgcggcaaggtgagcggcaagaacggcagcatcgagaactgcctgagcaagcccacccccaagagaggccccagaaagagagccaccgtggacgtgccccccagcagactgagcgccagcagcagcagcaagagcgccagcagcagcagctag

SEQ ID NO: 8467 - DNA, 1524 bp, Artificial Sequence
  Description of Artificial Sequence: Synthetic coding sequence
atgaagagaaccatgcaccccaagtgcccccccctggccaccatgctggtgctgcagatcctgaagaagggcagaagaggcaagggcagccccgccctgcccaacagcatggtgtacttcggcagcagccaggacgaggaggaggtggaggaggaggacgacgagaccgaggacgtgaagaccgccaccaacaacgccagcagcagctgccagagcacccccagaaagggcaagacccacaagcacgtgcacaacggccacgtgttcaacggcagcagcagaagcaccagagagaaggagcccgtgcagaagcacaagagcaaggaggccacccccgccaaggagaagcacagcgaccacagagccgacagcagaagagagcaggccagcgccaaccaccccgccgccgcccccagcaccggcagcagcgccaagggcctggccgccacccaccaccacccccccctgcacagaagcgcccaggacctgagaaagcaggtgagcaaggtgaacggcgtgaccagaatgagcagcctgggcgccggcgtgaccagcgccaagaagatgagagaggtgagacccagccccagcaagaccgtgaagtacaccgccaccgtgaccaagggcgccgtgacctacaccaaggccaagagagagctggtgaaggacaccaagcccaaccaccacaagcccagcagcgccgtgaaccacaccatcagcggcaagaccgagagcagcaacgccaagaccagaaagcaggtgctgagcctgggcggcgccagcaagagcaccggccccgccgtgaacggcctgaaggtgagcggcagactgaaccccaagagctgcaccaaggaggtgggcggcagacagctgagagagggcctgcagctgagagagggcctgagaaacagcaagagaagactggaggaggcccaccaggccgagaagccccagagcccccccaagaagatgaagggcgccgccggccccgccgagggccccggcaagaaggcccccgccgagagaggcctgctgaacggccacgtgaagaaggaggtgcccgagagaagcctggagagaaacagacccaagagagccaccgccggcaagagcacccccggcagacaggcccacggcaaggccgacagcgccagctgcgagaacagaagcaccagccagcccgagagcgtgcacaagccccaggacagcggcaaggccgagaagggcggcggcaaggccggctgggccgccatggacgagatccccgtgctgagacccagcgccaaggagttccacgaccccctgatctacatcgagagcgtgagagcccaggtggagaagttcggcatgtgcagagtgatccccccccccgactggagacccgagtgcaagctgaacgacgagatgagattcgtgacccagatccagcacatccacaagctgggcagaagatggggccccaacgtgcagagactggcctgcatcaagaagcacctgaagagcctgggcggctgcggcagctag

SEQ ID NO: 8468 - DNA, 2883 bp, Artificial Sequence
  Description of Artificial Sequence: Synthetic coding sequence
atggccgcccccagagtgtgccaggtgcagttcctggtggcctacctggaggagcccggcatcgagggcctgctgggcaacgaccagagcaagggcctgggccccgccagcgagcagagcgagaacgagaaggacgacgccagccaggtgagcagcaccagcaacgacgtgagcagcagcgacttcgaggagggccccagcagaaagagacccagactgcaggcccagagaaagttcgcccagagccagcccaacagccccagcaccacccccgtgaagatcgtggagcccctgctgcccccccccgccacccagatcagcgacctgagcaagagaaagcccaagaccgaggacttcctgaccttcctgtgcctgagaggcagccccgccctgcccaacagcatggtgtacttcggcagcagccaggacgaggaggaggtggaggaggaggacgacgagaccgaggacgtgaagaccgccaccaacaacgccagcagcagctgccagagcacccccagaaagggcaagacccacaagcacgtgcacaacggccacgtgttcaacggcagcagcagaagcaccagagagaaggagcccgtgcagaagcacaagagcaaggaggccacccccgccaaggagaagcacagcgaccacagagccgacagcagaagagagcaggccagcgccaaccaccccgccgccgcccccagcaccggcagcagcgccaagggcctggccgccacccaccaccacccccccctgcacagaagcgcccaggacctgagaaagcaggtgagcaaggtgaacggcgtgaccagaatgagcagcctgggcgccggcgtgaccagcgccaagaagatgagagaggtgagacccagccccagcaagaccgtgaagtacaccgccaccgtgaccaagggcgccgtgacctacaccaaggccaagagagagctggtgaaggacaccaagcccaaccaccacaagcccagcagcgccgtgaaccacaccatcagcggcaagaccgagagcagcaacgccaagaccagaaagcaggtgctgagcctgggcggcgccagcaagagcaccggccccgccgtgaacggcctgaaggtgagcggcagactgaaccccaagagctgcaccaaggaggtgggcggcagacagctgagagagggcctgcagctgagagagggcctgagaaacagcaagagaagactggaggaggcccaccaggccgagaagccccagagcccccccaagaagatgaagggcgccgccggccccgccgagggccccggcaagaaggcccccgccgagagaggcctgctgaacggccacgtgaagaaggaggtgcccgagagaagcctggagagaaacagacccaagagagccaccgccggcaagagcacccccggcagacaggcccacggcaaggccgacagcgccagctgcgagaacagaagcaccagccagcccgagagcgtgcacaagccccaggacagcggcaaggccgagaagggcggcggcaaggccggctgggccgccatggacgagatccccgtgctgagacccagcgccaaggagttccacgaccccctgatctacatcgagagcgtgagagcccaggtggagaagttcggcatgtgcagagtgatccccccccccgactggagacccgagtgcaagctgaacgacgagatgagattcgtgacccagatccagcacatccacaagctgggcagaagatggggccccaacgtgcagagactggcctgcatcaagaagcacctgaagagccagggcatcaccatggacgagctgcccctgatcggcggctgcgagctggacctggcctgcttcttcagactgatcaacgagatgggcggcatgcagcaggtgaccgacctgaagaagtggaacaagctggccgacatgctgagaatccccagaaccgcccaggacagactggccaagctgcaggaggcctactgccagtacctgctgagctacgacagcctgagccccgaggagcacagaagactggagaaggaggtgctgatggagaaggagatcctggagaagagaaagggccccctggagggccacaccgagaacgaccaccacaagttccaccccctgcccagattcgagcccaagaacggcctgatccacggcgtggcccccagaaacggcttcagaagcaagctgaaggaggtgggccaggcccagctgaagaccggcagaagaagactgttcgcccaggagaaggaggtggtgaaggaggaggaggaggacaagggcgtgctgaacgacttccacaagtgcatctacaagggcagaagcgtgagcctgaccaccttctacagaaccgccagaaacatcatgagcatgtgcttcagcaaggagcccgcccccgccgagatcgagcaggagtactggagactggtggaggagaaggactgccacgtggccgtgcactgcggcaaggtggacaccaacacccacggcagcggcttccccgtgggcaagagcgagcccttcagcagacacggctggaacctgaccgtgctgcccaacaacaccggcagcatcctgagacacctgggcgccgtgcccggcgtgaccatcccctggctgaacatcggcatggtgttcagcaccagctgctggagcagagaccagaaccacctgccctacatcgactacctgcacaccggcgccgactgcatctgcctgagcgtggagcccgtgttcccccacctgagcgtggccgtgggcagcagagtggacctgggcatcagcttcctgccctgcggcgacaccagagtgatgtaccccgtggagagcgtggcctggagaggcgtgctgggccccagactgtag

SEQ ID NO: 8469 - DNA, 525 bp, Artificial Sequence
  Description of Artificial Sequence: Synthetic coding sequence
atggtggccggctggcccgccaccccccccgccatgatgcccggccagatccccgaccccagcgtgaccaccggcagcctgcccggcctgggccccctgaccggcctgcccagcagcgccctgaccgtggaggagctgaagtacgccgacatcagaaacctgggcgccatgatcgcccccctgcacttcctggaggtgaagctgggcaagagaccccagcccgtgaagagcgagctggacgaggaggaggagagaagaaagagaagaagagagaagaacaaggtggccgccgccagatgcagaaacaagaagaaggagagaaccgagttcctgcagagagagagcgagagactggagctgatgaacgccgagctgaagacccagatcgaggagctgaagcaggagagacagcagctgatcctgatgctgaacagacacagacccacctgcatcgtgagaaccgacagcgtgaagacccccgagagcgagggcaaccccctgctggagcagctggagaagaagtag

SEQ ID NO: 8470 - DNA, 492 bp, Artificial Sequence
  Description of Artificial Sequence: Synthetic coding sequence
atgatgcccggccagatccccgaccccagcgtgaccaccggcagcctgcccggcctgggccccctgaccggcctgcccagcagcgccctgaccgtggaggagctgaagtacgccgacatcagaaacctgggcgccatgatcgcccccctgcacttcctggaggtgaagctgggcaagagaccccagcccgtgaagagcgagctggacgaggaggaggagagaagaaagagaagaagagagaagaacaaggtggccgccgccagatgcagaaacaagaagaaggagagaaccgagttcctgcagagagagagcgagagactggagctgatgaacgccgagctgaagacccagatcgaggagctgaagcaggagagacagcagctgatcctgatgctgaacagacacagacccacctgcatcgtgagaaccgacagcgtgaagacccccgagagcgagggcaaccccctgctggagcagctggagaagaagtag

SEQ ID NO: 8471 - DNA, 492 bp, Artificial Sequence; identical to SEQ ID NO: 8470
  Description of Artificial Sequence: Synthetic coding sequence

SEQ ID NO: 8472 - DNA, 492 bp, Artificial Sequence; identical to SEQ ID NO: 8470
  Description of Artificial Sequence: Synthetic coding sequence

SEQ ID NO: 8473 - DNA, 405 bp, Artificial Sequence
  Description of Artificial Sequence: Synthetic coding sequence
atgatgcccggccagatccccgaccccagcgtgaccaccggcagcctgcccggcctgggccccctgaccggcctgcccagcagcgccctgaccgtggaggagctgaagtacgccgacatcagaaacctgggcgccatgatcgcccccctgcacttcctggaggtgaagctgggcaagagaccccagcccgtgaagagcgagctggacgaggaggaggagagaagaaagagaagaagagagaagaacaaggtggccgccgccagatgcagaaacaagaagaaggagagaaccgagttcctgcagagagagagcgagagactggagctgatgaacgccgagctgaagacccagatcgaggagctgaagcaggagagacagcagctgatcctgatgctgaacagatag

SEQ ID NO: 8474 - DNA, 6015 bp, Artificial Sequence
  Description of Artificial Sequence: Synthetic coding sequence
atggtgaagctggccaaccccctgtacaccgagtggatcctggaggccatcaagaaggtgaagaagcagaagcagagacccagcgaggagagaatctgcaacgccgtgagcagcagccacggcctggacagaaagaccgtgctggagcagctggagctgagcgtgaaggacggcaccatcctgaaggtgagcaacaagggcctgaacagctacaaggaccccgacaaccccggcagaatcgccctgcccaagcccagaaaccacggcaagctggacaacaagcagaacgtggactggaacaagctgatcaagagagccgtggagggcctggccgagagcggcggcagcaccctgaagagcatcgagagattcctgaagggccagaaggacgtgagcgccctgttcggcggcagcgccgccagcggcttccaccagcagctgagactggccatcaagagagccatcggccacggcagactgctgaaggacggccccctgtacagactgaacaccaaggccaccaacgtggacggcaaggagagctgcgagagcctgagctgcctgccccccgtgagcctgctgccccacgagaaggacaagcccgtggccgagcccatccccatctgcagcttctgcctgggcaccaaggagcagaacagagagaagaagcccgaggagctgatcagctgcgccgactgcggcaacagcggccaccccagctgcctgaagttcagccccgagctgaccgtgagagtgaaggccctgagatggcagtgcatcgagtgcaagacctgcagcagctgcagagaccagggcaagaacgccgacaacatgctgttctgcgacagctgcgacagaggcttccacatggagtgctgcgacccccccctgaccagaatgcccaagggcatgtggatctgccagatctgcagacccagaaagaagggcagaaagctgctgcagaagaaggccgcccagatcaagagaagatacaccaaccccatcggcagacccaagaacagactgaagaagcagaacaccgtgagcaagggccccttcagcaaggtgagaaccggccccggcagaggcagaaagagaaagatcaccctgagcagccagagcgccagcagcagcagcgaggagggctacctggagagaatcgacggcctggacttctgcagagacagcaacgtgagcctgaagttcaacaagaagaccaagggcctgatcgacggcctgaccaagttcttcacccccagccccgacggcagaaaggccagaggcgaggtggtggactacagcgagcagtacagaatcagaaagagaggcaacagaaagagcagcaccagcgactggcccaccgacaaccaggacggctgggacggcaagcaggagaacgaggagagactgttcggcagccaggagatcatgaccgagaaggacatggagctgttcagagacatccaggagcaggccctgcagaaggtgggcgtgaccggcccccccgacccccaggtgagatgccccagcgtgatcgagttcggcaagtacgagatccacacctggtacagcagcccctacccccaggagtacagcagactgcccaagctgtacctgtgcgagttctgcctgaagtacatgaagagcagaaccatcctgcagcagcacatgaagaagtgcggctggttccacccccccgccaacgagatctacagaaagaacaacatcagcgtgttcgaggtggacggcaacgtgagcaccatctactgccagaacctgtgcctgctggccaagctgttcctggaccacaagaccctgtactacgacgtggagcccttcctgttctacgtgctgacccagaacgacgtgaagggctgccacctggtgggctacttcagcaaggagaagcactgccagcagaagtacaacgtgagctgcatcatgatcctgccccagtaccagagaaagggctacggcagattcctgatcgacttcagctacctgctgagcaagagagagggccaggccggcagccccgagaagcccctgagcgacctgggcagactgagctacatggcctactggaagagcgtgatcctggagtgcctgtaccaccagaacgacaagcagatcagcatcaagaagctgagcaagctgaccggcatctgcccccaggacatcaccagcaccctgcaccacctgagaatgctggacttcagaagcgaccagttcgtgatcatcagaagagagaagctgatccaggaccacatggccaagctgcagctgaacctgagacccgtggacgtggaccccgagtgcctgagatggacccccgtgatcgtgagcaacagcgtggtgagcgaggaggaggaggaggaggccgaggagggcgagaacgaggagccccagtgccaggagagagagctggagatcagcgtgggcaagagcgtgagccacgagaacaaggagcaggacagctacagcgtggagagcgagaagaagcccgaggtgatggcccccgtgagcagcaccagactgagcaagcaggtgctgccccacgacagcctgcccgccaacagccagcccagcagaagaggcagatggggcagaaagaacagaaagacccaggagagattcggcgacaaggacagcaagctgctgctggaggagaccagcagcgccccccaggagcagtacggcgagtgcggcgagaagagcgaggccacccaggagcagtacaccgagagcgaggagcagctggtggccagcgaggagcagcccagccaggacggcaagcccgacctgcccaagagaagactgagcgagggcgtggagccctggagaggccagctgaagaagagccccgaggccctgaagtgcagactgaccgagggcagcgagagactgcccagaagatacagcgagggcgacagagccgtgctgagaggcttcagcgagagcagcgaggaggaggaggagcccgagagccccagaagcagcagcccccccatcctgaccaagcccaccctgaagagaaagaagcccttcctgcacagaagaagaagagtgagaaagagaaagcaccacaacagcagcgtggtgaccgagaccatcagcgagaccaccgaggtgctggacgagcccttcgaggacagcgacagcgagagacccatgcccagactggagcccaccttcgagatcgacgaggaggaggaggaggaggacgagaacgagctgttccccagagagtacttcagaagactgagcagccaggacgtgctgagatgccagagcagcagcaagagaaagagcaaggacgaggaggaggacgaggagagcgacgacgccgacgacacccccatcctgaagcccgtgagcctgctgagaaagagagacgtgaagaacagccccctggagcccgacaccagcacccccctgaagaagaagaagggctggcccaagggcaagagcagaaagcccatccactggaagaagagacccggcagaaagcccggcttcaagctgagcagagagatcatgcccgtgagcacccaggcctgcgtgatcgagcccatcgtgagcatccccaaggccggcagaaagcccaagatccaggagagcgaggagaccgtggagcccaaggaggacatgcccctgcccgaggagagaaaggaggaggaggagatgcaggccgaggccgaggaggccgaggagggcgaggaggaggacgccgccagcagcgaggtgcccgccgccagccccgccgacagcagcaacagccccgagaccgagaccaaggagcccgaggtggaggaggaggaggagaagcccagagtgagcgaggagcagagacagagcgaggaggagcagcaggagctggaggagcccgagcccgaggaggaggaggacgccgccgccgagaccgcccagaacgacgaccacgacgccgacgacgaggacgacggccacctggagagcaccaagaagaaggagctggaggagcagcccaccagagaggacgtgaaggaggagcccggcgtgcaggagagcttcctggacgccaacatgcagaagagcagagagaagatcaaggacaaggaggagaccgagctggacagcgaggaggagcagcccagccacgacaccagcgtggtgagcgagcagatggccggcagcgaggacgaccacgaggaggacagccacaccaaggaggagctgatcgagctgaaggaggaggaggagatcccccacagcgagctggacctggagaccgtgcaggccgtgcagagcctgacccaggaggagagcagcgagcacgagggcgcctaccaggactgcgaggagaccctggccgcctgccagaccctgcagagctacacccaggccgacgaggacccccagatgagcatggtggaggactgccacgccagcgagcacaacagccccatcagcagcgtgcagagccaccccagccagagcgtgagaagcgtgagcagccccaacgtgcccgccctggagagcggctacacccagatcagccccgagcagggcagcctgagcgcccccagcatgcagaacatggagaccagccccatgatggacgtgcccagcgtgagcgaccacagccagcaggtggtggacagcggcttcagcgacctgggcagcatcgagagcaccaccgagaactacgagaaccccagcagctacgacagcaccatgggcggcagcatctgcggcaacagcagcagccagagcagctgcagctacggcggcctgagcagcagcagcagcctgacccagagcagctgcgtggtgacccagcagatggccagcatgggcagcagctgcagcatgatgcagcagagcagcgtgcagcccgccgccaactgcagcatcaagagcccccagagctgcgtggtggagagaccccccagcaaccagcagcagcagcccccccccccccccccccagcagccccagcccccccccccccagccccagcccgccccccagcccccccccccccagcagcagccccagcagcagccccagccccagccccagcagccccccccccccccccccccccagcagcagccccccctgagccagtgcagcatgaacaacagcttcacccccgcccccatgatcatggagatccccgagagcggcagcaccggcaacatcagcatctacgagagaatccccggcgacttcggcgccggcagctacagccagcccagcgccaccttcagcctggccaagctgcagcagctgaccaacaccatcatggacccccacgccatgccctacagccacagccccgccgtgaccagctacgccaccagcgtgagcctgagcaacaccggcctggcccagctggcccccagccaccccctggccggcaccccccaggcccaggccaccatgacccccccccccaacctggccagcaccaccatgaacctgaccagccccctgctgcagtgcaacatgagcgccaccaacatcggcatcccccacacccagagactgcagggccagatgcccgtgaagggccacatcagcatcagaagcaagagcgcccccctgcccagcgccgccgcccaccagcagcagctgtacggcagaagccccagcgccgtggccatgcaggccggccccagagccctggccgtgcagagaggcatgaacatgggcgtgaacctgatgcccacccccgcctacaacgtgaacagcatgaacatgaacaccctgaacgccatgaacagctacagaatgacccagcccatgatgaacagcagctaccacagcaaccccgcctacatgaaccagaccgcccagtaccccatgcagatgcagatgggcatgatgggcagccaggcctacacccagcagcccatgcagcccaacccccacggcaacatgatgtacaccggccccagccaccacagctacatgaacgccgccggcgtgcccaagcagagcctgaacggcccctacatgagaagatag

SEQ ID NO: 8475 - DNA, 6015 bp, Artificial Sequence; identical to SEQ ID NO: 8474
  Description of Artificial Sequence: Synthetic coding sequence

SEQ ID NO: 8476 - DNA, 6015 bp, Artificial Sequence; identical to SEQ ID NO: 8474
  Description of Artificial Sequence: Synthetic coding sequence

SEQ ID NO: 8477 - DNA, 42 bp, Artificial Sequence
  Description of Artificial Sequence: Synthetic coding sequence
atggtgaagctggccaaccccctgtacaccgagtggatctag

SEQ ID NO: 8478 - DNA, 2448 bp, Artificial Sequence
  Description of Artificial Sequence: Synthetic coding sequence
atggtgaagctggccaaccccctgtacaccgagtggatcctggaggccatcaagaaggtgaagaagcagaagcagagacccagcgaggagagaatctgcaacgccgtgagcagcagccacggcctggacagaaagaccgtgctggagcagctggagctgagcgtgaaggacggcaccatcctgaaggtgagcaacaagggcctgaacagctacaaggaccccgacaaccccggcagaatcgccctgcccaagcccagaaaccacggcaagctggacaacaagcagaacgtggactggaacaagctgatcaagagagccgtggagggcctggccgagagcggcggcagcaccctgaagagcatcgagagattcctgaagggccagaaggacgtgagcgccctgttcggcggcagcgccgccagcggcttccaccagcagctgagactggccatcaagagagccatcggccacggcagactgctgaaggacggccccctgtacagactgaacaccaaggccaccaacgtggacggcaaggagagctgcgagagcctgagctgcctgccccccgtgagcctgctgccccacgagaaggacaagcccgtggccgagcccatccccatctgcagcttctgcctgggcaccaaggagcagaacagagagaagaagcccgaggagctgatcagctgcgccgactgcggcaacagcggccaccccagctgcctgaagttcagccccgagctgaccgtgagagtgaaggccctgagatggcagtgcatcgagtgcaagacctgcagcagctgcagagaccagggcaagaacgccgacaacatgctgttctgcgacagctgcgacagaggcttccacatggagtgctgcgacccccccctgaccagaatgcccaagggcatgtggatctgccagatctgcagacccagaaagaagggcagaaagctgctgcagaagaaggccgcccagatcaagagaagatacaccaaccccatcggcagacccaagaacagactgaagaagcagaacaccgtgagcaagggccccttcagcaaggtgagaaccggccccggcagaggcagaaagagaaagatcaccctgagcagccagagcgccagcagcagcagcgaggagggctacctggagagaatcgacggcctggacttctgcagagacagcaacgtgagcctgaagttcaacaagaagaccaagggcctgatcgacggcctgaccaagttcttcacccccagccccgacggcagaaaggccagaggcgaggtggtggactacagcgagcagtacagaatcagaaagagaggcaacagaaagagcagcaccagcgactggcccaccgacaaccaggacggctgggacggcaagcaggagaacgaggagagactgttcggcagccaggagatcatgaccgagaaggacatggagctgttcagagacatccaggagcaggccctgcagaaggtgggcgtgaccggcccccccgacccccaggtgagatgccccagcgtgatcgagttcggcaagtacgagatccacacctggtacagcagcccctacccccaggagtacagcagactgcccaagctgtacctgtgcgagttctgcctgaagtacatgaagagcagaaccatcctgcagcagcacatgaagaagtgcggctggttccacccccccgccaacgagatctacagaaagaacaacatcagcgtgttcgaggtggacggcaacgtgagcaccatctactgccagaacctgtgcctgctggccaagctgttcctggaccacaagaccctgtactacgacgtggagcccttcctgttctacgtgctgacccagaacgacgtgaagggctgccacctggtgggctacttcagcaaggagaagcactgccagcagaagtacaacgtgagctgcatcatgatcctgccccagtaccagagaaagggctacggcagattcctgatcgacttcagctacctgctgagcaagagagagggccaggccggcagccccgagaagcccctgagcgacctgggcagactgagctacatggcctactggaagagcgtgatcctggagtgcctgtaccaccagaacgacaagcagatcagcatcaagaagctgagcaagctgaccggcatctgcccccaggacatcaccagcaccctgcaccacctgagaatgctggacttcagaagcgaccagttcgtgatcatcagaagagagaagctgatccaggaccacatggccaagctgcagctgaacctgagacccgtggacgtggaccccgagtgcctgagatggacccccgtgatcgtgagcaacagcgtggtgagcgaggaggaggaggaggaggccgaggagggcgagaacgaggagccccagtgccaggagagagagctggagatcagcgtgagagcctag

SEQ ID NO: 8479 - DNA, 1836 bp, Artificial Sequence
  Description of Artificial Sequence: Synthetic coding sequence
atgcccagaagaaagagaaacgccggcagcagcagcgacggcaccgaggacagcgacttcagcaccgacctggagcacaccgacagcagcgagagcgacggcaccagcagaagaagcgccagagtgaccagaagcagcgccagactgagccagagcagccaggacagcagccccgtgagaaacctgcagagcttcggcaccgaggagcccgcctacagcaccagaagagtgaccagaagccagcagcagcccacccccgtgacccccaagaagtaccccctgagacagaccagaagcagcggcagcgagaccgagcaggtggtggacttcagcgacagagagaccaagaacaccgccgaccacgacgagagcccccccagaacccccaccggcaacgcccccagcagcgagagcgacatcgacatcagcagccccaacgtgagccacgacgagagcatcgccaaggacatgagcctgaaggacagcggcagcgacctgagccacagacccaagagaagaagattccacgagagctacaacttcaacatgaagtgccccacccccggctgcaacagcctgggccacctgaccggcaagcacgagagacacttcagcatcagcggctgccccctgtaccacaacctgagcgccgacgagtgcaaggtgagagcccagagcagagacaagcagatcgaggagagaatgctgagccacagacaggacgacaacaacagacacgccaccagacaccaggcccccaccgagagacagctgagatacaaggagaaggtggccgagctgagaaagaagagaaacagcggcctgagcaaggagcagaaggagaagtacatggagcacagacagacctacggcaacaccagagagcccctgctggagaacctgaccagcgagtacgacctggacctgttcagaagagcccaggccagagccagcgaggacctggagaagctgagactgcagggccagatcaccgagggcagcaacatgatcaagaccatcgccttcggcagatacgagctggacacctggtaccacagcccctaccccgaggagtacgccagactgggcagactgtacatgtgcgagttctgcctgaagtacatgaagagccagaccatcctgagaagacacatggccaagtgcgtgtggaagcacccccccggcgacgagatctacagaaagggcagcatcagcgtgttcgaggtggacggcaagaagaacaagatctactgccagaacctgtgcctgctggccaagctgttcctggaccacaagaccctgtactacgacgtggagcccttcctgttctacgtgatgaccgaggccgacaacaccggctgccacctgatcggctacttcagcaaggagaagaacagcttcctgaactacaacgtgagctgcatcctgaccatgccccagtacatgagacagggctacggcaagatgctgatcgacttcagctacctgctgagcaaggtggaggagaaggtgggcagccccgagagacccctgagcgacctgggcctgatcagctacagaagctactggaaggaggtgctgctgagatacctgcacaacttccagggcaaggagatcagcatcaaggagatcagccaggagaccgccgtgaaccccgtggacatcgtgagcaccctgcaggccctgcagatgctgaagtactggaagggcaagcacctggtgctgaagagacaggacctgatcgacgagtggatcgccaaggaggccaagagaagcaacagcaacaagaccatggaccccagctgcctgaagtggaccccccccaagggcacctag

SEQ ID NO: 8480 - DNA, 1746 bp, Artificial Sequence
  Description of Artificial Sequence: Synthetic coding sequence
atgcccagaagaaagagaaacgccggcagcagcagcgacggcaccgaggacagcgacttcagcaccgacctggagcacaccgacagcagcgagagcgacggcaccagcagaagaagcgccagagtgaccagaagcagcgccagactgagccagagcagccaggacagcagccccgtgagaaacctgcagagcttcggcaccgaggagcccgcctacagcaccagaagagtgaccagaagccagcagcagcccacccccgtgacccccaagaagtaccccctgagacagaccagaagcagcggcagcgagaccgagcaggtggtggacttcagcgacagagagaccaagaacaccgccgaccacgacgagagcccccccagaacccccaccggcaacgcccccagcagcgagagcgacatcgacatcagcagccccaacgtgagccacgacgagagcatcgccaaggacatgagcctgaaggacagcggcagcgacctgagccacagacccaagagaagaagattccacgagagctacaacttcaacatgaagtgccccacccccggctgcaacagcctgggccacctgaccggcaagcacgagagacacttcagcatcagcggctgccccctgtaccacaacctgagcgccgacgagtgcaaggcccccaccgagagacagctgagatacaaggagaaggtggccgagctgagaaagaagagaaacagcggcctgagcaaggagcagaaggagaagtacatggagcacagacagacctacggcaacaccagagagcccctgctggagaacctgaccagcgagtacgacctggacctgttcagaagagcccaggccagagccagcgaggacctggagaagctgagactgcagggccagatcaccgagggcagcaacatgatcaagaccatcgccttcggcagatacgagctggacacctggtaccacagcccctaccccgaggagtacgccagactgggcagactgtacatgtgcgagttctgcctgaagtacatgaagagccagaccatcctgagaagacacatggccaagtgcgtgtggaagcacccccccggcgacgagatctacagaaagggcagcatcagcgtgttcgaggtggacggcaagaagaacaagatctactgccagaacctgtgcctgctggccaagctgttcctggaccacaagaccctgtactacgacgtggagcccttcctgttctacgtgatgaccgaggccgacaacaccggctgccacctgatcggctacttcagcaaggagaagaacagcttcctgaactacaacgtgagctgcatcctgaccatgccccagtacatgagacagggctacggcaagatgctgatcgacttcagctacctgctgagcaaggtggaggagaaggtgggcagccccgagagacccctgagcgacctgggcctgatcagctacagaagctactggaaggaggtgctgctgagatacctgcacaacttccagggcaaggagatcagcatcaaggagatcagccaggagaccgccgtgaaccccgtggacatcgtgagcaccctgcaggccctgcagatgctgaagtactggaagggcaagcacctggtgctgaagagacaggacctgatcgacgagtggatcgccaaggaggccaagagaagcaacagcaacaagaccatggaccccagctgcctgaagtggaccccccccaagggcacctag

SEQ ID NO: 8481 - DNA, 1278 bp, Artificial Sequence
  Description of Artificial Sequence: Synthetic coding sequence
atgagcctgaaggacagcggcagcgacctgagccacagacccaagagaagaagattccacgagagctacaacttcaacatgaagtgccccacccccggctgcaacagcctgggccacctgaccggcaagcacgagagacacttcagcatcagcggctgccccctgtaccacaacctgagcgccgacgagtgcaaggcccccaccgagagacagctgagatacaaggagaaggtggccgagctgagaaagaagagaaacagcggcctgagcaaggagcagaaggagaagtacatggagcacagacagacctacggcaacaccagagagcccctgctggagaacctgaccagcgagtacgacctggacctgttcagaagagcccaggccagagccagcgaggacctggagaagctgagactgcagggccagatcaccgagggcagcaacatgatcaagaccatcgccttcggcagatacgagctggacacctggtaccacagcccctaccccgaggagtacgccagactgggcagactgtacatgtgcgagttctgcctgaagtacatgaagagccagaccatcctgagaagacacatggccaagtgcgtgtggaagcacccccccggcgacgagatctacagaaagggcagcatcagcgtgttcgaggtggacggcaagaagaacaagatctactgccagaacctgtgcctgctggccaagctgttcctggaccacaagaccctgtactacgacgtggagcccttcctgttctacgtgatgaccgaggccgacaacaccggctgccacctgatcggctacttcagcaaggagaagaacagcttcctgaactacaacgtgagctgcatcctgaccatgccccagtacatgagacagggctacggcaagatgctgatcgacttcagctacctgctgagcaaggtggaggagaaggtgggcagccccgagagacccctgagcgacctgggcctgatcagctacagaagctactggaaggaggtgctgctgagatacctgcacaacttccagggcaaggagatcagcatcaaggagatcagccaggagaccgccgtgaaccccgtggacatcgtgagcaccctgcaggccctgcagatgctgaagtactggaagggcaagcacctggtgctgaagagacaggacctgatcgacgagtggatcgccaaggaggccaagagaagcaacagcaacaagaccatggaccccagctgcctgaagtggaccccccccaagggcacctag

SEQ ID NO: 8482 - DNA, 1419 bp, Artificial Sequence
  Description of Artificial Sequence: Synthetic coding sequence
atgcccagaagaaagagaaacgccggcagcagcagcgacggcaccgaggacagcgacttcagcaccgacctggagcacaccgacagcagcgagagcgacggcaccagcagaagaagcgccagagtgaccagaagcagcgccagactgagccagagcagccagggccacctgaccggcaagcacgagagacacttcagcatcagcggctgccccctgtaccacaacctgagcgccgacgagtgcaaggtgagagcccagagcagagacaagcagatcgaggagagaatgctgagccacagacaggacgacaacaacagacacgccaccagacaccaggcccccaccgagagacagctgagatacaaggagaaggtggccgagctgagaaagaagagaaacagcggcctgagcaaggagcagaaggagaagtacatggagcacagacagacctacggcaacaccagagagcccctgctggagaacctgaccagcgagtacgacctggacctgttcagaagagcccaggccagagccagcgaggacctggagaagctgagactgcagggccagatcaccgagggcagcaacatgatcaagaccatcgccttcggcagatacgagctggacacctggtaccacagcccctaccccgaggagtacgccagactgggcagactgtacatgtgcgagttctgcctgaagtacatgaagagccagaccatcctgagaagacacatggccaagtgcgtgtggaagcacccccccggcgacgagatctacagaaagggcagcatcagcgtgttcgaggtggacggcaagaagaacaagatctactgccagaacctgtgcctgctggccaagctgttcctggaccacaagaccctgtactacgacgtggagcccttcctgttctacgtgatgaccgaggccgacaacaccggctgccacctgatcggctacttcagcaaggagaagaacagcttcctgaactacaacgtgagctgcatcctgaccatgccccagtacatgagacagggctacggcaagatgctgatcgacttcagctacctgctgagcaaggtggaggagaaggtgggcagccccgagagacccctgagcgacctgggcctgatcagctacagaagctactggaaggaggtgctgctgagatacctgcacaacttccagggcaaggagatcagcatcaaggagatcagccaggagaccgccgtgaaccccgtggacatcgtgagcaccctgcaggccctgcagatgctgaagtactggaagggcaagcacctggtgctgaagagacaggacctgatcgacgagtggatcgccaaggaggccaagagaagcaacagcaacaagaccatggaccccagctgcctgaagtggaccccccccaagggcacctag

SEQ ID NO: 8483 - DNA, 1368 bp, Artificial Sequence
  Description of Artificial Sequence: Synthetic coding sequence
atgagcctgaaggacagcggcagcgacctgagccacagacccaagagaagaagattccacgagagctacaacttcaacatgaagtgccccacccccggctgcaacagcctgggccacctgaccggcaagcacgagagacacttcagcatcagcggctgccccctgtaccacaacctgagcgccgacgagtgcaaggtgagagcccagagcagagacaagcagatcgaggagagaatgctgagccacagacaggacgacaacaacagacacgccaccagacaccaggcccccaccgagagacagctgagatacaaggagaaggtggccgagctgagaaagaagagaaacagcggcctgagcaaggagcagaaggagaagtacatggagcacagacagacctacggcaacaccagagagcccctgctggagaacctgaccagcgagtacgacctggacctgttcagaagagcccaggccagagccagcgaggacctggagaagctgagactgcagggccagatcaccgagggcagcaacatgatcaagaccatcgccttcggcagatacgagctggacacctggtaccacagcccctaccccgaggagtacgccagactgggcagactgtacatgtgcgagttctgcctgaagtacatgaagagccagaccatcctgagaagacacatggccaagtgcgtgtggaagcacccccccggcgacgagatctacagaaagggcagcatcagcgtgttcgaggtggacggcaagaagaacaagatctactgccagaacctgtgcctgctggccaagctgttcctggaccacaagaccctgtactacgacgtggagcccttcctgttctacgtgatgaccgaggccgacaacaccggctgccacctgatcggctacttcagcaaggagaagaacagcttcctgaactacaacgtgagctgcatcctgaccatgccccagtacatgagacagggctacggcaagatgctgatcgacttcagctacctgctgagcaaggtggaggagaaggtgggcagccccgagagacccctgagcgacctgggcctgatcagctacagaagctactggaaggaggtgctgctgagatacctgcacaacttccagggcaaggagatcagcatcaaggagatcagccaggagaccgccgtgaaccccgtggacatcgtgagcaccctgcaggccctgcagatgctgaagtactggaagggcaagcacctggtgctgaagagacaggacctgatcgacgagtggatcgccaaggaggccaagagaagcaacagcaacaagaccatggaccccagctgcctgaagtggaccccccccaagggcacctag

SEQ ID NO: 8484 - DNA, 1506 bp, Artificial Sequence
  Description of Artificial Sequence: Synthetic coding sequence
atgcccagaagaaagagaaacgccggcagcagcagcgacggcaccgaggacagcgacttcagcaccgacctggagcacaccgacagcagcgagagcgacggcaccagcagaagaagcgccagagtgaccagaagcagcgccagactgagccagagcagccaggacagcagccccgtgagaaacctgcagagcttcggcaccgaggagcccgcctacagcaccagaagagtgaccagaagccagcagcagcccacccccgtgacccccaagaagtaccccctgagacagaccagaagcagcggcagcgagaccgagcaggtggtggacttcagcgacagaggccacctgaccggcaagcacgagagacacttcagcatcagcggctgccccctgtaccacaacctgagcgccgacgagtgcaaggcccccaccgagagacagctgagatacaaggagaaggtggccgagctgagaaagaagagaaacagcggcctgagcaaggagcagaaggagaagtacatggagcacagacagacctacggcaacaccagagagcccctgctggagaacctgaccagcgagtacgacctggacctgttcagaagagcccaggccagagccagcgaggacctggagaagctgagactgcagggccagatcaccgagggcagcaacatgatcaagaccatcgccttcggcagatacgagctggacacctggtaccacagcccctaccccgaggagtacgccagactgggcagactgtacatgtgcgagttctgcctgaagtacatgaagagccagaccatcctgagaagacacatggccaagtgcgtgtggaagcacccccccggcgacgagatctacagaaagggcagcatcagcgtgttcgaggtggacggcaagaagaacaagatctactgccagaacctgtgcctgctggccaagctgttcctggaccacaagaccctgtactacgacgtggagcccttcctgttctacgtgatgaccgaggccgacaacaccggctgccacctgatcggctacttcagcaaggagaagaacagcttcctgaactacaacgtgagctgcatcctgaccatgccccagtacatgagacagggctacggcaagatgctgatcgacttcagctacctgctgagcaaggtggaggagaaggtgggcagccccgagagacccctgagcgacctgggcctgatcagctacagaagctactggaaggaggtgctgctgagatacctgcacaacttccagggcaaggagatcagcatcaaggagatcagccaggagaccgccgtgaaccccgtggacatcgtgagcaccctgcaggccctgcagatgctgaagtactggaagggcaagcacctggtgctgaagagacaggacctgatcgacgagtggatcgccaaggaggccaagagaagcaacagcaacaagaccatggaccccagctgcctgaagtggaccccccccaagggcacctag

SEQ ID NO: 8485 - DNA, 1329 bp, Artificial Sequence
  Description of Artificial Sequence: Synthetic coding sequence
atgcccagaagaaagagaaacgccggcagcagcagcgacggcaccgaggacagcgacttcagcaccgacctggagcacaccgacagcagcgagagcgacggcaccagcagaagaagcgccagagtgaccagaagcagcgccagactgagccagagcagccagggccacctgaccggcaagcacgagagacacttcagcatcagcggctgccccctgtaccacaacctgagcgccgacgagtgcaaggcccccaccgagagacagctgagatacaaggagaaggtggccgagctgagaaagaagagaaacagcggcctgagcaaggagcagaaggagaagtacatggagcacagacagacctacggcaacaccagagagcccctgctggagaacctgaccagcgagtacgacctggacctgttcagaagagcccaggccagagccagcgaggacctggagaagctgagactgcagggccagatcaccgagggcagcaacatgatcaagaccatcgccttcggcagatacgagctggacacctggtaccacagcccctaccccgaggagtacgccagactgggcagactgtacatgtgcgagttctgcctgaagtacatgaagagccagaccatcctgagaagacacatggccaagtgcgtgtggaagcacccccccggcgacgagatctacagaaagggcagcatcagcgtgttcgaggtggacggcaagaagaacaagatctactgccagaacctgtgcctgctggccaagctgttcctggaccacaagaccctgtactacgacgtggagcccttcctgttctacgtgatgaccgaggccgacaacaccggctgccacctgatcggctacttcagcaaggagaagaacagcttcctgaactacaacgtgagctgcatcctgaccatgccccagtacatgagacagggctacggcaagatgctgatcgacttcagctacctgctgagcaaggtggaggagaaggtgggcagccccgagagacccctgagcgacctgggcctgatcagctacagaagctactggaaggaggtgctgctgagatacctgcacaacttccagggcaaggagatcagcatcaaggagatcagccaggagaccgccgtgaaccccgtggacatcgtgagcaccctgcaggccctgcagatgctgaagtactggaagggcaagcacctggtgctgaagagacaggacctgatcgacgagtggatcgccaaggaggccaagagaagcaacagcaacaagaccatggaccccagctgcctgaagtggaccccccccaagggcacctag

SEQ ID NO: 8486 - DNA, 1239 bp, Artificial Sequence
  Description of Artificial Sequence: Synthetic coding sequence
atgatcctggccagcgtgctgagaagcggccccggcggcggcctgcccctgagacccctgctgggccccgccctggccctgagagccagaagcaccagcgccaccgacacccaccacgtggagatggccagagagagaagcaagaccgtgaccagcttctacaaccagagcgccatcgacgccgccgccgagaagcccagcgtgagactgacccccaccatgatgctgtacgccggcagaagccaggacggcagccacctgctgaagagcgccagatacctgcagcaggagctgcccgtgagaatcgcccacagaatcaagggcttcagatgcctgcccttcatcatcggctgcaaccccaccatcctgcacgtgcacgagctgtacatcagagccttccagaagctgaccgacttcccccccatcaaggaccaggccgacgaggcccagtactgccagctggtgagacagctgctggacgaccacaaggacgtggtgaccctgctggccgagggcctgagagagagcagaaagcacatcgaggacgagaagctggtgagatacttcctggacaagaccctgaccagcagactgggcatcagaatgctggccacccaccacctggccctgcacgaggacaagcccgacttcgtgggcatcatctgcaccagactgagccccaagaagatcatcgagaagtgggtggacttcgccagaagactgtgcgagcacaagtacggcaacgcccccagagtgagaatcaacggccacgtggccgccagattccccttcatccccatgcccctggactacatcctgcccgagctgctgaagaacgccatgagagccaccatggagagccacctggacaccccctacaacgtgcccgacgtggtgatcaccatcgccaacaacgacgtggacctgatcatcagaatcagcgacagaggcggcggcatcgcccacaaggacctggacagagtgatggactaccacttcaccaccgccgaggccagcacccaggaccccagaatcagccccctgttcggccacctggacatgcacagcggcgcccagagcggccccatgcacggcttcggcttcggcctgcccaccagcagagcctacgccgagtacctgggcggcagcctgcagctgcagagcctgcagggcatcggcaccgacgtgtacctgagactgagacacatcgacggcagagaggagagcttcagaatctag

SEQ ID NO: 8487 - DNA, 1404 bp, Artificial Sequence
  Description of Artificial Sequence: Synthetic coding sequence
atggccgcccagggcgccgccgccgccgtggccgccggcaccagcggcgtggccggcgagggcgagcccggccccggcgagaacgccgccgccgagggcaccgcccccagccccggcagagtgagcccccccacccccgccagaggcgagcccgaggtgaccgtggagatcggcgagacctacctgtgcagaagacccgacagcacctggcacagcgccgaggtgatccagagcagagtgaacgaccaggagggcagagaggagttctacgtgcactacgtgggcttcaacagaagactggacgagtgggtggacaagaacagactggccctgaccaagaccgtgaaggacgccgtgcagaagaacagcgagaagtacctgagcgagctggccgagcagcccgagagaaagatcaccagaaaccagaagagaaagcacgacgagatcaaccacgtgcagaagacctacgccgagatggaccccaccaccgccgccctggagaaggagcacgaggccatcaccaaggtgaagtacgtggacaagatccacatcggcaactacgagatcgacgcctggtacttcagccccttccccgaggactacggcaagcagcccaagctgtggctgtgcgagtactgcctgaagtacatgaagtacgagaagagctacagattccacctgggccagtgccagtggagacagccccccggcaaggagatctacagaaagagcaacatcagcgtgtacgaggtggacggcaaggaccacaagatctactgccagaacctgtgcctgctggccaagctgttcctggaccacaagaccctgtacttcgacgtggagcccttcgtgttctacatcctgaccgaggtggacagacagggcgcccacatcgtgggctacttcagcaaggagaaggagagccccgacggcaacaacgtggcctgcatcctgaccctgcccccctaccagagaagaggctacggcaagttcctgatcgccttcagctacgagctgagcaagctggagagcaccgtgggcagccccgagaagcccctgagcgacctgggcaagctgagctacagaagctactggagctgggtgctgctggagatcctgagagacttcagaggcaccctgagcatcaaggacctgagccagatgaccagcatcacccagaacgacatcatcagcaccctgcagagcctgaacatggtgaagtactggaagggccagcacgtgatctgcgtgacccccaagctggtggaggagcacctgaagagcgcccagtacaagaagccccccatcaccggcggctggggcgccgccgtgtgcagaggcagatggggcagcgtgagcatctggaccggcagaagccagggcctgctgatcgccgtgacctag

SEQ ID NO: 8488 - DNA, 1221 bp, Artificial Sequence
  Description of Artificial Sequence: Synthetic coding sequence
atggccgacggcaacgaggacctgagagccgacgacctgcccggccccgccttcgagagctacgagagcatggagctggcctgccccgccgagagaagcggccacgtggccgtgagcgacggcagacacatgttcgtgtggggcggctacaagagcaaccaggtgagaggcctgtacgacttctacctgcccagagaggagctgtggatctacaacatggagaccggcagatggaagaagatcaacaccgagggcgacgtgccccccagcatgagcggcagctgcgccgtgtgcgtggacagagtgctgtacctgttcggcggccaccacagcagaggcaacaccaacaagttctacatgctggacagcagaagcaccgacagagtgctgcagtgggagagaatcgactgccagggcatcccccccagcagcaaggacaagctgggcgtgtgggtgtacaagaacaagctgatcttcttcggcggctacggctacctgcccgaggacaaggtgctgggcaccttcgagttcgacgagaccagcttctggaacagcagccaccccagaggctggaacgaccacgtgcacatcctggacaccgagaccttcacctggagccagcccatcaccaccggcaaggcccccagccccagagccgcccacgcctgcgccaccgtgggcaacagaggcttcgtgttcggcggcagatacagagacgccagaatgaacgacctgcactacctgaacctggacacctgggagtggaacgagctgatcccccagggcatctgccccgtgggcagaagctggcacagcctgacccccgtgagcagcgaccacctgttcctgttcggcggcttcaccaccgacaagcagcccctgagcgacgcctggacctactgcatcagcaagaacgagtggatccagttcaaccacccctacaccgagaagcccagactgtggcacaccgcctgcgccagcgacgagggcgaggtgatcgtgttcggcggctgcgccaacaacctgctggtgcaccacagagccgcccacagcaacgagatcctgatcttcagcgtgcagcccaagagcctggtgagactgagcctggaggccgtgatctgcttcaaggagatgctggccaacagctggaactgcctgcccaagcacctgctgcacagcgtgaaccagagattcggcagcaacaacaccagcggcagctag

SEQ ID NO: 8489 - DNA, 411 bp, Artificial Sequence
  Description of Artificial Sequence: Synthetic coding sequence
atggtgaacagctgctgcggcagcgtgtgcagcgaccagggctgcggcctggagaactgctgcagacccagctgctgccagaccacctgctgcagaaccacctgctgcagacccagctgctgcgtgagcagctgctgcagaccccagtgctgccagagcgtgtgctgccagcccacctgctgcagccccagctgctgccagaccacctgctgcagaaccacctgctgcagacccagctgctgcgtgagcagctgcttcagaccccagtgctgccagagcgtgtactgccagcccacctgctgcagacccagctgcggccagaccacctgctgcagaaccacctgctacagacccagctgctgcgtgagcacctgctgcagacccacctgcagcagcggcagctgctgctag

SEQ ID NO: 8490 - DNA, 762 bp, Artificial Sequence
  Description of Artificial Sequence: Synthetic coding sequence
tgctgccaccccagctgctgccagaccacctgctgcaagaccgcctgctgctgcagaagcttcctgaccaccgccccccagaccacctgctgctgccccagctgcgtggtgagcagctgctgcagacccagctgcagccagaccacctgctgccagaccacctgctgcagacccagctgctgccaccccgtgtgctgccagaccacctgcagacccagctgcggcgtgagcagctgctgcagacccctgtgctgccagaccacctgccaccccagctgcggcatgagcagctgctgcagacccctgtgctgccagaccacctgcagacccagctgcggcgtgagcagctgctgcagacccctgtgctgccagaccacctgctgcagagccacctgctgcagacccaactgctgcagacccagctgctgccagaccacctgctgcagaaccacctgctgcagacccagctgctgcgtgagcagctgctgcagaccccagtgctgccagagcgtgtgctgccagcccacctgctgcagccccagctgctgccagaccacctgctgcagaaccacctgctgcagacccagctgctgcgtgagcagctgcttcagaccccagtgctgccagagcgtgtactgccagcccacctgctgcagacccagctgcggccagaccacctgctgcagaaccacctgctacagacccagctgctgcgtgagcacctgctgcagacccacctgcagcagcggcagctgctgctag

SEQ ID NO: 8491 - DNA, 1332 bp, Artificial Sequence
  Description of Artificial Sequence: Synthetic coding sequence
atgcagagaagagacgaccccgccgccagaatgagcagaagcagcggcagaagcggcagcatggaccccagcggcgcccaccccagcgtgagacagacccccagcagacagccccccctgccccacagaagcagaggcggcggcggcggcagcagaggcggcgccagagccagccccgccacccagcccccccccctgctgccccccagcgccaccggccccgacgccaccgtgggcggccccgcccccacccccctgctgccccccagcgccaccgccagcgtgaagatggagcccgagaacaagtacctgcccgagctgatggccgagaaggacagcctggaccccagcttcacccacgccatgcagctgctgaccgccgagatcgagaagatccagaagggcgacagcaagaaggacgacgaggagaactacctggacctgttcagccacaagaacatgaagctgaaggagagagtgctgatccccgtgaagcagtaccccaagttcaacttcgtgggcaagatcctgggcccccagggcaacaccatcaagagactgcaggaggagaccggcgccaagatcagcgtgctgggcaagggcagcatgagagacaaggccaaggaggaggagctgagaaagggcggcgaccccaagtacgcccacctgaacatggacctgcacgtgttcatcgaggtgttcggccccccctgcgaggcctacgccctgatggcccacgccatggaggaggtgaagaagttcctggtgcccgacatgatggacgacatctgccaggagcagttcctggagctgagctacctgaacggcgtgcccgagcccagcagaggcagaggcgtgcccgtgagaggcagaggcgccgcccccccccccccccccgtgcccagaggcagaggcgtgggcccccccagaggcgccctggtgagaggcacccccgtgagaggcgccatcaccagaggcgccaccgtgaccagaggcgtgccccccccccccaccgtgagaggcgcccccgcccccagagccagaaccgccggcatccagagaatccccctgccccccccccccgcccccgagacctacgaggagtacggctacgacgacacctacgccgagcagagctacgagggctacgagggctactacagccagagccagggcgacagcgagtactacgactacggccacggcgaggtgcaggacagctacgaggcctacggccaggacgactggaacggcaccagacccagcctgaaggccccccccgccagacccgtgaagggcgcctacagagagcacccctacggcagatactag

SEQ ID NO: 8492 - DNA, 1260 bp, Artificial Sequence
  Description of Artificial Sequence: Synthetic coding sequence
atgcagagaagagacgaccccgccgccagaatgagcagaagcagcggcagaagcggcagcatggaccccagcggcgcccaccccagcgtgagacagacccccagcagacagccccccccccccctgctgccccccagcgccaccggccccgacgccaccgtgggcggccccgcccccacccccctgctgccccccagcgccaccgccagcgtgaagatggagcccgagaacaagtacctgcccgagctgatggccgagaaggacagcctggaccccagcttcacccacgccatgcagctgctgaccgccgagatcgagaagatccagaagggcgacagcaagaaggacgacgaggagaactacctggacctgttcagccacaagaacatgaagctgaaggagagagtgctgatccccgtgaagcagtaccccaagttcaacttcgtgggcaagatcctgggcccccagggcaacaccatcaagagactgcaggaggagaccggcgccaagatcagcgtgctgggcaagggcagcatgagagacaaggccaaggaggaggagctgagaaagggcggcgaccccaagtacgcccacctgaacatggacctgcacgtgttcatcgaggtgttcggccccccctgcgaggcctacgccctgatggcccacgccatggaggaggtgaagaagttcctggtgcccgacatgatggacgacatctgccaggagcagttcctggagctgagctacctgaacggcgtgcccgagcccagcagaggcagaggcgtgcccgtgagaggcagaggcgccgcccccccccccccccccgtgcccagaggcagaggcgtgggcccccccagaggcgccctggtgagaggcacccccgtgagaggcgccatcaccagaggcgccaccgtgaccagaggcgtgccccccccccccaccgtgagaggcgcccccgcccccagagccagaaccgccggcatccagagaatccccctgccccccccccccgcccccgagacctacgaggagtacggctacgacgacacctacgccgagcagagctacgagggctacgagggctactacagccagagccagggcgacagcgagtactacgactacggccacggcgaggtgcaggacagctacgaggcctacggccaggacgactggaacggcaccagacccagcctgaaggccccccccgccagacccgtgaagggcgcctacagagagcacccctacggcagatactag

SEQ ID NO: 8493 - DNA, 1215 bp, Artificial Sequence
  Description of Artificial Sequence: Synthetic coding sequence
atgcagagaagagacgaccccgccgccagaatgagcagaagcagcggcagaagcggcagcatggaccccagcggcgcccaccccagcgtgagacagacccccagcagacagccccccctgccccacagaagcagaggcggcggcggcggcagcagaggcggcgccagagccagccccgccacccagcccccccccctgctgccccccagcgccaccggccccgacgccaccgtgggcggccccgcccccacccccctgctgccccccagcgccaccgccagcgtgaagatggagcccgagaacaagtacctgcccgagctgatggccgagaaggacagcctggaccccagcttcacccacgccatgcagctgctgaccgccgagatcgagaagatccagaagggcgacagcaagaaggacgacgaggagaactacctggacctgttcagccacaagaacatgaagctgaaggagagagtgctgatccccgtgaagcagtaccccaaggaggaggagctgagaaagggcggcgaccccaagtacgcccacctgaacatggacctgcacgtgttcatcgaggtgttcggccccccctgcgaggcctacgccctgatggcccacgccatggaggaggtgaagaagttcctggtgcccgacatgatggacgacatctgccaggagcagttcctggagctgagctacctgaacggcgtgcccgagcccagcagaggcagaggcgtgcccgtgagaggcagaggcgccgcccccccccccccccccgtgcccagaggcagaggcgtgggcccccccagaggcgccctggtgagaggcacccccgtgagaggcgccatcaccagaggcgccaccgtgaccagaggcgtgccccccccccccaccgtgagaggcgcccccgcccccagagccagaaccgccggcatccagagaatccccctgccccccccccccgcccccgagacctacgaggagtacggctacgacgacacctacgccgagcagagctacgagggctacgagggctactacagccagagccagggcgacagcgagtactacgactacggccacggcgaggtgcaggacagctacgaggcctacggccaggacgactggaacggcaccagacccagcctgaaggccccccccgccagacccgtgaagggcgcctacagagagcacccctacggcagatactag

SEQ ID NO: 8494 - DNA, 1050 bp, Artificial Sequence
  Description of Artificial Sequence: Synthetic coding sequence
atggaggaggagaagtacctgcccgagctgatggccgagaaggacagcctggaccccagcttcgtgcacgccagcagactgctggccgaggagatcgagaagttccagggcagcgacggcaagaaggaggacgaggagaagaagtacctggacgtgatcagcaacaagaacatcaagctgagcgagagagtgctgatccccgtgaagcagtaccccaagttcaacttcgtgggcaagctgctgggccccagaggcaacagcctgaagagactgcaggaggagaccggcgccaagatgagcatcctgggcaagggcagcatgagagacaaggccaaggaggaggagctgagaaagagcggcgaggccaagtacgcccacctgagcgacgagctgcacgtgctgatcgaggtgttcgccccccccggcgaggcctacagcagaatgagccacgccctggaggagatcaagaagttcctggtgcccgactacaacgacgagatcagacaggagcagctgagagagctgagctacctgaacggcagcgaggacagcggcagaggcagaggcatcagaggcagaggcatcagaatcgcccccaccgcccccagcagaggcagaggcggcgccatcccccccccccccccccccggcagaggcgtgctgacccccagaggcagcaccgtgaccagaggcgccctgcccgtgccccccgtggccagaggcgtgcccacccccagagccagaggcgcccccaccgtgcccggctacagagccccccccccccccgcccacgaggcctacgaggagtacggctacgacgacggctacggcggcgagtacgacgaccagacctacgagacctacgacaacagctacgccacccagacccagagcgtgcccgagtactacgactacggccacggcgtgagcgaggacgcctacgacagctacgcccccgaggagtgggccaccaccagaagcagcctgaaggcccccccccagagaagcgccagaggcggctacagagagcacccctacggcagatactag

SEQ ID NO: 8495 - DNA, 951 bp, Artificial Sequence
  Description of Artificial Sequence: Synthetic coding sequence
atggaggaggagaagtacctgcccgagctgatggccgagaaggacagcctggaccccagcttcgtgcacgccagcagactgctggccgaggagatcgagaagttccagggcagcgacggcaagaaggaggacgaggagaagaagtacctggacgtgatcagcaacaagaacatcaagctgagcgagagagtgctgatccccgtgaagcagtaccccaagttcaacttcgtgggcaagctgctgggccccagaggcaacagcctgaagagactgcaggaggagaccggcgccaagatgagcatcctgggcaagggcagcatgagagacaaggccaaggaggaggagctgagaaagagcggcgaggccaagtacgcccacctgagcgacgagctgcacgtgctgatcgaggtgttcgccccccccggcgaggcctacagcagaatgagccacgccctggaggagatcaagaagttcctggtgcccgactacaacgacgagatcagacaggagcagctgagagagctgagctacctgaacggcagcgaggacagcggcagaggcagaggcatcagaggcagaggcatcagaatcgcccccaccgcccccagcagaggcagaggcggcgccatcccccccccccccccccccggcagaggcgtgctgacccccagaggcagcaccgtgaccagaggcgccctgcccgtgccccccgtggccagaggcgtgcccacccccagagccagaggcgcccccaccgtgcccggctacagagccccccccccccccgcccacgaggcctacgaggagtaccccagcctgcccctgagcctgttcttcgacaccgtggccaagagccaccagcactgcgacaacgaggtgccccagaccggcagcaccagactgaaccccggcagaagcttcttcctggcctggagatgggagtgggactag

SEQ ID NO: 8496 - DNA, 1905 bp, Artificial Sequence
  Description of Artificial Sequence: Synthetic coding sequence
atggccagcgccagaatcggcgacgagtacgccgaggacagcagcgacgaggaggacatcagaaacaccgtgggcaacgtgcccctggagtggtacgacgacttcccccacgtgggctacgacctggacggcagaagaatctacaagcccctgagaaccagagacgagctggaccagttcctggacaagatggacgaccccgactactggagaaccgtgcaggaccccatgaccggcagagacctgagactgaccgacgagcaggtggccctggtgagaagactgcagagcggccagttcggcgacgtgggcttcaacccctacgagcccgccgtggacttcttcagcggcgacgtgatgatccaccccgtgaccaacagacccgccgacaagagaagcttcatccccagcctggtggagaaggagaaggtgagcagaatggtgcacgccatcaagatgggctggatccagcccagaagacccagagaccccacccccagcttctacgacctgtgggcccaggaggaccccaacgccgtgctgggcagacacaagatgcacgtgcccgcccccaagctggccctgcccggccacgccgagagctacaaccccccccccgagtacctgctgagcgaggaggagagactggcctgggagcagcaggagcccggcgagagaaagctgagcttcctgcccagaaagttccccagcctgagagccgtgcccgcctacggcagattcatccaggagagattcgagagatgcctggacctgtacctgtgccccagacagagaaagatgagagtgaacgtggaccccgaggacctgatccccaagctgcccagacccagagacctgcagcccttccccacctgccaggccctggtgtacagaggccacagcgacctggtgagatgcctgagcgtgagccccggcggccagtggctggtgagcggcagcgacgacggcagcctgagactgtgggaggtggccaccgccagatgcgtgagaaccgtgcccgtgggcggcgtggtgaagagcgtggcctggaaccccagccccgccgtgtgcctggtggccgccgccgtggaggacagcgtgctgctgctgaaccccgccctgggcgacagactggtggccggcagcaccgaccagctgctgagcgccttcgtgccccccgaggagccccccctgcagcccgccagatggctggaggccagcgaggaggagagacaggtgggcctgagactgagaatctgccacggcaagcccgtgacccaggtgacctggcacggcagaggcgactacctggccgtggtgctggccacccagggccacacccaggtgctgatccaccagctgagcagaagaagaagccagagccccttcagaagaagccacggccaggtgcagagagtggccttccaccccgccagacccttcctgctggtggccagccagagaagcgtgagactgtaccacctgctgagacaggagctgaccaagaagctgatgcccaactgcaagtgggtgagcagcctggccgtgcaccccgccggcgacaacgtgatctgcggcagctacgacagcaagctggtgtggttcgacctggacctgagcaccaagccctacagaatgctgagacaccacaagaaggccctgagagccgtggccttccaccccagataccccctgttcgccagcggcagcgacgacggcagcgtgatcgtgtgccacggcatggtgtacaacgacctgctgcagaaccccctgctggtgcccgtgaaggtgctgaagggccacgtgctgaccagagacctgggcgtgctggacgtgatcttccaccccacccagccctgggtgttcagcagcggcgccgacggcaccgtgagactgttcacctag

SEQ ID NO: 8497 - DNA, 1443 bp, Artificial Sequence
  Description of Artificial Sequence: Synthetic coding sequence
atgctgaacttcggcgccagcctgcagcagaccgccgaggagagaatggagatgatcagcgagagacccaaggagagcatgtacagctggaacaagaccgccgagaagagcgacttcgaggccgtggaggccctgatgagcatgagctgcagctggaagagcgacttcaagaagtacgtggagaacagacccgtgacccccgtgagcgacctgagcgaggaggagaacctgctgcccggcacccccgacttccacaccatccccgccttctgcctgacccccccctacagccccagcgacttcgagcccagccaggtgagcaacctgatggcccccgcccccagcaccgtgcacttcaagagcctgagcgacaccgccaagccccacatcgccgcccccttcaaggaggaggagaagagccccgtgagcgcccccaagctgcccaaggcccaggccaccagcgtgatcagacacaccgccgacgcccagctgtgcaaccaccagacctgccccatgaaggccgccagcatcctgaactaccagaacaacagcttcagaagaagaacccacctgaacgtggaggccgccagaaagaacatcccctgcgccgccgtgagccccaacagaagcaagtgcgagagaaacaccgtggccgacgtggacgagaaggccagcgccgccctgtacgacttcagcgtgcccagcagcgagaccgtgatctgcagaagccagcccgcccccgtgagcccccagcagaagagcgtgctggtgagcccccccgccgtgagcgccggcggcgtgccccccatgcccgtgatctgccagatggtgcccctgcccgccaacaaccccgtggtgaccaccgtggtgcccagcaccccccccagccagccccccgccgtgtgcccccccgtggtgttcatgggcacccaggtgcccaagggcgccgtgatgttcgtggtgccccagcccgtggtgcagagcagcaagccccccgtggtgagccccaacggcaccagactgagccccatcgcccccgcccccggcttcagccccagcgccgccaaggtgaccccccagatcgacagcagcagaatcagaagccacatctgcagccaccccggctgcggcaagacctacttcaagagcagccacctgaaggcccacaccagaacccacaccggcgagaagcccttcagctgcagctggaagggctgcgagagaagattcgccagaagcgacgagctgagcagacacagaagaacccacaccggcgagaagaagttcgcctgccccatgtgcgacagaagattcatgagaagcgaccacctgaccaagcacgccagaagacacctgagcgccaagaagctgcccaactggcagatggaggtgagcaagctgaacgacatcgccctgccccccacccccgcccccacccagtag

SEQ ID NO: 8498 - DNA, 1410 bp, Artificial Sequence
  Description of Artificial Sequence: Synthetic coding sequence
atggaggagagaatggagatgatcagcgagagacccaaggagagcatgtacagctggaacaagaccgccgagaagagcgacttcgaggccgtggaggccctgatgagcatgagctgcagctggaagagcgacttcaagaagtacgtggagaacagacccgtgacccccgtgagcgacctgagcgaggaggagaacctgctgcccggcacccccgacttccacaccatccccgccttctgcctgacccccccctacagccccagcgacttcgagcccagccaggtgagcaacctgatggcccccgcccccagcaccgtgcacttcaagagcctgagcgacaccgccaagccccacatcgccgcccccttcaaggaggaggagaagagccccgtgagcgcccccaagctgcccaaggcccaggccaccagcgtgatcagacacaccgccgacgcccagctgtgcaaccaccagacctgccccatgaaggccgccagcatcctgaactaccagaacaacagcttcagaagaagaacccacctgaacgtggaggccgccagaaagaacatcccctgcgccgccgtgagccccaacagaagcaagtgcgagagaaacaccgtggccgacgtggacgagaaggccagcgccgccctgtacgacttcagcgtgcccagcagcgagaccgtgatctgcagaagccagcccgcccccgtgagcccccagcagaagagcgtgctggtgagcccccccgccgtgagcgccggcggcgtgccccccatgcccgtgatctgccagatggtgcccctgcccgccaacaaccccgtggtgaccaccgtggtgcccagcaccccccccagccagccccccgccgtgtgcccccccgtggtgttcatgggcacccaggtgcccaagggcgccgtgatgttcgtggtgccccagcccgtggtgcagagcagcaagccccccgtggtgagccccaacggcaccagactgagccccatcgcccccgcccccggcttcagccccagcgccgccaaggtgaccccccagatcgacagcagcagaatcagaagccacatctgcagccaccccggctgcggcaagacctacttcaagagcagccacctgaaggcccacaccagaacccacaccggcgagaagcccttcagctgcagctggaagggctgcgagagaagattcgccagaagcgacgagctgagcagacacagaagaacccacaccggcgagaagaagttcgcctgccccatgtgcgacagaagattcatgagaagcgaccacctgaccaagcacgccagaagacacctgagcgccaagaagctgcccaactggcagatggaggtgagcaagctgaacgacatcgccctgccccccacccccgcccccacccagtag

SEQ ID NO: 8499 - DNA, 972 bp, Artificial Sequence
  Description of Artificial Sequence: Synthetic coding sequence
atgagcgccgccgtggcctgcctggactacttcgccgccgagtgcctggtgagcatgagcgccggcgccgtggtgcacagaagaccccccgaccccgagggcgccggcggcgccgccggcagcgaggtgggcgccgcccaccccgagagcgccctgcccggccccggccccagcggccccgccagcgtgccccagctgccccaggtgcccgcccccagccccggcgccggcggcgccgccccccacctgctggccgccagcgtgtgggccgacctgagaggcagcagcggcgagggcagctgggagaacagcggcgaggcccccagagccagcagcggcttcagcgaccccatcccctgcagcgtgcagaccccctgcagcgagctggcccccgccagcggcgccgccgccgtgtgcgcccccgagagcagcagcgacgcccccgccgtgcccagcgcccccgccgcccccggcgcccccgccgccagcggcggcttcagcggcggcgccctgggcgccggccccgcccccgccgccgaccaggcccccagaagaagaagcgtgacccccgccgccaagagacaccagtgccccttccccggctgcaccaaggcctactacaagagcagccacctgaagagccaccagagaacccacaccggcgagagacccttcagctgcgactggctggactgcgacaagaagttcaccagaagcgacgagctggccagacactacagaacccacaccggcgagaagagattcagctgccccctgtgccccaagcagttcagcagaagcgaccacctgaccaagcacgccagaagacaccccacctaccaccccgacatgatcgagtacagaggcagaagaagaacccccagaatcgacccccccctgaccagcgaggtggagagcagcgccagcggcagcggccccggccccgcccccagcttcaccacctgcctgtag

SEQ ID NO: 8500 - DNA, 759 bp, Artificial Sequence
  Description of Artificial Sequence: Synthetic coding sequence
atgagcgccgccgtggcctgcgtggactacttcgccgccgacgtgctgatggccatcagcagcggcgccgtggtgcacagaggcagacccggccccgagggcgccggccccgccgccggcctggacgtgagagccgccagaagagaggccgccagccccggcacccccggcccccccccccccccccccgccgccagcggccccggccccggcgccgccgccgccccccacctgctggccgccagcatcctggccgacctgagaggcggccccggcgccgcccccggcggcgccagccccgccagcagcagcagcgccgccagcagccccagcagcggcagagcccccggcgccgcccccagcgccgccgccaagagccacagatgccccttccccgactgcgccaaggcctactacaagagcagccacctgaagagccacctgagaacccacaccggcgagagacccttcgcctgcgactggcagggctgcgacaagaagttcgccagaagcgacgagctggccagacaccacagaacccacaccggcgagaagagattcagctgccccctgtgcagcaagagattcaccagaagcgaccacctggccaagcacgccagaagacaccccggcttccaccccgacctgctgagaagacccggcgccagaagcaccagccccagcgacagcctgccctgcagcctggccggcagccccgcccccagccccgcccccagccccgcccccgccggcctgtag

SEQ ID NO: 8501 - DNA, 759 bp, Artificial Sequence; identical to SEQ ID NO: 8500
  Description of Artificial Sequence: Synthetic coding sequence

SEQ ID NO: 8502 - DNA, 1170 bp, Artificial Sequence
  Description of Artificial Sequence: Synthetic coding sequence
atgtacggcagaccccaggccgagatggagcaggaggccggcgagctgagcagatggcaggccgcccaccaggccgcccaggacaacgagaacagcgcccccatcctgaacatgagcagcagcagcggcagcagcggcgtgcacaccagctggaaccagggcctgcccagcatccagcacttcccccacagcgccgagatgctgggcagccccctggtgagcgtggaggcccccggccagaacgtgaacgagggcggcccccagttcagcatgcccctgcccgagagaggcatgagctactgcccccaggccaccctgacccccagcagaatgatctactgccagagaatgagccccccccagcaggagatgaccatcttcagcggcccccagctgatgcccgtgggcgagcccaacatccccagagtggccagacccttcggcggcaacctgagaatgccccccaacggcctgcccgtgagcgccagcaccggcatccccatcatgagccacaccggcaacccccccgtgccctaccccggcctgagcaccgtgcccagcgacgagaccctgctgggccccaccgtgcccagcaccgaggcccaggccgtgctgcccagcatggcccagatgctgcccccccaggacgcccacgacctgggcatgccccccgccgagagccagagcctgctggtgctgggcagccaggacagcctggtgagccagcccgacagccaggagggccccttcctgcccgagcagcccggccccgccccccagaccgtggagaagaacagcagaccccaggagggcaccggcagaagaggcagcagcgaggccagaccctactgctgcaactacgagaactgcggcaaggcctacaccaagagaagccacctggtgagccaccagagaaagcacaccggcgagagaccctacagctgcaactgggagagctgcagctggagcttcttcagaagcgacgagctgagaagacacatgagagtgcacaccagatacagaccctacaagtgcgaccagtgcagcagagagttcatgagaagcgaccacctgaagcagcaccagaagacccacagacccggccccagcgacccccaggccaacaacaacaacggcgagcaggacagcccccccgccgccggcccctag

SEQ ID NO: 8503 - DNA, 1038 bp, Artificial Sequence
  Description of Artificial Sequence: Synthetic coding sequence
atgctgatgttcgaccccgtgcccgtgaagcaggaggccatggaccccgtgagcgtgagctaccccagcaactacatggagagcatgaagcccaacaagtacggcgtgatctacagcacccccctgcccgagaagttcttccagacccccgagggcctgagccacggcatccagatggagcccgtggacctgaccgtgaacaagagaagcagcccccccagcgccggcaacagccccagcagcctgaagttccccagcagccacagaagagccagccccggcctgagcatgcccagcagcagcccccccatcaagaagtacagcccccccagccccggcgtgcagcccttcggcgtgcccctgagcatgccccccgtgatggccgccgccctgagcagacacggcatcagaagccccggcatcctgcccgtgatccagcccgtggtggtgcagcccgtgcccttcatgtacaccagccacctgcagcagcccctgatggtgagcctgagcgaggagatggagaacagcagcagcagcatgcaggtgcccgtgatcgagagctacgagaagcccatcagccagaagaagatcaagatcgagcccggcatcgagccccagagaaccgactactaccccgaggagatgagcccccccctgatgaacagcgtgagccccccccaggccctgctgcaggagaaccaccccagcgtgatcgtgcagcccggcaagagacccctgcccgtggagagccccgacacccagagaaagagaagaatccacagatgcgactacgacggctgcaacaaggtgtacaccaagagcagccacctgaaggcccacagaagaacccacaccggcgagaagccctacaagtgcacctgggagggctgcacctggaagttcgccagaagcgacgagctgaccagacacttcagaaagcacaccggcatcaagcccttccagtgccccgactgcgacagaagcttcagcagaagcgaccacctggccctgcacagaaagagacacatgctggtgtag

SEQ ID NO: 8504 - DNA, 1374 bp, Artificial Sequence
  Description of Artificial Sequence: Synthetic coding sequence
atggccaccagagtgctgagcatgagcgccagactgggccccgtgccccagccccccgccccccaggacgagcccgtgttcgcccagctgaagcccgtgctgggcgccgccaaccccgccagagacgccgccctgttccccggcgaggagctgaagcacgcccaccacagaccccaggcccagcccgcccccgcccaggccccccagcccgcccagccccccgccaccggccccagactgccccccgaggacctggtgcagaccagatgcgagatggagaagtacctgaccccccagctgccccccgtgcccatcatccccgagcacaagaagtacagaagagacagcgccagcgtggtggaccagttcttcaccgacaccgagggcctgccctacagcatcaacatgaacgtgttcctgcccgacatcacccacctgagaaccggcctgtacaagagccagagaccctgcgtgacccacatcaagaccgagcccgtggccatcttcagccaccagagcgagaccaccgcccccccccccgcccccacccaggccctgcccgagttcaccagcatcttcagcagccaccagaccgccgcccccgaggtgaacaacatcttcatcaagcaggagctgcccacccccgacctgcacctgagcgtgcccacccagcagggccacctgtaccagctgctgaacacccccgacctggacatgcccagcagcaccaaccagaccgccgccatggacaccctgaacgtgagcatgagcgccgccatggccggcctgaacacccacaccagcgccgtgccccagaccgccgtgaagcagttccagggcatgcccccctgcacctacaccatgcccagccagttcctgccccagcaggccacctacttcccccccagcccccccagcagcgagcccggcagccccgacagacaggccgagatgctgcagaacctgacccccccccccagctacgccgccaccatcgccagcaagctggccatccacaaccccaacctgcccaccaccctgcccgtgaacagccagaacatccagcccgtgagatacaacagaagaagcaaccccgacctggagaagagaagaatccactactgcgactaccccggctgcaccaaggtgtacaccaagagcagccacctgaaggcccacctgagaacccacaccggcgagaagccctacaagtgcacctgggagggctgcgactggagattcgccagaagcgacgagctgaccagacactacagaaagcacaccggcgccaagcccttccagtgcggcgtgtgcaacagaagcttcagcagaagcgaccacctggccctgcacatgaagagacaccagaactag

SEQ ID NO: 8505 - DNA, 1101 bp, Artificial Sequence
  Description of Artificial Sequence: Synthetic coding sequence
atggagaagtacctgaccccccagctgccccccgtgcccatcatccccgagcacaagaagtacagaagagacagcgccagcgtggtggaccagttcttcaccgacaccgagggcctgccctacagcatcaacatgaacgtgttcctgcccgacatcacccacctgagaaccggcctgtacaagagccagagaccctgcgtgacccacatcaagaccgagcccgtggccatcttcagccaccagagcgagaccaccgcccccccccccgcccccacccaggccctgcccgagttcaccagcatcttcagcagccaccagaccgccgcccccgaggtgaacaacatcttcatcaagcaggagctgcccacccccgacctgcacctgagcgtgcccacccagcagggccacctgtaccagctgctgaacacccccgacctggacatgcccagcagcaccaaccagaccgccgccatggacaccctgaacgtgagcatgagcgccgccatggccggcctgaacacccacaccagcgccgtgccccagaccgccgtgaagcagttccagggcatgcccccctgcacctacaccatgcccagccagttcctgccccagcaggccacctacttcccccccagcccccccagcagcgagcccggcagccccgacagacaggccgagatgctgcagaacctgacccccccccccagctacgccgccaccatcgccagcaagctggccatccacaaccccaacctgcccaccaccctgcccgtgaacagccagaacatccagcccgtgagatacaacagaagaagcaaccccgacctggagaagagaagaatccactactgcgactaccccggctgcaccaaggtgtacaccaagagcagccacctgaaggcccacctgagaacccacaccggcgagaagccctacaagtgcacctgggagggctgcgactggagattcgccagaagcgacgagctgaccagacactacagaaagcacaccggcgccaagcccttccagtgcggcgtgtgcaacagaagcttcagcagaagcgaccacctggccctgcacatgaagagacaccagaactag

SEQ ID NO: 8506 - DNA, 1314 bp, Artificial Sequence
  Description of Artificial Sequence: Synthetic coding sequence
atggccaccagagtgctgagcatgagcgccagactgggccccgtgccccagccccccgccccccaggacgagcccgtgttcgcccagctgaagcccgtgctgggcgccgccaaccccgccagagacgccgccctgttccccggcgaggagctgaagcacgcccaccacagacccagactgccccccgaggacctggtgcagaccagatgcgagatggagaagtacctgaccccccagctgccccccgtgcccatcatccccgagcacaagaagtacagaagagacagcgccagcgtggtggaccagttcttcaccgacaccgagggcctgccctacagcatcaacatgaacgtgttcctgcccgacatcacccacctgagaaccggcctgtacaagagccagagaccctgcgtgacccacatcaagaccgagcccgtggccatcttcagccaccagagcgagaccaccgcccccccccccgcccccacccaggccctgcccgagttcaccagcatcttcagcagccaccagaccgccgcccccgaggtgaacaacatcttcatcaagcaggagctgcccacccccgacctgcacctgagcgtgcccacccagcagggccacctgtaccagctgctgaacacccccgacctggacatgcccagcagcaccaaccagaccgccgccatggacaccctgaacgtgagcatgagcgccgccatggccggcctgaacacccacaccagcgccgtgccccagaccgccgtgaagcagttccagggcatgcccccctgcacctacaccatgcccagccagttcctgccccagcaggccacctacttcccccccagcccccccagcagcgagcccggcagccccgacagacaggccgagatgctgcagaacctgacccccccccccagctacgccgccaccatcgccagcaagctggccatccacaaccccaacctgcccaccaccctgcccgtgaacagccagaacatccagcccgtgagatacaacagaagaagcaaccccgacctggagaagagaagaatccactactgcgactaccccggctgcaccaaggtgtacaccaagagcagccacctgaaggcccacctgagaacccacaccggcgagaagccctacaagtgcacctgggagggctgcgactggagattcgccagaagcgacgagctgaccagacactacagaaagcacaccggcgccaagcccttccagtgcggcgtgtgcaacagaagcttcagcagaagcgaccacctggccctgcacatgaagagacaccagaactag

SEQ ID NO: 8507 - DNA, 735 bp, Artificial Sequence
  Description of Artificial Sequence: Synthetic coding sequence
atgagcgccgccgcctacatggacttcgtggccgcccagtgcctggtgagcatcagcaacagagccgccgtgcccgagcacggcgtggcccccgacgccgagagactgagactgcccgagagagaggtgaccaaggagcacggcgaccccggcgacacctggaaggactactgcaccctggtgaccatcgccaagagcctgctggacctgaacaagtacagacccatccagacccccagcgtgtgcagcgacagcctggagagccccgacgaggacatgggcagcgacagcgacgtgaccaccgagagcggcagcagccccagccacagccccgaggagagacaggaccccggcagcgcccccagccccctgagcctgctgcaccccggcgtggccgccaagggcaagcacgccagcgagaagagacacaagtgcccctacagcggctgcggcaaggtgtacggcaagagcagccacctgaaggcccactacagagtgcacaccggcgagagacccttcccctgcacctggcccgactgcctgaagaagttcagcagaagcgacgagctgaccagacactacagaacccacaccggcgagaagcagttcagatgccccctgtgcgagaagagattcatgagaagcgaccacctgaccaagcacgccagaagacacaccgagttccaccccagcatgatcaagagaagcaagaaggccctggccaacgccctgtag

SEQ ID NO: 8508 - DNA, 2343 bp, Artificial Sequence
  Description of Artificial Sequence: Synthetic coding sequence
atgaccgagagcgccagcagcaccagcggccaggagttcgacgtgttcagcgtgatggactggaaggacggcgtgggcaccctgcccggcagcgacctgaagttcagagtgaacgagttcggcgccctggaggtgatcaccgacgagaacgagatggagaacgtgaagaaggccaccgccaccaccacctggatggtgcccaccgcccaggaggcccccaccagcccccccagcagcagacccgtgttcccccccgcctactggaccagcccccccggctgccccaccgtgttcagcgagaagaccggcatgcccttcagactgaaggaccccgtgaaggtggagggcctgcagttctgcgagaactgctgccagtacggcaacgtggacgagtgcctgagcggcggcaactactgcagccagaactgcgccagacacatcaaggacaaggaccagaaggaggagagagacgtggaggaggacaacgaggaggaggaccccaagtgcagcagaaagaagaagcccaagctgagcctgaaggccgacaccaaggaggacggcgaggagagagacgacgagatggagaacaagcaggacgtgagaatcctgagaggcagccagagagccagaagaaagagaagaggcgacagcgccgtgctgaagcagggcctgccccccaagggcaagaaggcctggtgctgggccagctacctggaggaggagaaggccgtggccgtgcccgccaagctgttcaaggagcaccagagcttcccctacaacaagaacggcttcaaggtgggcatgaagctggagggcgtggaccccgagcaccagagcgtgtactgcgtgctgaccgtggccgaggtgtgcggctacagaatcaagctgcacttcgacggctacagcgactgctacgacttctgggtgaacgccgacgccctggacatccaccccgtgggctggtgcgagaagaccggccacaagctgcacccccccaagggctacaaggaggaggagttcaactggcagacctacctgaagacctgcaaggcccaggccgcccccaagagcctgttcgagaaccagaacatcaccgtgatccccagcggcttcagagtgggcatgaagctggaggccgtggacaagaagaaccccagcttcatctgcgtggccaccgtgaccgacatggtggacaacagattcctggtgcacttcgacaactgggacgagagctacgactactggtgcgaggccagcagcccccacatccaccccgtgggctggtgcaaggagcacagaagaaccctgatcaccccccccggctaccccaacgtgaagcacttcagctgggacaagtacctggaggagaccaacagcctgcccgcccccgccagagccttcaaggtgaagcccccccacggcttccagaagaagatgaagctggaggtggtggacaagagaaaccccatgttcatcagagtggccaccgtggccgacaccgacgaccacagagtgaaggtgcacttcgacggctggaacaactgctacgactactggatcgacgccgacagccccgacatccaccccgtgggctggtgcagcaagaccggccaccccctgcagccccccctgagccccctggagctgatggaggccagcgagcacggcggctgcagcacccccggctgcaagggcatcggccacttcaagagagccagacacctgggcccccacagcgccgccaactgcccctacagcgagatcaacctgaacaaggacagaatcttccccgacagactgagcggcgagatgccccccgccagccccagcttccccagaaacaagagaaccgacgccaacgagagcagcagcagccccgagatcagagaccagcacgccgacgacgtgaaggaggacttcgaggagagaaccgagagcgagatgagaaccagccacgaggccagaggcgccagagaggagcccaccgtgcagcaggcccagagaagaagcgccgtgttcctgagcttcaagagccccatcccctgcctgcccctgagatgggagcagcagagcaagctgctgcccaccgtggccggcatccccgccagcaaggtgagcaagtggagcaccgacgaggtgagcgagttcatccagagcctgcccggctgcgaggagcacggcaaggtgttcaaggacgagcagatcgacggcgaggccttcctgctgatgacccagaccgacatcgtgaagatcatgagcatcaagctgggccccgccctgaagatcttcaacagcatcctgatgttcaaggccgccgagaagaacagccacaacgagctgtag

SEQ ID NO: 8509 - DNA, 2343 bp, Artificial Sequence; identical to SEQ ID NO: 8508
  Description of Artificial Sequence: Synthetic coding sequence

SEQ ID NO: 8510 - DNA, 2268 bp, Artificial Sequence
  Description of Artificial Sequence: Synthetic coding sequence
atgaccgagagcgccagcagcaccagcggccaggagttcgacgtgttcagcgtgatggactggaaggacggcgtgggcaccctgcccggcagcgacctgaagttcagagtgaacgagttcggcgccctggaggtgatcaccgacgagaacgagatggagaacgtgaagaaggccaccgccaccaccacctggatggtgcccaccgcccaggaggtgttcagcgagaagaccggcatgcccttcagactgaaggaccccgtgaaggtggagggcctgcagttctgcgagaactgctgccagtacggcaacgtggacgagtgcctgagcggcggcaactactgcagccagaactgcgccagacacatcaaggacaaggaccagaaggaggagagagacgtggaggaggacaacgaggaggaggaccccaagtgcagcagaaagaagaagcccaagctgagcctgaaggccgacaccaaggaggacggcgaggagagagacgacgagatggagaacaagcaggacgtgagaatcctgagaggcagccagagagccagaagaaagagaagaggcgacagcgccgtgctgaagcagggcctgccccccaagggcaagaaggcctggtgctgggccagctacctggaggaggagaaggccgtggccgtgcccgccaagctgttcaaggagcaccagagcttcccctacaacaagaacggcttcaaggtgggcatgaagctggagggcgtggaccccgagcaccagagcgtgtactgcgtgctgaccgtggccgaggtgtgcggctacagaatcaagctgcacttcgacggctacagcgactgctacgacttctgggtgaacgccgacgccctggacatccaccccgtgggctggtgcgagaagaccggccacaagctgcacccccccaagggctacaaggaggaggagttcaactggcagacctacctgaagacctgcaaggcccaggccgcccccaagagcctgttcgagaaccagaacatcaccgtgatccccagcggcttcagagtgggcatgaagctggaggccgtggacaagaagaaccccagcttcatctgcgtggccaccgtgaccgacatggtggacaacagattcctggtgcacttcgacaactgggacgagagctacgactactggtgcgaggccagcagcccccacatccaccccgtgggctggtgcaaggagcacagaagaaccctgatcaccccccccggctaccccaacgtgaagcacttcagctgggacaagtacctggaggagaccaacagcctgcccgcccccgccagagccttcaaggtgaagcccccccacggcttccagaagaagatgaagctggaggtggtggacaagagaaaccccatgttcatcagagtggccaccgtggccgacaccgacgaccacagagtgaaggtgcacttcgacggctggaacaactgctacgactactggatcgacgccgacagccccgacatccaccccgtgggctggtgcagcaagaccggccaccccctgcagccccccctgagccccctggagctgatggaggccagcgagcacggcggctgcagcacccccggctgcaagggcatcggccacttcaagagagccagacacctgggcccccacagcgccgccaactgcccctacagcgagatcaacctgaacaaggacagaatcttccccgacagactgagcggcgagatgccccccgccagccccagcttccccagaaacaagagaaccgacgccaacgagagcagcagcagccccgagatcagagaccagcacgccgacgacgtgaaggaggacttcgaggagagaaccgagagcgagatgagaaccagccacgaggccagaggcgccagagaggagcccaccgtgcagcaggcccagagaagaagcgccgtgttcctgagcttcaagagccccatcccctgcctgcccctgagatgggagcagcagagcaagctgctgcccaccgtggccggcatccccgccagcaaggtgagcaagtggagcaccgacgaggtgagcgagttcatccagagcctgcccggctgcgaggagcacggcaaggtgttcaaggacgagcagatcgacggcgaggccttcctgctgatgacccagaccgacatcgtgaagatcatgagcatcaagctgggccccgccctgaagatcttcaacagcatcctgatgttcaaggccgccgagaagaacagccacaacgagctgtag

SEQ ID NO: 8511 - DNA, 2268 bp, Artificial Sequence; identical to SEQ ID NO: 8510
  Description of Artificial Sequence: Synthetic coding sequence

SEQ ID NO: 8512 - DNA, 573 bp, Artificial Sequence
  Description of Artificial Sequence: Synthetic coding sequence
atgaccgagagcgccagcagcaccagcggccaggagttcgacgtgttcagcgtgatggactggaaggacggcgtgggcaccctgcccggcagcgacctgaagttcagagtgaacgagttcggcgccctggaggtgatcaccgacgagaacgagatggagaacgtgaagaaggccaccgccaccaccacctggatggtgcccaccgcccaggaggcccccaccagcccccccagcagcagacccgtgttcccccccgcctactggaccagcccccccggctgccccaccgtgttcagcgagaagaccggcatgcccttcagactgaaggaccccgtgaaggtggagggcctgcagttctgcgagaactgctgccagtacggcaacgtggacgagtgcctgagcggcggcaactactgcagccagaactgcgccagacacatcaaggacaaggaccagaaggaggagagagacgtggaggaggacaacgaggaggaggaccccaagtgcagcagaaagaagaagcccaagctgagcctgaaggccgacaccaaggaggacggcgaggagagatag

SEQ ID NO: 8513 - DNA, 2343 bp, Artificial Sequence; identical to SEQ ID NO: 8508
  Description of Artificial Sequence: Synthetic coding sequence

SEQ ID NO: 8514 - DNA, 2268 bp, Artificial Sequence; identical to SEQ ID NO: 8510
  Description of Artificial Sequence: Synthetic coding sequence

SEQ ID NO: 8515 - DNA, 1872 bp, Artificial Sequence
  Description of Artificial Sequence: Synthetic coding sequence
atgaagcagcccaacagaaagagaaagctgaacatggacagcaaggagagactggaccaggacggcagactggagcaggccgaggaggagaagaagcccaaggacagcaccacccccctgagccacgtgcccagcgccgccgcccagggcgcctggagctgggagtggtacctgaaggagcagaaggccgtggccgcccccgtggagctgttcagcaaggaccagagcttccccgagcacgagaacggcttccagatcggcatgagactggagggcatcgaccccagacaccccagcgtgttctgcgtgctgagcgtggccgaggtgtgcggctacagactgagactgcacttcgacggctacctgagctgctacgacttctggaccaacgccggcagccccgacatccaccccgtgggctggtgcgagaagaccaagcacgagctgcacatccccaagggctacagaaaggacaagttcgtgtggatggactacctgaaggcctgcaagctgcagaacgcccccaagaagctgttcagaaacagaagccccaacggccccatgagcaaggagttccaggtgggcatgaagctggaggccgtggacagaaagaaccccagcctggtgtgcgtggccaccatcgccgacatcgtggaggacagactgctggtgcacttcgacaactgggacgacagctacgactactggtgcgacgtgaacagcccctacgtgcagcccgtgggctggtgccaggagaacggcagaaccctgatcgccccccagggctaccccaaccccgagaacttcagctggaccgagtacctggaggccacccagaccaacgccgtgcccgccaaggtgttcaagatgagactgccccacggcttcctgcccaacatgaagctggaggtggtggacaagagaaaccccagactgatcagagtggccaccatcgtggacgtggacgaccagagagtgaaggtgcacttcgacggctgggaccacaagtacgactactgggtggaggccgacagccccgacatccaccccatcggctggtgcgacgtgaccggccaccccctggaggtgccccagagaaccaacgacctgaagatcctgcccggccaggccgtgtgccccacccccggctgcagaggcatcggccacatcagaggccccagatacagcggccaccacagcgccttcggctgcccctacagcgacatgaacctgaagaaggaggccaccctgcacgacagactgagagagcagacccaggccaacctggagagcgacagcagccacagcaagagcaagagcctgtgcagcctgaacttcaacggcaagcacgagaaggtgaacagccagcccagactggtgcagcaggccaagtgcctgaagatcaagggcaaggaggacatcgacctggacaacctgttcagagtgctggtgctgcaccccagaggcctggagtacagcgtggagcaggcccagcaggtgctgcaccagagcgtgagcatgagcaccgtgagcgcccaccccttcagagacctgcccctgggcagagagcagcactgcaagctgctgcccggcgtggccgacatcagagccagccaggtggccagatggaccgtggacgaggtggccgagttcgtgcagagcctgctgggctgcgaggagcacgccaagtgcttcaagaaggagcagatcgacggcaaggccttcctgctgctgacccagaccgacatcgtgaaggtgatgaagatcaagctgggccccgccctgaagatctacaacagcatcctgatgttcagacacagccaggagctgcccgaggaggacatcgccagcggccaggaggtgagaggctag

SEQ ID NO: 8516 - DNA, 1872 bp, Artificial Sequence; identical to SEQ ID NO: 8515
  Description of Artificial Sequence: Synthetic coding sequence

SEQ ID NO: 8517 - DNA, 1284 bp, Artificial Sequence
  Description of Artificial Sequence: Synthetic coding sequence
atgagcaaggagttccaggtgggcatgaagctggaggccgtggacagaaagaaccccagcctggtgtgcgtggccaccatcgccgacatcgtggaggacagactgctggtgcacttcgacaactgggacgacagctacgactactggtgcgacgtgaacagcccctacgtgcagcccgtgggctggtgccaggagaacggcagaaccctgatcgccccccagggctaccccaaccccgagaacttcagctggaccgagtacctggaggccacccagaccaacgccgtgcccgccaaggtgttcaagatgagactgccccacggcttcctgcccaacatgaagctggaggtggtggacaagagaaaccccagactgatcagagtggccaccatcgtggacgtggacgaccagagagtgaaggtgcacttcgacggctgggaccacaagtacgactactgggtggaggccgacagccccgacatccaccccatcggctggtgcgacgtgaccggccaccccctggaggtgccccagagaaccaacgacctgaagatcctgcccggccaggccgtgtgccccacccccggctgcagaggcatcggccacatcagaggccccagatacagcggccaccacagcgccttcggctgcccctacagcgacatgaacctgaagaaggaggccaccctgcacgacagactgagagagcagacccaggccaacctggagagcgacagcagccacagcaagagcaagagcctgtgcagcctgaacttcaacggcaagcacgagaaggtgaacagccagcccagactggtgcagcaggccaagtgcctgaagatcaagggcaaggaggacatcgacctggacaacctgttcagagagtacagcgtggagcaggcccagcaggtgctgcaccagagcgtgagcatgagcaccgtgagcgcccaccccttcagagacctgcccctgggcagagagcagcactgcaagctgctgcccggcgtggccgacatcagagccagccaggtggccagatggaccgtggacgaggtggccgagttcgtgcagagcctgctgggctgcgaggagcacgccaagtgcttcaagaaggagcagatcgacggcaaggccttcctgctgctgacccagaccgacatcgtgaaggtgatgaagatcaagctgggccccgccctgaagatctacaacagcatcctgatgttcagacacagccaggagctgcccgaggaggacatcgccagcggccaggaggtgagaggctag

SEQ ID NO: 8518 - DNA, 876 bp, Artificial Sequence
  Description of Artificial Sequence: Synthetic coding sequence
atgagctgggagagcggcgccggccccggcctgggcagccagggcatggacctggtgtggagcgcctggtacggcaagtgcgtgaagggcaagggcagcctgcccctgagcgcccacggcatcgtggtggcctggctgagcagagccgagtgggaccaggtgaccgtgtacctgttctgcgacgaccacaagctgcagagatacgccctgaacagaatcaccgtgtggagaagcagaagcggcaacgagctgcccctggccgtggccagcaccgccgacctgatcagatgcaagctgctggacgtgaccggcggcctgggcaccgacgagctgagactgctgtacggcatggccctggtgagattcgtgaacctgatcagcgagagaaagaccaagttcgccaaggtgcccctgaagtgcctggcccaggaggtgaacatccccgactggatcgtggacctgagacacgagctgacccacaagaagatgccccacatcaacgactgcagaagaggctgctacttcgtgctggactggctgcagaagacctactggtgcagacagctggagaacagcctgagagagacctgggagctggaggagttcagagagggcatcgaggaggaggaccaggaggaggacaagaacatcgtggtggacgacatcaccgagcagaagcccgagccccaggacgacggcaagagcaccgagagcgacgtgaaggccgacggcgacagcaagggcagcgaggaggtggacagccactgcaagaaggccctgagccacaaggagctgtacgagagagccagagagctgctggtgagctacgaggaggagcagttcaccggcggctgcgccggctgcttcagcggctag

SEQ ID NO: 8519 - DNA, 2028 bp, Artificial Sequence
  Description of Artificial Sequence: Synthetic coding sequence
atgagctgggagagcggcgccggccccggcctgggcagccagggcatggacctggtgtggagcgcctggtacggcaagtgcgtgaagggcaagggcagcctgcccctgagcgcccacggcatcgtggtggcctggctgagcagagccgagtgggaccaggtgaccgtgtacctgttctgcgacgaccacaagctgcagagatacgccctgaacagaatcaccgtgtggagaagcagattcgtgaacctgatcagcgagagaaagaccaagttcgccaaggtgcccctgaagtgcctggcccaggaggtgaacatccccgactggatcgtggacctgagacacgagctgacccacaagaagatgccccacatcaacgactgcagaagaggctgctacttcgtgctggactggctgcagaagacctactggtgcagacagctggagaacagcctgagagagacctgggagctggaggagttcagagagggcatcgaggaggaggaccaggaggaggacaagaacatcgtggtggacgacatcaccgagcagaagcccgagccccaggacgacggcaagagcaccgagagcgacgtgaaggccgacggcgacagcaagggcagcgaggaggtggacagccactgcaagaaggccctgagccacaaggagctgtacgagagagccagagagctgctggtgagctacgaggaggagcagttcaccgtgctggagaagttcagatacctgcccaaggccatcaaggcctggaacaaccccagccccagagtggagtgcgtgctggccgagctgaagggcgtgacctgcgagaacagagaggccgtgctggacgccttcctggacgacggcttcctggtgcccaccttcgagcagctggccgccctgcagatcgagtacgaggagaacgtggacctgaacgacgtgctggtgcccaagcccttcagccagttctggcagcccctgctgagaggcctgcacagccagaacttcacccaggccctgctggagagaatgctgagcgagctgcccgccctgggcatcagcggcatcagacccacctacatcctgagatggaccgtggagctgatcgtggccaacaccaagaccggcagaaacgccagaagattcagcgccggccagtgggaggccagaagaggctggagactgttcaactgcagcgccagcctggactggcccagaatggtggagagctgcctgggcagcccctgctgggccagcccccagctgctgagaatcatcttcaaggccatgggccagggcctgcccgacgaggagcaggagaagctgctgagaatctgcagcatctacacccagagcggcgagaacagcctggtgcaggagggcagcgaggccagccccatcggcaagagcccctacaccctggacagcctgtactggagcgtgaagcccgccagcagcagcttcggcagcgaggccaaggcccagcagcaggaggagcagggcagcgtgaacgacgtgaaggaggaggagaaggaggagaaggaggtgctgcccgaccaggtggaggaggaggaggagaacgacgaccaggaggaggaggaggaggacgaggacgacgaggacgacgaggaggaggacagaatggaggtgggccccttcagcaccggccaggagagccccaccgccgagaacgccagactgctggcccagaagagaggcgccctgcagggcagcgcctggcaggtgagcagcgaggacgtgagatgggacaccttccccctgggcagaatgcccggccagaccgaggaccccgccgagctgatgctggagaactacgacaccatgtacctgctggaccagcccgtgctggagcagagactggagcccagcacctgcaagaccgacaccctgggcctgagctgcggcgtgggcagcggcaactgcagcaacagcagcagcagcaacttcgagggcctgctgtggagccagggccagctgcacggcctgaagaccggcctgcagctgttctag

SEQ ID NO: 8520 - DNA, 2154 bp, Artificial Sequence
  Description of Artificial Sequence: Synthetic coding sequence
atgagctgggagagcggcgccggccccggcctgggcagccagggcatggacctggtgtggagcgcctggtacggcaagtgcgtgaagggcaagggcagcctgcccctgagcgcccacggcatcgtggtggcctggctgagcagagccgagtgggaccaggtgaccgtgtacctgttctgcgacgaccacaagctgcagagatacgccctgaacagaatcaccgtgtggagaagcagaagcggcaacgagctgcccctggccgtggccagcaccgccgacctgatcagatgcaagctgctggacgtgaccggcggcctgggcaccgacgagctgagactgctgtacggcatggccctggtgagattcgtgaacctgatcagcgagagaaagaccaagttcgccaaggtgcccctgaagtgcctggcccaggaggtgaacatccccgactggatcgtggacctgagacacgagctgacccacaagaagatgccccacatcaacgactgcagaagaggctgctacttcgtgctggactggctgcagaagacctactggtgcagacagctggagaacagcctgagagagacctgggagctggaggagttcagagagggcatcgaggaggaggaccaggaggaggacaagaacatcgtggtggacgacatcaccgagcagaagcccgagccccaggacgacggcaagagcaccgagagcgacgtgaaggccgacggcgacagcaagggcagcgaggaggtggacagccactgcaagaaggccctgagccacaaggagctgtacgagagagccagagagctgctggtgagctacgaggaggagcagttcaccgtgctggagaagttcagatacctgcccaaggccatcaaggcctggaacaaccccagccccagagtggagtgcgtgctggccgagctgaagggcgtgacctgcgagaacagagaggccgtgctggacgccttcctggacgacggcttcctggtgcccaccttcgagcagctggccgccctgcagatcgagtacgaggagaacgtggacctgaacgacgtgctggtgcccaagcccttcagccagttctggcagcccctgctgagaggcctgcacagccagaacttcacccaggccctgctggagagaatgctgagcgagctgcccgccctgggcatcagcggcatcagacccacctacatcctgagatggaccgtggagctgatcgtggccaacaccaagaccggcagaaacgccagaagattcagcgccggccagtgggaggccagaagaggctggagactgttcaactgcagcgccagcctggactggcccagaatggtggagagctgcctgggcagcccctgctgggccagcccccagctgctgagaatcatcttcaaggccatgggccagggcctgcccgacgaggagcaggagaagctgctgagaatctgcagcatctacacccagagcggcgagaacagcctggtgcaggagggcagcgaggccagccccatcggcaagagcccctacaccctggacagcctgtactggagcgtgaagcccgccagcagcagcttcggcagcgaggccaaggcccagcagcaggaggagcagggcagcgtgaacgacgtgaaggaggaggagaaggaggagaaggaggtgctgcccgaccaggtggaggaggaggaggagaacgacgaccaggaggaggaggaggaggacgaggacgacgaggacgacgaggaggaggacagaatggaggtgggccccttcagcaccggccaggagagccccaccgccgagaacgccagactgctggcccagaagagaggcgccctgcagggcagcgcctggcaggtgagcagcgaggacgtgagatgggacaccttccccctgggcagaatgcccggccagaccgaggaccccgccgagctgatgctggagaactacgacaccatgtacctgctggaccagcccgtgctggagcagagactggagcccagcacctgcaagaccgacaccctgggcctgagctgcggcgtgggcagcggcaactgcagcaacagcagcagcagcaacttcgagggcctgctgtggagccagggccagctgcacggcctgaagaccggcctgcagctgttctag

SEQ ID NO: 8521 - DNA, 2205 bp, Artificial Sequence
  Description of Artificial Sequence: Synthetic coding sequence
atgagctgggagagcggcgccggccccggcctgggcagccagggcatggacctggtgtggagcgcctggtacggcaagtgcgtgaagggcaagggcagcctgcccctgagcgcccacggcatcgtggtggcctggctgagcagagccgagtgggaccaggtgaccgtgtacctgttctgcgacgaccacaagctgcagagatacgccctgaacagaatcaccgtgtggagaagcagaagcggcaacgagctgcccctggccgtggccagcaccgccgacctgatcagatgcaagctgctggacgtgaccggcggcctgggcaccgacgagctgagactgctgtacggcatggccctggtgagattcgtgaacctgatcagcgagagaaagaccaagttcgccaaggtgcccctgaagtgcctggcccaggaggtgaacatccccgactggatcgtggacctgagacacgagctgacccacaagaagatgccccacatcaacgactgcagaagaggctgctacttcgtgctggactggctgcagaagacctactggtgcagacagctggagaacagcctgagagagacctgggagctggaggagttcagagagggcatcgaggaggaggaccaggaggaggacaagaacatcgtggtggacgacatcaccgagcagaagcccgagccccaggacgacggcaagagcaccgagagcgacgtgaaggccgacggcgacagcaagggcagcgaggaggtggacagccactgcaagaaggccctgagccacaaggagctgtacgagagagccagagagctgctggtgagctacgaggaggagcagttcaccgtgctggagaagttcagatacctgcccaaggccatcaaggcctggaacaaccccagccccagagtggagtgcgtgctggccgagctgaagggcgtgacctgcgagaacagagaggccgtgctggacgccttcctggacgacggcttcctggtgcccaccttcgagcagctggccgccctgcagatcgagtacgaggacggccagaccgaggtgcagagaggcgagggcaccgaccccaagagccacaagaacgtggacctgaacgacgtgctggtgcccaagcccttcagccagttctggcagcccctgctgagaggcctgcacagccagaacttcacccaggccctgctggagagaatgctgagcgagctgcccgccctgggcatcagcggcatcagacccacctacatcctgagatggaccgtggagctgatcgtggccaacaccaagaccggcagaaacgccagaagattcagcgccggccagtgggaggccagaagaggctggagactgttcaactgcagcgccagcctggactggcccagaatggtggagagctgcctgggcagcccctgctgggccagcccccagctgctgagaatcatcttcaaggccatgggccagggcctgcccgacgaggagcaggagaagctgctgagaatctgcagcatctacacccagagcggcgagaacagcctggtgcaggagggcagcgaggccagccccatcggcaagagcccctacaccctggacagcctgtactggagcgtgaagcccgccagcagcagcttcggcagcgaggccaaggcccagcagcaggaggagcagggcagcgtgaacgacgtgaaggaggaggagaaggaggagaaggaggtgctgcccgaccaggtggaggaggaggaggagaacgacgaccaggaggaggaggaggaggacgaggacgacgaggacgacgaggaggaggacagaatggaggtgggccccttcagcaccggccaggagagccccaccgccgagaacgccagactgctggcccagaagagaggcgccctgcagggcagcgcctggcaggtgagcagcgaggacgtgagatgggacaccttccccctgggcagaatgcccggccagaccgaggaccccgccgagctgatgctggagaactacgacaccatgtacctgctggaccagcccgtgctggagcagagactggagcccagcacctgcaagaccgacaccctgggcctgagctgcggcgtgggcagcggcaactgcagcaacagcagcagcagcaacttcgagggcctgctgtggagccagggccagctgcacggcctgaagaccggcctgcagctgttctag

SEQ ID NO: 8522 - DNA, 507 bp, Artificial Sequence
  Description of Artificial Sequence: Synthetic coding sequence
atgagcctgacccacagactgcacctgtgcaagtactggggctgcgccgtgagcaacgtgtgcagattctgggagggcagacccctgcccctgatgatcgtggtgccctacaccctgcccgtgagcctgcccgtgggcagctgcgtgatcatcaccggcacccccatcctgaccttcgtgaaggacccccagctggaggtgaacttctacaccggcatggacgaggacagcgacatcgccttccagttcagactgcacttcggccaccccgccatcatgaacagctgcgtgttcggcatctggagatacgaggagaagtgctactacctgcccttcgaggacggcaagcccttcgagctgtgcatctacgtgagacacaaggagtacaaggtgatggtgaacggccagagaatctacaacttcgcccacagattcccccccgccagcgtgaagatgctgcaggtgttcagagacatcagcctgaccagagtgctgatcagcgactag

SEQ ID NO: 8523 - DNA, 420 bp, Artificial Sequence
  Description of Artificial Sequence: Synthetic coding sequence
atgagcagcctgcccgtgccctacaccctgcccgtgagcctgcccgtgggcagctgcgtgatcatcaccggcacccccatcctgaccttcgtgaaggacccccagctggaggtgaacttctacaccggcatggacgaggacagcgacatcgccttccagttcagactgcacttcggccaccccgccatcatgaacagctgcgtgttcggcatctggagatacgaggagaagtgctactacctgcccttcgaggacggcaagcccttcgagctgtgcatctacgtgagacacaaggagtacaaggtgatggtgaacggccagagaatctacaacttcgcccacagattcccccccgccagcgtgaagatgctgcaggtgttcagagacatcagcctgaccagagtgctgatcagcgactag

SEQ ID NO: 8524 - DNA, 1314 bp, Artificial Sequence
  Description of Artificial Sequence: Synthetic coding sequence
atggccagagtggcctggggcctgctgtggctgctgctgggcagcgccggcgcccagtacgagaagtacagcttcagaggcttcccccccgaggacctgatgcccctggccgccgcctacggccacgccctggagcagtacgagggcgagagctggagagagagcgccagatacctggaggccgccctgagactgcacagactgctgagagacagcgaggccttctgccacgccaactgcagcggccccgcccccgccgccaagcccgaccccgacggcggcagagccgacgagtgggcctgcgagctgagactgttcggcagagtgctggagagagccgcctgcctgagaagatgcaagagaaccctgcccgccttccaggtgccctacccccccagacagctgctgagagacttccagagcagactgccctaccagtacctgcactacgccctgttcaaggccaacagactggagaaggccgtggccgccgcctacaccttcctgcagagaaaccccaagcacgagctgaccgccaagtacctgaactactaccagggcatgctggacgtggccgacgagagcctgaccgacctggaggcccagccctacgaggccgtgttcctgagagccgtgaagctgtacaacagcggcgacttcagaagcagcaccgaggacatggagagagccctgagcgagtacctggccgtgttcgccagatgcctggccggctgcgagggcgcccacgagcaggtggacttcaaggacttctaccccgccatcgccgacctgttcgccgagagcctgcagtgcaaggtggactgcgaggccaacctgacccccaacgtgggcggctacttcgtggacaagttcgtggccaccatgtaccactacctgcagttcgcctactacaagctgaacgacgtgagacaggccgccagaagcgccgccagctacatgctgttcgaccccaaggacagcgtgatgcagcagaacctggtgtactacagattccacagagccagatggggcctggaggaggaggacttccagcccagagaggaggccatgctgtaccacaaccagaccgccgagctgagagagctgctggagttcacccacatgtacctgcagagcgacgacgagatggagctggaggagaccgagccccccctggagcccgaggacgccctgagcgacgccgagttcgagggcgagggcgactacgaggagggcatgtacgccgactggtggcaggagcccgacgccaagggcgacgaggccgaggccgagcccgagcccgagctggcctag

SEQ ID NO: 8525 - DNA, 1314 bp, Artificial Sequence; identical to SEQ ID NO: 8524
  Description of Artificial Sequence: Synthetic coding sequence

SEQ ID NO: 8526 - DNA, 1281 bp, Artificial Sequence
  Description of Artificial Sequence: Synthetic coding sequence
atggccagagtggcctggggcctgctgtggctgctgctgggcagcgccggcgcccagtacgagaagtacagcttcagaggcttcccccccgaggacctgatgcccctggccgccgcctacggccacgccctggagcagtacgagggcgagagctggagagagagcgccagatacctggaggccgccctgagactgcacagactgctgagagacagcgaggccttctgccacgccaactgcagcggccccgcccccgccgccaagcccgaccccgacggcggcagagccgacgagtgggcctgcgagctgagactgttcggcagagtgctggagagagccgccttccaggtgccctacccccccagacagctgctgagagacttccagagcagactgccctaccagtacctgcactacgccctgttcaaggccaacagactggagaaggccgtggccgccgcctacaccttcctgcagagaaaccccaagcacgagctgaccgccaagtacctgaactactaccagggcatgctggacgtggccgacgagagcctgaccgacctggaggcccagccctacgaggccgtgttcctgagagccgtgaagctgtacaacagcggcgacttcagaagcagcaccgaggacatggagagagccctgagcgagtacctggccgtgttcgccagatgcctggccggctgcgagggcgcccacgagcaggtggacttcaaggacttctaccccgccatcgccgacctgttcgccgagagcctgcagtgcaaggtggactgcgaggccaacctgacccccaacgtgggcggctacttcgtggacaagttcgtggccaccatgtaccactacctgcagttcgcctactacaagctgaacgacgtgagacaggccgccagaagcgccgccagctacatgctgttcgaccccaaggacagcgtgatgcagcagaacctggtgtactacagattccacagagccagatggggcctggaggaggaggacttccagcccagagaggaggccatgctgtaccacaaccagaccgccgagctgagagagctgctggagttcacccacatgtacctgcagagcgacgacgagatggagctggaggagaccgagccccccctggagcccgaggacgccctgagcgacgccgagttcgagggcgagggcgactacgaggagggcatgtacgccgactggtggcaggagcccgacgccaagggcgacgaggccgaggccgagcccgagcccgagctggcctag

SEQ ID NO: 8527 - DNA, 942 bp, Artificial Sequence
  Description of Artificial Sequence: Synthetic coding sequence
atggccagcttcagaaagctgaccctgagcgagaaggtgccccccaaccaccccagcagaaagaaggtgaacttcctggacatgagcctggacgacatcatcatctacaaggagctggagggcaccaacgccgaggaggagaagaacaagagacagaaccacagcaagaaggagagccccagcagacagcagagcaaggcccacagacacagacacagaagaggctacagcagatgcagaagcaacagcgaggagggcaaccacgacaagaagcccagccagaagcccagcggcttcaagagcggccagcaccccctgaacggccagcccctgatcgagcaggagaagtgcagcgacaactacgaggcccaggccgagaagaaccagggccagagcgagggcaaccagcaccagagcgagggcaaccccgacaagagcgaggagagccagggccagcccgaggagaaccaccacagcgagagaagcagaaaccacctggagagaagcctgagccagagcgacagaagccagggccagctgaagagacaccacccccagtacgagagaagccacggccagtacaagagaagccacggccagagcgagagaagccacggccacagcgagagaagccacggccacagcgagagaagccacggccacagcgagagaagccacggccacagcaagagaagcagaagccagggcgacctggtggacacccagagcgacctgatcgccacccagagagacctgatcgccacccagaaggacctgatcgccacccagagagacctgatcgccacccagagagacctgatcgtgacccagagagacctggtggccaccgagagagacctgatcaaccagagcggcagaagccacggccagagcgagagacaccagagatacagcaccggcaagaacaccatcaccacctag

SEQ ID NO: 8528 - DNA, 237 bp, Artificial Sequence
  Description of Artificial Sequence: Synthetic coding sequence
atggccagcttcagaaagctgaccctgagcgagaaggtgccccccaaccaccccagcagaaagaaggtgaacttcctggacatgagcctggacgacatcatcatctacaaggagctggagggcaccaacgccgaggaggagaagaacaagagacagaaccacagcaagaaggagagccccagcagacagcagagcaaggcccacagacacagacacagaagaggcgaggtgcagtag

SEQ ID NO: 8529 - DNA, 696 bp, Artificial Sequence
  Description of Artificial Sequence: Synthetic coding sequence
atgctgaagaagaagagaatcaaggacagaaccatcgtgaagagaaacagactgcaggacagcaaccagaagctgatcgacatcgccatcggcgaggagaagtgcagcgacaactacgaggcccaggccgagaagaaccagggccagagcgagggcaaccagcaccagagcgagggcaaccccgacaagagcgaggagagccagggccagcccgaggagaaccaccacagcgagagaagcagaaaccacctggagagaagcctgagccagagcgacagaagccagggccagctgaagagacaccacccccagtacgagagaagccacggccagtacaagagaagccacggccagagcgagagaagccacggccacagcgagagaagccacggccacagcgagagaagccacggccacagcgagagaagccacggccacagcaagagaagcagaagccagggcgacctggtggacacccagagcgacctgatcgccacccagagagacctgatcgccacccagaaggacctgatcgccacccagagagacctgatcgccacccagagagacctgatcgtgacccagagagacctggtggccaccgagagagacctgatcaaccagagcggcagaagccacggccagagcgagagacaccagagatacagcaccggcaagaacaccatcaccacctag

SEQ ID NO: 8530 - DNA, 1944 bp, Artificial Sequence
  Description of Artificial Sequence: Synthetic coding sequence
atgggccccctgagcgccagactgctgatgcagagaggcagacccaagagcgacagactgggcaagatcagaagcctggacctgagcggcctggagctgctgagcgagcacctggaccccaagctgctgtgcagactgacccagctgcaggagctggacctgagcaacaaccacctggagaccctgcccgacaacctgggcctgagccacctgagagtgctgagatgcgccaacaaccagctgggcgacgtgaccgccctgtgccagttccccaagctggaggagctgagcctggagggcaaccccttcctgaccgtgaacgacaacctgaaggtgagcttcctgctgcccaccctgagaaaggtgaacggcaaggacgccagcagcacctacagccaggtggagaacctgaacagagagctgaccagcagagtgaccgcccactgggagaagttcatggccaccctgggccccgaggaggaggccgagaaggcccaggccgacttcgtgaagagcgccgtgagagacgtgagatacggccccgagagcctgagcgagttcacccagtggagagtgagaatgatcagcgaggagctggtggccgccagcagaacccaggtgcagaaggccaacagccccgagaagccccccgaggccggcgccgcccacaagcccagagccagactggccgccctgaagagacccgacgacgtgcccctgagcctgagccccagcaagagagcctgcgccagccccagcgcccaggtggagggcagccccgtggccggcagcgacggcagccagcccgccgtgaagctggagcccctgcacttcctgcagtgccacagcaagaacaacagcccccaggacctggagacccagctgtgggcctgcgccttcgagcccgcctgggaggagggcgccaccagccagaccgtggccacctgcggcggcgaggccgtgtgcgtgatcgactgccagaccggcatcgtgctgcacaagtacaaggcccccggcgaggagttcttcagcgtggcctggaccgccctgatggtggtgacccaggccggccacaagaagagatggagcgtgctggccgccgccggcctgagaggcctggtgagactgctgcacgtgagagccggcttctgctgcggcgtgatcagagcccacaagaaggccatcgccaccctgtgcttcagccccgcccacgagacccacctgttcaccgccagctacgacaagagaatcatcctgtgggacatcggcgtgcccaaccaggactacgagttccaggccagccagctgctgaccctggacaccaccagcatccccctgagactgtgccccgtggccagctgccccgacgccagactgctggccggctgcgagggcggctgctgctgctgggacgtgagactggaccagccccagaagagaagagtgtgcgaggtggagttcgtgttcagcgagggcagcgaggccagcggcagaagagtggacggcctggccttcgtgaacgaggacatcgtggccagcaagggcagcggcctgggcaccatctgcctgtggagctggagacagacctggggcggcagaggcagccagagcaccgtggccgtggtggtgctggccagactgcagtggagcagcaccgagctggcctacttcagcctgagcgcctgccccgacaagggcatcgtgctgtgcggcgacgaggagggcaacgtgtggctgtacgacgtgagcaacatcctgaagcagccccccctgctgcccgccgccctgcaggcccccacccagatcctgaagtggccccagccctgggccctgggccaggtggtgaccaagaccatggtgaacaccgtggtggccaacgccagcttcacctacctgaccgccctgaccgacagcaacatcgtggccatctggggcagaatgtag

SEQ ID NO: 8531 - DNA, 2310 bp, Artificial Sequence
  Description of Artificial Sequence: Synthetic coding sequence
atgagcaacaacctgagaagagtgttcctgaagcccgccgaggagaacagcggcaacgccagcagatgcgtgagcggctgcatgtaccaggtggtgcagaccatcggcagcgacggcaagaacctgctgcagctgctgcccatccccaagagcagcggcaacctgatccccctggtgcagagcagcgtgatgagcgacgccctgaagggcaacaccggcaagcccgtgcaggtgaccttccagacccagatcagcagcagcagcaccagcgccagcgtgcagctgcccatcttccagcccgccagcagcagcaactacttcctgaccagaaccgtggacaccagcgagaagggcagagtgaccagcgtgggcaccggcaacttcagcagcagcgtgagcaaggtgcagagccacggcgtgaagatcgacggcctgaccatgcagaccttcgccgtgccccccagcacccagaaggacagcagcttcatcgtggtgaacacccagagcctgcccgtgaccgtgaagagccccgtgctgcccagcggccaccacctgcagatccccgcccacgccgaggtgaagagcgtgcccgccagcagcctgccccccagcgtgcagcagaagatcctggccaccgccaccaccagcaccagcggcatggtggaggccagccagatgcccaccgtgatctacgtgagccccgtgaacaccgtgaagaacgtggtgaccaagaacttccagaacatctaccccaagcccgtgaccgagatcgccaagcccgtgatcctgaacaccacccagatccccaagaacgtggccaccgagacccagctgaagggcggccagcacagccaggccgcccccgtgaagtggatcttccaggacaacctgcagcccttcacccccagcctggtgcccgtgaagagcagcaacaacgtggccagcaagatcctgaagaccttcgtggacagaaagaacctgggcgacaacaccatcaacatgccccccctgagcaccatcgaccccagcggcaccagaagcaagaacatgcccatcaaggacaacgccctggtgatgttcaacggcaaggtgtacctgctggccaagaagggcaccgacgtgctgcccagccagatcgaccagcagaacagcgtgagccccgacacccccgtgagaaaggacaccctgcagaccgtgagcagcagccccgtgaccgagatcagcagagaggtggtgaacatcgtgctggccaagagcaagagcagccagatggagaccaagagcctgagcaacacccagctggccagcatggccaacctgagagccgagaagaacaaggtggagaagcccagccccagcaccaccaacccccacatgaaccagagcagcaactacctgaagcagagcaagaccctgttcaccaaccccatcttccccgtgggcttcagcaccggccacaacgcccccagaaaggtgaccgccgtgatctacgccagaaagggcagcgtgctgcagagcatcgagaagatcagcagcagcgtggacgccaccaccgtgaccagccagcagtgcgtgttcagagaccaggagcccaagatccacaacgagatggccagcaccagcgacaagggcgcccagggcagaaacgacaagaaggacagccagggcagaagcaacaaggccctgcacctgaagagcgacgccgagttcaagaagatcttcggcctgaccaaggacctgagagtgtgcctgaccagaatccccgaccacctgaccagcggcgagggcttcgacagcttcagcagcctggtgaagagcggcacctacaaggagaccgagttcatggtgaaggagggcgagagaaagcagcagaacttcgacaagaagagaaaggccaagaccaacaagaagatggaccacatcaagaagagaaagaccgagaacgcctacaacgccatcatcaacggcgaggccaacgtgaccggcagccagctgctgagcagcatcctgcccaccagcgacgtgagccagcacaacatcctgaccagccacagcaagaccagacaggagaagagaaccgagatggagtactacacccacgagaagcaggagaagggcaccctgaacagcaacgccgcctacgagcagagccacttcttcaacaagaactacaccgaggacatcttccccgtgaccccccccgagctggaggagaccatcagagacgagaagatcagaagactgaagcaggtgctgagagagaaggaggccgccctggaggagatgagaaagaagatgcaccagaagtag

SEQ ID NO: 8532 - DNA, 702 bp, Artificial Sequence
  Description of Artificial Sequence: Synthetic coding sequence
atggccagcaccagcgacaagggcgcccagggcagaaacgacaagaaggacagccagggcagaagcaacaaggccctgcacctgaagagcgacgccgagttcaagaagatcttcggcctgaccaaggacctgagagtgtgcctgaccagaatccccgaccacctgaccagcggcgagggcttcgacagcttcagcagcctggtgaagagcggcacctacaaggagaccgagttcatggtgaaggagggcgagagaaagcagcagaacttcgacaagaagagaaaggccaagaccaacaagaagatggaccacatcaagaagagaaagaccgagaacgcctacaacgccatcatcaacggcgaggccaacgtgaccggcagccagctgctgagcagcatcctgcccaccagcgacgtgagccagcacaacatcctgaccagccacagcaagaccagacaggagaagagaaccgagatggagtactacacccacgagaagcaggagaagggcaccctgaacagcaacgccgcctacgagcagagccacttcttcaacaagaactacaccgaggacatcttccccgtgaccccccccgagctggaggagaccatcagagacgagaagatcagaagactgaagcaggtgctgagagagaaggaggccgccctggaggagatgagaaagaagatgcaccagaagtag

SEQ ID NO: 8533 - DNA, 702 bp, Artificial Sequence; identical to SEQ ID NO: 8532
  Description of Artificial Sequence: Synthetic coding sequence

SEQ ID NO: 8534 - DNA, 1134 bp, Artificial Sequence
  Description of Artificial Sequence: Synthetic coding sequence
atgtactggaagcacgagaacgccgcccccgccctgcccgagggctgcagactgcccgccgagggcggccccgccaccgaccaggtgatggcccagcccggcagcggctgcaaggccaccaccagatgcctggagggcaccgccccccccgccatggcccagagcgacgccgaggccctggccggcgccctggacaaggacgagggccaggccagcccctgcacccccagcacccccagcgtgtgcagcccccccagcgccgccagcagcgtgcccagcgccggcaagaacatctgcagcagctgcggcctggagatcctggacagatacctgctgaaggtgaacaacctgatctggcacgtgagatgcctggagtgcagcgtgtgcagaaccagcctgagacagcagaacagctgctacatcaagaacaaggagatcttctgcaagatggactacttcagcagattcggcaccaagtgcgccagatgcggcagacagatctacgccagcgactgggtgagaagagccagaggcaacgcctaccacctggcctgcttcgcctgcttcagctgcaagagacagctgagcaccggcgaggagttcggcctggtggaggagaaggtgctgtgcagaatccactacgacaccatgatcgagaacctgaagagagccgccgagaacggcaacggcctgaccctggagggcgccgtgcccagcgagcaggacagccagcccaagcccgccaagagagccagaaccagcttcaccgccgagcagctgcaggtgatgcaggcccagttcgcccaggacaacaaccccgacgcccagaccctgcagaagctggccgacatgaccggcctgagcagaagagtgatccaggtgtggttccagaactgcagagccagacacaagaagcacaccccccagcaccccgtgccccccagcggcgccccccccagcagactgcccagcgccctgagcgacgacatccactacacccccttcagcagccccgagagagccagaatggtgaccctgcacggctacatcgagagccaccccttcagcgtgctgaccctgcccgccctgccccacctgcccgtgggcgccccccagctgcccctgagcagatag

SEQ ID NO: 8535 - DNA, 1092 bp, Artificial Sequence
  Description of Artificial Sequence: Synthetic coding sequence
atggcccagcccggcagcggctgcaaggccaccaccagatgcctggagggcaccgccccccccgccatggcccagagcgacgccgaggccctggccggcgccctggacaaggacgagggccaggccagcccctgcacccccagcacccccagcgtgtgcagcccccccagcgccgccagcagcgtgcccagcgccggcaagaacatctgcagcagctgcggcctggagatcctggacagatacctgctgaaggtgaacaacctgatctggcacgtgagatgcctggagtgcagcgtgtgcagaaccagcctgagacagcagaacagctgctacatcaagaacaaggagatcttctgcaagatggactacttcagcagattcggcaccaagtgcgccagatgcggcagacagatctacgccagcgactgggtgagaagagccagaggcaacgcctaccacctggcctgcttcgcctgcttcagctgcaagagacagctgagcaccggcgaggagttcggcctggtggaggagaaggtgctgtgcagaatccactacgacaccatgatcgagaacctgaagagagccgccgagaacggcaacggcctgaccctggagggcgccgtgcccagcgagcaggacagccagcccaagcccgccaagagagccagaaccagcttcaccgccgagcagctgcaggtgatgcaggcccagttcgcccaggacaacaaccccgacgcccagaccctgcagaagctggccgacatgaccggcctgagcagaagagtgatccaggtgtggttccagaactgcagagccagacacaagaagcacaccccccagcaccccgtgccccccagcggcgccccccccagcagactgcccagcgccctgagcgacgacatccactacacccccttcagcagccccgagagagccagaatggtgaccctgcacggctacatcgagagccaggtgcagtgcggccaggtgcactgcagactgccctacaccgccccccccgtgcacctgaaggccgacatggacggccccctgagcaacagaggcgagaaggtgatcctgttccagtactag

SEQ ID NO: 8536 - DNA, 1179 bp, Artificial Sequence
  Description of Artificial Sequence: Synthetic coding sequence
atgtactggaagcacgagaacgccgcccccgccctgcccgagggctgcagactgcccgccgagggcggccccgccaccgaccaggtgatggcccagcccggcagcggctgcaaggccaccaccagatgcctggagggcaccgccccccccgccatggcccagagcgacgccgaggccctggccggcgccctggacaaggacgagggccaggccagcccctgcacccccagcacccccagcgtgtgcagcccccccagcgccgccagcagcgtgcccagcgccggcaagaacatctgcagcagctgcggcctggagatcctggacagatacctgctgaaggtgaacaacctgatctggcacgtgagatgcctggagtgcagcgtgtgcagaaccagcctgagacagcagaacagctgctacatcaagaacaaggagatcttctgcaagatggactacttcagcagattcggcaccaagtgcgccagatgcggcagacagatctacgccagcgactgggtgagaagagccagaggcaacgcctaccacctggcctgcttcgcctgcttcagctgcaagagacagctgagcaccggcgaggagttcggcctggtggaggagaaggtgctgtgcagaatccactacgacaccatgatcgagaacctgaagagagccgccgagaacggcaacggcctgaccctggagggcgccgtgcccagcgagcaggacagccagcccaagcccgccaagagagccagaaccagcttcaccgccgagcagctgcaggtgatgcaggcccagttcgcccaggacaacaaccccgacgcccagaccctgcagaagctggccgacatgaccggcctgagcagaagagtgatccaggtgtggttccagaactgcagagccagacacaagaagcacaccccccagcaccccgtgccccccagcggcgccccccccagcagactgcccagcgccctgagcgacgacatccactacacccccttcagcagccccgagagagccagaatggtgaccctgcacggctacatcgagagccaggtgcagtgcggccaggtgcactgcagactgccctacaccgccccccccgtgcacctgaaggccgacatggacggccccctgagcaacagaggcgagaaggtgatcctgttccagtactag

SEQ ID NO: 8537 - DNA, 1101 bp, Artificial Sequence
  Description of Artificial Sequence: Synthetic coding sequence
atgagaagaggcctgtgcagaagaagcgccgagaaccccgacgccggccccgtgatggcccagcccggcagcggctgcaaggccaccaccagatgcctggagggcaccgccccccccgccatggcccagagcgacgccgaggccctggccggcgccctggacaaggacgagggccaggccagcccctgcacccccagcacccccagcgtgtgcagcccccccagcgccgccagcagcgtgcccagcgccggcaagaacatctgcagcagctgcggcctggagatcctggacagatacctgctgaaggtgaacaacctgatctggcacgtgagatgcctggagtgcagcgtgtgcagaaccagcctgagacagcagaacagctgctacatcaagaacaaggagatcttctgcaagatggactacttcagcagattcggcaccaagtgcgccagatgcggcagacagatctacgccagcgactgggtgagaagagccagaggcaacgcctaccacctggcctgcttcgcctgcttcagctgcaagagacagctgagcaccggcgaggagttcggcctggtggaggagaaggtgctgtgcagaatccactacgacaccatgatcgagaacctgaagagagccgccgagaacggcaacggcctgaccctggagggcgccgtgcccagcgagcaggacagccagcccaagcccgccaagagagccagaaccagcttcaccgccgagcagctgcaggtgatgcaggcccagttcgcccaggacaacaaccccgacgcccagaccctgcagaagctggccgacatgaccggcctgagcagaagagtgatccaggtgtggttccagaactgcagagccagacacaagaagcacaccccccagcaccccgtgccccccagcggcgccccccccagcagactgcccagcgccctgagcgacgacatccactacacccccttcagcagccccgagagagccagaatggtgaccctgcacggctacatcgagagccaccccttcagcgtgctgaccctgcccgccctgccccacctgcccgtgggcgccccccagctgcccctgagcagatag

SEQ ID NO: 8538 - DNA, 66 bp, Artificial Sequence
  Description of Artificial Sequence: Synthetic coding sequence
atggcccagcccggcagcggctgcaaggccaccaccagatgcctggagggcaccgcccccccctag

SEQ ID NO: 8539 - DNA, 105 bp, Artificial Sequence
  Description of Artificial Sequence: Synthetic coding sequence
atggcccagcccggcagcggctgcaaggccaccaccagatgcctggagggcaccgccccccccgccatggcccagagcgacgccgaggccctggccggcgcctag

SEQ ID NO: 8540 - DNA, 531 bp, Artificial Sequence
  Description of Artificial Sequence: Synthetic coding sequence
atgatcgagaacctgaagagagccgccgagaacggcaacggcctgaccctggagggcgccgtgcccagcgagcaggacagccagcccaagcccgccaagagagccagaaccagcttcaccgccgagcagctgcaggtgatgcaggcccagttcgcccaggacaacaaccccgacgcccagaccctgcagaagctggccgacatgaccggcctgagcagaagagtgatccaggtgtggttccagaactgcagagccagacacaagaagcacaccccccagcaccccgtgccccccagcggcgccccccccagcagactgcccagcgccctgagcgacgacatccactacacccccttcagcagccccgagagagccagaatggtgaccctgcacggctacatcgagagccaggtgcagtgcggccaggtgcactgcagactgccctacaccgccccccccgtgcacctgaaggccgacatggacggccccctgagcaacagaggcgagaaggtgatcctgttccagtactag

SEQ ID NO: 8541 - DNA, 372 bp, Artificial Sequence
  Description of Artificial Sequence: Synthetic coding sequence
atggccgtgagccacagcgtgaaggagagaaccatcagcgagaacagcctgatcatcctgctgcagggcctgcagggcagagtgaccaccgtggacctgagagacgagagcgtggcccacggcagaatcgacaacgtggacgccttcatgaacatcagactggccaaggtgacctacaccgacagatggggccaccaggtgaagctggacgacctgttcgtgaccggcagaaacgtgagatacgtgcacatccccgacgacgtgaacatcaccagcaccatcgagcagcagctgcagatcatccacagagtgagaaacttcggcggcaagggccagggcagatgggagttcccccccaagaactgcaagtag

SEQ ID NO: 8542 - DNA, 1083 bp, Artificial Sequence
  Description of Artificial Sequence: Synthetic coding sequence
atggaggagagagagagaggcgccagaagcgccggcgccggcagccccgccagaccccccagccccagactggacgtgagcagcgacagcttcgaccccctgctggccctgtacgcccccagactgccccccatcccctaccccaacgccccctgcttcaacaacgtggccgagtacgagagcttcctgagaaccggcgtgagaggcggcggcagaggcagaggcagagccagaggcgccgccgccggcagcggcgtgcccgccgcccccggccccagcggcagaaccagaagaagacccgacgcccccgcccccgaccccgagagaatccagagactgagaagactgatggtggccaaggaggagggcgacggcgccgccggcgccggcagaagaggccccggcagaagcagaaaggcccccagaaacgtgctgaccagaatgcccctgcacgagggcagccccctgggcgagctgcacagatgcatcagagagggcgtgaaggtgaacgtgcacatcagaaccttcaagggcctgagaggcgtgtgcaccggcttcctggtggccttcgacaagttctggaacatggccctgaccgacgtggacgagacctacagaaagcccgtgctgggcaaggcctacgagagagacagcagcctgaccctgaccagactgttcgacagactgaagctgcaggacagcagcaagaaggaggccgacagcaagagcgccgtggaggacagcaccctgagcagatacagccagaccagcacctggaagctggccagcgtgtggggcagagccgacaccggcagaggcagccacaagagaagcagaagcgtgcccagcagcctgcaggccagcgccagagaggagagcagaagcgagctgagcggcagaaccaccagaaccgacggcagcagcgtgggcggcaccttcagcagagccaccaccctgagcagaggccagagcagaaagaagaagagaaagcccaaggtggactaccagcaggtgttcaccagacacatcaaccagatcttcatcagaggcgagaacgtgctgctggtgcacctggcccagtag

SEQ ID NO: 8543 - DNA, 1140 bp, Artificial Sequence
  Description of Artificial Sequence: Synthetic coding sequence
atggtgttcttcacctgcaacgcctgcggcgagagcgtgaagaagatccaggtggagaagcacgtgagcgtgtgcagaaactgcgagtgcctgagctgcatcgactgcggcaaggacttctggggcgacgactacaagaaccacgtgaagtgcatcagcgaggaccagaagtacggcggcaagggctacgagggcaagacccacaagggcgacatcaagcagcaggcctggatccagaagatcagcgagctgatcaagagacccaacgtgagccccaaggtgagagagctgctggagcagatcagcgccttcgacaacgtgcccagaaagaaggccaagttccagaactggatgaagaacagcctgaaggtgcacaacgagagcatcctggaccaggtgtggaacatcttcagcgaggccagcaacagcgagcccgtgaacaaggagcaggaccagagacccctgcaccccgtggccaacccccacgccgagatcagcaccaaggtgcccgccagcaaggtgaaggacgccgtggagcagcagggcgaggtgaagaagaacaagagagagagaaaggaggagagacagaagaagagaaagagagagaagaaggagctgaagctggagaaccaccaggagaacagcagaaaccagaagcccaagaagagaaagaagggccaggaggccgacctggaggccggcggcgaggaggtgcccgaggccaacggcagcgccggcaagagaagcaagaagaagaagcagagaaaggacagcgccagcgaggaggaggcccacgtgggcgccggcaagagaaagagaagacacagcgaggtggagaccgacagcaagaagaagaagatgaagctgcccgagcaccccgagggcggcgagcccgaggacgacgaggcccccgccaagggcaagttcaactggaagggcaccatcaaggccatcctgaagcaggcccccgacaacgagatcaccatcaagaagctgagaaagaaggtgctggcccagtactacaccgtgaccgacgagcaccacagaagcgaggaggagctgctggtgatcttcaacaagaagatcagcaagaaccccaccttcaagctgctgaaggacaaggtgaagctggtgaagtag

SEQ ID NO: 8544 - DNA, 1140 bp, Artificial Sequence; identical to SEQ ID NO: 8543
  Description of Artificial Sequence: Synthetic coding sequence

SEQ ID NO: 8545 - DNA, 240 bp, Artificial Sequence
  Description of Artificial Sequence: Synthetic coding sequence
atggtgttcttcacctgcaacgcctgcggcgagagcgtgaagaagatccaggtggagaagcacgtgagcgtgtgcagaaactgcgagtgcctgagctgcatcgactgcggcaaggacttctggggcgacgactacaagaaccacgtgaagtgcatcagcgaggaccagaagtacggcggcaagggctacgagggcaagacccacaagggcgacatcaagcagcaggcctggatccagtag

SEQ ID NO: 8546 - DNA, 1863 bp, Artificial Sequence
  Description of Artificial Sequence: Synthetic coding sequence
atgaagcccgcccccagactgacccccgtgagacccgccgccgccagccccatcgtgagcggcgccagaagaagaagagtgagatgcagaaagtgcaaggcctgcgtgcagggcgagtgcggcgtgtgccactactgcagagacatgaagaagttcggcggccccggcagaatgaagcagagctgcgtgctgagacagtgcctggcccccagactgccccacagcgtgacctgcagcctgtgcggcgaggtggaccagaacgaggagacccaggacttcgagaagaagctgatggagtgctgcatctgcaacgagatcgtgcaccccggctgcctgcagatggacggcgagggcctgctgaacgaggagctgcccaactgctgggagtgccccaagtgctaccaggaggacagcagcgagaaggcccagaagagaaagatggaggagagcgacgaggaggccgtgcaggccaaggtgctgagacccctgagaagctgcgacgagcccctgaccccccccccccacagccccaccagcatgctgcagctgatccacgaccccgtgagccccagaggcatggtgaccagaagcagccccggcgccggccccagcgaccaccacagcgccagcagagacgagagattcaagagaagacagctgctgagactgcaggccaccgagagaaccatggtgagagagaaggagaacaaccccagcggcaagaaggagctgagcgaggtggagaaggccaagatcagaggcagctacctgaccgtgaccctgcagagacccaccaaggagctgcacggcaccagcatcgtgcccaagctgcaggccatcaccgccagcagcgccaacctgagacacagccccagagtgctggtgcagcactgccccgccagaaccccccagagaggcgacgaggagggcctgggcggcgaggaggaggaggaggaggaggaggaggaggaggacgacagcgccgaggagggcggcgccgccagactgaacggcagaggcagctgggcccaggacggcgacgagagctggatgcagagagaggtgtggatgagcgtgttcagatacctgagcagaagagagctgtgcgagtgcatgagagtgtgcaagacctggtacaagtggtgctgcgacaagagactgtggaccaagatcgacctgagcagatgcaaggccatcgtgccccaggccctgagcggcatcatcaagagacagcccgtgagcctggacctgagctggaccaacatcagcaagaagcagctgacctggctggtgaacagactgcccggcctgaaggacctgctgctggccggctgcagctggagcgccgtgagcgccctgagcaccagcagctgccccctgctgagaaccctggacctgagatgggccgtgggcatcaaggacccccagatcagagacctgctgaccccccccgccgacaagcccggccaggacaacagaagcaagctgagaaacatgaccgacttcagactggccggcctggacatcaccgacgccaccctgagactgatcatcagacacatgcccctgctgagcagactggacctgagccactgcagccacctgaccgaccagagcagcaacctgctgaccgccgtgggcagcagcaccagatacagcctgaccgagctgaacatggccggctgcaacaagctgaccgaccagaccctgatctacctgagaagaatcgccaacgtgaccctgatcgacctgagaggctgcaagcagatcaccagaaaggcctgcgagcacttcatcagcgacctgagcatcaacagcctgtactgcctgagcgacgagaagctgatccagaagatcagctag

SEQ ID NO: 8547 - DNA, 2349 bp, Artificial Sequence
  Description of Artificial Sequence: Synthetic coding sequence
atggagcccgaggaggagagaatcagatacagccagagactgagaggcaccatgagaagaagatacgaggacgacggcatcagcgacgacgagatcgagggcaagagaaccttcgacctggaggagaagctgcacaccaacaagtacaacgccaacttcgtgaccttcatggagggcaaggacttcaacgtggagtacatccagagaggcggcctgagagaccccctgatcttcaagaacagcgacggcctgggcatcaagatgcccgaccccgacttcaccgtgaacgacgtgaagatgtgcgtgggcagcagaagaatggtggacgtgatggacgtgaacacccagaagggcatcgagatgaccatggcccagtggaccagatactacgagacccccgaggaggagagagagaagctgtacaacgtgatcagcctggagttcagccacaccagactggagaacatggtgcagagacccagcaccgtggacttcatcgactgggtggacaacatgtggcccagacacctgaaggagagccagaccgagagcaccaacgccatcctggagatgcagtaccccaaggtgcagaagtactgcctgatgagcgtgagaggctgctacaccgacttccacgtggacttcggcggcaccagcgtgtggtaccacatccaccagggcggcaaggtgttctggctgatcccccccaccgcccacaacctggagctgtacgagaactggctgctgagcggcaagcagggcgacatcttcctgggcgacagagtgagcgactgccagagaatcgagctgaagcagggctacaccttcgtgatccccagcggctggatccacgccgtgtacacccccaccgacaccctggtgttcggcggcaacttcctgcacagcttcaacatccccatgcagctgaagatctacaacatcgaggacagaaccagagtgcccaacaagttcagataccccttctactacgagatgtgctggtacgtgctggagagatacgtgtactgcatcaccaacagaagccacctgaccaaggagttccagaaggagagcctgagcatggacctggagctgaacggcctggagagcggcaacggcgacgaggaggccgtggacagagagcccagaagactgagcagcagaagaagcgtgctgaccagccccgtggccaacggcgtgaacctggactacgacggcctgggcaagacctgcagaagcctgcccagcctgaagaagaccctggccggcgacagcagcagcgactgcagcagaggcagccacaacggccaggtgtgggacccccagtgcgcccccagaaaggacagacaggtgcacctgacccacttcgagctggagggcctgagatgcctggtggacaagctggagagcctgcccctgcacaagaagtgcgtgcccaccggcatcgaggacgaggacgccctgatcgccgacgtgaagatcctgctggaggagctggccaacagcgaccccaagctggccctgaccggcgtgcccatcgtgcagtggcccaagagagacaagctgaagttccccaccagacccaaggtgagagtgcccaccatccccatcaccaagccccacaccatgaagcccgcccccagactgacccccgtgagacccgccgccgccagccccatcgtgagcggcgccagaagaagaagagtgagatgcagaaagtgcaaggcctgcgtgcagggcgagtgcggcgtgtgccactactgcagagacatgaagaagttcggcggccccggcagaatgaagcagagctgcgtgctgagacagtgcctggcccccagactgccccacagcgtgacctgcagcctgtgcggcgaggtggaccagaacgaggagacccaggacttcgagaagaagctgatggagtgctgcatctgcaacgagatcgtgcaccccggctgcctgcagatggacggcgagggcctgctgaacgaggagctgcccaactgctgggagtgccccaagtgctaccaggaggacagcagcgagaaggcccagaagagaaagatggaggagagcgacgaggaggccgtgcaggccaaggtgctgagacccctgagaagctgcgacgagcccctgaccccccccccccacagccccaccagcatgctgcagctgatccacgaccccgtgagccccagaggcatggtgaccagaagcagccccggcgccggccccagcgaccaccacagcgccagcagagacgagagattcaagagaagacagctgctgagactgcaggccaccgagagaaccatggtgctgagacaggagaccctggacaagaactag

SEQ ID NO: 8548 - DNA, 1263 bp, Artificial Sequence
  Description of Artificial Sequence: Synthetic coding sequence
atgtgcagcggcagattccagaacatccaggtgaaccccgacttccccagaggcagaatcagcaacagcttcagaagaaccagcagcaccgagaacaagaccaagaccctgggcaagctgcaccaggagcccagacagctgcagagcgacggcaagagaaagatcctgctggaggagctggccaacagcgaccccaagctggccctgaccggcgtgcccatcgtgcagtggcccaagagagacaagctgaagttccccaccagacccaaggtgagagtgcccaccatccccatcaccaagccccacaccatgaagcccgcccccagactgacccccgtgagacccgccgccgccagccccatcgtgagcggcgccagaagaagaagagtgagatgcagaaagtgcaaggcctgcgtgcagggcgagtgcggcgtgtgccactactgcagagacatgaagaagttcggcggccccggcagaatgaagcagagctgcgtgctgagacagtgcctggcccccagactgccccacagcgtgacctgcagcctgtgcggcgaggtggaccagaacgaggagacccaggacttcgagaagaagctgatggagtgctgcatctgcaacgagatcgtgcaccccggctgcctgcagatggacggcgagggcctgctgaacgaggagctgcccaactgctgggagtgccccaagtgctaccaggaggacagcagcgagaaggcccagaagagaaagatggaggagagcgacgaggaggccgtgcaggccaaggtgctgagacccctgagaagctgcgacgagcccctgaccccccccccccacagccccaccagcatgctgcagctgatccacgaccccgtgagccccagaggcatggtgaccagaagcagccccggcgccggccccagcgaccaccacagcgccagcagagacgagagattcaagagaagacagctgctgagactgcaggccaccgagagaaccatggtgagagagaaggagaacaaccccagcggcaagaaggagctgagcgaggtggagaaggccaagatcagaggcagctacctgaccgtgaccctgcagagacccaccaaggagctgcacggcaccagcatcgtgcccaagctgcacggccaggtgctggtggtgagcagcgccagactgagcagcatcaccctgagcagactggcccaggagggccccgccgcccccggcgtgcccgacccctgcagaagccactggtgctgctag

SEQ ID NO: 8549 - DNA, 3489 bp, Artificial Sequence
  Description of Artificial Sequence: Synthetic coding sequence
atggagcccgaggaggagagaatcagatacagccagagactgagaggcaccatgagaagaagatacgaggacgacggcatcagcgacgacgagatcgagggcaagagaaccttcgacctggaggagaagctgcacaccaacaagtacaacgccaacttcgtgaccttcatggagggcaaggacttcaacgtggagtacatccagagaggcggcctgagagaccccctgatcttcaagaacagcgacggcctgggcatcaagatgcccgaccccgacttcaccgtgaacgacgtgaagatgtgcgtgggcagcagaagaatggtggacgtgatggacgtgaacacccagaagggcatcgagatgaccatggcccagtggaccagatactacgagacccccgaggaggagagagagaagctgtacaacgtgatcagcctggagttcagccacaccagactggagaacatggtgcagagacccagcaccgtggacttcatcgactgggtggacaacatgtggcccagacacctgaaggagagccagaccgagagcaccaacgccatcctggagatgcagtaccccaaggtgcagaagtactgcctgatgagcgtgagaggctgctacaccgacttccacgtggacttcggcggcaccagcgtgtggtaccacatccaccagggcggcaaggtgttctggctgatcccccccaccgcccacaacctggagctgtacgagaactggctgctgagcggcaagcagggcgacatcttcctgggcgacagagtgagcgactgccagagaatcgagctgaagcagggctacaccttcgtgatccccagcggctggatccacgccgtgtacacccccaccgacaccctggtgttcggcggcaacttcctgcacagcttcaacatccccatgcagctgaagatctacaacatcgaggacagaaccagagtgcccaacaagttcagataccccttctactacgagatgtgctggtacgtgctggagagatacgtgtactgcatcaccaacagaagccacctgaccaaggagttccagaaggagagcctgagcatggacctggagctgaacggcctggagagcggcaacggcgacgaggaggccgtggacagagagcccagaagactgagcagcagaagaagcgtgctgaccagccccgtggccaacggcgtgaacctggactacgacggcctgggcaagacctgcagaagcctgcccagcctgaagaagaccctggccggcgacagcagcagcgactgcagcagaggcagccacaacggccaggtgtgggacccccagtgcgcccccagaaaggacagacaggtgcacctgacccacttcgagctggagggcctgagatgcctggtggacaagctggagagcctgcccctgcacaagaagtgcgtgcccaccggcatcgaggacgaggacgccctgatcgccgacgtgaagatcctgctggaggagctggccaacagcgaccccaagctggccctgaccggcgtgcccatcgtgcagtggcccaagagagacaagctgaagttccccaccagacccaaggtgagagtgcccaccatccccatcaccaagccccacaccatgaagcccgcccccagactgacccccgtgagacccgccgccgccagccccatcgtgagcggcgccagaagaagaagagtgagatgcagaaagtgcaaggcctgcgtgcagggcgagtgcggcgtgtgccactactgcagagacatgaagaagttcggcggccccggcagaatgaagcagagctgcgtgctgagacagtgcctggcccccagactgccccacagcgtgacctgcagcctgtgcggcgaggtggaccagaacgaggagacccaggacttcgagaagaagctgatggagtgctgcatctgcaacgagatcgtgcaccccggctgcctgcagatggacggcgagggcctgctgaacgaggagctgcccaactgctgggagtgccccaagtgctaccaggaggacagcagcgagaaggcccagaagagaaagatggaggagagcgacgaggaggccgtgcaggccaaggtgctgagacccctgagaagctgcgacgagcccctgaccccccccccccacagccccaccagcatgctgcagctgatccacgaccccgtgagccccagaggcatggtgaccagaagcagccccggcgccggccccagcgaccaccacagcgccagcagagacgagagattcaagagaagacagctgctgagactgcaggccaccgagagaaccatggtgagagagaaggagaacaaccccagcggcaagaaggagctgagcgaggtggagaaggccaagatcagaggcagctacctgaccgtgaccctgcagagacccaccaaggagctgcacggcaccagcatcgtgcccaagctgcaggccatcaccgccagcagcgccaacctgagacacagccccagagtgctggtgcagcactgccccgccagaaccccccagagaggcgacgaggagggcctgggcggcgaggaggaggaggaggaggaggaggaggaggaggacgacagcgccgaggagggcggcgccgccagactgaacggcagaggcagctgggcccaggacggcgacgagagctggatgcagagagaggtgtggatgagcgtgttcagatacctgagcagaagagagctgtgcgagtgcatgagagtgtgcaagacctggtacaagtggtgctgcgacaagagactgtggaccaagatcgacctgagcagatgcaaggccatcgtgccccaggccctgagcggcatcatcaagagacagcccgtgagcctggacctgagctggaccaacatcagcaagaagcagctgacctggctggtgaacagactgcccggcctgaaggacctgctgctggccggctgcagctggagcgccgtgagcgccctgagcaccagcagctgccccctgctgagaaccctggacctgagatgggccgtgggcatcaaggacccccagatcagagacctgctgaccccccccgccgacaagcccggccaggacaacagaagcaagctgagaaacatgaccgacttcagactggccggcctggacatcaccgacgccaccctgagactgatcatcagacacatgcccctgctgagcagactggacctgagccactgcagccacctgaccgaccagagcagcaacctgctgaccgccgtgggcagcagcaccagatacagcctgaccgagctgaacatggccggctgcaacaagctgaccgaccagaccctgatctacctgagaagaatcgccaacgtgaccctgatcgacctgagaggctgcaagcagatcaccagaaaggcctgcgagcacttcatcagcgacctgagcatcaacagcctgtactgcctgagcgacgagaagctgatccagaagatcagctag

SEQ ID NO: 8550 - DNA, 2172 bp, Artificial Sequence
  Description of Artificial Sequence: Synthetic coding sequence
atgtgcagcggcagattccagaacatccaggtgaaccccgacttccccagaggcagaatcagcaacagcttcagaagaaccagcagcaccgagaacaagaccaagaccctgggcaagctgcaccaggagcccagacagctgcagagcgacggcaagagaaagatcctgctggaggagctggccaacagcgaccccaagctggccctgaccggcgtgcccatcgtgcagtggcccaagagagacaagctgaagttccccaccagacccaaggtgagagtgcccaccatccccatcaccaagccccacaccatgaagcccgcccccagactgacccccgtgagacccgccgccgccagccccatcgtgagcggcgccagaagaagaagagtgagatgcagaaagtgcaaggcctgcgtgcagggcgagtgcggcgtgtgccactactgcagagacatgaagaagttcggcggccccggcagaatgaagcagagctgcgtgctgagacagtgcctggcccccagactgccccacagcgtgacctgcagcctgtgcggcgaggtggaccagaacgaggagacccaggacttcgagaagaagctgatggagtgctgcatctgcaacgagatcgtgcaccccggctgcctgcagatggacggcgagggcctgctgaacgaggagctgcccaactgctgggagtgccccaagtgctaccaggaggacagcagcgagaaggcccagaagagaaagatggaggagagcgacgaggaggccgtgcaggccaaggtgctgagacccctgagaagctgcgacgagcccctgaccccccccccccacagccccaccagcatgctgcagctgatccacgaccccgtgagccccagaggcatggtgaccagaagcagccccggcgccggccccagcgaccaccacagcgccagcagagacgagagattcaagagaagacagctgctgagactgcaggccaccgagagaaccatggtgagagagaaggagaacaaccccagcggcaagaaggagctgagcgaggtggagaaggccaagatcagaggcagctacctgaccgtgaccctgcagagacccaccaaggagctgcacggcaccagcatcgtgcccaagctgcaggccatcaccgccagcagcgccaacctgagacacagccccagagtgctggtgcagcactgccccgccagaaccccccagagaggcgacgaggagggcctgggcggcgaggaggaggaggaggaggaggaggaggaggaggacgacagcgccgaggagggcggcgccgccagactgaacggcagaggcagctgggcccaggacggcgacgagagctggatgcagagagaggtgtggatgagcgtgttcagatacctgagcagaagagagctgtgcgagtgcatgagagtgtgcaagacctggtacaagtggtgctgcgacaagagactgtggaccaagatcgacctgagcagatgcaaggccatcgtgccccaggccctgagcggcatcatcaagagacagcccgtgagcctggacctgagctggaccaacatcagcaagaagcagctgacctggctggtgaacagactgcccggcctgaaggacctgctgctggccggctgcagctggagcgccgtgagcgccctgagcaccagcagctgccccctgctgagaaccctggacctgagatgggccgtgggcatcaaggacccccagatcagagacctgctgaccccccccgccgacaagcccggccaggacaacagaagcaagctgagaaacatgaccgacttcagactggccggcctggacatcaccgacgccaccctgagactgatcatcagacacatgcccctgctgagcagactggacctgagccactgcagccacctgaccgaccagagcagcaacctgctgaccgccgtgggcagcagcaccagatacagcctgaccgagctgaacatggccggctgcaacaagctgaccgaccagaccctgatctacctgagaagaatcgccaacgtgaccctgatcgacctgagaggctgcaagcagatcaccagaaaggcctgcgagcacttcatcagcgacctgagcatcaacagcctgtactgcctgagcgacgagaagctgatccagaagatcagctag

SEQ ID NO: 8551 - DNA, 3921 bp, Artificial Sequence
  Description of Artificial Sequence: Synthetic coding sequence
atggccggcccccagatgggcggcagcgccgaggaccacccccccagaaagagacacgccgccgagaagcagaagaagaagaccgtgatctacaccaagtgcttcgagttcgagagcgccacccagagacccatcgacagacagagatacgacgagaacgaggacctgagcgacgtggaggagatcgtgagcgtgagaggcttcagcctggaggagaagctgagaagccagctgtaccagggcgacttcgtgcacgccatggagggcaaggacttcaactacgagtacgtgcagagagaggccctgagagtgcccctgatcttcagagagaaggacggcctgggcatcaagatgcccgaccccgacttcaccgtgagagacgtgaagctgctggtgggcagcagaagactggtggacgtgatggacgtgaacacccagaagggcaccgagatgagcatgagccagttcgtgagatactacgagacccccgaggcccagagagacaagctgtacaacgtgatcagcctggagttcagccacaccaagctggagcacctggtgaagagacccaccgtggtggacctggtggactgggtggacaacatgtggccccagcacctgaaggagaagcagaccgaggccaccaacgccatcgccgagatgaagtaccccaaggtgaagaagtactgcctgatgagcgtgaagggctgcttcaccgacttccacatcgacttcggcggcaccagcgtgtggtaccacgtgttcagaggcggcaagatcttctggctgatcccccccaccctgcacaacctggccctgtacgaggagtgggtgctgagcggcaagcagagcgacatcttcctgggcgacagagtggagagatgccagagaatcgagctgaagcagggctacaccttcttcatccccagcggctggatccacgccgtgtacacccccgtggacagcctggtgttcggcggcaacatcctgcacagcttcaacgtgcccatgcagctgagaatctacgagatcgaggacagaaccagagtgcagcccaagttcagataccccttctactacgagatgtgctggtacgtgctggagagatacgtgtactgcgtgacccagagaagccacctgacccaggagtaccagagagagagcatgctgatcgacgcccccagaaagcccagcatcgacggcttcagcagcgacagctggctggagatggaggaggaggcctgcgaccagcagccccaggaggaggaggagaaggacgaggagggcgagggcagagacagagcccccaagccccccaccgacggcagcaccagccccaccagcacccccagcgaggaccaggaggccctgggcaagaagcccaaggcccccgccctgagattcctgaagagaaccctgagcaacgagagcgaggagagcgtgaagagcaccaccctggccgtggactaccccaagacccccaccggcagccccgccaccgaggtgagcgccaagtggacccacctgaccgagttcgagctgaagggcctgaaggccctggtggagaagctggagagcctgcccgagaacaagaagtgcgtgcccgagggcatcgaggacccccaggccctgctggagggcgtgaagaacgtgctgaaggagcacgccgacgacgaccccagcctggccatcaccggcgtgcccgtggtgacctggcccaagaagacccccaagaacagagccgtgggcagacccaagggcaagctgggccccgccagcgccgtgaagctggccgccaacagaaccaccgccggcgccagaagaagaagaaccagatgcagaaagtgcgaggcctgcctgagaaccgagtgcggcgagtgccacttctgcaaggacatgaagaagttcggcggccccggcagaatgaagcagagctgcatcatgagacagtgcatcgcccccgtgctgccccacaccgccgtgtgcctggtgtgcggcgaggccggcaaggaggacaccgtggaggaggaggagggcaagttcaacctgatgctgatggagtgcagcatctgcaacgagatcatccaccccggctgcctgaagatcaaggagagcgagggcgtggtgaacgacgagctgcccaactgctgggagtgccccaagtgcaaccacgccggcaagaccggcaaggcctacaagcagaagagaggccccggcttcaagtacgccagcaacctgcccggcagcctgctgaaggagcagaagatgaacagagacaacaaggagggccaggagcccgccaagagaagaagcgagtgcgaggaggcccccagaagaagaagcgacgagcacagcaagaaggtgccccccgacggcctgctgagaagaaagagcgacgacgtgcacctgagaaagaagagaaagtacgagaagccccaggagctgagcggcagaaagagagccagcagcctgcagaccagccccggcagcagcagccacctgagccccagaccccccctgggcagcagcctgagcccctggtggagaagcagcctgacctacttccagcagcagctgaagcccggcaaggaggacaagctgttcagaaagaagagaagaagctggaagaacgccgaggacagaatggccctggccaacaagcccctgagaagattcaagcaggagcccgaggacgagctgcccgaggccccccccaagaccagagagagcgaccacagcagaagcagcagccccaccgccggccccagcaccgagggcgccgagggccccgaggagaagaagaaggtgaagatgagaagaaagagaagactgcccaacaaggagctgagcagagagctgagcaaggagctgaaccacgagatccagagaaccgagaacagcctggccaacgagaaccagcagcccatcaagagcgagcccgagagcgagggcgaggagcccaagagaccccccggcatctgcgagagaccccacagattcagcaagggcctgaacggcacccccagagagctgagacaccagctgggccccagcctgagaagcccccccagagtgatcagcagacccccccccagcgtgagcccccccaagtgcatccagatggagagacacgtgatcagacccccccccatcagccccccccccgacagcctgcccctggacgacggcgccgcccacgtgatgcacagagaggtgtggatggccgtgttcagctacctgagccaccaggacctgtgcgtgtgcatgagagtgtgcagaacctggaacagatggtgctgcgacaagagactgtggaccagaatcgacctgaaccactgcaagagcatcacccccctgatgctgagcggcatcatcagaagacagcccgtgagcctggacctgagctggaccaacatcagcaagaagcagctgagctggctgatcaacagactgcccggcctgagagacctggtgctgagcggctgcagctggatcgccgtgagcgccctgtgcagcagcagctgccccctgctgagaaccctggacgtgcagtgggtggagggcctgaaggacgcccagatgagagacctgctgagcccccccaccgacaacagacccggccagatggacaacagaagcaagctgagaaacatcgtggagctgagactggccggcctggacatcaccgacgccagcctgagactgatcatcagacacatgcccctgctgagcaagctgcacctgagctactgcaaccacgtgaccgaccagagcatcaacctgctgaccgccgtgggcaccaccaccagagacagcctgaccgagatcaacctgagcggcttcttcgtgggcagagtgttcggcctgcagttctggggcatctgcgagccccaggccagaaagaacgccggctgggcctag

SEQ ID NO: 8552 - DNA, 3798 bp, Artificial Sequence
  Description of Artificial Sequence: Synthetic coding sequence
atggaggccgagaaggacagcggcagaagactgagacccatcgacagacagagatacgacgagaacgaggacctgagcgacgtggaggagatcgtgagcgtgagaggcttcagcctggaggagaagctgagaagccagctgtaccagggcgacttcgtgcacgccatggagggcaaggacttcaactacgagtacgtgcagagagaggccctgagagtgcccctgatcttcagagagaaggacggcctgggcatcaagatgcccgaccccgacttcaccgtgagagacgtgaagctgctggtgggcagcagaagactggtggacgtgatggacgtgaacacccagaagggcaccgagatgagcatgagccagttcgtgagatactacgagacccccgaggcccagagagacaagctgtacaacgtgatcagcctggagttcagccacaccaagctggagcacctggtgaagagacccaccgtggtggacctggtggactgggtggacaacatgtggccccagcacctgaaggagaagcagaccgaggccaccaacgccatcgccgagatgaagtaccccaaggtgaagaagtactgcctgatgagcgtgaagggctgcttcaccgacttccacatcgacttcggcggcaccagcgtgtggtaccacgtgttcagaggcggcaagatcttctggctgatcccccccaccctgcacaacctggccctgtacgaggagtgggtgctgagcggcaagcagagcgacatcttcctgggcgacagagtggagagatgccagagaatcgagctgaagcagggctacaccttcttcatccccagcggctggatccacgccgtgtacacccccgtggacagcctggtgttcggcggcaacatcctgcacagcttcaacgtgcccatgcagctgagaatctacgagatcgaggacagaaccagagtgcagcccaagttcagataccccttctactacgagatgtgctggtacgtgctggagagatacgtgtactgcgtgacccagagaagccacctgacccaggagtaccagagagagagcatgctgatcgacgcccccagaaagcccagcatcgacggcttcagcagcgacagctggctggagatggaggaggaggcctgcgaccagcagccccaggaggaggaggagaaggacgaggagggcgagggcagagacagagcccccaagccccccaccgacggcagcaccagccccaccagcacccccagcgaggaccaggaggccctgggcaagaagcccaaggcccccgccctgagattcctgaagagaaccctgagcaacgagagcgaggagagcgtgaagagcaccaccctggccgtggactaccccaagacccccaccggcagccccgccaccgaggtgagcgccaagtggacccacctgaccgagttcgagctgaagggcctgaaggccctggtggagaagctggagagcctgcccgagaacaagaagtgcgtgcccgagggcatcgaggacccccaggccctgctggagggcgtgaagaacgtgctgaaggagcacgccgacgacgaccccagcctggccatcaccggcgtgcccgtggtgacctggcccaagaagacccccaagaacagagccgtgggcagacccaagggcaagctgggccccgccagcgccgtgaagctggccgccaacagaaccaccgccggcgccagaagaagaagaaccagatgcagaaagtgcgaggcctgcctgagaaccgagtgcggcgagtgccacttctgcaaggacatgaagaagttcggcggccccggcagaatgaagcagagctgcatcatgagacagtgcatcgcccccgtgctgccccacaccgccgtgtgcctggtgtgcggcgaggccggcaaggaggacaccgtggaggaggaggagggcaagttcaacctgatgctgatggagtgcagcatctgcaacgagatcatccaccccggctgcctgaagatcaaggagagcgagggcgtggtgaacgacgagctgcccaactgctgggagtgccccaagtgcaaccacgccggcaagaccggcaagcagaagagaggccccggcttcaagtacgccagcaacctgcccggcagcctgctgaaggagcagaagatgaacagagacaacaaggagggccaggagcccgccaagagaagaagcgagtgcgaggaggcccccagaagaagaagcgacgagcacagcaagaaggtgccccccgacggcctgctgagaagaaagagcgacgacgtgcacctgagaaagaagagaaagtacgagaagccccaggagctgagcggcagaaagagactgaagcccggcaaggaggacaagctgttcagaaagaagagaagaagctggaagaacgccgaggacagaatggccctggccaacaagcccctgagaagattcaagcaggagcccgaggacgagctgcccgaggccccccccaagaccagagagagcgaccacagcagaagcagcagccccaccgccggccccagcaccgagggcgccgagggccccgaggagaagaagaaggtgaagatgagaagaaagagaagactgcccaacaaggagctgagcagagagctgagcaaggagctgaaccacgagatccagagaaccgagaacagcctggccaacgagaaccagcagcccatcaagagcgagcccgagagcgagggcgaggagcccaagagaccccccggcatctgcgagagaccccacagattcagcaagggcctgaacggcacccccagagagctgagacaccagctgggccccagcctgagaagcccccccagagtgatcagcagacccccccccagcgtgagcccccccaagtgcatccagatggagagacacgtgatcagacccccccccatcagccccccccccgacagcctgcccctggacgacggcgccgcccacgtgatgcacagagaggtgtggatggccgtgttcagctacctgagccaccaggacctgtgcgtgtgcatgagagtgtgcagaacctggaacagatggtgctgcgacaagagactgtggaccagaatcgacctgaaccactgcaagagcatcacccccctgatgctgagcggcatcatcagaagacagcccgtgagcctggacctgagctggaccaacatcagcaagaagcagctgagctggctgatcaacagactgcccggcctgagagacctggtgctgagcggctgcagctggatcgccgtgagcgccctgtgcagcagcagctgccccctgctgagaaccctggacgtgcagtgggtggagggcctgaaggacgcccagatgagagacctgctgagcccccccaccgacaacagacccggccagatggacaacagaagcaagctgagaaacatcgtggagctgagactggccggcctggacatcaccgacgccagcctgagactgatcatcagacacatgcccctgctgagcaagctgcacctgagctactgcaaccacgtgaccgaccagagcatcaacctgctgaccgccgtgggcaccaccaccagagacagcctgaccgagatcaacctgagcgactgcaacaaggtgaccgaccagtgcctgagcttcttcaagagatgcggcaacatctgccacatcgacctgagatactgcaagcaggtgaccaaggagggctgcgagcagttcatcgccgagatgagcagcttccagggcagaagctgcagcaccaccagactgggcgacgagtag

SEQ ID NO: 8553 - DNA, 4011 bp, Artificial Sequence
  Description of Artificial Sequence: Synthetic coding sequence
atggccggcccccagatgggcggcagcgccgaggaccacccccccagaaagagacacgccgccgagaagcagaagaagaagaccgtgatctacaccaagtgcttcgagttcgagagcgccacccagagacccatcgacagacagagatacgacgagaacgaggacctgagcgacgtggaggagatcgtgagcgtgagaggcttcagcctggaggagaagctgagaagccagctgtaccagggcgacttcgtgcacgccatggagggcaaggacttcaactacgagtacgtgcagagagaggccctgagagtgcccctgatcttcagagagaaggacggcctgggcatcaagatgcccgaccccgacttcaccgtgagagacgtgaagctgctggtgggcagcagaagactggtggacgtgatggacgtgaacacccagaagggcaccgagatgagcatgagccagttcgtgagatactacgagacccccgaggcccagagagacaagctgtacaacgtgatcagcctggagttcagccacaccaagctggagcacctggtgaagagacccaccgtggtggacctggtggactgggtggacaacatgtggccccagcacctgaaggagaagcagaccgaggccaccaacgccatcgccgagatgaagtaccccaaggtgaagaagtactgcctgatgagcgtgaagggctgcttcaccgacttccacatcgacttcggcggcaccagcgtgtggtaccacgtgttcagaggcggcaagatcttctggctgatcccccccaccctgcacaacctggccctgtacgaggagtgggtgctgagcggcaagcagagcgacatcttcctgggcgacagagtggagagatgccagagaatcgagctgaagcagggctacaccttcttcatccccagcggctggatccacgccgtgtacacccccgtggacagcctggtgttcggcggcaacatcctgcacagcttcaacgtgcccatgcagctgagaatctacgagatcgaggacagaaccagagtgcagcccaagttcagataccccttctactacgagatgtgctggtacgtgctggagagatacgtgtactgcgtgacccagagaagccacctgacccaggagtaccagagagagagcatgctgatcgacgcccccagaaagcccagcatcgacggcttcagcagcgacagctggctggagatggaggaggaggcctgcgaccagcagccccaggaggaggaggagaaggacgaggagggcgagggcagagacagagcccccaagccccccaccgacggcagcaccagccccaccagcacccccagcgaggaccaggaggccctgggcaagaagcccaaggcccccgccctgagattcctgaagagaaccctgagcaacgagagcgaggagagcgtgaagagcaccaccctggccgtggactaccccaagacccccaccggcagccccgccaccgaggtgagcgccaagtggacccacctgaccgagttcgagctgaagggcctgaaggccctggtggagaagctggagagcctgcccgagaacaagaagtgcgtgcccgagggcatcgaggacccccaggccctgctggagggcgtgaagaacgtgctgaaggagcacgccgacgacgaccccagcctggccatcaccggcgtgcccgtggtgacctggcccaagaagacccccaagaacagagccgtgggcagacccaagggcaagctgggccccgccagcgccgtgaagctggccgccaacagaaccaccgccggcgccagaagaagaagaaccagatgcagaaagtgcgaggcctgcctgagaaccgagtgcggcgagtgccacttctgcaaggacatgaagaagttcggcggccccggcagaatgaagcagagctgcatcatgagacagtgcatcgcccccgtgctgccccacaccgccgtgtgcctggtgtgcggcgaggccggcaaggaggacaccgtggaggaggaggagggcaagttcaacctgatgctgatggagtgcagcatctgcaacgagatcatccaccccggctgcctgaagatcaaggagagcgagggcgtggtgaacgacgagctgcccaactgctgggagtgccccaagtgcaaccacgccggcaagaccggcaagcagaagagaggccccggcttcaagtacgccagcaacctgcccggcagcctgctgaaggagcagaagatgaacagagacaacaaggagggccaggagcccgccaagagaagaagcgagtgcgaggaggcccccagaagaagaagcgacgagcacagcaagaaggtgccccccgacggcctgctgagaagaaagagcgacgacgtgcacctgagaaagaagagaaagtacgagaagccccaggagctgagcggcagaaagagagccagcagcctgcagaccagccccggcagcagcagccacctgagccccagaccccccctgggcagcagcctgagcccctggtggagaagcagcctgacctacttccagcagcagctgaagcccggcaaggaggacaagctgttcagaaagaagagaagaagctggaagaacgccgaggacagaatggccctggccaacaagcccctgagaagattcaagcaggagcccgaggacgagctgcccgaggccccccccaagaccagagagagcgaccacagcagaagcagcagccccaccgccggccccagcaccgagggcgccgagggccccgaggagaagaagaaggtgaagatgagaagaaagagaagactgcccaacaaggagctgagcagagagctgagcaaggagctgaaccacgagatccagagaaccgagaacagcctggccaacgagaaccagcagcccatcaagagcgagcccgagagcgagggcgaggagcccaagagaccccccggcatctgcgagagaccccacagattcagcaagggcctgaacggcacccccagagagctgagacaccagctgggccccagcctgagaagcccccccagagtgatcagcagacccccccccagcgtgagcccccccaagtgcatccagatggagagacacgtgatcagacccccccccatcagccccccccccgacagcctgcccctggacgacggcgccgcccacgtgatgcacagagaggtgtggatggccgtgttcagctacctgagccaccaggacctgtgcgtgtgcatgagagtgtgcagaacctggaacagatggtgctgcgacaagagactgtggaccagaatcgacctgaaccactgcaagagcatcacccccctgatgctgagcggcatcatcagaagacagcccgtgagcctggacctgagctggaccaacatcagcaagaagcagctgagctggctgatcaacagactgcccggcctgagagacctggtgctgagcggctgcagctggatcgccgtgagcgccctgtgcagcagcagctgccccctgctgagaaccctggacgtgcagtgggtggagggcctgaaggacgcccagatgagagacctgctgagcccccccaccgacaacagacccggccagatggacaacagaagcaagctgagaaacatcgtggagctgagactggccggcctggacatcaccgacgccagcctgagactgatcatcagacacatgcccctgctgagcaagctgcacctgagctactgcaaccacgtgaccgaccagagcatcaacctgctgaccgccgtgggcaccaccaccagagacagcctgaccgagatcaacctgagcgactgcaacaaggtgaccgaccagtgcctgagcttcttcaagagatgcggcaacatctgccacatcgacctgagatactgcaagcaggtgaccaaggagggctgcgagcagttcatcgccgagatgagcgtgagcgtgcagttcggccaggtggaggagaagctgctgcagaagctgagctag

SEQ ID NO: 8554 - DNA, 2121 bp, Artificial Sequence
  Description of Artificial Sequence: Synthetic coding sequence
atggccggcccccagatgggcggcagcgccgaggaccacccccccagaaagagacacgccgccgagaagcagaagaagaagaccgtgatctacaccaagtgcttcgagttcgagagcgccacccagagacccatcgacagacagagatacgacgagaacgaggacctgagcgacgtggaggagatcgtgagcgtgagaggcttcagcctggaggagaagctgagaagccagctgtaccagggcgacttcgtgcacgccatggagggcaaggacttcaactacgagtacgtgcagagagaggccctgagagtgcccctgatcttcagagagaaggacggcctgggcatcaagatgcccgaccccgacttcaccgtgagagacgtgaagctgctggtgggcagcagaagactggtggacgtgatggacgtgaacacccagaagggcaccgagatgagcatgagccagttcgtgagatactacgagacccccgaggcccagagagacaagctgtacaacgtgatcagcctggagttcagccacaccaagctggagcacctggtgaagagacccaccgtggtggacctggtggactgggtggacaacatgtggccccagcacctgaaggagaagcagaccgaggccaccaacgccatcgccgagatgaagtaccccaaggtgaagaagtactgcctgatgagcgtgaagggctgcttcaccgacttccacatcgacttcggcggcaccagcgtgtggtaccacgtgttcagaggcggcaagatcttctggctgatcccccccaccctgcacaacctggccctgtacgaggagtgggtgctgagcggcaagcagagcgacatcttcctgggcgacagagtggagagatgccagagaatcgagctgaagcagggctacaccttcttcatccccagcggctggatccacgccgtgtacacccccgtggacagcctggtgttcggcggcaacatcctgcacagcttcaacgtgcccatgcagctgagaatctacgagatcgaggacagaaccagagtgcagcccaagttcagataccccttctactacgagatgtgctggtacgtgctggagagatacgtgtactgcgtgacccagagaagccacctgacccaggagtaccagagagagagcatgctgatcgacgcccccagaaagcccagcatcgacggcttcagcagcgacagctggctggagatggaggaggaggcctgcgaccagcagccccaggaggaggaggagaaggacgaggagggcgagggcagagacagagcccccaagccccccaccgacggcagcaccagccccaccagcacccccagcgaggaccaggaggccctgggcaagaagcccaaggcccccgccctgagattcctgaagagaaccctgagcaacgagagcgaggagagcgtgaagagcaccaccctggccgtggactaccccaagacccccaccggcagccccgccaccgaggtgagcgccaagtggacccacctgaccgagttcgagctgaagggcctgaaggccctggtggagaagctggagagcctgcccgagaacaagaagtgcgtgcccgagggcatcgaggacccccaggccctgctggagggcgtgaagaacgtgctgaaggagcacgccgacgacgaccccagcctggccatcaccggcgtgcccgtggtgacctggcccaagaagacccccaagaacagagccgtgggcagacccaagggcaagctgggccccgccagcgccgtgaagctggccgccaacagaaccaccgccggcgccagaagaagaagaaccagatgcagaaagtgcgaggcctgcctgagaaccgagtgcggcgagtgccacttctgcaaggacatgaagaagttcggcggccccggcagaatgaagcagagctgcatcatgagacagtgcatcgcccccgtgctgccccacaccgccgtgtgcctggtgtgcggcgaggccggcaaggaggacaccgtggaggaggaggagggcaagttcaacctgatgctgatggagtgcagcatctgcaacgagatcatccaccccggctgcctgaagagagaccagcccgtgtag

SEQ ID NO: 8555 - DNA, 3981 bp, Artificial Sequence
  Description of Artificial Sequence: Synthetic coding sequence
atggccggcccccagatgggcggcagcgccgaggaccacccccccagaaagagacacgccgccgagaagcagaagaagaagaccgtgatctacaccaagtgcttcgagttcgagagcgccacccagagacccatcgacagacagagatacgacgagaacgaggacctgagcgacgtggaggagatcgtgagcgtgagaggcttcagcctggaggagaagctgagaagccagctgtaccagggcgacttcgtgcacgccatggagggcaaggacttcaactacgagtacgtgcagagagaggccctgagagtgcccctgatcttcagagagaaggacggcctgggcatcaagatgcccgaccccgacttcaccgtgagagacgtgaagctgctggtgggcagcagaagactggtggacgtgatggacgtgaacacccagaagggcaccgagatgagcatgagccagttcgtgagatactacgagacccccgaggcccagagagacaagctgtacaacgtgatcagcctggagttcagccacaccaagctggagcacctggtgaagagacccaccgtggtggacctggtggactgggtggacaacatgtggccccagcacctgaaggagaagcagaccgaggccaccaacgccatcgccgagatgaagtaccccaaggtgaagaagtactgcctgatgagcgtgaagggctgcttcaccgacttccacatcgacttcggcggcaccagcgtgtggtaccacgtgttcagaggcggcaagatcttctggctgatcccccccaccctgcacaacctggccctgtacgaggagtgggtgctgagcggcaagcagagcgacatcttcctgggcgacagagtggagagatgccagagaatcgagctgaagcagggctacaccttcttcatccccagcggctggatccacgccgtgtacacccccgtggacagcctggtgttcggcggcaacatcctgcacagcttcaacgtgcccatgcagctgagaatctacgagatcgaggacagaaccagagtgcagcccaagttcagataccccttctactacgagatgtgctggtacgtgctggagagatacgtgtactgcgtgacccagagaagccacctgacccaggagtaccagagagagagcatgctgatcgacgcccccagaaagcccagcatcgacggcttcagcagcgacagctggctggagatggaggaggaggcctgcgaccagcagccccaggaggaggaggagaaggacgaggagggcgagggcagagacagagcccccaagccccccaccgacggcagcaccagccccaccagcacccccagcgaggaccaggaggccctgggcaagaagcccaaggcccccgccctgagattcctgaagagaaccctgagcaacgagagcgaggagagcgtgaagagcaccaccctggccgtggactaccccaagacccccaccggcagccccgccaccgaggtgagcgccaagtggacccacctgaccgagttcgagctgaagggcctgaaggccctggtggagaagctggagagcctgcccgagaacaagaagtgcgtgcccgagggcatcgaggacccccaggccctgctggagggcgtgaagaacgtgctgaaggagcacgccgacgacgaccccagcctggccatcaccggcgtgcccgtggtgacctggcccaagaagacccccaagaacagagccgtgggcagacccaagggcaagctgggccccgccagcgccgtgaagctggccgccaacagaaccaccgccggcgccagaagaagaagaaccagatgcagaaagtgcgaggcctgcctgagaaccgagtgcggcgagtgccacttctgcaaggacatgaagaagttcggcggccccggcagaatgaagcagagctgcatcatgagacagtgcatcgcccccgtgctgccccacaccgccgtgtgcctggtgtgcggcgaggccggcaaggaggacaccgtggaggaggaggagggcaagttcaacctgatgctgatggagtgcagcatctgcaacgagatcatccaccccggctgcctgaagatcaaggagagcgagggcgtggtgaacgacgagctgcccaactgctgggagtgccccaagtgcaaccacgccggcaagaccggcaagcagaagagaggccccggcttcaagtacgccagcaacctgcccggcagcctgctgaaggagcagaagatgaacagagacaacaaggagggccaggagcccgccaagagaagaagcgagtgcgaggaggcccccagaagaagaagcgacgagcacagcaagaaggtgccccccgacggcctgctgagaagaaagagcgacgacgtgcacctgagaaagaagagaaagtacgagaagccccaggagctgagcggcagaaagagagccagcagcctgcagaccagccccggcagcagcagccacctgagccccagaccccccctgggcagcagcctgagcccctggtggagaagcagcctgacctacttccagcagcagcagagaagaagctggaagaacgccgaggacagaatggccctggccaacaagcccctgagaagattcaagcaggagcccgaggacgagctgcccgaggccccccccaagaccagagagagcgaccacagcagaagcagcagccccaccgccggccccagcaccgagggcgccgagggccccgaggagaagaagaaggtgaagatgagaagaaagagaagactgcccaacaaggagctgagcagagagctgagcaaggagctgaaccacgagatccagagaaccgagaacagcctggccaacgagaaccagcagcccatcaagagcgagcccgagagcgagggcgaggagcccaagagaccccccggcatctgcgagagaccccacagattcagcaagggcctgaacggcacccccagagagctgagacaccagctgggccccagcctgagaagcccccccagagtgatcagcagacccccccccagcgtgagcccccccaagtgcatccagatggagagacacgtgatcagacccccccccatcagccccccccccgacagcctgcccctggacgacggcgccgcccacgtgatgcacagagaggtgtggatggccgtgttcagctacctgagccaccaggacctgtgcgtgtgcatgagagtgtgcagaacctggaacagatggtgctgcgacaagagactgtggaccagaatcgacctgaaccactgcaagagcatcacccccctgatgctgagcggcatcatcagaagacagcccgtgagcctggacctgagctggaccaacatcagcaagaagcagctgagctggctgatcaacagactgcccggcctgagagacctggtgctgagcggctgcagctggatcgccgtgagcgccctgtgcagcagcagctgccccctgctgagaaccctggacgtgcagtgggtggagggcctgaaggacgcccagatgagagacctgctgagcccccccaccgacaacagacccgcccccggccagatggacaacagaagcaagctgagaaacatcgtggagctgagactggccggcctggacatcaccgacgccagcctgagactgatcatcagacacatgcccctgctgagcaagctgcacctgagctactgcaaccacgtgaccgaccagagcatcaacctgctgaccgccgtgggcaccaccaccagagacagcctgaccgagatcaacctgagcgactgcaacaaggtgaccgaccagtgcctgagcttcttcaagagatgcggcaacatctgccacatcgacctgagatactgcaagcaggtgaccaaggagggctgcgagcagttcatcgccgagatgagcgtgagcgtgcagttcggccaggtggaggagaagctgctgcagaagctgagctag

SEQ ID NO: 8556 - DNA, 1680 bp, Artificial Sequence
  Description of Artificial Sequence: Synthetic coding sequence
atgcccgaccccgacttcaccgtgagagacgtgaagctgctggtgggcagcagaagactggtggacgtgatggacgtgaacacccagaagggcaccgagatgagcatgagccagttcgtgagatactacgagacccccgaggcccagagagacaagctgtacaacgtgatcagcctggagttcagccacaccaagctggagcacctggtgaagagacccaccgtggtggacctggtggactgggtggacaacatgtggccccagcacctgaaggagaagcagaccgaggccaccaacgccatcgccgagatgaagtaccccaaggtgaagaagtactgcctgatgagcgtgaagggctgcttcaccgacttccacatcgacttcggcggcaccagcgtgtggtaccacgtgttcagaggcggcaagatcttctggctgatcccccccaccctgcacaacctggccctgtacgaggagtgggtgctgagcggcaagcagagcgacatcttcctgggcgacagagtggagagatgccagagaatcgagctgaagcagggctacaccttcttcatccccagcggctggatccacgccgtgtacacccccgtggacagcctggtgttcggcggcaacatcctgcacagcttcaacgtgcccatgcagctgagaatctacgagatcgaggacagaaccagagtgcagcccaagttcagataccccttctactacgagatgtgctggtacgtgctggagagatacgtgtactgcgtgacccagagaagccacctgacccaggagtaccagagagagagcatgctgatcgacgcccccagaaagcccagcatcgacggcttcagcagcgacagctggctggagatggaggaggaggcctgcgaccagcagccccaggaggaggaggagaaggacgaggagggcgagggcagagacagagcccccaagccccccaccgacggcagcaccagccccaccagcacccccagcgaggaccaggaggccctgggcaagaagcccaaggcccccgccctgagattcctgaagagaaccctgagcaacgagagcgaggagagcgtgaagagcaccaccctggccgtggactaccccaagacccccaccggcagccccgccaccgaggtgagcgccaagtggacccacctgaccgagttcgagctgaagggcctgaaggccctggtggagaagctggagagcctgcccgagaacaagaagtgcgtgcccgagggcatcgaggacccccaggccctgctggagggcgtgaagaacgtgctgaaggagcacgccgacgacgaccccagcctggccatcaccggcgtgcccgtggtgacctggcccaagaagacccccaagaacagagccgtgggcagacccaagggcaagctgggccccgccagcgccgtgaagctggccgccaacagaaccaccgccggcgccagaagaagaagaaccagatgcagaaagtgcgaggcctgcctgagaaccgagtgcggcgagtgccacttctgcaaggacatgaagaagttcggcggccccggcagaatgaagcagagctgcatcatgagacagtgcatcgccaccgccatcagaagcctgatcagcgcctgccccagcagcaacgccgtggagaccagcgtgatcctgacctag

SEQ ID NO: 8557 - DNA, 2340 bp, Artificial Sequence
  Description of Artificial Sequence: Synthetic coding sequence
atggccatgagcgtgagcgccgaggacgacgactacgagagcgagcccgaccagaacagagccgtgggcagacccaagggcaagctgggccccgccagcgccgtgaagctggccgccaacagaaccaccgccggcgccagaagaagaagaaccagatgcagaaagtgcgaggcctgcctgagaaccgagtgcggcgagtgccacttctgcaaggacatgaagaagttcggcggccccggcagaatgaagcagagctgcatcatgagacagtgcatcgcccccgtgctgccccacaccgccgtgtgcctggtgtgcggcgaggccggcaaggaggacaccgtggaggaggaggagggcaagttcaacctgatgctgatggagtgcagcatctgcaacgagatcatccaccccggctgcctgaagatcaaggagagcgagggcgtggtgaacgacgagctgcccaactgctgggagtgccccaagtgcaaccacgccggcaagaccggcaaggcctacaagcagaagagaggccccggcttcaagtacgccagcaacctgcccggcagcctgctgaaggagcagaagatgaacagagacaacaaggagggccaggagcccgccaagagaagaagcgagtgcgaggaggcccccagaagaagaagcgacgagcacagcaagaaggtgccccccgacggcctgctgagaagaaagagcgacgacgtgcacctgagaaagaagagaaagtacgagaagccccaggagctgagcggcagaaagagagccagcagcctgcagaccagccccggcagcagcagccacctgagccccagaccccccctgggcagcagcctgagcccctggtggagaagcagcctgacctacttccagcagcagctgaagcccggcaaggaggacaagctgttcagaaagaagagaagaagctggaagaacgccgaggacagaatggccctggccaacaagcccctgagaagattcaagcaggagcccgaggacgagctgcccgaggccccccccaagaccagagagagcgaccacagcagaagcagcagccccaccgccggccccagcaccgagggcgccgagggccccgaggagaagaagaaggtgaagatgagaagaaagagaagactgcccaacaaggagctgagcagagagctgagcaaggagctgaaccacgagatccagagaaccgagaacagcctggccaacgagaaccagcagcccatcaagagcgagcccgagagcgagggcgaggagcccaagagaccccccggcatctgcgagagaccccacagattcagcaagggcctgaacggcacccccagagagctgagacaccagctgggccccagcctgagaagcccccccagagtgatcagcagacccccccccagcgtgagcccccccaagtgcatccagatggagagacacgtgatcagacccccccccatcagccccccccccgacagcctgcccctggacgacggcgccgcccacgtgatgcacagagaggtgtggatggccgtgttcagctacctgagccaccaggacctgtgcgtgtgcatgagagtgtgcagaacctggaacagatggtgctgcgacaagagactgtggaccagaatcgacctgaaccactgcaagagcatcacccccctgatgctgagcggcatcatcagaagacagcccgtgagcctggacctgagctggaccaacatcagcaagaagcagctgagctggctgatcaacagactgcccggcctgagagacctggtgctgagcggctgcagctggatcgccgtgagcgccctgtgcagcagcagctgccccctgctgagaaccctggacgtgcagtgggtggagggcctgaaggacgcccagatgagagacctgctgagcccccccaccgacaacagacccggccagatggacaacagaagcaagctgagaaacatcgtggagctgagactggccggcctggacatcaccgacgccagcctgagactgatcatcagacacatgcccctgctgagcaagctgcacctgagctactgcaaccacgtgaccgaccagagcatcaacctgctgaccgccgtgggcaccaccaccagagacagcctgaccgagatcaacctgagcgactgcaacaaggtgaccgaccagtgcctgagcttcttcaagagatgcggcaacatctgccacatcgacctgagatactgcaagcaggtgaccaaggagggctgcgagcagttcatcgccgagatgagcgtgagcgtgcagttcggccaggtggaggagaagctgctgcagaagctgagctag

SEQ ID NO: 8558 - DNA, 3291 bp, Artificial Sequence
  Description of Artificial Sequence: Synthetic coding sequence
atgggcagcgaggaccacggcgcccagaaccccagctgcaagatcatgaccttcagacccaccatggaggagttcaaggacttcaacaagtacgtggcctacatcgagagccagggcgcccacagagccggcctggccaagatcatcccccccaaggagtggaagcccagacagacctacgacgacatcgacgacgtggtgatccccgcccccatccagcaggtggtgaccggccagagcggcctgttcacccagtacaacatccagaagaaggccatgaccgtgggcgagtacagaagactggccaacagcgagaagtactgcacccccagacaccaggacttcgacgacctggagagaaagtactggaagaacctgaccttcgtgagccccatctacggcgccgacatcagcggcagcctgtacgacgacgacgtggcccagtggaacatcggcagcctgagaaccatcctggacatggtggagagagagtgcggcaccatcatcgagggcgtgaacaccccctacctgtacttcggcatgtggaagaccaccttcgcctggcacaccgaggacatggacctgtacagcatcaactacctgcacttcggcgagcccaagagctggtacgccatcccccccgagcacggcaagagactggagagactggccatcggcttcttccccggcagcagccagggctgcgacgccttcctgagacacaagatgaccctgatcagccccatcatcctgaagaagtacggcatccccttcagcagaatcacccaggaggccggcgagttcatgatcaccttcccctacggctaccacgccggcttcaaccacggcttcaactgcgccgagagcaccaacttcgccaccctgagatggatcgactacggcaaggtggccacccagtgcacctgcagaaaggacatggtgaagatcagcatggacgtgttcgtgagaatcctgcagcccgagagatacgagctgtggaagcagggcaaggacctgaccgtgctggaccacaccagacccaccgccctgaccagccccgagctgagcagctggagcgccagcagagccagcctgaaggccaagctgctgagaagaagccacagaaagagaagccagcccaagaagcccaagcccgaggaccccaagttccccggcgagggcaccgccggcgccgccctgctggaggaggccggcggcagcgtgaaggaggaggccggccccgaggtggaccccgaggaggaggaggaggagccccagcccctgccccacggcagagaggccgagggcgccgaggaggacggcagaggcaagctgagacccaccaaggccaagagcgagagaaagaagaagagcttcggcctgctgcccccccagctgccccccccccccgcccacttccccagcgaggaggccctgtggctgcccagccccctggagccccccgtgctgggccccggccccgccgccatggaggagagccccctgcccgcccccctgaacgtggtgccccccgaggtgcccagcgaggagctggaggccaagcccagacccatcatccccatgctgtacgtggtgcccagacccggcaaggccgccttcaaccaggagcacgtgagctgccagcaggccttcgagcacttcgcccagaagggccccacctggaaggagcccgtgagccccatggagctgaccggccccgaggacggcgccgccagcagcggcgccggcagaatggagaccaaggccagagccggcgagggccaggcccccagcaccttcagcaagctgaagatggagatcaagaagagcagaagacaccccctgggcagaccccccaccagaagccccctgagcgtggtgaagcaggaggccagcagcgacgaggaggccagccccttcagcggcgaggaggacgtgagcgaccccgacgccctgagacccctgctgagcctgcagtggaagaacagagccgccagcttccaggccgagagaaagttcaacgccgccgccgccagaaccgagccctactgcgccatctgcaccctgttctacccctactgccaggccctgcagaccgagaaggaggcccccatcgccagcctgggcaagggctgccccgccaccctgcccagcaagagcagacagaagaccagacccctgatccccgagatgtgcttcaccagcggcggcgagaacaccgagcccctgcccgccaacagctacatcggcgacgacggcaccagccccctgatcgcctgcggcaagtgctgcctgcaggtgcacgccagctgctacggcatcagacccgagctggtgaacgagggctggacctgcagcagatgcgccgcccacgcctggaccgccgagtgctgcctgtgcaacctgagaggcggcgccctgcagatgaccaccgacagaagatggatccacgtgatctgcgccatcgccgtgcccgaggccagattcctgaacgtgatcgagagacaccccgtggacatcagcgccatccccgagcagagatggaagctgaagtgcgtgtactgcagaaagagaatgaagaaggtgagcggcgcctgcatccagtgcagctacgagcactgcagcaccagcttccacgtgacctgcgcccacgccgccggcgtgctgatggagcccgacgactggccctacgtggtgagcatcacctgcctgaagcacaagagcggcggccacgccgtgcagctgctgagagccgtgagcctgggccaggtggtgatcaccaagaacagaaacggcctgtactacagatgcagagtgatcggcgccgccagccagacctgctacgaggtgaacttcgacgacggcagctacagcgacaacctgtaccccgagagcatcaccagcagagactgcgtgcagctgggcccccccagcgagggcgagctggtggagctgagatggaccgacggcaacctgtacaaggccaagttcatcagcagcgtgaccagccacatctaccaggtggagttcgaggacggcagccagctgaccgtgaagagaggcgacatcttcaccctggaggaggagctgcccaagagagtgagaagcagactgagcctgagcaccggcgccccccaggagcccgccttcagcggcgaggaggccaaggccgccaagagacccagagtgggcacccccctggccaccgaggacagcggcagaagccaggactacgtggccttcgtggagagcctgctgcaggtgcagggcagacccggcgcccccttctag

SEQ ID NO: 8559 - DNA, 1347 bp, Artificial Sequence
  Description of Artificial Sequence: Synthetic coding sequence
atgggcagcgaggaccacggcgcccagaaccccagctgcaagatcatgaccttcagacccaccatggaggagttcaaggacttcaacaagtacgtggcctacatcgagagccagggcgcccacagagccggcctggccaagatcatcccccccaaggagtggaagcccagacagacctacgacgacatcgacgacgtggtgatccccgcccccatccagcaggtggtgaccggccagagcggcctgttcacccagtacaacatccagaagaaggccatgaccgtgggcgagtacagaagactggccaacagcgagaagtactgcacccccagacaccaggacttcgacgacctggagagaaagtactggaagaacctgaccttcgtgagccccatctacggcgccgacatcagcggcagcctgtacgacgacgacgtggcccagtggaacatcggcagcctgagaaccatcctggacatggtggagagagagtgcggcaccatcatcgagggcgtgaacaccccctacctgtacttcggcatgtggaagaccaccttcgcctggcacaccgaggacatggacctgtacagcatcaactacctgcacttcggcgagcccaagagctggtacgccatcccccccgagcacggcaagagactggagagactggccatcggcttcttccccggcagcagccagggctgcgacgccttcctgagacacaagatgaccctgatcagccccatcatcctgaagaagtacggcatccccttcagcagaatcacccaggaggccggcgagttcatgatcaccttcccctacggctaccacgccggcttcaaccacggcttcaactgcgccgagagcaccaacttcgccaccctgagatggatcgactacggcaaggtggccacccagtgcacctgcagaaaggacatggtgaagatcagcatggacgtgttcgtgagaatcctgcagcccgagagatacgagctgtggaagcagggcaaggacctgaccgtgctggaccacaccagacccaccgccctgaccagccccgagctgagcagctggagcgccagcagagccagcctgaaggccaagctgctgagaagaacccccccctgcgtgagcccccacagacccagccagcccggcatctggtgcccccccggcggcgaggccaaggccagcgccgccagctggctgctgaccaccagaggccacggcgacaccgaggccggccccggcctgggcggcgaccccctgcacgcccagagcgagggccaggccagctgcgtgagcaccagcagactgagaatggccacccaggacccctgcagatag

SEQ ID NO: 8560 - DNA, 3393 bp, Artificial Sequence
  Description of Artificial Sequence: Synthetic coding sequence
atgggcagcgaggaccacggcgcccagaaccccagctgcaagatcatgaccttcagacccaccatggaggagttcaaggacttcaacaagtacgtggcctacatcgagagccagggcgcccacagagccggcctggccaagatcatcccccccaaggagtggaagcccagacagacctacgacgacatcgacgacgtggtgatccccgcccccatccagcaggtggtgaccggccagagcggcctgttcacccagtacaacatccagaagaaggccatgaccgtgggcgagtacagaagactggccaacagcgagaagtactgcacccccagacaccaggacttcgacgacctggagagaaagtactggaagaacctgaccttcgtgagccccatctacggcgccgacatcagcggcagcctgtacgacgacgacgtggcccagtggaacatcggcagcctgagaaccatcctggacatggtggagagagagtgcggcaccatcatcgagggcgtgaacaccccctacctgtacttcggcatgtggaagaccaccttcgcctggcacaccgaggacatggacctgtacagcatcaactacctgcacttcggcgagcccaagagctggtacgccatcccccccgagcacggcaagagactggagagactggccatcggcttcttccccggcagcagccagggctgcgacgccttcctgagacacaagatgaccctgatcagccccatcatcctgaagaagtacggcatccccttcagcagaatcacccaggaggccggcgagttcatgatcaccttcccctacggctaccacgccggcttcaaccacggcttcaactgcgccgagagcaccaacttcgccaccctgagatggatcgactacggcaaggtggccacccagtgcacctgcagaaaggacatggtgaagatcagcatggacgtgttcgtgagaatcctgcagcccgagagatacgagctgtggaagcagggcaaggacctgaccgtgctggaccacaccagacccaccgccctgaccagccccgagctgagcagctggagcgccagcagagccagcctgaaggccaagctgctgagaagacagatcagcctgaaggagaacagacactggagaaagaccgaggaggagagaaagcccagcctggagagaaagaaggagcagaccaagagacccggcctgagcagccacagaaagagaagccagcccaagaagcccaagcccgaggaccccaagttccccggcgagggcaccgccggcgccgccctgctggaggaggccggcggcagcgtgaaggaggaggccggccccgaggtggaccccgaggaggaggaggaggagccccagcccctgccccacggcagagaggccgagggcgccgaggaggacggcagaggcaagctgagacccaccaaggccaagagcgagagaaagaagaagagcttcggcctgctgcccccccagctgccccccccccccgcccacttccccagcgaggaggccctgtggctgcccagccccctggagccccccgtgctgggccccggccccgccgccatggaggagagccccctgcccgcccccctgaacgtggtgccccccgaggtgcccagcgaggagctggaggccaagcccagacccatcatccccatgctgtacgtggtgcccagacccggcaaggccgccttcaaccaggagcacgtgagctgccagcaggccttcgagcacttcgcccagaagggccccacctggaaggagcccgtgagccccatggagctgaccggccccgaggacggcgccgccagcagcggcgccggcagaatggagaccaaggccagagccggcgagggccaggcccccagcaccttcagcaagctgaagatggagatcaagaagagcagaagacaccccctgggcagaccccccaccagaagccccctgagcgtggtgaagcaggaggccagcagcgacgaggaggccagccccttcagcggcgaggaggacgtgagcgaccccgacgccctgagacccctgctgagcctgcagtggaagaacagagccgccagcttccaggccgagagaaagttcaacgccgccgccgccagaaccgagccctactgcgccatctgcaccctgttctacccctactgccaggccctgcagaccgagaaggaggcccccatcgccagcctgggcaagggctgccccgccaccctgcccagcaagagcagacagaagaccagacccctgatccccgagatgtgcttcaccagcggcggcgagaacaccgagcccctgcccgccaacagctacatcggcgacgacggcaccagccccctgatcgcctgcggcaagtgctgcctgcaggtgcacgccagctgctacggcatcagacccgagctggtgaacgagggctggacctgcagcagatgcgccgcccacgcctggaccgccgagtgctgcctgtgcaacctgagaggcggcgccctgcagatgaccaccgacagaagatggatccacgtgatctgcgccatcgccgtgcccgaggccagattcctgaacgtgatcgagagacaccccgtggacatcagcgccatccccgagcagagatggaagctgaagtgcgtgtactgcagaaagagaatgaagaaggtgagcggcgcctgcatccagtgcagctacgagcactgcagcaccagcttccacgtgacctgcgcccacgccgccggcgtgctgatggagcccgacgactggccctacgtggtgagcatcacctgcctgaagcacaagagcggcggccacgccgtgcagctgctgagagccgtgagcctgggccaggtggtgatcaccaagaacagaaacggcctgtactacagatgcagagtgatcggcgccgccagccagacctgctacgaggtgaacttcgacgacggcagctacagcgacaacctgtaccccgagagcatcaccagcagagactgcgtgcagctgggcccccccagcgagggcgagctggtggagctgagatggaccgacggcaacctgtacaaggccaagttcatcagcagcgtgaccagccacatctaccaggtggagttcgaggacggcagccagctgaccgtgaagagaggcgacatcttcaccctggaggaggagctgcccaagagagtgagaagcagactgagcctgagcaccggcgccccccaggagcccgccttcagcggcgaggaggccaaggccgccaagagacccagagtgggcacccccctggccaccgaggacagcggcagaagccaggactacgtggccttcgtggagagcctgctgcaggtgcagggcagacccggcgcccccttctag

SEQ ID NO: 8561 - DNA, 3144 bp, Artificial Sequence
  Description of Artificial Sequence: Synthetic coding sequence
atggaggtggccgaggtggagagccccctgaaccccagctgcaagatcatgaccttcagacccagcatggaggagttcagagagttcaacaagtacctggcctacatggagagcaagggcgcccacagagccggcctggccaaggtgatcccccccaaggagtggaagcccagacagtgctacgacgacatcgacaacctgctgatccccgcccccatccagcagatggtgaccggccagagcggcctgttcacccagtacaacatccagaagaaggccatgaccgtgaaggagttcagacagctggccaacagcggcaagtactgcacccccagatacctggactacgaggacctggagagaaagtactggaagaacctgaccttcgtggcccccatctacggcgccgacatcaacggcagcatctacgacgagggcgtggacgagtggaacatcgccagactgaacaccgtgctggacgtggtggaggaggagtgcggcatcagcatcgagggcgtgaacaccccctacctgtacttcggcatgtggaagaccaccttcgcctggcacaccgaggacatggacctgtacagcatcaactacctgcacttcggcgagcccaagagctggtacgccatcccccccgagcacggcaagagactggagagactggcccagggcttcttccccagcagcagccagggctgcgacgccttcctgagacacaagatgaccctgatcagccccagcgtgctgaagaagtacggcatccccttcgacaagatcacccaggaggccggcgagttcatgatcaccttcccctacggctaccacgccggcttcaaccacggcttcaactgcgccgagagcaccaacttcgccaccgtgagatggatcgactacggcaaggtggccaagctgtgcacctgcagaaaggacatggtgaagatcagcatggacatcttcgtgagaaagttccagcccgacagataccagctgtggaagcagggcaaggacatctacaccatcgaccacaccaagcccacccccgccagcacccccgaggtgaaggcctggctgcagagaagaagaaaggtgagaaaggccagcagaagcttccagtgcgccagaagcaccagcaagagacccaaggccgacgaggaggaggaggtgagcgacgaggtggacggcgccgaggtgcccaaccccgacagcgtgaccgacgacctgaaggtgagcgagaagagcgaggccgccgtgaagctgagaaacaccgaggccagcagcgaggaggagagcagcgccagcagaatgcaggtggagcagaacctgagcgaccacatcaagctgagcggcaacagctgcctgagcaccagcgtgaccgaggacatcaagaccgaggacgacaaggcctacgcctacagaagcgtgcccagcatcagcagcgaggccgacgacagcatccccctgagcagcggctacgagaagcccgagaagagcgaccccagcgagctgagctggcccaagagccccgagagctgcagcagcgtggccgagagcaacggcgtgctgaccgagggcgaggagagcgacgtggagagccacggcaacggcctggagcccggcgagatccccgccgtgcccagcggcgagagaaacagcttcaaggtgcccagcatcgccgagggcgagaacaagaccagcaagagctggagacaccccctgagcagaccccccgccagaagccccatgaccctggtgaagcagcaggcccccagcgacgaggagctgcccgaggtgctgagcatcgaggaggaggtggaggagaccgagagctgggccaagcccctgatccacctgtggcagaccaagagccccaacttcgccgccgagcaggagtacaacgccaccgtggccagaatgaagccccactgcgccatctgcaccctgctgatgccctaccacaagcccgacagcagcaacgaggagaacgacgccagatgggagaccaagctggacgaggtggtgaccagcgagggcaagaccaagcccctgatccccgagatgtgcttcatctacagcgaggagaacatcgagtacagcccccccaacgccttcctggaggaggacggcaccagcctgctgatcagctgcgccaagtgctgcgtgagagtgcacgccagctgctacggcatccccagccacgagatctgcgacggctggctgtgcgccagatgcaagagaaacgcctggaccgccgagtgctgcctgtgcaacctgagaggcggcgccctgaagcagaccaagaacaacaagtgggcccacgtgatgtgcgccgtggccgtgcccgaggtgagattcaccaacgtgcccgagagaacccagatcgacgtgggcagaatccccctgcagagactgaagctgaagtgcatcttctgcagacacagagtgaagagagtgagcggcgcctgcatccagtgcagctacggcagatgccccgccagcttccacgtgacctgcgcccacgccgccggcgtgctgatggagcccgacgactggccctacgtggtgaacatcacctgcttcagacacaaggtgaaccccaacgtgaagagcaaggcctgcgagaaggtgatcagcgtgggccagaccgtgatcaccaagcacagaaacaccagatactacagctgcagagtgatggccgtgaccagccagaccttctacgaggtgatgttcgacgacggcagcttcagcagagacaccttccccgaggacatcgtgagcagagactgcctgaagctgggcccccccgccgagggcgaggtggtgcaggtgaagtggcccgacggcaagctgtacggcgccaagtacttcggcagcaacatcgcccacatgtaccaggtggagttcgaggacggcagccagatcgccatgaagagagaggacatctacaccctggacgaggagctgcccaagagagtgaaggccagattcgtgagcgccggcagatgccacctgggcacctgccaggtgaacagcctgagcagcccccacgtgagccaggcccagcaggagacctacctgggcttctggatcaacagcaagaagagccagtgcaacatcttcctgagcggcacctactag

SEQ ID NO: 8562 - DNA, 3171 bp, Artificial Sequence
  Description of Artificial Sequence: Synthetic coding sequence
atggaggtggccgaggtggagagccccctgaaccccagctgcaagatcatgaccttcagacccagcatggaggagttcagagagttcaacaagtacctggcctacatggagagcaagggcgcccacagagccggcctggccaaggtgatcccccccaaggagtggaagcccagacagtgctacgacgacatcgacaacctgctgatccccgcccccatccagcagatggtgaccggccagagcggcctgttcacccagtacaacatccagaagaaggccatgaccgtgaaggagttcagacagctggccaacagcggcaagtactgcacccccagatacctggactacgaggacctggagagaaagtactggaagaacctgaccttcgtggcccccatctacggcgccgacatcaacggcagcatctacgacgagggcgtggacgagtggaacatcgccagactgaacaccgtgctggacgtggtggaggaggagtgcggcatcagcatcgagggcgtgaacaccccctacctgtacttcggcatgtggaagaccaccttcgcctggcacaccgaggacatggacctgtacagcatcaactacctgcacttcggcgagcccaagagctggtacgccatcccccccgagcacggcaagagactggagagactggcccagggcttcttccccagcagcagccagggctgcgacgccttcctgagacacaagatgaccctgatcagccccagcgtgctgaagaagtacggcatccccttcgacaagatcacccaggaggccggcgagttcatgatcaccttcccctacggctaccacgccggcttcaaccacggcttcaactgcgccgagagcaccaacttcgccaccgtgagatggatcgactacggcaaggtggccaagctgtgcacctgcagaaaggacatggtgaagatcagcatggacatcttcgtgagaaagttccagcccgacagataccagctgtggaagcagggcaaggacatctacaccatcgaccacaccaagcccacccccgccagcacccccgaggtgaaggcctggctgcagagaagaagaaaggtgagaaaggccagcagaagcttccagtgcgccagaagcaccagcaagagacccaaggccgacgaggaggaggaggtgagcgacgaggtggacggcgccgaggtgcccaaccccgacagcgtgaccgacgacctgaaggtgagcgagaagagcgaggccgccgtgaagctgagaaacaccgaggccagcagcgaggaggagagcagcgccagcagaatgcaggtggagcagaacctgagcgaccacatcaagctgagcggcaacagctgcctgagcaccagcgtgaccgaggacatcaagaccgaggacgacaaggcctacgcctacagaagcgtgcccagcatcagcagcgaggccgacgacagcatccccctgagcagcggctacgagaagcccgagaagagcgaccccagcgagctgagctggcccaagagccccgagagctgcagcagcgtggccgagagcaacggcgtgctgaccgagggcgaggagagcgacgtggagagccacggcaacggcctggagcccggcgagatccccgccgtgcccagcggcgagagaaacagcttcaaggtgcccagcatcgccgagggcgagaacaagaccagcaagagctggagacaccccctgagcagaccccccgccagaagccccatgaccctggtgaagcagcaggcccccagcgacgaggagctgcccgaggtgctgagcatcgaggaggaggtggaggagaccgagagctgggccaagcccctgatccacctgtggcagaccaagagccccaacttcgccgccgagcaggagtacaacgccaccgtggccagaatgaagccccactgcgccatctgcaccctgctgatgccctaccacaagcccgacagcagcaacgaggagaacgacgccagatgggagaccaagctggacgaggtggtgaccagcgagggcaagaccaagcccctgatccccgagatgtgcttcatctacagcgaggagaacatcgagtacagcccccccaacgccttcctggaggaggacggcaccagcctgctgatcagctgcgccaagtgctgcgtgagagtgcacgccagctgctacggcatccccagccacgagatctgcgacggctggctgtgcgccagatgcaagagaaacgcctggaccgccgagtgctgcctgtgcaacctgagaggcggcgccctgaagcagaccaagaacaacaagtgggcccacgtgatgtgcgccgtggccgtgcccgaggtgagattcaccaacgtgcccgagagaacccagatcgacgtgggcagaatccccctgcagagactgaagctgaagtgcatcttctgcagacacagagtgaagagagtgagcggcgcctgcatccagtgcagctacggcagatgccccgccagcttccacgtgacctgcgcccacgccgccggcgtgctgatggagcccgacgactggccctacgtggtgaacatcacctgcttcagacacaaggtgaaccccaacgtgaagagcaaggcctgcgagaaggtgatcagcgtgggccagaccgtgatcaccaagcacagaaacaccagatactacagctgcagagtgatggccgtgaccagccagaccttctacgaggtgatgttcgacgacggcagcttcagcagagacaccttccccgaggacatcgtgagcagagactgcctgaagctgggcccccccgccgagggcgaggtggtgcaggtgaagtggcccgacggcaagctgtacggcgccaagtacttcggcagcaacatcgcccacatgtaccaggtggagttcgaggacggcagccagatcgccatgaagagagaggacatctacaccctggacgaggagctgcccaagagagtgaaggccagattcagcaccgccagcgacatgagattcgaggacaccttctacggcgccgacatcatccagggcgagagaaagagacagagagtgctgagcagcagattcaagaacgagtacgtggccgaccccgtgtacagaaccttcctgaagagcagcttccagaagaagtgccagaagagacagtag

SEQ ID NO: 8563 - DNA, 1065 bp, Artificial Sequence
  Description of Artificial Sequence: Synthetic coding sequence
cccgacagcagcaacgaggagaacgacgccagatgggagaccaagctggacgaggtggtgaccagcgagggcaagaccaagcccctgatccccgagatgtgcttcatctacagcgaggagaacatcgagtacagcccccccaacgccttcctggaggaggacggcaccagcctgctgatcagctgcgccaagtgctgcgtgagagtgcacgccagctgctacggcatccccagccacgagatctgcgacggctggctgtgcgccagatgcaagagaaacgcctggaccgccgagtgctgcctgtgcaacctgagaggcggcgccctgaagcagaccaagaacaacaagtgggcccacgtgatgtgcgccgtggccgtgcccgaggtgagattcaccaacgtgcccgagagaacccagatcgacgtgggcagaatccccctgcagagactgaagctgaagtgcatcttctgcagacacagagtgaagagagtgagcggcgcctgcatccagtgcagctacggcagatgccccgccagcttccacgtgacctgcgcccacgccgccggcgtgctgatggagcccgacgactggccctacgtggtgaacatcacctgcttcagacacaaggtgaaccccaacgtgttcaccgcccagagcaagcacagcaagaacgagagctgcatcgccaccaccaccagcgccgccgccgccggcgccaccatcctgtgcgagctgggccacaagagcaaggcctgcgagaaggtgatcagcgtgggccagaccgtgatcaccaagcacagaaacaccagatactacagctgcagagtgatggccgtgaccagccagaccttctacgaggtgatgttcgacgacggcagcttcagcagagacaccttccccgaggacatcgtgagcagagactgcctgaagctgggcccccccgccgagggcgaggtggtgcaggtgaagtggcccgacggcaagctgtacggcgccaagtacttcggcagcaacatcgcccacatgtaccaggtggagttcgaggacggcagccagatcgcctag

SEQ ID NO: 8564 - DNA, 2232 bp, Artificial Sequence
  Description of Artificial Sequence: Synthetic coding sequence
atggtgaagatcagcatggacatcttcgtgagaaagttccagcccgacagataccagctgtggaagcagggcaaggacatctacaccatcgaccacaccaagcccacccccgccagcacccccgaggtgaaggcctggctgcagagaagaagaaaggtgagaaaggccagcagaagcttccagtgcgccagaagcaccagcaagagacccaaggccgacgaggaggaggaggtgagcgacgaggtggacggcgccgaggtgcccaaccccgacagcgtgaccgacgacctgaaggtgagcgagaagagcgaggccgccgtgaagctgagaaacaccgaggccagcagcgaggaggagagcagcgccagcagaatgcaggtggagcagaacctgagcgaccacatcaagctgagcggcaacagctgcctgagcaccagcgtgaccgaggacatcaagaccgaggacgacaaggcctacgcctacagaagcgtgcccagcatcagcagcgaggccgacgacagcatccccctgagcagcggctacgagaagcccgagaagagcgaccccagcgagctgagctggcccaagagccccgagagctgcagcagcgtggccgagagcaacggcgtgctgaccgagggcgaggagagcgacgtggagagccacggcaacggcctggagcccggcgagatccccgccgtgcccagcggcgagagaaacagcttcaaggtgcccagcatcgccgagggcgagaacaagaccagcaagagctggagacaccccctgagcagaccccccgccagaagccccatgaccctggtgaagcagcaggcccccagcgacgaggagctgcccgaggtgctgagcatcgaggaggaggtggaggagaccgagagctgggccaagcccctgatccacctgtggcagaccaagagccccaacttcgccgccgagcaggagtacaacgccaccgtggccagaatgaagccccactgcgccatctgcaccctgctgatgccctaccacaagcccgacagcagcaacgaggagaacgacgccagatgggagaccaagctggacgaggtggtgaccagcgagggcaagaccaagcccctgatccccgagatgtgcttcatctacagcgaggagaacatcgagtacagcccccccaacgccttcctggaggaggacggcaccagcctgctgatcagctgcgccaagtgctgcgtgagagtgcacgccagctgctacggcatccccagccacgagatctgcgacggctggctgtgcgccagatgcaagagaaacgcctggaccgccgagtgctgcctgtgcaacctgagaggcggcgccctgaagcagaccaagaacaacaagtgggcccacgtgatgtgcgccgtggccgtgcccgaggtgagattcaccaacgtgcccgagagaacccagatcgacgtgggcagaatccccctgcagagactgaagctgaagtgcatcttctgcagacacagagtgaagagagtgagcggcgcctgcatccagtgcagctacggcagatgccccgccagcttccacgtgacctgcgcccacgccgccggcgtgctgatggagcccgacgactggccctacgtggtgaacatcacctgcttcagacacaaggtgaaccccaacgtgaagagcaaggcctgcgagaaggtgatcagcgtgggccagaccgtgatcaccaagcacagaaacaccagatactacagctgcagagtgatggccgtgaccagccagaccttctacgaggtgatgttcgacgacggcagcttcagcagagacaccttccccgaggacatcgtgagcagagactgcctgaagctgggcccccccgccgagggcgaggtggtgcaggtgaagtggcccgacggcaagctgtacggcgccaagtacttcggcagcaacatcgcccacatgtaccaggtggagttcgaggacggcagccagatcgccatgaagagagaggacatctacaccctggacgaggagctgcccaagagagtgaaggccagattcagcaccgccagcgacatgagattcgaggacaccttctacggcgccgacatcatccagggcgagagaaagagacagagagtgctgagcagcagattcaagaacgagtacgtggccgaccccgtgtacagaaccttcctgaagagcagcttccagaagaagtgccagaagagacagtag

SEQ ID NO: 8565 - DNA, 2406 bp, Artificial Sequence
  Description of Artificial Sequence: Synthetic coding sequence
atgtggaagaccaccttcgcctggcacaccgaggacatggacctgtacagcatcaactacctgcacttcggcgagcccaagagctggtacgccatcccccccgagcacggcaagagactggagagactggcccagggcttcttccccagcagcagccagggctgcgacgccttcctgagacacaagatgaccctgatcagccccagcgtgctgaagaagtacggcatccccttcgacaagatcacccaggaggccggcgagttcatgatcaccttcccctacggctaccacgccggcttcaaccacggcttcaactgcgccgagagcaccaacttcgccaccgtgagatggatcgactacggcaaggtggccaagctgtgcacctgcagaaaggacatggtgaagatcagcatggacatcttcgtgagaaagttccagcccgacagataccagctgtggaagcagggcaaggacatctacaccatcgaccacaccaagcccacccccgccagcacccccgaggtgaaggcctggctgcagagaagaagaaaggtgagaaaggccagcagaagcttccagtgcgccagaagcaccagcaagagacccaaggccgacgaggaggaggaggtgagcgacgaggtggacggcgccgaggtgcccaaccccgacagcgtgaccgacgacctgaaggtgagcgagaagagcgaggccgccgtgaagctgagaaacaccgaggccagcagcgaggaggagagcagcgccagcagaatgcaggtggagcagaacctgagcgaccacatcaagctgagcggcaacagctgcctgagcaccagcgtgaccgaggacatcaagaccgaggacgacaaggcctacgcctacagaagcgtgcccagcatcagcagcgaggccgacgacagcatccccctgagcagcggctacgagaagcccgagaagagcgaccccagcgagctgagctggcccaagagccccgagagctgcagcagcgtggccgagagcaacgagctgcccgaggtgctgagcatcgaggaggaggtggaggagaccgagagctgggccaagcccctgatccacctgtggcagaccaagagccccaacttcgccgccgagcaggagtacaacgccaccgtggccagaatgaagccccactgcgccatctgcaccctgctgatgccctaccacaagcccgacagcagcaacgaggagaacgacgccagatgggagaccaagctggacgaggtggtgaccagcgagggcaagaccaagcccctgatccccgagatgtgcttcatctacagcgaggagaacatcgagtacagcccccccaacgccttcctggaggaggacggcaccagcctgctgatcagctgcgccaagtgctgcgtgagagtgcacgccagctgctacggcatccccagccacgagatctgcgacggctggctgtgcgccagatgcaagagaaacgcctggaccgccgagtgctgcctgtgcaacctgagaggcggcgccctgaagcagaccaagaacaacaagtgggcccacgtgatgtgcgccgtggccgtgcccgaggtgagattcaccaacgtgcccgagagaacccagatcgacgtgggcagaatccccctgcagagactgaagctgaagtgcatcttctgcagacacagagtgaagagagtgagcggcgcctgcatccagtgcagctacggcagatgccccgccagcttccacgtgacctgcgcccacgccgccggcgtgctgatggagcccgacgactggccctacgtggtgaacatcacctgcttcagacacaaggtgaaccccaacgtgaagagcaaggcctgcgagaaggtgatcagcgtgggccagaccgtgatcaccaagcacagaaacaccagatactacagctgcagagtgatggccgtgaccagccagaccttctacgaggtgatgttcgacgacggcagcttcagcagagacaccttccccgaggacatcgtgagcagagactgcctgaagctgggcccccccgccgagggcgaggtggtgcaggtgaagtggcccgacggcaagctgtacggcgccaagtacttcggcagcaacatcgcccacatgtaccaggtggagttcgaggacggcagccagatcgccatgaagagagaggacatctacaccctggacgaggagctgcccaagagagtgaaggccagattcagcaccgccagcgacatgagattcgaggacaccttctacggcgccgacatcatccagggcgagagaaagagacagagagtgctgagcagcagattcaagaacgagtacgtggccgaccccgtgtacagaaccttcctgaagagcagcttccagaagaagtgccagaagagacagtag

SEQ ID NO: 8566 - DNA, 2508 bp, Artificial Sequence
  Description of Artificial Sequence: Synthetic coding sequence
atgaagcactacggcctgccctggaagagaaccgaggaggccgccgccgacaccgccctgaccatcatggaggtggccgaggtggagagccccctgaaccccagctgcaagatcatgaccttcagacccagcatggaggagttcagagagttcaacaagtacctggcctacatggagagcaagggcgcccacagagccggcctggccaaggtgatcccccccaaggagtggaagcccagacagtgctacgacgacatcgacaacctgctgatccccgcccccatccagcagatggtgaccggccagagcggcctgttcacccagtacaacatccagaagaaggccatgaccgtgaaggagttcagacagctggccaacagcggcaagtactgcacccccagatacctggactacgaggacctggagagaaagtactggaagaacctgaccttcgtggcccccatctacggcgccgacatcaacggcagcatctacgacgagggcgtggacgagtggaacatcgccagactgaacaccgtgctggacgtggtggaggaggagtgcggcatcagcatcgagggcgtgaacaccccctacctgtacttcggcatgtggaagaccaccttcgcctggcacaccgaggacatggacctgtacagcatcaactacctgcacttcggcgagcccaagagctggtacgccatcccccccgagcacggcaagagactggagagactggcccagggcttcttccccagcagcagccagggctgcgacgccttcctgagacacaagatgaccctgatcagccccagcgtgctgaagaagtacggcatccccttcgacaagatcacccaggaggccggcgagttcatgatcaccttcccctacggctaccacgccggcttcaaccacggcttcaactgcgccgagagcaccaacttcgccaccgtgagatggatcgactacggcaaggtggccaagctgtgcacctgcagaaaggacatggtgaagatcagcatggacatcttcgtgagaaagttccagcccgacagataccagctgtggaagcagggcaaggacatctacaccatcgaccacaccaagcccacccccgccagcacccccgaggtgaaggcctggctgcagagaagaagaaaggtgagaaaggccagcagaagcttccagtgcgccagaagcaccagcaagagacccaaggccgacgaggaggaggaggtgagcgacgaggtggacggcgccgaggtgcccaaccccgacagcgtgaccgacgacctgaaggtgagcgagaagagcgaggccgccgtgaagctgagaaacaccgaggccagcagcgaggaggagagcagcgccagcagaatgcaggtggagcagaacctgagcgaccacatcaagctgagcggcaacagctgcctgagcaccagcgtgaccgaggacatcaagaccgaggacgacaaggcctacgcctacagaagcgtgcccagcatcagcagcgaggccgacgacagcatccccctgagcagcggctacgagaagcccgagaagagcgaccccagcgagctgagctggcccaagagccccgagagctgcagcagcgtggccgagagcaacggcgtgctgaccgagggcgaggagagcgacgtggagagccacggcaacggcctggagcccggcgagatccccgccgtgcccagcggcgagagaaacagcttcaaggtgcccagcatcgccgagggcgagaacaagaccagcaagagctggagacaccccctgagcagaccccccgccagaagccccatgaccctggtgaagcagcaggcccccagcgacgaggagctgcccgaggtgctgagcatcgaggaggaggtggaggagaccgagagctgggccaagcccctgatccacctgtggcagaccaagagccccaacttcgccgccgagcaggagtacaacgccaccgtggccagaatgaagccccactgcgccatctgcaccctgctgatgccctaccacaagcccgacagcagcaacgaggagaacgacgccagatgggagaccaagctggacgaggtggtgaccagcgagggcaagaccaagcccctgatccccgagatgtgcttcatctacagcgaggagaacatcgagtacagcccccccaacgccttcctggaggaggacggcaccagcctgctgatcagctgcgccaagtgctgcgtgagagtgcacgccagctgctacggcatccccagccacgagatctgcgacggctggctgtgcgccagatgcaagagaaacgcctggaccgccgagtgctgcctgtgcaacctgagaggcggcgccctgaagcagaccaagaacaacaagtgggcccacgtgatgtgcgccgtggccgtgcccgaggtgagattcaccaacgtgcccgagagaacccagatcgacgtgggcagaatccccctgcagagactgaagctgggcagactgggcatctag

SEQ ID NO: 8567 - DNA, 1890 bp, Artificial Sequence
  Description of Artificial Sequence: Synthetic coding sequence
atgtggaagaccaccttcgcctggcacaccgaggacatggacctgtacagcatcaactacctgcacttcggcgagcccaagagctggtacgccatcccccccgagcacggcaagagactggagagactggcccagggcttcttccccagcagcagccagggctgcgacgccttcctgagacacaagatgaccctgatcagccccagcgtgctgaagaagtacggcatccccttcgacaagatcacccaggaggccggcgagttcatgatcaccttcccctacggctaccacgccggcttcaaccacggcttcaactgcgccgagagcaccaacttcgccaccgtgagatggatcgactacggcaaggtggccaagctgtgcacctgcagaaaggacatggtgaagatcagcatggacatcttcgtgagaaagttccagcccgacagataccagctgtggaagcagggcaaggacatctacaccatcgaccacaccaagcccacccccgccagcacccccgaggtgaaggcctggctgcagagaagaagaaaggtgagaaaggccagcagaagcttccagtgcgccagaagcaccagcaagagacccaaggccgacgaggaggaggaggtgagcgacgaggtggacggcgccgaggtgcccaaccccgacagcgtgaccgacgacctgaaggtgagcgagaagagcgaggccgccgtgaagctgagaaacaccgaggccagcagcgaggaggagagcagcgccagcagaatgcaggtggagcagaacctgagcgaccacatcaagctgagcggcaacagctgcctgagcaccagcgtgaccgaggacatcaagaccgaggacgacaaggcctacgcctacagaagcgtgcccagcatcagcagcgaggccgacgacagcatccccctgagcagcggctacgagaagcccgagaagagcgaccccagcgagctgagctggcccaagagccccgagagctgcagcagcgtggccgagagcaacggcgtgctgaccgagggcgaggagagcgacgtggagagccacggcaacggcctggagcccggcgagatccccgccgtgcccagcggcgagagaaacagcttcaaggtgcccagcatcgccgagggcgagaacaagaccagcaagagctggagacaccccctgagcagaccccccgccagaagccccatgaccctggtgaagcagcaggcccccagcgacgaggagctgcccgaggtgctgagcatcgaggaggaggtggaggagaccgagagctgggccaagcccctgatccacctgtggcagaccaagagccccaacttcgccgccgagcaggagtacaacgccaccgtggccagaatgaagccccactgcgccatctgcaccctgctgatgccctaccacaagcccgacagcagcaacgaggagaacgacgccagatgggagaccaagctggacgaggtggtgaccagcgagggcaagaccaagcccctgatccccgagatgtgcttcatctacagcgaggagaacatcgagtacagcccccccaacgccttcctggaggaggacggcaccagcctgctgatcagctgcgccaagtgctgcgtgagagtgcacgccagctgctacggcatccccagccacgagatctgcgacggctggctgtgcgccagatgcaagagaaacgcctggaccgccgagtgctgcctgtgcaacctgagaggcggcgccctgaagcagaccaagaacaacaagaacgccagcagcgccgacaccggcctgagaggcagcctggagcccgccagcagcgtgcccaccgtggccgccagaccccccagcatgagcctggtgcccatgctgctgggctactag

SEQ ID NO: 8568 - DNA, 2442 bp, Artificial Sequence
  Description of Artificial Sequence: Synthetic coding sequence
atggaggtggccgaggtggagagccccctgaaccccagctgcaagatcatgaccttcagacccagcatggaggagttcagagagttcaacaagtacctggcctacatggagagcaagggcgcccacagagccggcctggccaaggtgatcccccccaaggagtggaagcccagacagtgctacgacgacatcgacaacctgctgatccccgcccccatccagcagatggtgaccggccagagcggcctgttcacccagtacaacatccagaagaaggccatgaccgtgaaggagttcagacagctggccaacagcggcaagtactgcacccccagatacctggactacgaggacctggagagaaagtactggaagaacctgaccttcgtggcccccatctacggcgccgacatcaacggcagcatctacgacgagggcgtggacgagtggaacatcgccagactgaacaccgtgctggacgtggtggaggaggagtgcggcatcagcatcgagggcgtgaacaccccctacctgtacttcggcatgtggaagaccaccttcgcctggcacaccgaggacatggacctgtacagcatcaactacctgcacttcggcgagcccaagagctggtacgccatcccccccgagcacggcaagagactggagagactggcccagggcttcttccccagcagcagccagggctgcgacgccttcctgagacacaagatgaccctgatcagccccagcgtgctgaagaagtacggcatccccttcgacaagatcacccaggaggccggcgagttcatgatcaccttcccctacggctaccacgccggcttcaaccacggcttcaactgcgccgagagcaccaacttcgccaccgtgagatggatcgactacggcaaggtggccaagctgtgcacctgcagaaaggacatggtgaagatcagcatggacatcttcgtgagaaagttccagcccgacagataccagctgtggaagcagggcaaggacatctacaccatcgaccacaccaagcccacccccgccagcacccccgaggtgaaggcctggctgcagagaagaagaaaggtgagaaaggccagcagaagcttccagtgcgccagaagcaccagcaagagacccaaggccgacgaggaggaggaggtgagcgacgaggtggacggcgccgaggtgcccaaccccgacagcgtgaccgacgacctgaaggtgagcgagaagagcgaggccgccgtgaagctgagaaacaccgaggccagcagcgaggaggagagcagcgccagcagaatgcaggtggagcagaacctgagcgaccacatcaagctgagcggcaacagctgcctgagcaccagcgtgaccgaggacatcaagaccgaggacgacaaggcctacgcctacagaagcgtgcccagcatcagcagcgaggccgacgacagcatccccctgagcagcggctacgagaagcccgagaagagcgaccccagcgagctgagctggcccaagagccccgagagctgcagcagcgtggccgagagcaacggcgtgctgaccgagggcgaggagagcgacgtggagagccacggcaacggcctggagcccggcgagatccccgccgtgcccagcggcgagagaaacagcttcaaggtgcccagcatcgccgagggcgagaacaagaccagcaagagctggagacaccccctgagcagaccccccgccagaagccccatgaccctggtgaagcagcaggcccccagcgacgaggagctgcccgaggtgctgagcatcgaggaggaggtggaggagaccgagagctgggccaagcccctgatccacctgtggcagaccaagagccccaacttcgccgccgagcaggagtacaacgccaccgtggccagaatgaagccccactgcgccatctgcaccctgctgatgccctaccacaagcccgacagcagcaacgaggagaacgacgccagatgggagaccaagctggacgaggtggtgaccagcgagggcaagaccaagcccctgatccccgagatgtgcttcatctacagcgaggagaacatcgagtacagcccccccaacgccttcctggaggaggacggcaccagcctgctgatcagctgcgccaagtgctgcgtgagagtgcacgccagctgctacggcatccccagccacgagatctgcgacggctggctgtgcgccagatgcaagagaaacgcctggaccgccgagtgctgcctgtgcaacctgagaggcggcgccctgaagcagaccaagaacaacaagtgggcccacgtgatgtgcgccgtggccgtgcccgaggtgagattcaccaacgtgcccgagagaacccagatcgacgtgggcagaatccccctgcagagactgaagctgggcagactgggcatctag

SEQ ID NO: 8569 - DNA, 1572 bp, Artificial Sequence
  Description of Artificial Sequence: Synthetic coding sequence
atggagaccatgaagagcaaggccaactgcgcccagaaccccaactgcaacatcatgatcttccaccccaccaaggaggagttcaacgacttcgacaagtacatcgcctacatggagagccagggcgcccacagagccggcctggccaagatcatcccccccaaggagtggaaggccagagagacctacgacaacatcagcgagatcctgatcgccacccccctgcagcaggtggccagcggcagagccggcgtgttcacccagtaccacaagaagaagaaggccatgaccgtgggcgagtacagacacctggccaacagcaagaagtaccagacccccccccaccagaacttcgaggacctggagagaaagtactggaagaacagaatctacaacagccccatctacggcgccgacatcagcggcagcctgttcgacgagaacaccaagcagtggaacctgggccacctgggcaccatccaggacctgctggagaaggagtgcggcgtggtgatcgagggcgtgaacaccccctacctgtacttcggcatgtggaagaccaccttcgcctggcacaccgaggacatggacctgtacagcatcaactacctgcacctgggcgagcccaagacctggtacgtggtgccccccgagcacggccagagactggagagactggccagagagctgttccccggcagcagcagaggctgcggcgccttcctgagacacaaggtggccctgatcagccccaccgtgctgaaggagaacggcatccccttcaacagaatcacccaggaggccggcgagttcatggtgaccttcccctacggctaccacgccggcttcaaccacggcttcaactgcgccgaggccatcaacttcgccacccccagatggatcgactacggcaagatggccagccagtgcagctgcggcgaggccagagtgaccttcagcatggacgccttcgtgagaatcctgcagcccgagagatacgacctgtggaagagaggccaggacagagccgtggtggaccacatggagcccagagtgcccgccagccaggagctgagcacccagaaggaggtgcagctgcccagaagagccgccctgggcctgagacagctgcccagccactgggccagacacagcccctggcccatggccgccagaagcggcaccagatgccacaccctggtgtgcagcagcctgcccagaagaagcgccgtgagcggcaccgccacccagcccagagccgccgccgtgcacagcagcaagaagcccagcagcacccccagcagcacccccggccccagcgcccagatcatccaccccagcaacggcagaagaggcagaggcagacccccccagaagctgagagcccaggagctgaccctgcagacccccgccaagagacccctgctggccggcaccacctgcaccgccagcggccccgagcccgagcccctgcccgaggacggcgccctgatggacaagcccgtgcccctgagccccggcctgcagcaccccgtgaaggccagcggctgcagctgggcccccgtgccctag

SEQ ID NO: 8570 - DNA, 1521 bp, Artificial Sequence
  Description of Artificial Sequence: Synthetic coding sequence
atgaagagcgtgcacagcagcccccagaacaccagccacaccatcatgaccttctaccccaccatggaggagttcgccgacttcaacacctacgtggcctacatggagagccagggcgcccaccaggccggcctggccaaggtgatcccccccaaggagtggaaggccagacagatgtacgacgacatcgaggacatcctgatcgccacccccctgcagcaggtgaccagcggccagggcggcgtgttcacccagtaccacaagaagaagaaggccatgagagtgggccagtacagaagactggccaacagcaagaagtaccagacccccccccaccagaacttcgccgacctggagcagagatactggaagagccaccccggcaacccccccatctacggcgccgacatcagcggcagcctgttcgaggagagcaccaagcagtggaacctgggccacctgggcaccatcctggacctgctggagcaggagtgcggcgtggtgatcgagggcgtgaacaccccctacctgtacttcggcatgtggaagaccaccttcgcctggcacaccgaggacatggacctgtacagcatcaactacctgcacttcggcgagcccaagacctggtacgtggtgccccccgagcacggccagcacctggagagactggccagagagctgttccccgacatcagcagaggctgcgaggccttcctgagacacaaggtggccctgatcagccccaccgtgctgaaggagaacggcatccccttcaactgcatgacccaggaggccggcgagttcatggtgaccttcccctacggctaccacgccggcttcaaccacggcttcaactgcgccgaggccatcaacttcgccacccccagatggatcgactacggcaagatggccagccagtgcagctgcggcgagagcaccgtgaccttcagcatggaccccttcgtgagaatcgtgcagcccgagagctacgagctgtggaagcacagacaggacctggccatcgtggagcacaccgagcccagagtggccgagagccaggagctgagcaactggagagacgacatcgtgctgagaagagccgccctgggcctgagactgctgcccaacctgaccgcccagtgccccacccagcccgtgagcagcggccactgctacaaccccaagggctgcggcaccgacgccgtgcccggcagcgccttccagagcagcgcctaccacacccagacccagagcctgaccctgggcatgagcgccagagtgctgctgcccagcaccggcagctggggcagcggcagaggcagaggcagaggccagggccagggcagaggctgcagcagaggcagaggccacggctgctgcaccagagagctgggcaccgaggagcccaccgtgcagcccgccagcaagagaagactgctgatgggcaccagaagcagagcccagggccacagaccccagctgcccctggccaacgacctgatgaccaacctgagcctgtag

SEQ ID NO: 8571 - DNA, 1080 bp, Artificial Sequence
  Description of Artificial Sequence: Synthetic coding sequence
atgatcgccgcccaggccaagctggtgtaccagctgaacaagtactacaccgagagatgccaggccagaaaggccgccatcgccaagaccatcagagaggtgtgcaaggtggtgagcgacgtgctgaaggaggtggaggtgcaggagcccagattcatcagcagcctgagcgagatcgacgccagatacgagggcctggaggtgatcagccccaccgagttcgaggtggtgctgtacctgaaccagatgggcgtgttcaacttcgtggacgacggcagcctgcccggctgcgccgtgctgaagctgagcgacggcagaaagagaagcatgagcctgtgggtggagttcatcaccgccagcggctacctgagcgccagaaagatcagaagcagattccagaccctggtggcccaggccgtggacaagtgcagctacagagacgtggtgaagatgatcgccgacaccagcgaggtgaagctgagaatcagagagagatacgtggtgcagatcacccccgccttcaagtgcaccggcatctggcccagaagcgccgcccagtggcccatgccccacatcccctggcccggccccaacagagtggccgaggtgaaggccgagggcttcaacctgctgagcaaggagtgctacagcctgaccggcaagcagagcagcgccgagagcgacgcctgggtgctgcagttcggcgaggccgagaacagactgctgatgggcggctgcagaaacaagtgcctgagcgtgctgaagaccctgagagacagacacctggagctgcccggccagcccctgaacaactaccacatgaagaccctgctgctgtacgagtgcgagaagcaccccagagagaccgactgggacgagagctgcctgggcgacagactgaacggcatcctgctgcagctgatcagctgcctgcagtgcagaagatgcccccactacttcctgcccaacctggacctgttccagggcaagccccacagcgccctggagagcgccgccaagcagacctggagactggccagagagatcctgaccaaccccaagagcctggacaagctgtag

SEQ ID NO: 8572 - DNA, 447 bp, Artificial Sequence
  Description of Artificial Sequence: Synthetic coding sequence
atggccgtggccagcgacttctacctgagatactacgtgggccacaagggcaagttcggccacgagttcctggagttcgagttcagacccgacggcaagctgagatacgccaacaacagcaactacaagaacgacgtgatgatcagaaaggaggcctacgtgcacaagagcgtgatggaggagctgaagagaatcatcgacgacagcgagatcaccaaggaggacgacgccctgtggcccccccccgacagagtgggcagacaggagctggagatcgtgatcggcgacgagcacatcagcttcaccaccagcaagatcggcagcctgatcgacgtgaaccagagcaaggaccccgagggcctgagagtgttctactacctggtgcaggacctgaagtgcctggtgttcagcctgatcggcctgcacttcaagatcaagcccatctag

SEQ ID NO: 8573 - DNA, 336 bp, Artificial Sequence
  Description of Artificial Sequence: Synthetic coding sequence
atggccgtggccagcgacttctacctgagatactacgtgggccacaagggcaagttcggccacgagttcctggagttcgagttcagacccgacggcaagctgagatacgccaacaacagcaactacaagaacgacgtgatgatcagaaaggaggagctggagatcgtgatcggcgacgagcacatcagcttcaccaccagcaagatcggcagcctgatcgacgtgaaccagagcaaggaccccgagggcctgagagtgttctactacctggtgcaggacctgaagtgcctggtgttcagcctgatcggcctgcacttcaagatcaagcccatctag

SEQ ID NO: 8574 - DNA, 1041 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagtacgtggacgacacccagttcctgagattcgacagcgacgccgccatccccagaatggagcccagagagccctgggtggagcaggagggcccccagtactgggagtggaccaccggctacgccaaggccaacgcccagaccgacagagtggccctgagaaacctgctgagaagatacaaccagagcgaggccggcagccacaccctgcagggcatgaacggctgcgacatgggccccgacggcagactgctgagaggctaccaccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgcccagcggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgacagaaacagaggcagctacagccaggccgccgtgtag

SEQ ID NO: 8575 - DNA, 903 bp, Artificial Sequence
  Description of Artificial Sequence: Synthetic coding sequence
atgcagagcgacgacgtgatctgggacaccctgggcaacaagcagttctgcagcttcaagatcagaaccaagacccagagcttctgcagaaacgagtacagcctgaccggcctgtgcaacagaagcagctgccccctggccaacagccagtacgccaccatcaaggaggagaagggccagtgctacctgtacatgaaggtgatcgagagagccgccttccccagaagactgtgggagagagtgagactgagcaagaactacgagaaggccctggagcagatcgacgagaacctgatctactggcccagattcatcagacacaagtgcaagcagagattcaccaagatcacccagtacctgatcagaatcagaaagctgaccctgaagagacagagaaagctggtgcccctgagcaagaaggtggagagaagagagaagagaagagaggagaaggccctgatcgccgcccagctggacaacgccatcgagaaggagctgctggagagactgaagcaggacacctacggcgacatctacaacttccccatccacgccttcgacaaggccctggagcagcaggaggccgagagcgacagcagcgacaccgaggagaaggacgacgacgacgacgacgaggaggacgtgggcaagagagagttcgtggaggacggcgaggtggacgagagcgacatcagcgacttcgaggacatggacaagctggacgccagcagcgacgaggaccaggacggcaagagcagcagcgaggaggaggaggagaaggccctgagcgccaagcacaagggcaagatgcccctgagaggccccctgcagagaaagagagcctacgtggagatcgagtacgagcaggagaccgagcccgtggccaaggccaagaccacctag

SEQ ID NO: 8576 - DNA, 1056 bp, Artificial Sequence
  Description of Artificial Sequence: Synthetic coding sequence
atggagagaagaatgcagctggtgaagaaggacaacgagaaggagagacacaagctgttccagggctacgagaccgaggagagagaggagaccgagctgagcgagaagatcaagctggagtgccagcccgagctgagcgagaccagccagaccctgccccccaagcccttcagctgcggcagaagcggcaagggccacaagagaaagagccccttcggcagcaccgagagaaagacccccgtgaagaagctggcccccgagttcagcaaggtgaagaccaagacccccaagcacagccccatcaaggaggagccctgcggcagcctgagcgagaccgtgtgcaagagagagctgagaagccaggagacccccgagaagcccagaagcagcgtggacaccccccccagactgagcaccccccagaagggccccagcacccaccccaaggagaaggccttcagcagcgagatcgaggacctgccctacctgagcaccaccgagatgtacctgtgcagatggcaccagcccccccccagccccctgcccctgagagagagcagccccaagaaggaggagaccgtggccagatgcctgatgcccagcagcgtggccggcgagaccagcgtgctggccgtgcccagctggagagaccacagcgtggagcccctgagagaccccaaccccagcgacctgctggagaacctggacgacagcgtgttcagcaagagacacgccaagctggagctggacgagaagagaagaaagagatgggacatccagagaatcagagagcagagaatcctgcagagactgcagctgagaatgtacaagaagaagggcatccaggagagcgagcccgaggtgaccagcttcttccccgagcccgacgacgtggagagcctgatgatcacccccttcctgcccgtggtggccttcggcagacccctgcccaagctgaccccccagaacttcgagctgccctggctggacgagagaagcagatgcagactggagatccagaagaagcagaccccccacagaacctgcagaaagtag

SEQ ID NO: 8577 - DNA, 1845 bp, Artificial Sequence
  Description of Artificial Sequence: Synthetic coding sequence
atgaccatgagaagcgccgtgttcaaggccgccgccgcccccgccggcggcaaccccgagcagagactggactacgagagagccgccgccctgggcggccccgaggacgagcccggcgccgccgaggcccacttcctgcccagacacagaaagctgaaggagcccggcccccccctggccagcagccagggcggcagccccgcccccagccccgccggctgcggcggcaagggcagaggcctgctgctgcccgccggcgccgcccccggccagcaggaggagagctggggcggcagcgtgcccctgccctgccccccccccgccaccaagcaggccggcatcggcggcgagcccgccgccgccggcgccggctgcagccccagacccaagtaccaggccgtgctgcccatccagaccggcagcctggtggccgccgccaaggagcccaccccctgggccggcgacaagggcggcgccgccagccccgccgccaccgccagcgaccccgccggccccccccccctgcccctgcccggccccccccccctggcccccaccgccaccgccggcaccctggccgccagcgagggcagatggaagagcatgagaaagagccccctgggcggcggcggcggcagcggcgccagcagccaggccgcctgcctgaagcagatcctgctgctgcagctggacctgatcgagcagcagcagcagcagctgcaggccaaggagaaggagatcgaggagctgaagagcgagagagacaccctgctggccagaatcgagagaatggagagaagaatgcagctggtgaagaaggacaacgagaaggagagacacaagctgttccagggctacgagaccgaggagagagaggagaccgagctgagcgagaagatcaagctggagtgccagcccgagctgagcgagaccagccagaccctgccccccaagcccttcagctgcggcagaagcggcaagggccacaagagaaagagccccttcggcagcaccgagagaaagacccccgtgaagaagctggcccccgagttcagcaaggtgaagaccaagacccccaagcacagccccatcaaggaggagccctgcggcagcctgagcgagaccgtgtgcaagagagagctgagaagccaggagacccccgagaagcccagaagcagcgtggacaccccccccagactgagcaccccccagaagggccccagcacccaccccaaggagaaggccttcagcagcgagatcgaggacctgccctacctgagcaccaccgagatgtacctgtgcagatggcaccagcccccccccagccccctgcccctgagagagagcagccccaagaaggaggagaccgtggccagatgcctgatgcccagcagcgtggccggcgagaccagcgtgctggccgtgcccagctggagagaccacagcgtggagcccctgagagaccccaaccccagcgacctgctggagaacctggacgacagcgtgttcagcaagagacacgccaagctggagctggacgagaagagaagaaagagatgggacatccagagaatcagagagcagagaatcctgcagagactgcagctgagaatgtacaagaagaagggcatccaggagagcgagcccgaggtgaccagcttcttccccgagcccgacgacgtggagagcctgatgatcacccccttcctgcccgtggtggccttcggcagacccctgcccaagctgaccccccagaacttcgagctgccctggctggacgagagaagcagatgcagactggagatccagaagaagcagaccccccacagaacctgcagaaagtag

SEQ ID NO: 8578 - DNA, 1056 bp, Artificial Sequence; identical to SEQ ID NO: 8576
  Description of Artificial Sequence: Synthetic coding sequence

SEQ ID NO: 8579 - DNA, 1734 bp, Artificial Sequence
  Description of Artificial Sequence: Synthetic coding sequence
atgaaccccgtgaacgccaccgccctgtacatcagcgccagcagactggtgctgaactacgaccccggcgaccccaaggccttcaccgagatcaacagactgctgccctacttcagacagagcctgagctgctgcgtgtgcggccacctgctgcaggaccccatcgcccccaccaacagcacctgccagcactacgtgtgcaagacctgcaagggcaagaagatgatgatgaagcccagctgcagctggtgcaaggactacgagcagttcgaggagaacaagcagctgagcatcctggtgaactgctacaagaagctgtgcgagtacatcacccagaccaccctggccagagacatcatcgaggccgtggactgcagcagcgacatcctggccctgctgaacgacggcagcctgttctgcgaggagaccgagaagcccagcgacagcagcttcaccctgtgcctgacccacagccccctgcccagcaccagcgagcccaccaccgacccccaggccagcctgagccccatgagcgagagcaccctgagcatcgccatcggcagcagcgtgatcaacggcctgcccacctacaacggcctgagcatcgacagattcggcatcaacatccccagccccgagcacagcaacaccatcgacgtgtgcaacaccgtggacatcaagaccgaggacctgagcgacagcctgccccccgtgtgcgacaccgtggccaccgacctgtgcagcaccggcatcgacatctgcagcttcagcgaggacatcaagcccggcgacagcctgctgctgagcgtggaggaggtgctgagaagcctggagaccgtgagcaacaccgaggtgtgctgccccaacctgcagcccaacctggaggccaccgtgagcaacggccccttcctgcagctgagcagccagagcctgagccacaacgtgttcatgagcaccagccccgccctgcacggcctgagctgcaccgccgccacccccaagatcgccaagctgaacagaaagagaagcagaagcgagagcgacagcgagaaggtgcagcccctgcccatcagcaccatcatcagaggccccaccctgggcgccagcgcccccgtgaccgtgaagagagagagcaagatcagcctgcagcccatcgccaccgtgcccaacggcggcaccacccccaagatcagcaagaccgtgctgctgagcaccaagagcatgaagaagagccacgagcacggcagcaagaagagccacagcaagaccaagcccggcatcctgaagaaggacaaggccgtgaaggagaagatccccagccaccacttcatgcccggcagccccaccaagaccgtgtacaagaagccccaggagaagaagggctgcaagtgcggcagagccacccagaaccccagcgtgctgacctgcagaggccagagatgcccctgctacagcaacagaaaggcctgcctggactgcatctgcagaggctgccagaacagctacatggccaacggcgagaagaagctggaggccttcgccgtgcccgagaaggccctggagcagaccagactgaccctgggcatcaacgtgaccagcatcgccgtgagaaacgccagcaccagcaccagcgtgatcaacgtgaccggcagccccgtgaccaccttcctggccgccagcacccacgacgacaagagcctggacgaggccatcgacatgagattcgactgctag

SEQ ID NO: 8580 - DNA, 1512 bp, Artificial Sequence
  Description of Artificial Sequence: Synthetic coding sequence
atgatgatgaagcccagctgcagctggtgcaaggactacgagcagttcgaggagaacaagcagctgagcatcctggtgaactgctacaagaagctgtgcgagtacatcacccagaccaccctggccagagacatcatcgaggccgtggactgcagcagcgacatcctggccctgctgaacgacggcagcctgttctgcgaggagaccgagaagcccagcgacagcagcttcaccctgtgcctgacccacagccccctgcccagcaccagcgagcccaccaccgacccccaggccagcctgagccccatgagcgagagcaccctgagcatcgccatcggcagcagcgtgatcaacggcctgcccacctacaacggcctgagcatcgacagattcggcatcaacatccccagccccgagcacagcaacaccatcgacgtgtgcaacaccgtggacatcaagaccgaggacctgagcgacagcctgccccccgtgtgcgacaccgtggccaccgacctgtgcagcaccggcatcgacatctgcagcttcagcgaggacatcaagcccggcgacagcctgctgctgagcgtggaggaggtgctgagaagcctggagaccgtgagcaacaccgaggtgtgctgccccaacctgcagcccaacctggaggccaccgtgagcaacggccccttcctgcagctgagcagccagagcctgagccacaacgtgttcatgagcaccagccccgccctgcacggcctgagctgcaccgccgccacccccaagatcgccaagctgaacagaaagagaagcagaagcgagagcgacagcgagaaggtgcagcccctgcccatcagcaccatcatcagaggccccaccctgggcgccagcgcccccgtgaccgtgaagagagagagcaagatcagcctgcagcccatcgccaccgtgcccaacggcggcaccacccccaagatcagcaagaccgtgctgctgagcaccaagagcatgaagaagagccacgagcacggcagcaagaagagccacagcaagaccaagcccggcatcctgaagaaggacaaggccgtgaaggagaagatccccagccaccacttcatgcccggcagccccaccaagaccgtgtacaagaagccccaggagaagaagggctgcaagtgcggcagagccacccagaaccccagcgtgctgacctgcagaggccagagatgcccctgctacagcaacagaaaggcctgcctggactgcatctgcagaggctgccagaacagctacatggccaacggcgagaagaagctggaggccttcgccgtgcccgagaaggccctggagcagaccagactgaccctgggcatcaacgtgaccagcatcgccgtgagaaacgccagcaccagcaccagcgtgatcaacgtgaccggcagccccgtgaccaccttcctggccgccagcacccacgacgacaagagcctggacgaggccatcgacatgagattcgactgctag

SEQ ID NO: 8581 - DNA, 1566 bp, Artificial Sequence
  Description of Artificial Sequence: Synthetic coding sequence
atgagcgccagcgagggcatgaagttcaagttccacagcggcgagaaggtgctgtgcttcgagcccgaccccaccaaggccagagtgctgtacgacgccaagatcgtggacgtgatcgtgggcaaggacgagaagggcagaaagatccccgagtacctgatccacttcaacggctggaacagaagctgggacagatgggccgccgaggaccacgtgctgagagacaccgacgagaacagaagactgcagagaaagctggccagaaaggccgtggccagactgagaagcaccggcagaaagaagaagagatgcagactgcccggcgtggacagcgtgctgaagggcctgcccaccgaggagaaggacgagaacgacgagaacagcctgagcagcagcagcgactgcagcgagaacaaggacgaggagatcagcgaggagagcgacatcgaggagaagaccgaggtgaaggaggagcccgagctgcagaccagaagagagatggaggagagaaccatcaccatcgagatccccgaggtgctgaagaagcagctggaggacgactgctactacatcaacagaagaaagagactggtgaagctgccctgccagaccaacatcatcaccatcctggagagctacgtgaagcacttcgccatcaacgccgccttcagcgccaacgagagacccagacaccaccacgtgatgccccacgccaacatgaacgtgcactacatccccgccgagaagaacgtggacctgtgcaaggagatggtggacggcctgagaatcaccttcgactacaccctgcccctggtgctgctgtacccctacgagcaggcccagtacaagaaggtgaccagcagcaagttcttcctgcccatcaaggagagcgccaccagcaccaacagaagccaggaggagctgagccccagcccccccctgctgaaccccagcaccccccagagcaccgagagccagcccaccaccggcgagcccgccacccccaagagaagaaaggccgagcccgaggccctgcagagcctgagaagaagcaccagacacagcgccaactgcgacagactgagcgagagcagcgccagcccccagcccaagagaagacagcaggacaccagcgccagcatgcccaagctgttcctgcacctggagaagaagacccccgtgcacagcagaagcagcagccccatccccctgacccccagcaaggagggcagcgccgtgttcgccggcttcgagggcagaagaaccaacgagatcaacgaggtgctgagctggaagctggtgcccgacaactacccccccggcgaccagccccccccccccagctacatctacggcgcccagcacctgctgagactgttcgtgaagctgcccgagatcctgggcaagatgagcttcagcgagaagaacctgaaggccctgctgaagcacttcgacctgttcctgagattcctggccgagtaccacgacgacttcttccccgagagcgcctacgtggccgcctgcgaggcccactacagcaccaagaaccccagagccatctactag

SEQ ID NO: 8582 - DNA, 1251 bp, Artificial Sequence
  Description of Artificial Sequence: Synthetic coding sequence
atgagcgccagcgagggcatgaagttcaagttccacagcggcgagaaggtgctgtgcttcgagcccgaccccaccaaggccagagtgctgtacgacgccaagatcgtggacgtgatcgtgggcaaggacgagaagggcagaaagatccccgagtacctgatccacttcaacggctggaacagaagctgggacagatgggccgccgaggaccacgtgctgagagacaccgacgagaacagaagactgcagagaaagctggccagaaaggccgtggccagactgagaagcaccggcagaaagaagaagagatgcagactgcccggcgtggacagcgtgctgaagggcctgcccaccgaggagaaggacgagaacgacgagaacagcctgagcagcagcagcgactgcagcgagaacaaggacgaggagatcagcgaggagagcgacatcgaggagaagaccgaggtgaaggaggagcccgagctgcagaccagaagagagatggaggagagaaccatcaccatcgagatccccgaggtgctgaagaagcagctggaggacgactgctactacatcaacagaagaaagagactggtgaagctgccctgccagaccaacatcatcaccatcctggagagctacgtgaagcacttcgccatcaacgccgccttcagcgccaacgagagacccagacaccaccacgtgatgccccacgccaacatgaacgtgcactacatccccgccgagaagaacgtggacctgtgcaaggagatggtggacggcctgagaatcaccttcgactacaccctgcccctggtgctgctgtacccctacgagcaggcccagtacaagaaggtgaccagcagcaagttcttcctgcccatcaaggagagcgccaccagcaccaacagaagccaggaggagctgagccccagcccccccctgctgaaccccagcaccccccagagcaccgagagccagcccaccaccggcgagcccgccacccccaagagaagaaaggccgagcccgaggccctgcagagcctgagaagaagcaccagacacagcgccaactgcgacagactgagcgagagcagcgccagcccccagcccaagagaagacagcaggacaccagcgccagcatgcccaagctgttcctgcacctggagaagagcagattcatcctgggctgccccagacccggcagagccagcgtgtacttcgtgttcagccagtgccaggcctggtgctag

SEQ ID NO: 8583 - DNA, 1119 bp, Artificial Sequence
  Description of Artificial Sequence: Synthetic coding sequence
atgaagatgatgaagaccaaggaggagcccgagctgcagaccagaagagagatggaggagagaaccatcaccatcgagatccccgaggtgctgaagaagcagctggaggacgactgctactacatcaacagaagaaagagactggtgaagctgccctgccagaccaacatcatcaccatcctggagagctacgtgaagcacttcgccatcaacgccgccttcagcgccaacgagagacccagacaccaccacgtgatgccccacgccaacatgaacgtgcactacatccccgccgagaagaacgtggacctgtgcaaggagatggtggacggcctgagaatcaccttcgactacaccctgcccctggtgctgctgtacccctacgagcaggcccagtacaagaaggtgaccagcagcaagttcttcctgcccatcaaggagagcgccaccagcaccaacagaagccaggaggagctgagccccagcccccccctgctgaaccccagcaccccccagagcaccgagagccagcccaccaccggcgagcccgccacccccaagagaagaaaggccgagcccgaggccctgcagagcctgagaagaagcaccagacacagcgccaactgcgacagactgagcgagagcagcgccagcccccagcccaagagaagacagcaggacaccagcgccagcatgcccaagctgttcctgcacctggagaagaagacccccgtgcacagcagaagcagcagccccatccccctgacccccagcaaggagggcagcgccgtgttcgccggcttcgagggcagaagaaccaacgagatcaacgaggtgctgagctggaagctggtgcccgacaactacccccccggcgaccagccccccccccccagctacatctacggcgcccagcacctgctgagactgttcgtgaagctgcccgagatcctgggcaagatgagcttcagcgagaagaacctgaaggccctgctgaagcacttcgacctgttcctgagattcctggccgagtaccacgacgacttcttccccgagagcgcctacgtggccgcctgcgaggcccactacagcaccaagaaccccagagccatctactag

SEQ ID NO: 8584 - DNA, 591 bp, Artificial Sequence
  Description of Artificial Sequence: Synthetic coding sequence
atggaggagagaaccatcaccatcgagatccccgaggtgctgaagaagcagctggaggacgactgctactacatcaacagaagaaagagactggtgaagctgccctgccagaccaacatcatcaccatcctggagagctacgtgaagcacttcgccatcaacgccgccttcagcgccaacgagagacccagacaccaccacgtgatgccccacgccaacatgaacgtgcactacatccccgccgagaagaacgtggacctgtgcaaggagatggtggacggcctgagaatcaccttcgactacaccctgcccctggtgctgctgtacccctacgagcaggcccagtacaagaaggtgaccagcagcaagttcttcctgcccatcaaggagagcgccaccagcaccaacagaagccaggaggagctgagccccagcccccccctgctgaaccccagcaccccccagagcaccgagagccagcccaccaccggcgagcccgccacccccaagagaagaaaggccgagcccgaggccctgcagagcctgagaagaagcaccagacacagcgccaactgcgacagactgagctag

SEQ ID NO: 8585 - DNA, 1068 bp, Artificial Sequence
  Description of Artificial Sequence: Synthetic coding sequence
atggaggagagaaccatcaccatcgagatccccgaggtgctgaagaagcagctggaggacgactgctactacatcaacagaagaaagagactggtgaagctgccctgccagaccaacatcatcaccatcctggagagctacgtgaagcacttcgccatcaacgccgccttcagcgccaacgagagacccagacaccaccacgtgatgccccacgccaacatgaacgtgcactacatccccgccgagaagaacgtggacctgtgcaaggagatggtggacggcctgagaatcaccttcgactacaccctgcccctggtgctgctgtacccctacgagcaggcccagtacaagaaggtgaccagcagcaagttcttcctgcccatcaaggagagcgccaccagcaccaacagaagccaggaggagctgagccccagcccccccctgctgaaccccagcaccccccagagcaccgagagccagcccaccaccggcgagcccgccacccccaagagaagaaaggccgagcccgaggccctgcagagcctgagaagaagcaccagacacagcgccaactgcgacagactgagcgagagcagcgccagcccccagcccaagagaagacagcaggacaccagcgccagcatgcccaagctgttcctgcacctggagaagaagacccccgtgcacagcagaagcagcagccccatccccctgacccccagcaaggagggcagcgccgtgttcgccggcttcgagggcagaagaaccaacgagatcaacgaggtgctgagctggaagctggtgcccgacaactacccccccggcgaccagccccccccccccagctacatctacggcgcccagcacctgctgagactgttcgtgaagctgcccgagatcctgggcaagatgagcttcagcgagaagaacctgaaggccctgctgaagcacttcgacctgttcctgagattcctggccgagtaccacgacgacttcttccccgagagcgcctacgtggccgcctgcgaggcccactacagcaccaagaaccccagagccatctactag

SEQ ID NO: 8586 - DNA, 1530 bp, Artificial Sequence
  Description of Artificial Sequence: Synthetic coding sequence
atgagccccagcgtgagacccggcgccggctgggcccccgtgggcagacccggcagacccatccagatcgtggacgtgatcgtgggcaaggacgagaagggcagaaagatccccgagtacctgatccacttcaacggctggaacagaagctgggacagatgggccgccgaggaccacgtgctgagagacaccgacgagaacagaagactgcagagaaagctggccagaaaggccgtggccagactgagaagcaccggcagaaagaagaagagatgcagactgcccggcgtggacagcgtgctgaagggcctgcccaccgaggagaaggacgagaacgacgagaacagcctgagcagcagcagcgactgcagcgagaacaaggacgaggagatcagcgaggagagcgacatcgaggagaagaccgaggtgaaggaggagcccgagctgcagaccagaagagagatggaggagagaaccatcaccatcgagatccccgaggtgctgaagaagcagctggaggacgactgctactacatcaacagaagaaagagactggtgaagctgccctgccagaccaacatcatcaccatcctggagagctacgtgaagcacttcgccatcaacgccgccttcagcgccaacgagagacccagacaccaccacgtgatgccccacgccaacatgaacgtgcactacatccccgccgagaagaacgtggacctgtgcaaggagatggtggacggcctgagaatcaccttcgactacaccctgcccctggtgctgctgtacccctacgagcaggcccagtacaagaaggtgaccagcagcaagttcttcctgcccatcaaggagagcgccaccagcaccaacagaagccaggaggagctgagccccagcccccccctgctgaaccccagcaccccccagagcaccgagagccagcccaccaccggcgagcccgccacccccaagagaagaaaggccgagcccgaggccctgcagagcctgagaagaagcaccagacacagcgccaactgcgacagactgagcgagagcagcgccagcccccagcccaagagaagacagcaggacaccagcgccagcatgcccaagctgttcctgcacctggagaagaagacccccgtgcacagcagaagcagcagccccatccccctgacccccagcaaggagggcagcgccgtgttcgccggcttcgagggcagaagaaccaacgagatcaacgaggtgctgagctggaagctggtgcccgacaactacccccccggcgaccagccccccccccccagctacatctacggcgcccagcacctgctgagactgttcgtgaagctgcccgagatcctgggcaagatgagcttcagcgagaagaacctgaaggccctgctgaagcacttcgacctgttcctgagattcctggccgagtaccacgacgacttcttccccgagagcgcctacgtggccgcctgcgaggcccactacagcaccaagaaccccagagccatctactag

SEQ ID NO: 8587 - DNA, 60 bp, Artificial Sequence
  Description of Artificial Sequence: Synthetic coding sequence
atggaggagagaaccatcaccatcgagatccccgaggtgctgaagaagcagctggagtag

SEQ ID NO: 8588 - DNA, 1842 bp, Artificial Sequence
  Description of Artificial Sequence: Synthetic coding sequence
atggccgcccaggccgccgccgccgcccaggccgccgccgcccaggccgcccaggccgaggccgccgacagctggtacctggccctgctgggcttcgccgagcacttcagaaccagcagcccccccaagatcagactgtgcgtgcactgcctgcaggccgtgttccccttcaagcccccccagagaatcgaggccagaacccacctgcagctgggcagcgtgctgtaccaccacaccaagaacagcgagcaggccagaagccacctggagaaggccggcagcctgagccagcagatcccccagttcgaggacgtgaagttcgaggccgccagcctgctgagcgagctgtactgccaggagaacagcgtggacgccgccaagcccctgctgagaaaggccatccagatcagccagcagaccccctactggcactgcagactgctgttccagctggcccagctgcacaccctggagaaggacctggtgagcgcctgcgacctgctgggcgtgggcgccgagtacgccagagtggtgggcagcgagtacaccagagccctgttcctgctgagcaagggcatgctgctgctgatggagagaaagctgcaggaggtgcaccccctgctgaccctgtgcggccagatcgtggagaactggcagggcaaccccatccagaaggagagcctgagagtgttcttcctggtgctgcaggtgacccactacctggacgccggccaggtgaagagcgtgaagccctgcctgaagcagctgcagcagtgcatccagaccatcagcaccctgcacgacgacgagatcctgcccagcaaccccgccgacctgttccactggctgcccaaggagcacatgtgcgtgctggtgtacctggtgaccgtgatgcacagcatgcaggccggctacctggagaaggcccagaagtacaccgacaaggccctgatgcagctggagaagctgaagatgctggactgcagccccatcctgagcagcttccaggtgatcctgctggagcacatcatcatgtgcagactggtgaccggccacaaggccaccgccctgcaggagatcagccaggtgtgccagctgtgccagcagagccccagactgttcagcaaccacgccgcccagctgcacaccctgctgggcctgtactgcgtgagcgtgaactgcatggacaacgccgaggcccagttcaccaccgccctgagactgaccaaccaccaggagctgtgggccttcatcgtgaccaacctggccagcgtgtacatcagagagggcaacagacaccaggaggtgctgtacagcctgctggagagaatcaaccccgaccacagcttccccgtgagcagccactgcctgagagccgccgccttctacgtgagaggcctgttcagcttcttccagggcagatacaacgaggccaagagattcctgagagagaccctgaagatgagcaacgccgaggacctgaacagactgaccgcctgcagcctggtgctgctgggccacatcttctacgtgctgggcaaccacagagagagcaacaacatggtggtgcccgccatgcagctggccagcaagatccccgacatgagcgtgcagctgtggagcagcgccctgctgagagacctgaacaaggcctgcggcaacgccatggacgcccacgaggccgcccagatgcaccagaacttcagccagcagctgctgcaggaccacatcgaggcctgcagcctgcccgagcacaacctgatcacctggaccgacggccccccccccgtgcagttccaggcccagaacggccccaacaccagcctggccagcctgctgtag

SEQ ID NO: 8589 - DNA, 504 bp, Artificial Sequence
  Description of Artificial Sequence: Synthetic coding sequence
atgcccatgaagccccccagatgcaccagaaccagcagaagcagctgcagcagaaccaccctgagacccgccgccagccccaacaccaccagcagcagaggccagaccgtgcaccccccctgcagcagcaagctgagaatggaccccacccccgcctggcccgccagctgcgaggccctgatgggccccagcagcagcgccggccccgccagactgagactgccccccagaagacacagcagcctgccccccagaagagccagcttcctgatcgtgagcagagccagcaagagctgggagtgcgccggccccgtgcccgccctgcccggcggcgtggtggccgtgcccaccagccagcaggacccccagtgcagaggcagccaggtggcccacagaagatgcctgagcagagccatcctgcagagcggcccccagtgccagagctgcctgagcatctgggtgaccagcgccagaagcagagtgcaggccagcagcagaagctag

SEQ ID NO: 8590 - DNA, 1842 bp, Artificial Sequence
  Description of Artificial Sequence: Synthetic coding sequence
atggccgcccaggccgccgccgccgcccaggccgccgccgcccaggccgcccaggccgaggccgccgacagctggtacctggccctgctgggcttcgccgagcacttcagaaccagcagcccccccaagatcagactgtgcgtgcactgcctgcaggccgtgttccccttcaagcccccccagagaatcgaggccagaacccacctgcagctgggcagcgtgctgtaccaccacaccaagaacagcgagcaggccagaagccacctggagaaggcctggctgatcagccagcagatcccccagttcgaggacgtgaagttcgaggccgccagcctgctgagcgagctgtactgccaggagaacagcgtggacgccgccaagcccctgctgagaaaggccatccagatcagccagcagaccccctactggcactgcagactgctgttccagctggcccagctgcacaccctggagaaggacctggtgagcgcctgcgacctgctgggcgtgggcgccgagtacgccagagtggtgggcagcgagtacaccagagccctgttcctgctgagcaagggcatgctgctgctgatggagagaaagctgcaggaggtgcaccccctgctgaccctgtgcggccagatcgtggagaactggcagggcaaccccatccagaaggagagcctgagagtgttcttcctggtgctgcaggtgacccactacctggacgccggccaggtgaagagcgtgaagccctgcctgaagcagctgcagcagtgcatccagaccatcagcaccctgcacgacgacgagatcctgcccagcaaccccgccgacctgttccactggctgcccaaggagcacatgtgcgtgctggtgtacctggtgaccgtgatgcacagcatgcaggccggctacctggagaaggcccagaagtacaccgacaaggccctgatgcagctggagaagctgaagatgctggactgcagccccatcctgagcagcttccaggtgatcctgctggagcacatcatcatgtgcagactggtgaccggccacaaggccaccgccctgcaggagatcagccaggtgtgccagctgtgccagcagagccccagactgttcagcaaccacgccgcccagctgcacaccctgctgggcctgtactgcgtgagcgtgaactgcatggacaacgccgaggcccagttcaccaccgccctgagactgaccaaccaccaggagctgtgggccttcatcgtgaccaacctggccagcgtgtacatcagagagggcaacagacaccaggaggtgctgtacagcctgctggagagaatcaaccccgaccacagcttccccgtgagcagccactgcctgagagccgccgccttctacgtgagaggcctgttcagcttcttccagggcagatacaacgaggccaagagattcctgagagagaccctgaagatgagcaacgccgaggacctgaacagactgaccgcctgcagcctggtgctgctgggccacatcttctacgtgctgggcaaccacagagagagcaacaacatggtggtgcccgccatgcagctggccagcaagatccccgacatgagcgtgcagctgtggagcagcgccctgctgagagacctgaacaaggcctgcggcaacgccatggacgcccacgaggccgcccagatgcaccagaacttcagccagcagctgctgcaggaccacatcgaggcctgcagcctgcccgagcacaacctgatcacctggaccgacggccccccccccgtgcagttccaggcccagaacggccccaacaccagcctggccagcctgctgtag

SEQ ID NO: 8591 - DNA, 504 bp, Artificial Sequence; identical to SEQ ID NO: 8589
  Description of Artificial Sequence: Synthetic coding sequence

SEQ ID NO: 8592 - DNA, 426 bp, Artificial Sequence
  Description of Artificial Sequence: Synthetic coding sequence
atgagcagccccccccacagcggccagaccgtgcaccccccctgcagcagcaagctgagaatggaccccacccccgcctggcccgccagctgcgaggccctgatgggccccagcagcagcgccggccccgccagactgagactgccccccagaagacacagcagcctgccccccagaagagccagcttcctgatcgtgagcagagccagcaagagctgggagtgcgccggccccgtgcccgccctgcccggcggcgtggtggccgtgcccaccagccagcaggacccccagtgcagaggcagccaggtggcccacagaagatgcctgagcagagccatcctgcagagcggcccccagtgccagagctgcctgagcatctgggtgaccagcgccagaagcagagtgcaggccagcagcagaagctag

SEQ ID NO: 8593 - DNA, 666 bp, Artificial Sequence
  Description of Artificial Sequence: Synthetic coding sequence
atggccgccgccgtgagaatgaacatccagatgctgctggaggccgccgactacctggagagaagagagagagaggccgagcacggctacgccagcatgctgccctacaacaacaaggacagagacgccctgaagagaagaaacaagagcaagaagaacaacagcagcagcagaagcacccacaacgagatggagaagaacagaagagcccacctgagactgtgcctggagaagctgaagggcctggtgcccctgggccccgagagcagcagacacaccaccctgagcctgctgaccaaggccaagctgcacatcaagaagctggaggactgcgacagaaaggccgtgcaccagatcgaccagctgcagagagagcagagacacctgaagagacagctggagaagctgggcatcgagagaatcagaatggacagcatcggcagcaccgtgagcagcgagagaagcgacagcgacagagaggagatcgacgtggacgtggagagcaccgactacctgaccggcgacctggactggagcagcagcagcgtgagcgacagcgacgagagaggcagcatgcagagcctgggcagcgacgagggctacagcagcaccagcatcaagagaatcaagctgcaggacagccacaaggcctgcctgggcctgtag

SEQ ID NO: 8594 - DNA, 636 bp, Artificial Sequence
  Description of Artificial Sequence: Synthetic coding sequence
atggccgccgccgtgagaatgaacatccagatgctgctggaggccgccgactacctggagagaagagagagagaggccgagcacggctacgccagcatgctgccctacaacaacaaggacagagacgccctgaagagaagaaacaagagcaagaagaacaacagcagcagcagaagagcccacctgagactgtgcctggagaagctgaagggcctggtgcccctgggccccgagagcagcagacacaccaccctgagcctgctgaccaaggccaagctgcacatcaagaagctggaggactgcgacagaaaggccgtgcaccagatcgaccagctgcagagagagcagagacacctgaagagacagctggagaagctgggcatcgagagaatcagaatggacagcatcggcagcaccgtgagcagcgagagaagcgacagcgacagagaggagatcgacgtggacgtggagagcaccgactacctgaccggcgacctggactggagcagcagcagcgtgagcgacagcgacgagagaggcagcatgcagagcctgggcagcgacgagggctacagcagcaccagcatcaagagaatcaagctgcaggacagccacaaggcctgcctgggcctgtag

SEQ ID NO: 8595 - DNA, 630 bp, Artificial Sequence
  Description of Artificial Sequence: Synthetic coding sequence
atggagctgaacagcctgctgatcctgctggaggccgccgagtacctggagagaagagacagagaggccgagcacggctacgccagcgtgctgcccttcgacggcgacttcgccagagagaagaccaaggccgccggcctggtgagaaaggcccccaacaacagaagcagccacaacgagctggagaagcacagaagagccaagctgagactgtacctggagcagctgaagcagctggtgcccctgggccccgacagcaccagacacaccaccctgagcctgctgaagagagccaaggtgcacatcaagaagctggaggagcaggacagaagagccctgagcatcaaggagcagctgcagcaggagcacagattcctgaagagaagactggagcagctgagcgtgcagagcgtggagagagtgagaaccgacagcaccggcagcgccgtgagcaccgacgacagcgagcaggaggtggacatcgagggcatggagttcggccccggcgagctggacagcgtgggcagcagcagcgacgccgacgaccactacagcctgcagagcggcaccggcggcgacagcggcttcggcccccactgcagaagactgggcagacccgccctgagctag

SEQ ID NO: 8596 - DNA, 177 bp, Artificial Sequence
  Description of Artificial Sequence: Synthetic coding sequence
atggagctgaacagcctgctgatcctgctggaggccgccgagtacctggagagaagagacagagaggccgagcacggctacgccagcgtgctgcccttcgacggcgacttcgccagagagaagaccaaggccgccggcctggtgagaaaggcccccaacaacagacccccccagtag

SEQ ID NO: 8597 - DNA, 1293 bp, Artificial Sequence
  Description of Artificial Sequence: Synthetic coding sequence
atgttcgacggctacgacagctgcagcgaggacaccagcagcagcagcagcagcgaggagagcgaggaggaggtggcccccctgcccagcaacctgcccatcatcaagaacaacggccaggtgtacacctaccccgacggcaagagcggcatggccacctgcgagatgtgcggcatggtgggcgtgagagacgccttctacagcaagaccaagagattctgcagcgtgagctgcagcagaagctacagcagcaacagcaagaaggccagcatcctggccagactgcagggcaagccccccaccaagaaggccaaggtgctgcagaagcagcccctggtggccaagctggccgcctacgcccagtaccaggccaccctgcagaaccaggccaagaccaaggccgccgtgagcatggagggcttcagctggggcaactacatcaacagcaacagcttcatcgccgcccccgtgacctgcttcaagcacgcccccatgggcacctgctggggcgacatcagcgagaacgtgagagtggaggtgcccaacaccgactgcagcctgcccaccaaggtgttctggatcgccggcatcgtgaagctggccggctacaacgccctgctgagatacgagggcttcgagaacgacagcggcctggacttctggtgcaacatctgcggcagcgacatccaccccgtgggctggtgcgccgccagcggcaagcccctggtgccccccagaaccatccagcacaagtacaccaactggaaggccttcctggtgaagagactgaccggcgccaagaccctgccccccgacttcagccagaaggtgagcgagagcatgcagtaccccttcaagccctgcatgagagtggaggtggtggacaagagacacctgtgcagaaccagagtggccgtggtggagagcgtgatcggcggcagactgagactggtgtacgaggagagcgaggacagaaccgacgacttctggtgccacatgcacagccccctgatccaccacatcggctggagcagaagcatcggccacagattcaagagaagcgacatcaccaagaagcaggacggccacttcgacacccccccccacctgttcgccaaggtgaaggaggtggaccagagcggcgagtggttcaaggagggcatgaagctggaggccatcgaccccctgaacctgagcaccatctgcgtggccaccatcagaaaggtgacccagaacttcctgctgaacggcctgaccaccagcggcaagctggcccccctgcagcaccagtag

SEQ ID NO: 8598 - DNA, 1887 bp, Artificial Sequence
  Description of Artificial Sequence: Synthetic coding sequence
atgttcgacggctacgacagctgcagcgaggacaccagcagcagcagcagcagcgaggagagcgaggaggaggtggcccccctgcccagcaacctgcccatcatcaagaacaacggccaggtgtacacctaccccgacggcaagagcggcatggccacctgcgagatgtgcggcatggtgggcgtgagagacgccttctacagcaagaccaagagattctgcagcgtgagctgcagcagaagctacagcagcaacagcaagaaggccagcatcctggccagactgcagggcaagccccccaccaagaaggccaaggtgctgcagaagcagcccctggtggccaagctggccgcctacgcccagtaccaggccaccctgcagaaccaggccaagaccaaggccgccgtgagcatggagggcttcagctggggcaactacatcaacagcaacagcttcatcgccgcccccgtgacctgcttcaagcacgcccccatgggcacctgctggggcgacatcagcgagaacgtgagagtggaggtgcccaacaccgactgcagcctgcccaccaaggtgttctggatcgccggcatcgtgaagctggccggctacaacgccctgctgagatacgagggcttcgagaacgacagcggcctggacttctggtgcaacatctgcggcagcgacatccaccccgtgggctggtgcgccgccagcggcaagcccctggtgccccccagaaccatccagcacaagtacaccaactggaaggccttcctggtgaagagactgaccggcgccaagaccctgccccccgacttcagccagaaggtgagcgagagcatgcagtaccccttcaagccctgcatgagagtggaggtggtggacaagagacacctgtgcagaaccagagtggccgtggtggagagcgtgatcggcggcagactgagactggtgtacgaggagagcgaggacagaaccgacgacttctggtgccacatgcacagccccctgatccaccacatcggctggagcagaagcatcggccacagattcaagagaagcgacatcaccaagaagcaggacggccacttcgacacccccccccacctgttcgccaaggtgaaggaggtggaccagagcggcgagtggttcaaggagggcatgaagctggaggccatcgaccccctgaacctgagcaccatctgcgtggccaccatcagaaaggtgctggccgacggcttcctgatgatcggcatcgacggcagcgaggccgccgacggcagcgactggttctgctaccacgccaccagccccagcatcttccccgtgggcttctgcgagatcaacatgatcgagctgaccccccccagaggctacaccaagctgcccttcaagtggttcgactacctgagagagaccggcagcatcgccgcccccgtgaagctgttcaacaaggacgtgcccaaccacggcttcagagtgggcatgaagctggaggccgtggacctgatggagcccagactgatctgcgtggccaccgtgaccagaatcatccacagactgctgagaatccacttcgacggctgggaggaggagtacgaccagtgggtggactgcgagagccccgacctgtaccccgtgggctggtgccagctgaccggctaccagctgcagccccccgccagccagagcagcagagagaaccagagcgccagcagcaagcagaagaagaaggccaagagccagcagtacaagggccacaagaagatgaccaccctgcagctgaaggaggagctgctggacggcgaggactacaacttcctgcagggcgccagcgaccaggagagcaacggcagcgccaacttctacatcaagcaggagccctag

SEQ ID NO: 8599 - DNA, 1887 bp, Artificial Sequence; identical to SEQ ID NO: 8598
  Description of Artificial Sequence: Synthetic coding sequence

SEQ ID NO: 8600 - DNA, 1887 bp, Artificial Sequence; identical to SEQ ID NO: 8598
  Description of Artificial Sequence: Synthetic coding sequence

SEQ ID NO: 8601 - DNA, 16791 bp, Artificial Sequence
  Description of Artificial Sequence: Synthetic coding sequence
atggagcacttcctgctggaggtggccgccgcccccctgagactgatcgccgccaagaacgagaagagcagaagcgagctgggcagattcctggccaagcaggtgtggaccccccaggacagacagtgcgtgctgagcaccctggcccagctgctgctggacaaggactgcaccgtgctggtgggcagacagctgagacccctgctgctggacctgctggagagaaacgccgaggccatcaaggccggcggccagatcaaccacgacctgcacgagagactgtgcgtgagcatgagcaagctgatcggcaaccaccccgacgtgctgcccttcgccctgagatacttcaaggacaccagccccgtgttccagagactgttcctggagagcagcgacgccaaccccgtgagatacggcagaagaagaatgaagctgagagacctgatggaggccgccttcaagttcctgcagcaggagcagagcgtgttcagagagctgtgggactggagcgtgtgcgtgcccctgctgagaagccacgacaccctggtgagatggtacaccgccaactgcctggccctggtgacctgcatgaacgaggagcacaagctgagcttcctgaagaagatcttcaacagcgacgagctgatccacttcagactgagactgctggaggaggcccagctgcaggacctggagaaggccctggtgctggccaaccccgaggtgagcctgtggagaaagcagaaggagctgcagtacctgcagggccacctggtgagcagcgacctgagccccagagtgaccgccgtgtgcggcgtggtgctgcccggccagctgcccgcccccggcgagctgggcggcaacagaagcagcagcagagagcaggagctggccctgagaagctacgtgctggtggagagcgtgtgcaagagcctgcagaccctggccatggccgtggccagccagaacgccgtgctgctggagggccccatcggctgcggcaagaccagcctggtggagtacctggccgccgtgaccggcagaaccaagcccccccagctgctgaaggtgcagctgggcgaccagaccgacagcaagatgctgctgggcatgtacagatgcaccgacgtgcccggcgagttcgtgtggcagcccggcaccctgacccaggccgccaccatgggccactggatcctgctggaggacatcgactacgcccccctggacgtggtgagcgtgctgatccccctgctggagaacggcgagctgctgatccccggcagaggcgactgcctgaaggtggcccccggcttccagttcttcgccaccagaagactgctgagctgcggcggcaactggtacagacccctgaacagccacgccaccctgctggacaagtactggaccaagatccacctggacaacctggacaagagagagctgaacgaggtgctgcagagcagataccccagcctgctggccgtggtggaccacctgctggacatctacatccagctgaccggcgagaagcaccacagctggagcgacagcagcgtgggctgcgagcaggcccccgaggaggtgagcgaggccagaagagagaacaagagacccaccctggagggcagagagctgagcctgagagacctgctgaactggtgcaacagaatcgcccacagcttcgacagcagcagcctgagcgccagcctgaacatcttccaggaggccctggactgcttcaccgccatgctgagcgagcacaccagcaagctgaagatggccgaggtgatcggcagcaagctgaacatcagcagaaagaaggccgagttcttctgccagctgtacaagcccgagatcgtgatcaacgagctggacctgcaggtgggcagagtgagactgctgagaaagcagagcgaggccgtgcacctgcagagagagaagttcaccttcgccgccaccagacccagcagcgtgctgatcgagcagctggccgtgtgcgtgagcaagggcgagcccgtgctgctggtgggcgagaccggcaccggcaagaccagcaccatccagtacctggcccacatcaccggccacagactgagagtggtgaacatgaaccagcagagcgacaccgccgacctgctgggcggctacaagcccgtggaccacaagctgatctggctgcccctgagagaggccttcgaggagctgttcgcccagaccttcagcaagaagcagaacttcaccttcctgggccacatccagacctgctacagacagaagagatggcacgacctgctgagactgatgcagcacgtgcacaagagcgccgtgaacaaggacggcaaggacagcgagaccggcctgctgatcaaggagaagtgggaggccttcggcctgagactgaaccacgcccagcagcagatgaagatgaccgagaacaccctgctgttcgccttcgtggagggcaccctggcccaggccgtgaagaagggcgagtggatcctgctggacgagatcaacctggccgcccccgagatcctggagtgcctgagcggcctgctggagggcagcagcggcagcctggtgctgctggacagaggcgacaccgagcccctggtgagacaccccgacttcagactgttcgcctgcatgaaccccgccaccgacgtgggcaagagaaacctgccccccggcatcagaaacagattcaccgagctgtacgtggaggagctggagagcaaggaggacctgcaggtgctgatcgtggactacctgaagggcctgagcgtgaacaagaacaccgtgcagggcatcatcaacttctacaccgccctgagaaaggagagcggcaccaagctggtggacggcaccggccacagaccccactacagcctgagaaccctgtgcagagccctgagattcgccgccagcaacccctgcggcaacatccagagaagcctgtacgagggcttctgcctgggcttcctgacccagctggacagagccagccaccccatcgtgcagaagctgatctgccagcacatcgtgcccggcaacgtgaagagcctgctgaagcagcccatccccgagcccaagggcggcagactgatccaggtggagggctactggatcgccgtgggcgacaaggagcccaccatcgacgagacctacatcctgaccagcagcgtgaagctgaacctgagagacatcgtgagagtggtgagcgccggcacctaccccgtgctgatccagggcgagaccagcgtgggcaagaccagcctgatccagtggctggccgccgccaccggcaaccactgcgtgagaatcaacaaccacgagcacaccgacatccaggagtacatcggctgctacaccagcgacagcagcggcaagctggtgttcaaggagggcgtgctgatcgacgccatgagaaagggctactggatcatcctggacgagctgaacctggcccccaccgacgtgctggaggccctgaacagactgctggacgacaacagagagctgctggtgaccgagacccaggaggtggtgaaggcccaccccagattcatgctgttcgccacccagaacccccccggcctgtacggcggcagaaaggtgctgagcagagccttcagaaacagattcgtggagctgcacttcgacgagctgcccagcagcgagctggagaccatcctgcacaagagatgcagcctgccccccagctactgcagcaagctggtgaaggtgatgctggacctgcagagctacagaagaagcagcagcgtgttcgccggcaagcagggcttcatcaccctgagagacctgttcagatgggccgagagatacagactggccgagcccaccgagaaggagtacgactggctgcagcacctggccaacgacggctacatgctgctggccggcagagtgagaaagcaggaggagatcgacgtgatccaggaggtgctggagaagcacttcaagaagaagctgtgcccccagagcctgttcagcaaggagaacgtgctgaagctgctgggcaagctgagcacccagatcagcaccctggagtgcaacttcggccacatcgtgtggaccgagggcatgagaagactggccatgctggtgggcagagccctggagttcggcgagcccgtgctgctggtgggcgacaccggctgcggcaagaccaccatctgccaggtgttcgccgccctggccaaccagaagctgtacagcgtgagctgccacctgcacatggagaccagcgacttcctgggcggcctgagacccgtgagacagaagcccaacgacaaggaggagatcgacaccagcagactgttcgagtggcacgacggccccctggtgcaggccatgaaggaggacggcttcttcctgctggacgagatcagcctggccgacgacagcgtgctggagagactgaacagcgtgctggaggtggagaagagcctggtgctggccgagaagggcagccccgaggacaaggacagcgagatcgagctgctgaccgccggcaagaagttcagaatcctggccaccatgaaccccggcggcgacttcggcaagaaggagctgagccccgccctgagaaacagattcaccgagatctggtgcccccagagcaccagcagagaggacctgatccagatcatcagccacaacctgagacccggcctgtgcctgggcagaatcgaccccaagggcagcgacatccccgaggtgatgctggacttcatcgactggctgacccaccaggagttcggcagaaagtgcgtggtgagcatcagagacatcctgagctgggtgaacttcatgaacaagatgggcgaggaggccgccctgaagagacccgagatcatcagcaccgtgaccagcttcgtgcacgccgcctgcctggtgtacatcgacggcatcggcagcggcgtgaccagcagcggcttcggcaccgccctgctggccagaaaggagtgcctgaagttcctgatcaagagactggccaagatcgtgagactgaccgagtaccagaagaacgagctgaagatctacgacagaatgaaggccaaggagttcaccggcatcgacaacctgtggggcatccaccccttcttcatccccagaggccccgtgctgcacagaaacaacatcgccgactacgccctgagcgccggcaccaccgccatgaacgcccagagactgctgagagccaccaagctgaagaagcccatcctgctggagggcagccccggcgtgggcaagaccagcctggtgggcgccctggccaaggccagcggcaacaccctggtgagaatcaacctgagcgagcagaccgacatcaccgacctgttcggcgccgacctgcccgtggagggcggcaagggcggcgagttcgcctggagagacggccccctgctggccgccctgaaggccggccactgggtggtgctggacgagctgaacctggccagccagagcgtgctggagggcctgaacgcctgcttcgaccacagaggcgagatctacgtgcccgagctgggcatgagcttccaggtgcagcacgagaagaccaagatcttcggctgccagaaccccttcagacagggcggcggcagaaagggcctgcccagaagcttcctgaacagattcacccaggtgttcgtggaccccctgaccgtgatcgacatggagttcatcgccagcaccctgttccccgccatcgagaagaacatcgtgaagaagatggtggccttcaacaaccagatcgaccacgaggtgaccgtggagaagaagtggggccagaagggcggcccctgggagttcaacctgagagacctgttcagatggtgccagctgatgctggtggaccagagccccggctgctacgaccccggccagcacgtgttcctggtgtacggcgagagaatgagaaccgaggaggacaagaagaaggtgatcgccgtgttcaaggacgtgttcggcagcaacagcaacccctacatgggcaccagactgttcagaatcaccccctacgacgtgcagctgggctacagcgtgctgagcagaggcagctgcgtgccccaccccagcagacaccccctgctgctgctgcaccagagcttccagcccctggagagcatcatgaagtgcgtgcagatgagctggatggtgatcctggtgggccccgccagcgtgggcaagaccagcctggtgcagctgctggcccacctgaccggccacaccctgaagatcatggccatgaacagcgccatggacaccaccgagctgctgggcggcttcgagcaggtggacctgatcagaccctggagaagactgctggagaaggtggagggcaccgtgagagccctgctgagagacagcctgctgatcagcgccgacgacgccgaggtggtgctgagagcctggagccacttcctgctgacctacaagcccaagtgcctgggcgagggcggcaaggccatcaccatggagatcgtgaacaagctggaggccgtgctgctgctgatgcagagactgaacaacaagatcaacagctactgcaaggccgagttcgccaagctggtggaggagttcagaagcttcggcgtgaagctgacccagctggccagcggccacagccacggcaccttcgagtgggtggacagcatgctggtgcaggccctgaagagcggcgactggctgctgatggacaacgtgaacttctgcaaccccagcgtgctggacagactgaacgccctgctggagcccggcggcgtgctgaccatcagcgagagaggcatgatcgacggcagcacccccaccatcacccccaaccccaacttcagactgttcctgagcatggaccccgtgcacggcgacatcagcagagccatgagaaacagaggcctggagatctacatcagcggcgagggcgacgccagcacccccgacaacctggacctgaaggtgctgctgcacagcctgggcctggtgggcaacagcgtgtgcgacatcctgctggccctgcacaccgagaccagaagcaccgtggtgggcagccccaccagcagcgtgagcaccctgatccagaccgccatcctgatcgtgcagtacctgcagagaggcctgagcctggacagagccttcagcgaggcctgctgggaggtgtacgtgtgcagccagcacagccccgccaacagaaagctggtgcaggccctgctggagaagcacgtgagcagcctgagagcccacgagacctggggcgacagcatcctgggcatgggcctgtggcccgacagcgtgcccagcgccctgttcgccaccgaggacagccacctgagcaccgtgagaagagacggccagatcctggtgtactgcctgaacagaatgagcatgaagaccagcagctggaccagaagccagcccttcaccctgcaggacctggagaagatcatgcagagccccagccccgagaacctgaagttcaacgccgtggaggtgaacacctactggatcgacgagcccgacgtgctggtgatggccgtgaagctgctgatcgagagagccaccaaccaggactggatgctgagagtgaagtggctgtaccacctggccaagaacatcccccagggcctggagagcatccagatccacctggaggccagcgccgccagcctgagaaacttctacagccacagcctgagcggcgccgtgagcaacgtgttcaagatcctgcagcccaacaccaccgacgagttcgtgatccccctggaccccagatggaacatgcaggccctggacatgatcagaaacctgatggacttcgacccccagaccgaccagcccgaccagctgttcgccctgctggagagcgccgccaacaagaccatcatctacctggacagagagaagagagtgttcaccgaggccaacctggtgagcgtgggcagcaagaagctgagagagagcgtgctgagaatgagcttcgagttccaccaggaccccgagagctaccacaccctgccccacgagatcgtggtgaacctggccgccttcttcgagctgtgcgacgccctggtgctgctgtgggtgcagagcagccagggcatggtgagcgacgccagcgccaacgagatcctgggcagcctgagatggagagacagattctggaccgtggccgacaccgtgaaggtggacgcccccggcctggccctgctggccctgcactggcactgggtgctgaagcacctggtgcaccagatccccagactgctgatgaactacgaggacaagtactacaaggaggtgcagaccgtgagcgagcacatccagaactgcctgggcagccagaccggcggcttcgccggcatcaagaagctgcagaagttcctgggcagacccttccccttcaaggacaagctggtggtggagtgcttcagccagctgaaggtgctgaacaaggtgctggccatcagagagcagatgagcgccctgggcgagagcggctggcaggaggacatcaacagactgcaggtggtggccagccagtggaccctgaagaagagcctgctgcaggcctggggcctgatcctgagagccaacatcctggaggacgtgagcctggacgagctgaagaacttcgtgcacgcccagtgcctggagctgaaggccaagggcctgagcctgggcttcctggagaagaagcacgacgaggccagcagcctgagccaccccgacctgaccagcgtgatccacctgaccagaagcgtgcagctgtggcccgccatggagtacctggccatgctgtggagatacaaggtgaccgccgacttcatggcccaggcctgcctgagaagatgcagcaagaaccagcagccccagatcaacgaggagatcagccacctgatcagcttctgcctgtaccacacccccgtgaccccccaggagctgagagacctgtggagcctgctgcaccaccagaaggtgagccccgaggagatcaccagcctgtggagcgagctgttcaacagcatgttcatgagcttctggagcagcaccgtgaccaccaaccccgagtactggctgatgtggaaccccctgcccggcatgcagcagagagaggcccccaagagcgtgctggacagcaccctgaagggccccggcaacctgaacagacccatcttcagcaagtgctgcttcgaggtgctgaccagcagctggagagccagcccctgggacgtgagcggcctgcccatcctgagcagcagccacgtgaccctgggcgagtgggtggagagaacccagcagctgcaggacatcagcagcatgctgtggaccaacatggccatcagcagcgtggccgagttcagaagaaccgacagccagctgcagggccaggtgctgttcagacacctggccggcctggccgagctgctgcccgagagcagaagacaggagtacatgcagaactgcgagcagctgctgctgggcagcagccaggccttccagcacgtgggccagaccctgggcgacatggccggccaggaggtgctgcccaaggagctgctgtgccagctgctgaccagcctgcaccacttcgtgggcgagggcgagagcaagagaagcctgcccgagcccgcccagagaggcagcctgtgggtgagcctgggcctgctgcagatccagacctggctgccccaggccagattcgaccccgccgtgaagagagagtacaagctgaactacgtgaaggaggagctgcaccagctgcagtgcgagtggaagaccagaaacctgagcagccagctgcagaccggcagagacctggaggacgaggtggtggtgagctacagccacccccacgtgagactgctgagacagagaatggacagactggacaacctgacctgccacctgctgaagaagcaggccttcagaccccagctgcccgcctacgagagcctggtgcaggagatccaccactacgtgaccagcatcgccaaggcccccgccgtgcaggacctgctgaccagactgctgcaggccctgcacatcgacggccccagaagcgcccaggtggcccagagcctgctgaaggaggaggccagctggcagcagagccaccaccagttcagaaagagactgagcgaggagtacaccttctaccccgacgccgtgagccccctgcaggccagcatcctgcagctgcagcacggcatgagactggtggccagcgagctgcacaccagcctgcacagcagcatggtgggcgccgacagactgggcaccctggccaccgccctgctggccttccccagcgtgggccccaccttccccacctactacgcccacgccgacaccctgtgcagcgtgaagagcgaggaggtgctgagaggcctgggcaagctgatcctgaagagaagcggcggcaaggagctggagggcaagggccagaaggcctgccccaccagagagcagctgctgatgaacgccctgctgtacctgagaagccacgtgctgtgcaagggcgagctggaccagagagccctgcagctgttcagacacgtgtgccaggagatcatcagcgagtgggacgagcaggagagaatcgcccaggagaaggccgagcaggagagcggcctgtacagatacagaagcagaaacagcagaaccgccctgagcgaggaggaggaggaggagagagagttcagaaagcagttccccctgcacgagaaggacttcgccgacatcctggtgcagcccaccctggaggagaacaagggcaccagcgacggccaggaggaggaggccggcaccaaccccgccctgctgagccagaacagcatgcaggccgtgatgctgatccaccagcagctgtgcctgaacttcgccagaagcctgtggtaccagcagaccctgcccccccacgaggccaagcactacctgagcctgttcctgagctgctaccagaccggcgccagcctggtgacccacttctaccccctgatgggcgtggagctgaacgacagactgctgggcagccagctgctggcctgcaccctgagccacaacaccctgttcggcgaggcccccagcgacctgatggtgaagcccgacggcccctacgacttctaccagcaccccaacgtgcccgaggccagacagtgccagcccgtgctgcagggcttcagcgaggccgtgagccacctgctgcaggactggcccgagcaccccgccctggagcagctgctggtggtgatggacagaatcagaagcttccccctgagcagccccatcagcaagttcctgaacggcctggagatcctgctggccaaggcccaggactgggaggagaacgccagcagagccctgagcctgagaaagcacctggacctgatcagccagatgatcatcagatggagaaagctggagctgaactgctggagcatgagcctggacaacaccatgaagagacacaccgagaagagcaccaagcactggttcagcatctaccagatgctggagaagcacatgcaggagcagaccgaggagcaggaggacgacaagcagatgaccctgatgctgctggtgagcaccctgcaggccttcatcgagggcagcagcctgggcgagttccacgtgagactgcagatgctgctggtgttccactgccacgtgctgctgatgccccaggtggagggcaaggacagcctgtgcagcgtgctgtggaacctgtaccactactacaagcagttcttcgacagagtgcaggccaagatcgtggagctgagaagccccctggagaaggagctgaaggagttcgtgaagatcagcaagtggaacgacgtgagcttctggagcatcaagcagagcgtggagaagacccacagaaccctgttcaagttcatgaagaagttcgaggccgtgctgagcgagccctgcagaagcagcctggtggagagcgacaaggaggagcagcccgacttcctgcccagacccaccgacggcgccgccagcgagctgagcagcatccagaacctgaacagagccctgagagagaccctgctggcccagcccgccgccggccaggccaccatccccgagtggtgccagggcgccgcccccagcggcctggagggcgagctgctgagaagactgcccaagctgagaaagagaatgagaaagatgtgcctgaccttcatgaaggagagccccctgcccagactggtggagggcctggaccagttcaccggcgaggtgatcagcagcgtgagcgagctgcagagcctgaaggtggagcccagcgccgagaaggagaagcagagaagcgaggccaagcacatcctgatgcagaagcagagagccctgagcgacctgttcaagcacctggccaagatcggcctgagctacagaaagggcctggcctgggccagaagcaagaacccccaggagatgctgcacctgcaccccctggacctgcagagcgccctgagcatcgtgagcagcacccaggaggccgacagcagactgctgaccgagatcagcagcagctgggacggctgccagaagtacttctacagaagcctggccagacacgccagactgaacgccgccctggccacccccgccaaggagatgggcatgggcaacgtggagagatgcagaggcttcagcgcccacctgatgaagatgctggtgagacagagaagaagcctgaccaccctgagcgagcagtggatcatcctgagaaacctgctgagctgcgtgcaggagatccacagcagactgatgggcccccaggcctaccccgtggccttccccccccaggacggcgtgcagcagtggaccgagagactgcagcacctggccatgcagtgccagatcctgctggagcagctgagctggctgctgcagtgctgccccagcgtgggccccgcccccggccacggcaacgtgcaggtgctgggccagccccccggcccctgcctggagggccccgagctgagcaagggccagctgtgcggcgtggtgctggacctgatccccagcaacctgagctaccccagccccatccccggcagccagctgcccagcggctgcagaatgagaaagcaggaccacctgtggcagcagagcaccaccagactgaccgagatgctgaagaccatcaagaccgtgaaggccgacgtggacaagatcagacagcagagctgcgagaccctgttccacagctggaaggacttcgaggtgtgcagcagcgccctgagctgcctgagccaggtgagcgtgcacctgcagggcctggagagcctgttcatcctgcccggcatggaggtggagcagagagacagccagatggccctggtggagagcctggagtacgtgagaggcgagatcagcaaggccatggccgacttcaccacctggaagacccacctgctgaccagcgacagccagggcggcaaccagatgctggacgagggcttcgtggaggacttcagcgagcagatggagatcgccatcagagccatcctgtgcgccatccagaacctggaggagagaaagaacgagaaggccgaggagaacaccgaccaggccagcccccaggaggactacgccggcttcgagagactgcagagcggccacctgaccaagctgctggaggacgacttctgggccgacgtgagcaccctgcacgtgcagaagatcatcagcgccatcagcgagctgctggagagactgaagagctacggcgaggacggcaccgccgccaagcacctgttcttcagccagagctgcagcctgctggtgagactggtgcccgtgctgagcagctacagcgacctggtgctgttcttcctgaccatgagcctggccacccacagaagcaccgccaagctgctgagcgtgctggcccaggtgttcaccgagctggcccagaagggcttctgcctgcccaaggagttcatggaggacagcgccggcgagggcgccaccgagttccacgactacgagggcggcggcatcggcgagggcgagggcatgaaggacgtgagcgaccagatcggcaacgaggagcaggtggaggacaccttccagaagggccaggagaaggacaaggaggaccccgacagcaagagcgacatcaagggcgaggacaacgccatcgagatgagcgaggacttcgacggcaagatgcacgacggcgagctggaggagcaggaggaggacgacgagaagagcgacagcgagggcggcgacctggacaagcacatgggcgacctgaacggcgaggaggccgacaagctggacgagagactgtggggcgacgacgacgaggaggaggacgaggaggaggaggacaacaagaccgaggagaccggccccggcatggacgaggaggacagcgagctggtggccaaggacgacaacctggacagcggcaacagcaacaaggacaagagccagcaggacaagaaggaggagaaggaggaggccgaggccgacgacggcggccagggcgaggacaagatcaacgagcagatcgacgagagagactacgacgagaacgaggtggacccctaccacggcaaccaggagaaggtgcccgagcccgaggccctggacctgcccgacgacctgaacctggacagcgaggacaagaacggcggcgaggacaccgacaacgaggagggcgaggaggagaaccccctggagatcaaggagaagcccgaggaggccggccacgaggccgaggagagaggcgagaccgagaccgaccagaacgagagccagagcccccaggagcccgaggagggccccagcgaggacgacaaggccgagggcgaggaggagatggacaccggcgccgacgaccaggacggcgacgccgcccagcaccccgaggagcacagcgaggagcagcagcagagcgtggaggagaaggacaaggaggccgacgaggagggcggcgagaacggccccgccgaccagggcttccagccccaggaggaggaggagagagaggacagcgacaccgaggagcaggtgcccgaggccctggagagaaaggagcacgccagctgcggccagaccggcgtggagaacatgcagaacacccaggccatggagctggccggcgccgcccccgagaaggagcagggcaaggaggagcacggcagcggcgccgccgacgccaaccaggccgagggccacgagagcaacttcatcgcccagctggccagccagaagcacaccagaaagaacacccagagcttcaagagaaagcccggccaggccgacaacgagagaagcatgggcgaccacaacgagagagtgcacaagagactgagaaccgtggacaccgacagccacgccgagcagggccccgcccagcagccccaggcccaggtggaggacgccgacgccttcgagcacatcaagcagggcagcgacgcctacgacgcccagacctacgacgtggccagcaaggagcagcagcagagcgccaaggacagcggcaaggaccaggaggaggaggagatcgaggacaccctgatggacaccgaggagcaggaggagttcaaggccgccgacgtggagcagctgaagcccgaggagatcaagagcggcaccaccgcccccctgggcttcgacgagatggaggtggagatccagaccgtgaagaccgaggaggaccaggaccccagaaccgacaaggcccacaaggagaccgagaacgagaagcccgagagaagcagagagagcaccatccacaccgcccaccagttcctgatggacaccatcttccagcccttcctgaaggacgtgaacgagctgagacaggagctggagagacagctggagatgtggcagcccagagagagcggcaaccccgaggaggagaaggtggccgccgagatgtggcagagctacctgatcctgaccgcccccctgagccagagactgtgcgaggagctgagactgatcctggagcccacccaggccgccaagctgaagggcgactacagaaccggcaagagactgaacatcagaaaggtgatcccctacatcgccagccagttcagaaaggacaagatctggctgagaagaaccaagcccagcaagagacagtaccagatctgcctggccatcgacgacagcagcagcatggtggacaaccacaccaagcagctggccttcgagagcctggccgtgatcggcaacgccctgaccctgctggaggtgggccagatcgccgtgtgcagcttcggcgagagcgtgaagctgctgcaccccttccacgagcagttcagcgactacagcggcagccagatcctgagactgtgcaagttccagcagaagaagaccaagatcgcccagttcctggagagcgtggccaacatgttcgccgccgcccagcagctgagccagaacatcagcagcgagaccgcccagctgctgctggtggtgagcgacggcagaggcctgttcctggagggcaaggagagagtgctggccgccgtgcaggccgccagaaacgccaacatcttcgtgatcttcgtggtgctggacaaccccagcagcagagacagcatcctggacatcaaggtgcccatcttcaagggccccggcgagatgcccgagatcagaagctacatggaggagttccccttcccctactacatcatcctgagagacgtgaacgccctgcccgagaccctgagcgacgccctgagacagtggttcgagctggtgaccgccagcgaccacccctag

SEQ ID NO: 8602 - DNA, 16791 bp, Artificial Sequence; identical to SEQ ID NO: 8601
  Description of Artificial Sequence: Synthetic coding sequence

SEQ ID NO: 8603 - DNA, 3546 bp, Artificial Sequence
  Description of Artificial Sequence: Synthetic coding sequence
atggagcacttcctgctggaggtggccgccgcccccctgagactgatcgccgccaagaacgagaagagcagaagcgagctgggcagattcctggccaagcaggtgtggaccccccaggacagacagtgcgtgctgagcaccctggcccagctgctgctggacaaggactgcaccgtgctggtgggcagacagctgagacccctgctgctggacctgctggagagaaacgccgaggccatcaaggccggcggccagatcaaccacgacctgcacgagagactgtgcgtgagcatgagcaagctgatcggcaaccaccccgacgtgctgcccttcgccctgagatacttcaaggacaccagccccgtgttccagagactgttcctggagagcagcgacgccaaccccgtgagatacggcagaagaagaatgaagctgagagacctgatggaggccgccttcaagttcctgcagcaggagcagagcgtgttcagagagctgtgggactggagcgtgtgcgtgcccctgctgagaagccacgacaccctggtgagatggtacaccgccaactgcctggccctggtgacctgcatgaacgaggagcacaagctgagcttcctgaagaagatcttcaacagcgacgagctgatccacttcagactgagactgctggaggaggcccagctgcaggacctggagaaggccctggtgctggccaaccccgaggtgagcctgtggagaaagcagaaggagctgcagtacctgcagggccacctggtgagcagcgacctgagccccagagtgaccgccgtgtgcggcgtggtgctgcccggccagctgcccgcccccggcgagctgggcggcaacagaagcagcagcagagagcaggagctggccctgagaagctacgtgctggtggagagcgtgtgcaagagcctgcagaccctggccatggccgtggccagccagaacgccgtgctgctggagggccccatcggctgcggcaagaccagcctggtggagtacctggccgccgtgaccggcagaaccaagcccccccagctgctgaaggtgcagctgggcgaccagaccgacagcaagatgctgctgggcatgtacagatgcaccgacgtgcccggcgagttcgtgtggcagcccggcaccctgacccaggccgccaccatgggccactggatcctgctggaggacatcgactacgcccccctggacgtggtgctgcagagcagataccccagcctgctggccgtggtggaccacctgctggacatctacatccagctgaccggcgagaagcaccacagctggagcgacagcagcgtgggctgcgagcaggcccccgaggaggtgagcgaggccagaagagagaacaagagacccaccctggagggcagagagctgagcctgagagacctgctgaactggtgcaacagaatcgcccacagcttcgacagcagcagcctgagcgccagcctgaacatcttccaggaggccctggactgcttcaccgccatgctgagcgagcacaccagcaagctgaagatggccgaggtgatcggcagcaagctgaacatcagcagaaagaaggccgagttcttctgccagctgtacaagcccgagatcgtgatcaacgagctggacctgcaggtgggcagagtgagactgctgagaaagcagagcgaggccgtgcacctgcagagagagaagttcaccttcgccgccaccagacccagcagcgtgctgatcgagcagctggccgtgtgcgtgagcaagggcgagcccgtgctgctggtgggcgagaccggcaccggcaagaccagcaccatccagtacctggcccacatcaccggccacagactgagagtggtgaacatgaaccagcagagcgacaccgccgacctgctgggcggctacaagcccgtggaccacaagctgatctggctgcccctgagagaggccttcgaggagctgttcgcccagaccttcagcaagaagcagaacttcaccttcctgggccacatccagacctgctacagacagaagagatggcacgacctgctgagactgatgcagcacgtgcacaagagcgccgtgaacaaggacggcaaggacagcgagaccggcctgctgatcaaggagaagtgggaggccttcggcctgagactgaaccacgcccagcagcagatgaagatgaccgagaacaccctgctgttcgccttcgtggagggcaccctggcccaggccgtgaagaagggcgagtggatcctgctggacgagatcaacctggccgcccccgagatcctggagtgcctgagcggcctgctggagggcagcagcggcagcctggtgctgctggacagaggcgacaccgagcccctggtgagacaccccgacttcagactgttcgcctgcatgaaccccgccaccgacgtgggcaagagaaacctgccccccggcatcagaaacagattcaccgagctgtacgtggaggagctggagagcaaggaggacctgcaggtgctgatcgtggactacctgaagggcctgagcgtgaacaagaacaccgtgcagggcatcatcaacttctacaccgccctgagaaaggagagcggcaccaagctggtggacggcaccggccacagaccccactacagcctgagaaccctgtgcagagccctgagattcgccgccagcaacccctgcggcaacatccagagaagcctgtacgagggcttctgcctgggcttcctgacccagctggacagagccagccaccccatcgtgcagaagctgatctgccagcacatcgtgcccggcaacgtgaagagcctgctgaagcagcccatccccgagcccaagggcggcagactgatccaggtggagggctactggatcgccgtgggcgacaaggagcccaccatcgacgagacctacatcctgaccagcagcgtgaagctgaacctgagagacatcgtgagagtggtgagcgccggcacctaccccgtgctgatccagggcgagaccagcgtgggcaagaccagcctgatccagtggctggccgccgccaccggcaaccactgcgtgagaatcaacaaccacgagcacaccgacatccaggagtacatcggctgctacaccagcgacagcagcggcaagctggtgttcaaggagggcgtgctgatcgacgccatgagaaagggctactggatcatcctggacgagctgaacctggcccccaccgacgtgctggaggccctgaacagactgctggacgacaacagagagctgctggtgaccgagacccaggaggtggtgaaggcccaccccagattcatgctgttcgccacccagaacccccccggcctgtacggcggcagaaaggtgctgagcagagccttcagaaacagattcgtggagctgcacttcgacgagctgcccagcagcgagctggagaccatcctgcacaagagatgcagcctgccccccagctactgcagcaagctggtgaaggtgatgctggacctgcagtag

SEQ ID NO: 8604 - DNA, 3351 bp, Artificial Sequence
  Description of Artificial Sequence: Synthetic coding sequence
atgatcctggacgagttctacaacgtgaagttctgcatcgacgccagccagcccgacgtgggcagctggctgaagtacatcagattcgccggctgctacgaccagcacaacctggtggcctgccagatcaacgaccagatcttctacagagtggtggccgacatcgcccccggcgaggagctgctgctgttcatgaagagcgaggactacccccacgagaccatggcccccgacatccacgaggagagacagtacagatgcgaggactgcgaccagctgttcgagagcaaggccgagctggccgaccaccagaagttcccctgcagcaccccccacagcgccttcagcatggtggaggaggacttccagcagaagctggagagcgagaacgacctgcaggagatccacaccatccaggagtgcaaggagtgcgaccaggtgttccccgacctgcagagcctggagaagcacatgctgagccacaccgaggagagagagtacaagtgcgaccagtgccccaaggccttcaactggaagagcaacctgatcagacaccagatgagccacgacagcggcaagcactacgagtgcgagaactgcgccaagcaggtgttcaccgaccccagcaacctgcagagacacatcagaagccagcacgtgggcgccagagcccacgcctgccccgagtgcggcaagaccttcgccaccagcagcggcctgaagcagcacaagcacatccacagcagcgtgaagcccttcatctgcgaggtgtgccacaagagctacacccagttcagcaacctgtgcagacacaagagaatgcacgccgactgcagaacccagatcaagtgcaaggactgcggccagatgttcagcaccaccagcagcctgaacaagcacagaagattctgcgagggcaagaaccacttcgccgccggcggcttcttcggccagggcatcagcctgcccggcacccccgccatggacaagaccagcatggtgaacatgagccacgccaaccccggcctggccgactacttcggcgccaacagacaccccgccggcctgaccttccccaccgcccccggcttcagcttcagcttccccggcctgttccccagcggcctgtaccacagaccccccctgatccccgccagcagccccgtgaagggcctgagcagcaccgagcagaccaacaagagccagagccccctgatgacccacccccagatcctgcccgccacccaggacatcctgaaggccctgagcaagcaccccagcgtgggcgacaacaagcccgtggagctgcagcccgagagaagcagcgaggagagacccttcgagaagatcagcgaccagagcgagagcagcgacctggacgacgtgagcacccccagcggcagcgacctggagaccaccagcggcagcgacctggagagcgacatcgagagcgacaaggagaagttcaaggagaacggcaagatgttcaaggacaaggtgagccccctgcagaacctggccagcatcaacaacaagaaggagtacagcaaccacagcatcttcagccccagcctggaggagcagaccgccgtgagcggcgccgtgaacgacagcatcaaggccatcgccagcatcgccgagaagtacttcggcagcaccggcctggtgggcctgcaggacaagaaggtgggcgccctgccctaccccagcatgttccccctgcccttcttccccgccttcagccagagcatgtaccccttccccgacagagacctgagaagcctgcccctgaagatggagccccagagccccggcgaggtgaagaagctgcagaagggcagcagcgagagccccttcgacctgaccaccaagagaaaggacgagaagcccctgacccccgtgcccagcaagccccccgtgacccccgccaccagccaggaccagcccctggacctgagcatgggcagcagaagcagagccagcggcaccaagctgaccgagcccagaaagaaccacgtgttcggcggcaagaagggcagcaacgtggagagcagacccgccagcgacggcagcctgcagcacgccagacccacccccttcttcatggaccccatctacagagtggagaagagaaagctgaccgaccccctggaggccctgaaggagaagtacctgagacccagccccggcttcctgttccacccccagttccagctgcccgaccagagaacctggatgagcgccatcgagaacatggccgagaagctggagagcttcagcgccctgaagcccgaggccagcgagctgctgcagagcgtgcccagcatgttcaacttcagagccccccccaacgccctgcccgagaacctgctgagaaagggcaaggagagatacacctgcagatactgcggcaagatcttccccagaagcgccaacctgaccagacacctgagaacccacaccggcgagcagccctacagatgcaagtactgcgacagaagcttcagcatcagcagcaacctgcagagacacgtgagaaacatccacaacaaggagaagcccttcaagtgccacctgtgcgacagatgcttcggccagcagaccaacctggacagacacctgaagaagcacgagaacggcaacatgagcggcaccgccaccagcagcccccacagcgagctggagagcaccggcgccatcctggacgacaaggaggacgcctacttcaccgagatcagaaacttcatcggcaacagcaaccacggcagccagagccccagaaacgtggaggagagaatgaacggcagccacttcaaggacgagaaggccctggtgaccagccagaacagcgacctgctggacgacgaggaggtggaggacgaggtgctgctggacgaggaggacgaggacaacgacatcaccggcaagaccggcaaggagcccgtgaccagcaacctgcacgagggcaaccccgaggacgactacgaggagaccagcgccctggagatgagctgcaagaccagccccgtgagatacaaggaggaggagtacaagagcggcctgagcgccctggaccacatcagacacttcaccgacagcctgaagatgagaaagatggaggacaaccagtacagcgaggccgagctgagcagcttcagcaccagccacgtgcccgaggagctgaagcagcccctgcacagaaagagcaagagccaggcctacgccatgatgctgagcctgagcgacaaggagagcctgcacagcaccagccacagcagcagcaacgtgtggcacagcatggccagagccgccgccgagagcagcgccatccagagcatcagccacgtgtag

SEQ ID NO: 8605 - DNA, 3156 bp, Artificial Sequence
  Description of Artificial Sequence: Synthetic coding sequence
atgaagagcgaggactacccccacgagaccatggcccccgacatccacgaggagagacagtacagatgcgaggactgcgaccagctgttcgagagcaaggccgagctggccgaccaccagaagttcccctgcagcaccccccacagcgccttcagcatggtggaggaggacttccagcagaagctggagagcgagaacgacctgcaggagatccacaccatccaggagtgcaaggagtgcgaccaggtgttccccgacctgcagagcctggagaagcacatgctgagccacaccgaggagagagagtacaagtgcgaccagtgccccaaggccttcaactggaagagcaacctgatcagacaccagatgagccacgacagcggcaagcactacgagtgcgagaactgcgccaaggtgttcaccgaccccagcaacctgcagagacacatcagaagccagcacgtgggcgccagagcccacgcctgccccgagtgcggcaagaccttcgccaccagcagcggcctgaagcagcacaagcacatccacagcagcgtgaagcccttcatctgcgaggtgtgccacaagagctacacccagttcagcaacctgtgcagacacaagagaatgcacgccgactgcagaacccagatcaagtgcaaggactgcggccagatgttcagcaccaccagcagcctgaacaagcacagaagattctgcgagggcaagaaccacttcgccgccggcggcttcttcggccagggcatcagcctgcccggcacccccgccatggacaagaccagcatggtgaacatgagccacgccaaccccggcctggccgactacttcggcgccaacagacaccccgccggcctgaccttccccaccgcccccggcttcagcttcagcttccccggcctgttccccagcggcctgtaccacagaccccccctgatccccgccagcagccccgtgaagggcctgagcagcaccgagcagaccaacaagagccagagccccctgatgacccacccccagatcctgcccgccacccaggacatcctgaaggccctgagcaagcaccccagcgtgggcgacaacaagcccgtggagctgcagcccgagagaagcagcgaggagagacccttcgagaagatcagcgaccagagcgagagcagcgacctggacgacgtgagcacccccagcggcagcgacctggagaccaccagcggcagcgacctggagagcgacatcgagagcgacaaggagaagttcaaggagaacggcaagatgttcaaggacaaggtgagccccctgcagaacctggccagcatcaacaacaagaaggagtacagcaaccacagcatcttcagccccagcctggaggagcagaccgccgtgagcggcgccgtgaacgacagcatcaaggccatcgccagcatcgccgagaagtacttcggcagcaccggcctggtgggcctgcaggacaagaaggtgggcgccctgccctaccccagcatgttccccctgcccttcttccccgccttcagccagagcatgtaccccttccccgacagagacctgagaagcctgcccctgaagatggagccccagagccccggcgaggtgaagaagctgcagaagggcagcagcgagagccccttcgacctgaccaccaagagaaaggacgagaagcccctgacccccgtgcccagcaagccccccgtgacccccgccaccagccaggaccagcccctggacctgagcatgggcagcagaagcagagccagcggcaccaagctgaccgagcccagaaagaaccacgtgttcggcggcaagaagggcagcaacgtggagagcagacccgccagcgacggcagcctgcagcacgccagacccacccccttcttcatggaccccatctacagagtggagaagagaaagctgaccgaccccctggaggccctgaaggagaagtacctgagacccagccccggcttcctgttccacccccagttccagctgcccgaccagagaacctggatgagcgccatcgagaacatggccgagaagctggagagcttcagcgccctgaagcccgaggccagcgagctgctgcagagcgtgcccagcatgttcaacttcagagccccccccaacgccctgcccgagaacctgctgagaaagggcaaggagagatacacctgcagatactgcggcaagatcttccccagaagcgccaacctgaccagacacctgagaacccacaccggcgagcagccctacagatgcaagtactgcgacagaagcttcagcatcagcagcaacctgcagagacacgtgagaaacatccacaacaaggagaagcccttcaagtgccacctgtgcgacagatgcttcggccagcagaccaacctggacagacacctgaagaagcacgagaacggcaacatgagcggcaccgccaccagcagcccccacagcgagctggagagcaccggcgccatcctggacgacaaggaggacgcctacttcaccgagatcagaaacttcatcggcaacagcaaccacggcagccagagccccagaaacgtggaggagagaatgaacggcagccacttcaaggacgagaaggccctggtgaccagccagaacagcgacctgctggacgacgaggaggtggaggacgaggtgctgctggacgaggaggacgaggacaacgacatcaccggcaagaccggcaaggagcccgtgaccagcaacctgcacgagggcaaccccgaggacgactacgaggagaccagcgccctggagatgagctgcaagaccagccccgtgagatacaaggaggaggagtacaagagcggcctgagcgccctggaccacatcagacacttcaccgacagcctgaagatgagaaagatggaggacaaccagtacagcgaggccgagctgagcagcttcagcaccagccacgtgcccgaggagctgaagcagcccctgcacagaaagagcaagagccaggcctacgccatgatgctgagcctgagcgacaaggagagcctgcacagcaccagccacagcagcagcaacgtgtggcacagcatggccagagccgccgccgagagcagcgccatccagagcatcagccacgtgtag

SEQ ID NO: 8606 - DNA, 3159 bp, Artificial Sequence
  Description of Artificial Sequence: Synthetic coding sequence
atgaagagcgaggactacccccacgagaccatggcccccgacatccacgaggagagacagtacagatgcgaggactgcgaccagctgttcgagagcaaggccgagctggccgaccaccagaagttcccctgcagcaccccccacagcgccttcagcatggtggaggaggacttccagcagaagctggagagcgagaacgacctgcaggagatccacaccatccaggagtgcaaggagtgcgaccaggtgttccccgacctgcagagcctggagaagcacatgctgagccacaccgaggagagagagtacaagtgcgaccagtgccccaaggccttcaactggaagagcaacctgatcagacaccagatgagccacgacagcggcaagcactacgagtgcgagaactgcgccaagcaggtgttcaccgaccccagcaacctgcagagacacatcagaagccagcacgtgggcgccagagcccacgcctgccccgagtgcggcaagaccttcgccaccagcagcggcctgaagcagcacaagcacatccacagcagcgtgaagcccttcatctgcgaggtgtgccacaagagctacacccagttcagcaacctgtgcagacacaagagaatgcacgccgactgcagaacccagatcaagtgcaaggactgcggccagatgttcagcaccaccagcagcctgaacaagcacagaagattctgcgagggcaagaaccacttcgccgccggcggcttcttcggccagggcatcagcctgcccggcacccccgccatggacaagaccagcatggtgaacatgagccacgccaaccccggcctggccgactacttcggcgccaacagacaccccgccggcctgaccttccccaccgcccccggcttcagcttcagcttccccggcctgttccccagcggcctgtaccacagaccccccctgatccccgccagcagccccgtgaagggcctgagcagcaccgagcagaccaacaagagccagagccccctgatgacccacccccagatcctgcccgccacccaggacatcctgaaggccctgagcaagcaccccagcgtgggcgacaacaagcccgtggagctgcagcccgagagaagcagcgaggagagacccttcgagaagatcagcgaccagagcgagagcagcgacctggacgacgtgagcacccccagcggcagcgacctggagaccaccagcggcagcgacctggagagcgacatcgagagcgacaaggagaagttcaaggagaacggcaagatgttcaaggacaaggtgagccccctgcagaacctggccagcatcaacaacaagaaggagtacagcaaccacagcatcttcagccccagcctggaggagcagaccgccgtgagcggcgccgtgaacgacagcatcaaggccatcgccagcatcgccgagaagtacttcggcagcaccggcctggtgggcctgcaggacaagaaggtgggcgccctgccctaccccagcatgttccccctgcccttcttccccgccttcagccagagcatgtaccccttccccgacagagacctgagaagcctgcccctgaagatggagccccagagccccggcgaggtgaagaagctgcagaagggcagcagcgagagccccttcgacctgaccaccaagagaaaggacgagaagcccctgacccccgtgcccagcaagccccccgtgacccccgccaccagccaggaccagcccctggacctgagcatgggcagcagaagcagagccagcggcaccaagctgaccgagcccagaaagaaccacgtgttcggcggcaagaagggcagcaacgtggagagcagacccgccagcgacggcagcctgcagcacgccagacccacccccttcttcatggaccccatctacagagtggagaagagaaagctgaccgaccccctggaggccctgaaggagaagtacctgagacccagccccggcttcctgttccacccccagttccagctgcccgaccagagaacctggatgagcgccatcgagaacatggccgagaagctggagagcttcagcgccctgaagcccgaggccagcgagctgctgcagagcgtgcccagcatgttcaacttcagagccccccccaacgccctgcccgagaacctgctgagaaagggcaaggagagatacacctgcagatactgcggcaagatcttccccagaagcgccaacctgaccagacacctgagaacccacaccggcgagcagccctacagatgcaagtactgcgacagaagcttcagcatcagcagcaacctgcagagacacgtgagaaacatccacaacaaggagaagcccttcaagtgccacctgtgcgacagatgcttcggccagcagaccaacctggacagacacctgaagaagcacgagaacggcaacatgagcggcaccgccaccagcagcccccacagcgagctggagagcaccggcgccatcctggacgacaaggaggacgcctacttcaccgagatcagaaacttcatcggcaacagcaaccacggcagccagagccccagaaacgtggaggagagaatgaacggcagccacttcaaggacgagaaggccctggtgaccagccagaacagcgacctgctggacgacgaggaggtggaggacgaggtgctgctggacgaggaggacgaggacaacgacatcaccggcaagaccggcaaggagcccgtgaccagcaacctgcacgagggcaaccccgaggacgactacgaggagaccagcgccctggagatgagctgcaagaccagccccgtgagatacaaggaggaggagtacaagagcggcctgagcgccctggaccacatcagacacttcaccgacagcctgaagatgagaaagatggaggacaaccagtacagcgaggccgagctgagcagcttcagcaccagccacgtgcccgaggagctgaagcagcccctgcacagaaagagcaagagccaggcctacgccatgatgctgagcctgagcgacaaggagagcctgcacagcaccagccacagcagcagcaacgtgtggcacagcatggccagagccgccgccgagagcagcgccatccagagcatcagccacgtgtag

SEQ ID NO: 8607 - DNA, 3012 bp, Artificial Sequence
  Description of Artificial Sequence: Synthetic coding sequence
atgaagagcgaggactacccccacgagaccatggcccccgacatccacgaggagagacagtacagatgcgaggactgcgaccagctgttcgagagcaaggccgagctggccgaccaccagaagttcccctgcagcaccccccacagcgccttcagcatggtggaggaggacttccagcagaagctggagagcgagaacgacctgcaggagatccacaccatccaggagtgcaaggagtgcgaccaggtgttccccgacctgcagagcctggagaagcacatgctgagccacaccgaggagagagagtacaagtgcgaccagtgccccaaggccttcaactggaagagcaacctgatcagacaccagatgagccacgacagcggcaagcactacgagtgcgagaactgcgccaaggtgttcaccgaccccagcaacctgcagagacacatcagaagccagcacgtgggcgccagagcccacgcctgccccgagtgcggcaagaccttcgccaccagcagcggcctgaagcagcacaagcacatccacagcagcgtgaagcccttcatctgcgaggtgtgccacaagagctacacccagttcagcaacctgtgcagacacaagagaatgcacgccgactgcagaacccagatcaagtgcaaggactgcggccagatgttcagcaccaccagcagcctgaacaagcacagaagattctgcgagggcaagaaccacttcgccgccggcggcttcttcggccagggcatcagcctgcccggcacccccgccatggacaagaccagcatggtgaacatgagccacgccaaccccggcctggccgactacttcggcgccaacagacaccccgccggcctgaccttccccaccgcccccggcttcagcttcagcttccccggcctgttccccagcggcctgtaccacagaccccccctgatccccgccagcagccccgtgaagggcctgagcagcaccgagcagaccaacaagagccagagccccctgatgacccacccccagatcctgcccgccacccaggacatcctgaaggccctgagcaagcaccccagcgtgggcgacaacaagcccgtggagctgcagcccgagagaagcagcgaggagagacccttcgagaagatcagcgaccagagcgagagcagcgacctggacgacgtgagcacccccagcggcagcgacctggagaccaccagcggcagcgacctggagagcgacatcgagagcgacaaggagaagttcaaggagaacggcaagatgttcaaggacaaggtgagccccctgcagaacctggccagcatcaacaacaagaaggagtacagcaaccacagcatcttcagccccagcctggaggagcagaccgccgtgagcggcgccgtgaacgacagcatcaaggccatcgccagcatcgccgagaagtacttcggcagcaccggcctggtgggcctgcaggacaagaaggtgggcgccctgccctaccccagcatgttccccctgcccttcttccccgccttcagccagagcatgtaccccttccccgacagagacctgagaagcctgcccctgaagatggagccccagagccccggcgaggtgaagaagctgcagaagggcagcagcgagagccccttcgacctgaccaccaagagaaaggacgagaagcccctgacccccgtgcccagcaagccccccgtgacccccgccaccagccaggaccagcccctggacctgagcatgggcagcagaagcagagccagcggcaccaagctgaccgagcccagaaagaaccacgtgttcggcggcaagaagggcagcaacgtggagagcagacccgccagcgacggcagcctgcagcacgccagacccacccccttcttcatggaccccatctacagagtggagaagagaaagctgaccgaccccctggaggccctgaaggagaagtacctgagacccagccccggcttcctgttccacccccagatgagcgccatcgagaacatggccgagaagctggagagcttcagcgccctgaagcccgaggccagcgagctgctgcagagcgtgcccagcatgttcaacttcagagccccccccaacgccctgcccgagaacctgctgagaaagggcaaggagagatacacctgcagatactgcggcaagatcttccccagaagcgccaacctgaccagacacctgagaacccacaccggcgagcagccctacagatgcaagtactgcgacagaagcttcagcatcagcagcaacctgcagagacacgtgagaaacatccacaacaaggagaagcccttcaagtgccacctgtgcgacagatgcttcggccagcagaccaacctggacagacacctgaagaagcacgagaacggcaacatgagcggcaccgccaccagcagcccccacagcgagctggagagcaccggcgccatcctggacgacaaggaggacgcctacttcaccgagatcagaaacttcatcggcaacagcaaccacggcagccagagccccagaaacgtggaggagagaatgaacggcagccacttcaaggacgagaaggccctggtgaccagccagaacagcgacctgctggacgacgaggaggtggaggacgaggtgctgctggacgaggaggacgaggacaacgacatcaccggcaagaccggcaaggagcccgtgaccagcaacctgcacgagggcaaccccgaggacgactacgaggagaccagcgccctggagatgagctgcaagaccagccccgtgagatacaaggaggaggagtacaagagcggcctgagcgccctggaccacatcagacacttcaccgacagcctgaagatgagaaagatggaggacaaccagtacagcgaggccgagctgagcagcttcagcaccagccacgtgcccgaggagctgaagcagcccctgcacagaaagagcaagagccaggaggagagcaaggcctag

SEQ ID NO: 8608 - DNA, 312 bp, Artificial Sequence
  Description of Artificial Sequence: Synthetic coding sequence
atgaagagcgaggactacccccacgagaccatggcccccgacatccacgaggagagacagtacagatgcgaggactgcgaccagctgttcgagagcaaggccgagctggccgaccaccagaagttcccctgcagcaccccccacagcgccttcagcatggtggaggaggacttccagcagaagctggagagcgagaacgacctgcaggagatccacaccatccaggagtgcaaggagtgcgaccaggtgttccccgacctgcagagcctggagaagcacatgctgagccacaccgaggagagagagtactag

SEQ ID NO: 8609 - DNA, 3129 bp, Artificial Sequence
  Description of Artificial Sequence: Synthetic coding sequence
atgaagagcgaggactacccccacgagaccatggcccccgacatccacgaggagagacagtacagatgcgaggactgcgaccagctgttcgagagcaaggccgagctggccgaccaccagaagttcccctgcagcaccccccacagcgccttcagcatggtggaggaggacttccagcagaagctggagagcgagaacgacctgcaggagatccacaccatccaggagtgcaaggagtgcgaccaggtgttccccgacctgcagagcctggagaagcacatgctgagccacaccgaggagagagagtacaagtgcgaccagtgccccaaggccttcaactggaagagcaacctgatcagacaccagatgagccacgacagcggcaagcactacgagtgcgagaactgcgccaaggtgttcaccgaccccagcaacctgcagagacacatcagaagccagcacgtgggcgccagagcccacgcctgccccgagtgcggcaagaccttcgccaccagcagcggcctgaagcagcacaagcacatccacagcagcgtgaagcccttcatctgcgaggtgtgccacaagagctacacccagttcagcaacctgtgcagacacaagagaatgcacgccgactgcagaacccagatcaagtgcaaggactgcggccagatgttcagcaccaccagcagcctgaacaagcacagaagattctgcgagggcaagaaccacttcgccgccggcggcttcttcggccagggcatcagcctgcccggcacccccgccatggacaagaccagcatggtgaacatgagccacgccaaccccggcctggccgactacttcggcgccaacagacaccccgccggcctgaccttccccaccgcccccggcttcagcttcagcttccccggcctgttccccagcggcctgtaccacagaccccccctgatccccgccagcagccccgtgaagggcctgagcagcaccgagcagaccaacaagagccagagccccctgatgacccacccccagatcctgcccgccacccaggacatcctgaaggccctgagcaagcaccccagcgtgggcgacaacaagcccgtggagctgcagcccgagagaagcagcgaggagagacccttcgagaagatcagcgaccagagcgagagcagcgacctggacgacgtgagcacccccagcggcagcgacctggagaccaccagcggcagcgacctggagagcgacatcgagagcgacaaggagaagttcaaggagaacggcaagatgttcaaggacaaggtgagccccctgcagaacctggccagcatcaacaacaagaaggagtacagcaaccacagcatcttcagccccagcctggaggagcagaccgccgtgagcggcgccgtgaacgacagcatcaaggccatcgccagcatcgccgagaagtacttcggcagcaccggcctggtgggcctgcaggacaagaaggtgggcgccctgccctaccccagcatgttccccctgcccttcttccccgccttcagccagagcatgtaccccttccccgacagagacctgagaagcctgcccctgaagatggagccccagagccccggcgaggtgaagaagctgcagaagggcagcagcgagagccccttcgacctgaccaccaagagaaaggacgagaagcccctgacccccgtgcccagcaagccccccgtgacccccgccaccagccaggaccagcccctggacctgagcatgggcagcagaagcagagccagcggcaccaagctgaccgagcccagaaagaaccacgtgttcggcggcaagaagggcagcaacgtggagagcagacccgccagcgacggcagcctgcagcacgccagacccacccccttcttcatggaccccatctacagagtggagaagagaaagctgaccgaccccctggaggccctgaaggagaagtacctgagacccagccccggcttcctgttccacccccagatgagcgccatcgagaacatggccgagaagctggagagcttcagcgccctgaagcccgaggccagcgagctgctgcagagcgtgcccagcatgttcaacttcagagccccccccaacgccctgcccgagaacctgctgagaaagggcaaggagagatacacctgcagatactgcggcaagatcttccccagaagcgccaacctgaccagacacctgagaacccacaccggcgagcagccctacagatgcaagtactgcgacagaagcttcagcatcagcagcaacctgcagagacacgtgagaaacatccacaacaaggagaagcccttcaagtgccacctgtgcgacagatgcttcggccagcagaccaacctggacagacacctgaagaagcacgagaacggcaacatgagcggcaccgccaccagcagcccccacagcgagctggagagcaccggcgccatcctggacgacaaggaggacgcctacttcaccgagatcagaaacttcatcggcaacagcaaccacggcagccagagccccagaaacgtggaggagagaatgaacggcagccacttcaaggacgagaaggccctggtgaccagccagaacagcgacctgctggacgacgaggaggtggaggacgaggtgctgctggacgaggaggacgaggacaacgacatcaccggcaagaccggcaaggagcccgtgaccagcaacctgcacgagggcaaccccgaggacgactacgaggagaccagcgccctggagatgagctgcaagaccagccccgtgagatacaaggaggaggagtacaagagcggcctgagcgccctggaccacatcagacacttcaccgacagcctgaagatgagaaagatggaggacaaccagtacagcgaggccgagctgagcagcttcagcaccagccacgtgcccgaggagctgaagcagcccctgcacagaaagagcaagagccaggcctacgccatgatgctgagcctgagcgacaaggagagcctgcacagcaccagccacagcagcagcaacgtgtggcacagcatggccagagccgccgccgagagcagcgccatccagagcatcagccacgtgtag

SEQ ID NO: 8610 - DNA, 69 bp, Artificial Sequence
  Description of Artificial Sequence: Synthetic coding sequence
atgaagagcgaggactacccccacgagaccatggcccccgacatccacgaggagagacagtacagatag

SEQ ID NO: 8611 - DNA, 3156 bp, Artificial Sequence; identical to SEQ ID NO: 8605
  Description of Artificial Sequence: Synthetic coding sequence

SEQ ID NO: 8612 - DNA, 3159 bp, Artificial Sequence; identical to SEQ ID NO: 8606
  Description of Artificial Sequence: Synthetic coding sequence

SEQ ID NO: 8613 - DNA, 207 bp, Artificial Sequence
  Description of Artificial Sequence: Synthetic coding sequence
atgaagagcgaggactacccccacgagaccatggcccccgacatccacgaggagagacagtacagatgcgaggactgcgaccagctgttcgagagcaaggccgagctggccgaccaccagaagttcccctgcagcaccccccacagcgccttcagcatggtggaggaggacttccagcagaagctggagagcgagaacgacctgtag

SEQ ID NO: 8614 - DNA, 90 bp, Artificial Sequence
  Description of Artificial Sequence: Synthetic coding sequence
atgaagagcgaggactacccccacgagaccatggcccccgacatccacgaggagagacagtacagatgcgaggactgcgaccagctgtag

SEQ ID NO: 8615 - DNA, 378 bp, Artificial Sequence
  Description of Artificial Sequence: Synthetic coding sequence
atgaagagcgaggactacccccacgagaccatggcccccgacatccacgaggagagacagtacagatgcgaggactgcgaccagctgttcgagagcaaggccgagctggccgaccaccagaagttcccctgcagcaccccccacagcgccttcagcatggtggaggaggacttccagcagaagctggagagcgagaacgacctgcaggagatccacaccatccaggagtgcaaggagtgcgaccaggtgttccccgacctgcagagcctggagaagcacatgctgagccacaccgaggagagagagtacaagtgcgaccagtgccccaaggccttcaactggaagagcaacctgatcagacaccagatgagccactag

SEQ ID NO: 8616 - DNA, 312 bp, Artificial Sequence; identical to SEQ ID NO: 8608
  Description of Artificial Sequence: Synthetic coding sequence

SEQ ID NO: 8617 - DNA, 3693 bp, Artificial Sequence
  Description of Artificial Sequence: Synthetic coding sequence
atgagaagcaagggcagagccagaaagctggccaccaacaacgagtgcgtgtacggcaactaccccgagatccccctggaggagatgcccgacgccgacggcgtggccagcacccccagcctgaacatccaggagccctgcagccccgccaccagcagcgaggccttcacccccaaggagggcagcccctacaaggcccccatctacatccccgacgacatccccatccccgccgagttcgagctgagagagagcaacatgcccggcgccggcctgggcatctggaccaagagaaagatcgaggtgggcgagaagttcggcccctacgtgggcgagcagagaagcaacctgaaggaccccagctacggctgggagatcctggacgagttctacaacgtgaagttctgcatcgacgccagccagcccgacgtgggcagctggctgaagtacatcagattcgccggctgctacgaccagcacaacctggtggcctgccagatcaacgaccagatcttctacagagtggtggccgacatcgcccccggcgaggagctgctgctgttcatgaagagcgaggactacccccacgagaccatggcccccgacatccacgaggagagacagtacagatgcgaggactgcgaccagctgttcgagagcaaggccgagctggccgaccaccagaagttcccctgcagcaccccccacagcgccttcagcatggtggaggaggacttccagcagaagctggagagcgagaacgacctgcaggagatccacaccatccaggagtgcaaggagtgcgaccaggtgttccccgacctgcagagcctggagaagcacatgctgagccacaccgaggagagagagtacaagtgcgaccagtgccccaaggccttcaactggaagagcaacctgatcagacaccagatgagccacgacagcggcaagcactacgagtgcgagaactgcgccaaggtgttcaccgaccccagcaacctgcagagacacatcagaagccagcacgtgggcgccagagcccacgcctgccccgagtgcggcaagaccttcgccaccagcagcggcctgaagcagcacaagcacatccacagcagcgtgaagcccttcatctgcgaggtgtgccacaagagctacacccagttcagcaacctgtgcagacacaagagaatgcacgccgactgcagaacccagatcaagtgcaaggactgcggccagatgttcagcaccaccagcagcctgaacaagcacagaagattctgcgagggcaagaaccacttcgccgccggcggcttcttcggccagggcatcagcctgcccggcacccccgccatggacaagaccagcatggtgaacatgagccacgccaaccccggcctggccgactacttcggcgccaacagacaccccgccggcctgaccttccccaccgcccccggcttcagcttcagcttccccggcctgttccccagcggcctgtaccacagaccccccctgatccccgccagcagccccgtgaagggcctgagcagcaccgagcagaccaacaagagccagagccccctgatgacccacccccagatcctgcccgccacccaggacatcctgaaggccctgagcaagcaccccagcgtgggcgacaacaagcccgtggagctgcagcccgagagaagcagcgaggagagacccttcgagaagatcagcgaccagagcgagagcagcgacctggacgacgtgagcacccccagcggcagcgacctggagaccaccagcggcagcgacctggagagcgacatcgagagcgacaaggagaagttcaaggagaacggcaagatgttcaaggacaaggtgagccccctgcagaacctggccagcatcaacaacaagaaggagtacagcaaccacagcatcttcagccccagcctggaggagcagaccgccgtgagcggcgccgtgaacgacagcatcaaggccatcgccagcatcgccgagaagtacttcggcagcaccggcctggtgggcctgcaggacaagaaggtgggcgccctgccctaccccagcatgttccccctgcccttcttccccgccttcagccagagcatgtaccccttccccgacagagacctgagaagcctgcccctgaagatggagccccagagccccggcgaggtgaagaagctgcagaagggcagcagcgagagccccttcgacctgaccaccaagagaaaggacgagaagcccctgacccccgtgcccagcaagccccccgtgacccccgccaccagccaggaccagcccctggacctgagcatgggcagcagaagcagagccagcggcaccaagctgaccgagcccagaaagaaccacgtgttcggcggcaagaagggcagcaacgtggagagcagacccgccagcgacggcagcctgcagcacgccagacccacccccttcttcatggaccccatctacagagtggagaagagaaagctgaccgaccccctggaggccctgaaggagaagtacctgagacccagccccggcttcctgttccacccccagatgagcgccatcgagaacatggccgagaagctggagagcttcagcgccctgaagcccgaggccagcgagctgctgcagagcgtgcccagcatgttcaacttcagagccccccccaacgccctgcccgagaacctgctgagaaagggcaaggagagatacacctgcagatactgcggcaagatcttccccagaagcgccaacctgaccagacacctgagaacccacaccggcgagcagccctacagatgcaagtactgcgacagaagcttcagcatcagcagcaacctgcagagacacgtgagaaacatccacaacaaggagaagcccttcaagtgccacctgtgcgacagatgcttcggccagcagaccaacctggacagacacctgaagaagcacgagaacggcaacatgagcggcaccgccaccagcagcccccacagcgagctggagagcaccggcgccatcctggacgacaaggaggacgcctacttcaccgagatcagaaacttcatcggcaacagcaaccacggcagccagagccccagaaacgtggaggagagaatgaacggcagccacttcaaggacgagaaggccctggtgaccagccagaacagcgacctgctggacgacgaggaggtggaggacgaggtgctgctggacgaggaggacgaggacaacgacatcaccggcaagaccggcaaggagcccgtgaccagcaacctgcacgagggcaaccccgaggacgactacgaggagaccagcgccctggagatgagctgcaagaccagccccgtgagatacaaggaggaggagtacaagagcggcctgagcgccctggaccacatcagacacttcaccgacagcctgaagatgagaaagatggaggacaaccagtacagcgaggccgagctgagcagcttcagcaccagccacgtgcccgaggagctgaagcagcccctgcacagaaagagcaagagccaggcctacgccatgatgctgagcctgagcgacaaggagagcctgcacagcaccagccacagcagcagcaacgtgtggcacagcatggccagagccgccgccgagagcagcgccatccagagcatcagccacgtgtag

SEQ ID NO: 8618 - DNA, 312 bp, Artificial Sequence; identical to SEQ ID NO: 8608
  Description of Artificial Sequence: Synthetic coding sequence

SEQ ID NO: 8619 - DNA, 2256 bp, Artificial Sequence
  Description of Artificial Sequence: Synthetic coding sequence
atgtgcgacctgagaagacccgccgccggcggcatgatggacctggcctacgtgtgcgagtgggagaagtggagcaagagcacccactgccccagcgtgcccctggcctgcgcctggagctgcagaaacctgatcgccttcaccatggacctgagaagcgacgaccaggacctgaccagaatgatccacatcctggacaccgagcacccctgggacctgcacagcatccccagcgagcaccacgaggccatcacctgcctggagtgggaccagagcggcagcagactgctgagcgccgacgccgacggccagatcaagtgctggagcatggccgaccacctggccaacagctgggagagcagcgtgggcagcctggtggagggcgaccccatcgtggccctgagctggctgcacaacggcgtgaagctggccctgcacgtggagaagagcggcgccagcagcttcggcgagaagttcagcagagtgaagttcagccccagcctgaccctgttcggcggcaagcccatggagggctggatcgccgtgaccgtgagcggcctggtgaccgtgagcctgctgaagcccagcggccaggtgctgaccagcaccgagagcctgtgcagactgagaggcagagtggccctggccgacatcgccttcaccggcggcggcaacatcgtggtggccaccgccgacggcagcagcgccagccccgtgcagttctacaaggtgtgcgtgagcgtggtgagcgagaagtgcagaatcgacaccgagatcctgcccagcctgttcatgagatgcaccaccgacctgaacagaaaggacaagttccccgccatcacccacctgaagttcctggccagagacatgagcgagcaggtgctgctgtgcgccagcagccagaccagcagcatcgtggagtgctggagcctgagaaaggagggcctgcccgtgaacaacatcttccagcagatcagccccgtggtgggcgacaagcagcccaccatcctgaagtggagaatcctgagcgccaccaacgacctggacagagtgagcgccgtggccctgcccaagctgcccatcagcctgaccaacaccgacctgaaggtggccagcgacacccagttctaccccggcctgggcctggccctggccttccacgacggcagcgtgcacatcgtgcacagactgagcctgcagaccatggccgtgttctacagcagcgccgcccccagacccgtggacgagcccgccatgaagagacccagaaccgccggccccgccgtgcacctgaaggccatgcagctgagctggaccagcctggccctggtgggcatcgacagccacggcaagctgagcgtgctgagactgagccccagcatgggccaccccctggaggtgggcctggccctgagacacctgctgttcctgctggagtactgcatggtgaccggctacgactggtgggacatcctgctgcacgtgcagcccagcatggtgcagagcctggtggagaagctgcacgaggagtacaccagacagaccgccgccctgcagcaggtgctgagcaccagaatcctggccatgaaggccagcctgtgcaagctgagcccctgcaccgtgaccagagtgtgcgactaccacaccaagctgttcctgatcgccatcagcagcaccctgaagagcctgctgagaccccacttcctgaacacccccgacaagagccccggcgacagactgaccgagatctgcaccaagatcaccgacgtggacatcgacaaggtgatgatcaacctgaagaccgaggagttcgtgctggacatgaacaccctgcaggccctgcagcagctgctgcagtgggtgggcgacttcgtgctgtacctgctggccagcctgcccaaccaggtggccatgagagcccagagagccagcagaaccagaagatggtggatgaacgccgcctgctgccccgccagctgcctgagccccgcctggaccggctgccagcccgccaccgcctggctggccgcctgcagccccagcagccccttcgtgtgcagcctggccggcagacccagatgcctggccgtgctgcccccctgcagcagcaccgccagccccggcccccaggccagccccagaagcaccacctgcggcggctgcaccctggccctggcccccagaagaaacgccagacccgcccccggcgccgccgtgagcccctgcagcagcagacccaccgagcccagaagatag

SEQ ID NO: 8620 - DNA, 2583 bp, Artificial Sequence
  Description of Artificial Sequence: Synthetic coding sequence
atgtgcgacctgagaagacccgccgccggcggcatgatggacctggcctacgtgtgcgagtgggagaagtggagcaagagcacccactgccccagcgtgcccctggcctgcgcctggagctgcagaaacctgatcgccttcaccatggacctgagaagcgacgaccaggacctgaccagaatgatccacatcctggacaccgagcacccctgggacctgcacagcatccccagcgagcaccacgaggccatcacctgcctggagtgggaccagagcggcagcagactgctgagcgccgacgccgacggccagatcaagtgctggagcatggccgaccacctggccaacagctgggagagcagcgtgggcagcctggtggagggcgaccccatcgtggccctgagctggctgcacaacggcgtgaagctggccctgcacgtggagaagagcggcgccagcagcttcggcgagaagttcagcagagtgaagttcagccccagcctgaccctgttcggcggcaagcccatggagggctggatcgccgtgaccgtgagcggcctggtgaccgtgagcctgctgaagcccagcggccaggtgctgaccagcaccgagagcctgtgcagactgagaggcagagtggccctggccgacatcgccttcaccggcggcggcaacatcgtggtggccaccgccgacggcagcagcgccagccccgtgcagttctacaaggtgtgcgtgagcgtggtgagcgagaagtgcagaatcgacaccgagatcctgcccagcctgttcatgagatgcaccaccgacctgaacagaaaggacaagttccccgccatcacccacctgaagttcctggccagagacatgagcgagcaggtgctgctgtgcgccagcagccagaccagcagcatcgtggagtgctggagcctgagaaaggagggcctgcccgtgaacaacatcttccagcagatcagccccgtggtgggcgacaagcagcccaccatcctgaagtggagaatcctgagcgccaccaacgacctggacagagtgagcgccgtggccctgcccaagctgcccatcagcctgaccaacaccgacctgaaggtggccagcgacacccagttctaccccggcctgggcctggccctggccttccacgacggcagcgtgcacatcgtgcacagactgagcctgcagaccatggccgtgttctacagcagcgccgcccccagacccgtggacgagcccgccatgaagagacccagaaccgccggccccgccgtgcacctgaaggccatgcagctgagctggaccagcctggccctggtgggcatcgacagccacggcaagctgagcgtgctgagactgagccccagcatgggccaccccctggaggtgggcctggccctgagacacctgctgttcctgctggagtactgcatggtgaccggctacgactggtgggacatcctgctgcacgtgcagcccagcatggtgcagagcctggtggagaagctgcacgaggagtacaccagacagaccgccgccctgcagcaggtgctgagcaccagaatcctggccatgaaggccagcctgtgcaagctgagcccctgcaccgtgaccagagtgtgcgactaccacaccaagctgttcctgatcgccatcagcagcaccctgaagagcctgctgagaccccacttcctgaacacccccgacaagagccccggcgacagactgaccgagatctgcaccaagatcaccgacgtggacatcgacaaggtgatgatcaacctgaagaccgaggagttcgtgctggacatgaacaccctgcaggccctgcagcagctgctgcagtgggtgggcgacttcgtgctgtacctgctggccagcctgcccaaccagggcagcctgctgagacccggccacagcttcctgagagacggcaccagcctgggcatgctgagagagctgatggtggtgatcagaatctggggcctgctgaagcccagctgcctgcccgtgtacaccgccaccagcgacacccaggacagcatgagcctgctgttcagactgctgaccaagctgtggatctgcttccccagcaccggcccctgcagcgtgtgggtgctgctgggctggcagcccctgcccggcagagacgagggccccgccagcgagcccgacgaggccctggtggacgagtgctgcctgctgcccagccagctgctgatccccagcctggactggctgcccgccagcgacggcctggtgagcagactgcagcccaagcagcccctgagactgcagttcggcagagcccccaccctgcccggcagcgccgccaccctgcagctggacggcctggccagagcccccggccagcccaagatcgaccacctgagaagactgcacctgggcgcctgccccaccgaggagtgcaaggcctgcaccagatgcggctgcgtgaccatgctgaagagccccaacagaaccaccgccgtgaagcagtgggagcagagatggatcaagaactgcctgtgcggcggcctgtggtggagagtgcccctgagctacccctag

SEQ ID NO: 8621 - DNA, 2634 bp, Artificial Sequence
  Description of Artificial Sequence: Synthetic coding sequence
atgtgcgacctgagaagacccgccgccggcggcatgatggacctggcctacgtgtgcgagtgggagaagtggagcaagagcacccactgccccagcgtgcccctggcctgcgcctggagctgcagaaacctgatcgccttcaccatggacctgagaagcgacgaccaggacctgaccagaatgatccacatcctggacaccgagcacccctgggacctgcacagcatccccagcgagcaccacgaggccatcacctgcctggagtgggaccagagcggcagcagactgctgagcgccgacgccgacggccagatcaagtgctggagcatggccgaccacctggccaacagctgggagagcagcgtgggcagcctggtggagggcgaccccatcgtggccctgagctggctgcacaacggcgtgaagctggccctgcacgtggagaagagcggcgccagcagcttcggcgagaagttcagcagagtgaagttcagccccagcctgaccctgttcggcggcaagcccatggagggctggatcgccgtgaccgtgagcggcctggtgaccgtgagcctgctgaagcccagcggccaggtgctgaccagcaccgagagcctgtgcagactgagaggcagagtggccctggccgacatcgccttcaccggcggcggcaacatcgtggtggccaccgccgacggcagcagcgccagccccgtgcagttctacaaggtgtgcgtgagcgtggtgagcgagaagtgcagaatcgacaccgagatcctgcccagcctgttcatgagatgcaccaccgacctgaacagaaaggacaagttccccgccatcacccacctgaagttcctggccagagacatgagcgagcaggtgctgctgtgcgccagcagccagaccagcagcatcgtggagtgctggagcctgagaaaggagggcctgcccgtgaacaacatcttccagcagatcagccccgtggtgggcgacaagcagcccaccatcctgaagtggagaatcctgagcgccaccaacgacctggacagagtgagcgccgtggccctgcccaagctgcccatcagcctgaccaacaccgacctgaaggtggccagcgacacccagttctaccccggcctgggcctggccctggccttccacgacggcagcgtgcacatcgtgcacagactgagcctgcagaccatggccgtgttctacagcagcgccgcccccagacccgtggacgagcccgccatgaagagacccagaaccgccggccccgccgtgcacctgaaggccatgcagctgagctggaccagcctggccctggtgggcatcgacagccacggcaagctgagcgtgctgagactgagccccagcatgggccaccccctggaggtgggcctggccctgagacacctgctgttcctgctggagtactgcatggtgaccggctacgactggtgggacatcctgctgcacgtgcagcccagcatggtgcagagcctggtggagaagctgcacgaggagtacaccagacagaccgccgccctgcagcaggtgctgagcaccagaatcctggccatgaaggccagcctgtgcaagctgagcccctgcaccgtgaccagagtgtgcgactaccacaccaagctgttcctgatcgccatcagcagcaccctgaagagcctgctgagaccccacttcctgaacacccccgacaagagccccggcgacagactgaccgagatctgcaccaagatcaccgacgtggacatcgacaaggtgatgatcaacctgaagaccgaggagttcgtgctggacatgaacaccctgcaggccctgcagcagctgctgcagtgggtgggcgacttcgtgctgtacctgctggccagcctgcccaaccagggcagcctgctgagacccggccacagcttcctgagagacggcaccagcctgggcatgctgagagagctgatggtggtgatcagaatctggggcctgctgaagcccagctgcctgcccgtgtacaccgccaccagcgacacccaggacagcatgagcctgctgttcagactgctgaccaagctgtggatctgctgcagagacgagggccccgccagcgagcccgacgaggccctggtggacgagtgctgcctgctgcccagccagctgctgatccccagcctggactggctgcccgccagcgacggcctggtgagcagactgcagcccaagcagcccctgagactgcagttcggcagagcccccaccctgcccggcagcgccgccaccctgcagctggacggcctggccagagcccccggccagcccaagatcgaccacctgagaagactgcacctgggcgcctgccccaccgaggagtgcaaggcctgcaccagatgcggctgcgtgaccatgctgaagagccccaacagaaccaccgccgtgaagcagtgggagcagagatggatcaagaactgcctggccgtggagggcagaggccccgacgcctgcgtgaccagcagagccagcgaggaggcccccgccttcgtgcagctgggcccccagagcacccaccacagccccagaacccccagaagcctggaccacctgcaccccgaggacagaccctag

SEQ ID NO: 8622 - DNA, 2526 bp, Artificial Sequence
  Description of Artificial Sequence: Synthetic coding sequence
atgtgcgacctgagaagacccgccgccggcggcatgatggacctggcctacgtgtgcgagtgggagaagtggagcaagagcacccactgccccagcgtgcccctggcctgcgcctggagctgcagaaacctgatcgccttcaccatggacctgagaagcgacgaccaggacctgaccagaatgatccacatcctggacaccgagcacccctgggacctgcacagcatccccagcgagcaccacgaggccatcacctgcctggagtgggaccagagcggcagcagactgctgagcgccgacgccgacggccagatcaagtgctggagcatggccgaccacctggccaacagctgggagagcagcgtgggcagcctggtggagggcgaccccatcgtggccctgagctggctgcacaacggcgtgaagctggccctgcacgtggagaagagcggcgccagcagcttcggcgagaagttcagcagagtgaagttcagccccagcctgaccctgttcggcggcaagcccatggagggctggatcgccgtgaccgtgagcggcctggtgaccgtgagcctgctgaagcccagcggccaggtgctgaccagcaccgagagcctgtgcagactgagaggcagagtggccctggccgacatcgccttcaccggcggcggcaacatcgtggtggccaccgccgacggcagcagcgccagccccgtgcagttctacaaggtgtgcgtgagcgtggtgagcgagaagtgcagaatcgacaccgagatcctgcccagcctgttcatgagatgcaccaccgacctgaacagaaaggacaagttccccgccatcacccacctgaagttcctggccagagacatgagcgagcaggtgctgctgtgcgccagcagccagaccagcagcatcgtggagtgctggagcctgagaaaggagggcctgcccgtgaacaacatcttccagcagatcagccccgtggtgggcgacaagcagcccaccatcctgaagtggagaatcctgagcgccaccaacgacctggacagagtgagcgccgtggccctgcccaagctgcccatcagcctgaccaacaccgacctgaaggtggccagcgacacccagttctaccccggcctgggcctggccctggccttccacgacggcagcgtgcacatcgtgcacagactgagcctgcagaccatggccgtgttctacagcagcgccgcccccagacccgtggacgagcccgccatgaagagacccagaaccgccggccccgccgtgcacctgaaggccatgcagctgagctggaccagcctggccctggtgggcatcgacagccacggcaagctgagcgtgctgagactgagccccagcatgggccaccccctggaggtgggcctggccctgagacacctgctgttcctgctggagtactgcatggtgaccggctacgactggtgggacatcctgctgcacgtgcagcccagcatggtgcagagcctggtggagaagctgcacgaggagtacaccagacagaccgccgccctgcagcaggtgctgagcaccagaatcctggccatgaaggccagcctgtgcaagctgagcccctgcaccgtgaccagagtgtgcgactaccacaccaagctgttcctgatcgccatcagcagcaccctgaagagcctgctgagaccccacttcctgaacacccccgacaagagccccggcgacagactgaccgagatctgcaccaagatcaccgacgtggacatcgacaaggtgatgatcaacctgaagaccgaggagttcgtgctggacatgaacaccctgcaggccctgcagcagctgctgcagtgggtgggcgacttcgtgctgtacctgctggccagcctgcccaaccagggcagcctgctgagacccggccacagcttcctgagagacggcaccagcctgggcatgctgagagagctgatggtggtgatcagaatctggggcctgctgaagcccagctgcctgcccgtgtacaccgccaccagcgacacccaggacagcatgagcctgctgttcagactgctgaccaagctgtggatctgctgcagagacgagggccccgccagcgagcccgacgaggccctggtggacgagtgctgcctgctgcccagccagctgctgatccccagcctggactggctgcccgccagcgacggcctggtgagcagactgcagcccaagcagcccctgagactgcagttcggcagagcccccaccctgcccggcagcgccgccaccctgcagctggacggcctggccagagcccccggccagcccaagatcgaccacctgagaagactgcacctgggcgcctgccccaccgaggagtgcaaggcctgcaccagatgcggctgcgtgaccatgctgaagagccccaacagaaccaccgccgtgaagcagtgggagcagagatggatcaagaactgcctgtgcggcggcctgtggtggagagtgcccctgagctacccctag

SEQ ID NO: 8623 - DNA, 1992 bp, Artificial Sequence
  Description of Artificial Sequence: Synthetic coding sequence
atgtgcgacctgagaagacccgccgccggcggcatgatggacctggcctacgtgtgcgagtgggagaagtggagcaagagcacccactgccccagcgtgcccctggcctgcgcctggagctgcagaaacctgatcgccttcaccatggacctgagaagcgacgaccaggacctgaccagaatgatccacatcctggacaccgagcacccctgggacctgcacagcatccccagcgagcaccacgaggccatcacctgcctggagtgggaccagagcggcagcagactgctgagcgccgacgccgacggccagatcaagtgctggagcatggccgaccacctggccaacagctgggagagcagcgtgggcagcctggtggagggcgaccccatcgtggccctgagctggctgcacaacggcgtgaagctggccctgcacgtggagaagagcggcgccagcagcttcggcgagaagttcagcagagtgaagttcagccccagcctgaccctgttcggcggcaagcccatggagggctggatcgccgtgaccgtgagcggcctggtgaccgtgagcctgctgaagcccagcggccaggtgctgaccagcaccgagagcctgtgcagactgagaggcagagtggccctggccgacatcgccttcaccggcggcggcaacatcgtggtggccaccgccgacggcagcagcgccagccccgtgcagttctacaaggtgtgcgtgagcgtggtgagcgagaagtgcagaatcgacaccgagatcctgcccagcctgttcatgagatgcaccaccgacctgaacagaaaggacaagttccccgccatcacccacctgaagttcctggccagagacatgagcgagcaggtgctgctgtgcgccagcagccagaccagcagcatcgtggagtgctggagcctgagaaaggagggcctgcccgtgaacaacatcttccagcagatcagccccgtggtgggcgacaagcagcccaccatcctgaagtggagaatcctgagcgccaccaacgacctggacagagtgagcgccgtggccctgcccaagctgcccatcagcctgaccaacaccgacctgaaggtggccagcgacacccagttctaccccggcctgggcctggccctggccttccacgacggcagcgtgcacatcgtgcacagactgagcctgcagaccatggccgtgttctacagcagcgccgcccccagacccgtggacgagcccgccatgaagagacccagaaccgccggccccgccgtgcacctgaaggccatgcagctgagctggaccagcctggccctggtgggcatcgacagccacggcaagctgagcgtgctgagactgagccccagcatgggccaccccctggaggtgggcctggccctgagacacctgctgttcctgctggagtactgcatggtgaccggctacgactggtgggacatcctgctgcacgtgcagcccagcatggtgcagagcctggtggagaagctgcacgaggagtacaccagacagaccgccgccctgcagcaggtgctgagcaccagaatcctggccatgaaggccagcctgtgcaagctgagcccctgcaccgtgaccagagtgtgcgactaccacaccaagctgttcctgatcgccatcagcagcaccctgaagagcctgctgagaccccacttcctgaacacccccgacaagagccccggcgacagactgaccgagatctgcaccaagatcaccgacgtggacatcgacaaggtgatgatcaacctgaagaccgaggagttcgtgctggacatgaacaccctgcaggccctgcagcagctgctgcagtgggtgggcgacttcgtgctgtacctgctggccagcctgcccaaccagccctgccccaccagcgagccctgccccaccagcgagccctgccccaccagcgagcccagccccaccagcgagcccagccccacctag

SEQ ID NO: 8624 - DNA, 1614 bp, Artificial Sequence
  Description of Artificial Sequence: Synthetic coding sequence
atgtgcgacctgagaagacccgccgccggcggcatgatggacctggcctacgtgtgcgagtgggagaagtggagcaagagcacccactgccccagcgtgcccctggcctgcgcctggagctgcagaaacctgatcgccttcaccatggacctgagaagcgacgaccaggacctgaccagaatgatccacatcctggacaccgagcacccctgggacctgcacagcatccccagcgagcaccacgaggccatcacctgcctggagtgggaccagagcggcagcagactgctgagcgccgacgccgacggccagatcaagtgctggagcatggccgaccacctggccaacagctgggagagcagcgtgggcagcctggtggagggcgaccccatcgtggccctgagctggctgcacaacggcgtgaagctggccctgcacgtggagaagagcggcgccagcagcttcggcgagaagttcagcagagtgaagttcagccccagcctgaccctgttcggcggcaagcccatggagggctggatcgccgtgaccgtgagcggcctggtgaccgtgagcctgctgaagcccagcggccaggtgctgaccagcaccgagagcctgtgcagactgagaggcagagtggccctggccgacatcgccttcaccggcggcggcaacatcgtggtggccaccgccgacggcagcagcgccagccccgtgcagttctacaaggtgtgcgtgagcgtggtgagcgagaagtgcagaatcgacaccgagatcctgcccagcctgttcatgagatgcaccaccgacctgaacagaaaggacaagttccccgccatcacccacctgaagttcctggccagagacatgagcgagcaggtgctgctgtgcgccagcagccagaccagcagcatcgtggagtgctggagcctgagaaaggagggcctgcccgtgaacaacatcttccagcagatcagccccgtggtgggcgacaagcagcccaccatcctgaagtggagaatcctgagcgccaccaacgacctggacagagtgagcgccgtggccctgcccaagctgcccatcagcctgaccaacaccgacctgaaggtggccagcgacacccagttctaccccggcctgggcctggccctggccttccacgacggcagcgtgcacatcgtgcacagactgagcctgcagaccatggccgtgttctacagcagcgccgcccccagacccgtggacgagcccgccatgaagagacccagaaccgccggccccgccgtgcacctgaaggccatgcagctgagctggaccagcctggccctggtgggcatcgacagccacggcaaggtgctgagcaccagaatcctggccatgaaggccagcctgtgcaagctgagcccctgcaccgtgaccagagtgtgcgactaccacaccaagctgttcctgatcgccatcagcagcaccctgaagagcctgctgagaccccacttcctgaacacccccgacaagagccccggcgacagactgaccgagatctgcaccaagatcaccgacgtggacatcgacaaggtgatgatcaacctgaagaccgaggagttcgtgctgtag

SEQ ID NO: 8625 - DNA, 1389 bp, Artificial Sequence
  Description of Artificial Sequence: Synthetic coding sequence
atgtgcgacctgagaagacccgccgccggcggcatgatggacctggcctacgtgtgcgagtgggagaagtggagcaagagcacccactgccccagcgtgcccctggcctgcgcctggagctgcagaaacctgatcgccttcaccatggacctgagaagcgacgaccaggacctgaccagaatgatccacatcctggacaccgagcacccctgggacctgcacagcatccccagcgagcaccacgaggccatcacctgcctggagtgggaccagagcggcagcagactgctgagcgccgacgccgacggccagatcaagtgctggagcatggccgaccacctggccaacagctgggagagcagcgtgggcagcctggtggagggcgaccccatcgtggccctgagctggctgcacaacggcgtgaagctggccctgcacgtggagaaggtgctgctgtgcgccagcagccagaccagcagcatcgtggagtgctggagcctgagaaaggagggcctgcccgtgaacaacatcttccagcagatcagccccgtggtgggcgacaagcagcccaccatcctgaagtggagaatcctgagcgccaccaacgacctggacagagtgagcgccgtggccctgcccaagctgcccatcagcctgaccaacaccgacctgaaggtggccagcgacacccagttctaccccggcctgggcctggccctggccttccacgacggcagcgtgcacatcgtgcacagactgagcctgcagaccatggccgtgttctacagcagcgccgcccccagacccgtggacgagcccgccatgaagagacccagaaccgccggccccgccgtgcacctgaaggccatgcagctgagctggaccagcctggccctggtgggcatcgacagccacggcaagctgagcgtgctgagactgagccccagcatgggccaccccctggaggtgggcctggccctgagacacctgctgttcctgctggagtactgcatggtgaccggctacgactggtgggacatcctgctgcacgtgcagcccagcatggtgcagagcctggtggagaagctgcacgaggagtacaccagacagaccgccgccctgcagcaggtgctgagcaccagaatcctggccatgaaggccagcctgtgcaagctgagcccctgcaccgtgaccagagtgtgcgactaccacaccaagctgttcctgatcgccatcagcagcaccctgaagagcctgctgagaccccacttcctgaacacccccgacaagagccccggcgacagactgaccgagatctgcaccaagatcaccgacgtggacatcgacaaggtgatgatcaacctgaagaccgaggagttcgtgctgtag

SEQ ID NO: 8626 - DNA, 1098 bp, Artificial Sequence
  Description of Artificial Sequence: Synthetic coding sequence
atgtgcgacctgagaagacccgccgccggcggcatgatggacctggcctacgtgtgcgagtgggagaagtggagcaagagcacccactgccccagcgtgcccctggcctgcgcctggagctgcagaaacctgatcgccttcaccatggacctgagaagcgacgaccaggacctgaccagaatgatccacatcctggacaccgagcacccctgggacctgcacagcatccccagcgagcaccacgaggccatcacctgcctggagtgggaccagagcggcagcagactgctgagcgccgacgccgacggccagatcaagtgctggagcatggccgaccacctggccaacagctgggagagcagcgtgggcagcctggtggagggcgaccccatcgtggccctgagctggctgcacaacggcctggccctggccttccacgacggcagcgtgcacatcgtgcacagactgagcctgcagaccatggccgtgttctacagcagcgccgcccccagacccgtggacgagcccgccatgaagagacccagaaccgccggccccgccgtgcacctgaaggccatgcagctgagctggaccagcctggccctggtgggcatcgacagccacggcaagctgagcgtgctgagactgagccccagcatgggccaccccctggaggtgggcctggccctgagacacctgctgttcctgctggagtactgcatggtgaccggctacgactggtgggacatcctgctgcacgtgcagcccagcatggtgcagagcctggtggagaagctgcacgaggagtacaccagacagaccgccgccctgcagcaggtgctgagcaccagaatcctggccatgaaggccagcctgtgcaagctgagcccctgcaccgtgaccagagtgtgcgactaccacaccaagctgttcctgatcgccatcagcagcaccctgaagagcctgctgagaccccacttcctgaacacccccgacaagagccccggcgacagactgaccgagatctgcaccaagatcaccgacgtggacatcgacaaggtgatgatcaacctgaagaccgaggagttcgtgctgtag

SEQ ID NO: 8627 - DNA, 1104 bp, Artificial Sequence
  Description of Artificial Sequence: Synthetic coding sequence
atgtgcgacctgagaagacccgccgccggcggcatgatggacctggcctacgtgtgcgagtgggagaagtggagcaagagcacccactgccccagcgtgcccctggcctgcgcctggagctgcagaaacctgatcgccttcaccatggacctgagaagcgacgaccaggacctgaccagaatgatccacatcctggacaccgagcacccctgggacctgcacagcatccccagcgagcaccacgaggccatcacctgcctggagtgggaccagagcggcagcagactgctgagcgccgacgccgacggccagatcaagtgctggagcatggccgaccacctggccaacagctgggagagcagcgtgggcagcctggtggagggcgaccccatcgtggccctgagctggctgcacaacggcgtgagactggccctggccttccacgacggcagcgtgcacatcgtgcacagactgagcctgcagaccatggccgtgttctacagcagcgccgcccccagacccgtggacgagcccgccatgaagagacccagaaccgccggccccgccgtgcacctgaaggccatgcagctgagctggaccagcctggccctggtgggcatcgacagccacggcaagctgagcgtgctgagactgagccccagcatgggccaccccctggaggtgggcctggccctgagacacctgctgttcctgctggagtactgcatggtgaccggctacgactggtgggacatcctgctgcacgtgcagcccagcatggtgcagagcctggtggagaagctgcacgaggagtacaccagacagaccgccgccctgcagcaggtgctgagcaccagaatcctggccatgaaggccagcctgtgcaagctgagcccctgcaccgtgaccagagtgtgcgactaccacaccaagctgttcctgatcgccatcagcagcaccctgaagagcctgctgagaccccacttcctgaacacccccgacaagagccccggcgacagactgaccgagatctgcaccaagatcaccgacgtggacatcgacaaggtgatgatcaacctgaagaccgaggagttcgtgctgtag

SEQ ID NO: 8628 - DNA, 975 bp, Artificial Sequence
  Description of Artificial Sequence: Synthetic coding sequence
atgtgcgacctgagaagacccgccgccggcggcatgatggacctggcctacgtgtgcgagtgggagaagtggagcaagagcacccactgccccagcgtgcccctggcctgcgcctggagctgcagaaacctgatcgccttcaccatggacctgagaagcgacgaccaggacctgaccagaatgatccacatcctggacaccgagcacccctgggacctgcacagcatccccagcgagcaccacgaggccatcacctgcctggagtgggaccagagcggcagcagactgctgagcgccgacgccgacggccagatcaagtgctggagcatggccgaccacctggccaacagctgggagagcagcgtgggcagcctggtggagggcgaccccatcgtggccctgagctggctgcacaacggcgtgaagctggccctgcacgtggagaagagcggcgccagcagcttcggcgagaagttcagcagagtgaagttcagccccagcctgaccctgttcggcggcaagcccatggagggctggatcgccgtgaccgtgagcggcctggtgaccgtgagcctgctgttcctgctggagtactgcatggtgaccggctacgactggtgggacatcctgctgcacgtgcagcccagcatggtgcagagcctggtggagaagctgcacgaggagtacaccagacagaccgccgccctgcagcaggtgctgagcaccagaatcctggccatgaaggccagcctgtgcaagctgagcccctgcaccgtgaccagagtgtgcgactaccacaccaagctgttcctgatcgccatcagcagcaccctgaagagcctgctgagaccccacttcctgaacacccccgacaagagccccggcgacagactgaccgagatctgcaccaagatcaccgacgtggacatcgacaaggtgatgatcaacctgaagaccgaggagttcgtgctgtag

SEQ ID NO: 8629 - DNA, 603 bp, Artificial Sequence
  Description of Artificial Sequence: Synthetic coding sequence
atggcccagcagagagccctgccccagagcaaggagaccctgctgcagagctacaacaagagactgaaggacgacatcaagagcatcatggacaacttcaccgagatcatcaagaccgccaagatcgaggacgagacccaggtgagcagagccacccagggcgagcaggacaactacgagatgcacgtgagagccgccaacatcgtgagagccggcgagagcctgatgaagctggtgagcgacctgaagcagttcctgatcctgaacgacttccccagcgtgaacgaggccatcgaccagagaaaccagcagctgagaaccctgcaggaggagtgcgacagaaagctgatcaccctgagagacgagatcagcatcgacctgtacgagctggaggaggagtactacagcagcagcagcagcctgtgcgaggccaacgacctgcccctgtgcgaggcctacggcagactggacctggacaccgacagcgccgacggcctgagcgcccccctgctggccagccccgagcccagcgccggccccctgcaggtggccgcccccgcccacagccacgccggcggccccggccccaccgagcacgcctag

SEQ ID NO: 8630 - DNA, 423 bp, Artificial Sequence
  Description of Artificial Sequence: Synthetic coding sequence
atggcccagcagagagccctgccccagagcaaggagaccctgctgcagagctacaacaagagactgaaggacgacatcaagagcatcatggacaacttcaccgagatcatcaagaccgccaagatcgaggacgagacccaggtgagcagagccacccagggcgagcaggacaactacgagatgcacgtgagagccgccaacatcgtgagagccggcgagagcctgatgaagctggtgagcgacctgaagcagttcctgatcctgaacgacttccccagcgtgaacgaggccatcgaccagagaaaccagcagctgagaaccctgcaggaggagtgcgacagaaagctgatcaccctgagagacgagatcagcatcgacctgtacgagctggaggaggagtactacagcagcagatacaagtag

SEQ ID NO: 8631 - DNA, 405 bp, Artificial Sequence
  Description of Artificial Sequence: Synthetic coding sequence
atggcccagcagagagccctgccccagagcaaggagaccctgctgcagagctacaacaagagactgaaggacgacatcaagagcatcatggacaacttcaccgagatcatcaagaccgccaagatcgaggacgagacccaggtgagcagagccacccagggcgagcaggacaactacgagatgcacgtgagagccggcgagagcctgatgaagctggtgagcgacctgaagcagttcctgatcctgaacgacttccccagcgtgaacgaggccatcgaccagagaaaccagcagctgagaaccctgcaggaggagtgcgacagaaagctgatcaccctgagagacgagatcagcatcgacctgtacgagctggaggaggagtactacagcagcagatacaagtag

SEQ ID NO: 8632 - DNA, 414 bp, Artificial Sequence
  Description of Artificial Sequence: Synthetic coding sequence
atggcccagcagagagccctgccccagagcaaggagaccctgctgcagagctacaacaagagactgaaggacgacatcaagagcatcatggacaacttcaccgagatcatcaagaccgccaagatcgaggacgagacccaggtgagcagagccacccagggcgagcaggacaactacgagatgcacgtgagagccgccaacatcgtgagagccggcgagagcctgatgaagctggtgagcgacctgaagcagttcctgatcctgaacgacttccccagcgtgaacgaggccatcgaccagagaaaccagcagctgagaaccctgcaggaggagtgcgacagaaagctgatcaccctgagagacgagatcagcatcgacctgtacgagctggaggaggagtactacagcagctag

SEQ ID NO: 8633 - DNA, 336 bp, Artificial Sequence
  Description of Artificial Sequence: Synthetic coding sequence
atggcccagcagagagccctgccccagagcaaggagaccctgctgcagagctacaacaagagactgaaggacgacatcaagagcatcatggacaacttcaccgagatcatcaagaccgccaagatcgaggacgagacccaggtgagcagagccacccagggcgagcaggacaactacgagatgcacgtgagagccgccaacatcgtgagagccggcgagagcctgatgaagctggtgagcgacctgaagcagttcctgatcctgaacgacttccccagcgtgaacgaggccatcgaccagagaaaccagcagctgagaaccctgcaggaggagtag

SEQ ID NO: 8634 - DNA, 423 bp, Artificial Sequence; identical to SEQ ID NO: 8630
  Description of Artificial Sequence: Synthetic coding sequence

SEQ ID NO: 8635 - DNA, 423 bp, Artificial Sequence; identical to SEQ ID NO: 8630
  Description of Artificial Sequence: Synthetic coding sequence

SEQ ID NO: 8636 - DNA, 603 bp, Artificial Sequence; identical to SEQ ID NO: 8629
  Description of Artificial Sequence: Synthetic coding sequence

SEQ ID NO: 8637 - DNA, 408 bp, Artificial Sequence
  Description of Artificial Sequence: Synthetic coding sequence
atggcccagcagagagccctgccccagagcaaggagaccctgctgcagagctacaacaagagactgaaggacgacatcaagagcatcatggacaacttcaccgagatcatcaagaccgccaagatcgaggacgagacccaggtgagcagagccacccagggcgagcaggacaactacgagatgcacgtgagagccgccaacatcgtgagagccggcgagagcctgatgaagctggtgagcgacctgaagcagttcctgatcctgaacgacttccccagcgtgaacgaggccatcgaccagagaaaccagcagctgagaaccctgcaggaggagtgcgacagaaagctgatcaccctgagagacgagatcagcatcgacctgtacgagctggaggaggagtactactag

SEQ ID NO: 8638 - DNA, 1452 bp, Artificial Sequence
  Description of Artificial Sequence: Synthetic coding sequence
atgaaggccttccacaccttctgcgtggtgctgctggtgttcggcagcgtgagcgaggccaagttcgacgacttcgaggacgaggaggacatcgtggagtacgacgacaacgacttcgccgagttcgaggacgtgatggaggacagcgtgaccgagagcccccagagagtgatcatcaccgaggacgacgaggacgagaccaccgtggagctggagggccaggacgagaaccaggagggcgacttcgaggacgccgacacccaggagggcgacaccgagagcgagccctacgacgacgaggagttcgagggctacgaggacaagcccgacaccagcagcagcaagaacaaggaccccatcaccatcgtggacgtgcccgcccacctgcagaacagctgggagagctactacctggagatcctgatggtgaccggcctgctggcctacatcatgaactacatcatcggcaagaacaagaacagcagactggcccaggcctggttcaacacccacagagagctgctggagagcaacttcaccctggtgggcgacgacggcaccaacaaggaggccaccagcaccggcaagctgaaccaggagaacgagcacatctacaacctgtggtgcagcggcagagtgtgctgcgagggcatgctgatccagctgagattcctgaagagacaggacctgctgaacgtgctggccagaatgatgagacccgtgagcgaccaggtgcagatcaaggtgaccatgaacgacgaggacatggacacctacgtgttcgccgtgggcaccagaaaggccctggtgagactgcagaaggagatgcaggacctgagcgagttctgcagcgacaagcccaagagcggcgccaagtacggcctgcccgacagcctggccatcctgagcgagatgggcgaggtgaccgacggcatgatggacaccaagatggtgcacttcctgacccactacgccgacaagatcgagagcgtgcacttcagcgaccagttcagcggccccaagatcatgcaggaggagggccagcccctgaagctgcccgacaccaagagaaccctgctgttcaccttcaacgtgcccggcagcggcaacacctaccccaaggacatggaggccctgctgcccctgatgaacatggtgatctacagcatcgacaaggccaagaagttcagactgaacagagagggcaagcagaaggccgacaagaacagagccagagtggaggagaacttcctgaagctgacccacgtgcagagacaggaggccgcccagagcagaagagaggagaagaagagagccgagaaggagagaatcatgaacgaggaggaccccgagaagcagagaagactggaggaggccgccctgagaagagagcagaagaagctggagaagaagcagatgaagatgaagcagatcaaggtgaaggccatgtag

SEQ ID NO: 8639 - DNA, 741 bp, Artificial Sequence
  Description of Artificial Sequence: Synthetic coding sequence
atggccgccgtggacatcagagacaacctgctgggcatcagctgggtggacagcagctggatccccatcctgaacagcggcagcgtgctggactacttcagcgagagaagcaaccccttctacgacagaacctgcaacaacgaggtggtgaagatgcagagactgaccctggagcacctgaaccagatggtgggcatcgagtacatcctgctgcacgcccaggagcccatcctgttcatcatcagaaagcagcagagacagagccccgcccaggtgatccccctggccgactactacatcatcgccggcgtgatctaccaggcccccgacctgggcagcgtgatcaacagcagagtgctgaccgccgtgcacggcatccagagcgccttcgacgaggccatgagctactgcagataccaccccagcaagggctactggtggcacttcaaggaccacgaggagcaggacaaggtgagacccaaggccaagagaaaggaggagcccagcagcatcttccagagacagagagtggacgccctgctgctggacctgagacagaagttcccccccaagttcgtgcagctgaagcccggcgagaagcccgtgcccgtggaccagaccaagaaggaggccgagcccatccccgagaccgtgaagcccgaggagaaggagaccaccaagaacgtgcagcagaccgtgagcgccaagggcccccccgagaagagaatgagactgcagtag

SEQ ID NO: 8640 - DNA, 762 bp, Artificial Sequence
  Description of Artificial Sequence: Synthetic coding sequence
atggccgccgtggacatcagagacaacctgctgggcatcagctgggtggacagcagctggatccccatcctgaacagcggcagcgtgctggactacttcagcgagagaagcaaccccttctacgacagaacctgcaacaacgaggtggtgaagatgcagagactgaccctggagcacctgaaccagatggtgggcatcgagtacatcctgctgcacgcccaggagcccatcctgttcatcatcagaaagcagcagagacagagccccgcccaggtgatccccctggccgactactacatcatcgccggcgtgatctaccaggcccccgacctgggcagcgtgatcaacagcagagtgagcctgttcagcttctacaagctgaccgccgtgcacggcatccagagcgccttcgacgaggccatgagctactgcagataccaccccagcaagggctactggtggcacttcaaggaccacgaggagcaggacaaggtgagacccaaggccaagagaaaggaggagcccagcagcatcttccagagacagagagtggacgccctgctgctggacctgagacagaagttcccccccaagttcgtgcagctgaagcccggcgagaagcccgtgcccgtggaccagaccaagaaggaggccgagcccatccccgagaccgtgaagcccgaggagaaggagaccaccaagaacgtgcagcagaccgtgagcgccaagggcccccccgagaagagaatgagactgcagtag

SEQ ID NO: 8641 - DNA, 546 bp, Artificial Sequence
  Description of Artificial Sequence: Synthetic coding sequence
atggccgccgtggacatcagagacaacctgctgggcatcagctgggtggacagcagctggatccccatcctgaacagcggcagcgtgctggactacttcagcgagagaagcaaccccttctacgacagaacctgcaacaacgaggtggtgaagatgcagagactgaccctggagcacctgaaccagatggtgggcatcgagtacatcctgctgcacgcccaggagcccatcctgttcatcatcagaaagcagcagagacagagccccgcccaggtgatccccctggccgactactacatcatcgccggcgtgatctaccaggcccccgacctgggcagcgtgatcaacagcagagtgctgaccgccgtgcacggcatccagagcgccttcgacgaggccatgagctactgcagataccaccccagcaagggctactggtggcacttcaaggaccacgaggagcaggccaaggcctggagaaaggcctgcagcagcggcagcaacaaggagagaggcagaacctacaccagaaactgcaagacctag

SEQ ID NO: 8642 - DNA, 750 bp, Artificial Sequence
  Description of Artificial Sequence: Synthetic coding sequence
atggccgccgtggacatcagagacaacctgctgggcatcagctgggtggacagcagctggatccccatcctgaacagcggcagcgtgctggactacttcagcgagagaagcaaccccttctacgacagaacctgcaacaacgaggtggtgaagatgcagagactgaccctggagcacctgaaccagatggtgggcatcgagtacatcctgctgcacgcccaggagcccatcctgttcatcatcagaaagcagcagagacagagccccgcccaggtgatccccctggccgactactacatcatcgccggcgtgatctaccaggcccccgacctgggcagcgtgatcaacagcagagtgctgaccgccgtgcacggcatccagagcgccttcgacgaggccatgagctactgcagataccaccccagcaagggctactggtggcacttcaaggaccacgaggagcaggacaaggtgagacccaaggccaagagaaaggaggagcccagcagcatcttccagagacagagagtggacgccctgctgctggacctgagacagaagttcccccccaagttcgtgcagctgaagcccggcgagaagcccgtgcccgtggaccagaccaagaaggaggccgagcccatccccgagaccgtgaagcccgaggagaaggagaccaccaagaacgtgcagcagaccgtgagcgccaagggcccccccgagaagagaatgagactgcagaaggccgtgtag

SEQ ID NO: 8643 - DNA, 906 bp, Artificial Sequence
  Description of Artificial Sequence: Synthetic coding sequence
atgcagagagaggagaagcagctggaggccagcctggacgccctgctgagccaggtggccgacctgaagaacagcctgggcagcttcatctgcaagctggagaacgagtacggcagactgacctggcccagcgtgctggacagcttcgccctgctgagcggccagctgaacaccctgaacaaggtgctgaagcacgagaagacccccctgttcagaaaccaggtgatcatccccctggtgctgagccccgacagagacgaggacctgatgagacagaccgagggcagagtgcccgtgttcagccacgaggtggtgcccgaccacctgagaaccaagcccgaccccgaggtggaggagcaggagaagcagctgaccaccgacgccgccagaatcggcgccgacgccgcccagaagcagatccagagcctgaacaagatgtgcagcaacctgctggagaagatcagcaaggaggagagagagagcgagagcggcggcctgagacccaacaagcagaccttcaaccccaccgacaccaacgccctggtggccgccgtggccttcggcaagggcctgagcaactggagacccagcggcagcagcggccccggccaggccggccagcccggcgccggcaccatcctggccggcaccagcggcctgcagcaggtgcagatggccggcgcccccagccagcagcagcccatgctgagcggcgtgcagatggcccaggccggccagcccggcaagatgcccagcggcatcaagaccaacatcaagagcgccagcatgcacccctaccagagacccagctgcctgggcttcatcctggccatccccctgagaagaaaggtgaagaagctgctgggccaggagggcaagaagaacgcccacctgcagctgtggtag

SEQ ID NO: 8644 - DNA, 807 bp, Artificial Sequence
  Description of Artificial Sequence: Synthetic coding sequence
atgcagagagaggagaagcagctggaggccagcctggacgccctgctgagccaggtggccgacctgaagaacagcctgggcagcttcatctgcaagctggagaacgagtacggcagactgacctggcccagcgtgctggacagcttcgccctgctgagcggccagctgaacaccctgaacaaggtgctgaagcacgagaagacccccctgttcagaaaccaggtgatcatccccctggtgctgagccccgacagagacgaggacctgatgagacagaccgagggcagagtgcccgtgttcagccacgaggtggtgcccgaccacctgagaaccaagcccgaccccgaggtggaggagcaggagaagcagctgaccaccgacgccgccagaatcggcgccgacgccgcccagaagcagatccagagcctgaacaagatgtgcagcaacctgctggagaagatcagcaaggaggagagagagagcgagagcggcggcctgagacccaacaagcagaccttcaaccccaccgacaccaacgccctggtggccgccgtggccttcggcaagggcctgagcaactggagacccagcggcagcagcggccccggccaggccggccagcccggcgccggcaccatcctggccggcaccagcggcctgcagcaggtgcagatggccggcgcccccagccagcagcagcccatgctgagcggcgtgcagatggcccaggccggccagcccggcaagatgcccagcggcatcaagaccaacatcaagagcgccagcatgcacccctaccagagatag

SEQ ID NO: 8645 - DNA, 1248 bp, Artificial Sequence
  Description of Artificial Sequence: Synthetic coding sequence
atgaccctggccgccagcagccagagaagccagatcatcagaagcaagttcagaagcgtgctgcagctgagaatccacagaagaaaccaggagcagatcagcgaccccgacccctggatcagcgccagcgacccccccctggcccccgccctgcccagcggcaccgcccccttcctgttcagccccggcgtgctgctgcccgagcccgagtactgccccccctggagaagccccaagaaggagagccccaagatcagccagagatggagagagagcaagcccagaggcaacctgacctaccaccagtacatgccccccgagcccagacagggcagcagagccgacccccaggccgagggcagcgccctgggcccccccggccccagcctgtgggagggcaccgacagccagcagccccaccccagaatgaagcccagccccctgaccccctgcccccccggcgtgcccagccccagcccccccccccacaagctggagctgcagaccctgaagctggaggagctgaccgtgagcgagctgagacagcagctgagactgagaggcctgcccgtgagcggcaccaagagcatgctgctggagagaatgagaggcggcgccccccccagagagagacccaagcccagaagagaggacagccccgccggcgccccctggcccagactgaagcccaaggccctggccgccgccagaagacagggcagcgtgaagcccagcgccgccagccacagaccccccctgcccagagccgccgacacccccggcaccgcccccgcccccacccccacccccgcccccgccgccgcccccgccctgacccccagcagcggccccggcagcgccgccctgaccctggaggaggagctgcaggaggccatcagaagagcccagctgctgcccaacagaggcatcgacgacatcctggaggaccaggtggagcccgacgaccccctgccccccatccccctggacttccccggcagcttcgacgtgctgagccccagccccgacagcgagggcctgagcagcgtgttcagcagcagcctgcccagccccaccaacagcagcagccccagccccagagaccccaccgacagcctggactggctggaggccctgagcggcggcccccccctgggcagcggcccccccccccccagcatcttcagcgccgacctgagcgacagcagcagcagcagactgtgggacctgctggaggacccctggtag

SEQ ID NO: 8646 - DNA, 939 bp, Artificial Sequence
  Description of Artificial Sequence: Synthetic coding sequence
atgccccccgagcccagacagggcagcagagccgacccccaggccgagggcagcgccctgggcccccccggccccagcctgtgggagggcaccgacagccagcagccccaccccagaatgaagcccagccccctgaccccctgcccccccggcgtgcccagccccagcccccccccccacaagctggagctgcagaccctgaagctggaggagctgaccgtgagcgagctgagacagcagctgagactgagaggcctgcccgtgagcggcaccaagagcatgctgctggagagaatgagaggcggcgccccccccagagagagacccaagcccagaagagaggacagccccgccggcgccccctggcccagactgaagcccaaggccctggccgccgccagaagacagggcagcgtgaagcccagcgccgccagccacagaccccccctgcccagagccgccgacacccccggcaccgcccccgcccccacccccacccccgcccccgccgccgcccccgccctgacccccagcagcggccccggcagcgccgccctgaccctggaggaggagctgcaggaggccatcagaagagcccagctgctgcccaacagaggcatcgacgacatcctggaggaccaggtggagcccgacgaccccctgccccccatccccctggacttccccggcagcttcgacgtgctgagccccagccccgacagcgagggcctgagcagcgtgttcagcagcagcctgcccagccccaccaacagcagcagccccagccccagagaccccaccgacagcctggactggctggaggccctgagcggcggcccccccctgggcagcggcccccccccccccagcatcttcagcgccgacctgagcgacagcagcagcagcagactgtgggacctgctggaggacccctggtag

SEQ ID NO: 8647 - DNA, 744 bp, Artificial Sequence
  Description of Artificial Sequence: Synthetic coding sequence
atgccccccgagcccagacagggcagcagagccgacccccaggccgagggcagcgccctgggcccccccggccccagcctgtgggagggcaccgacagccagcagccccaccccagaatgaagcccagccccctgaccccctgcccccccggcgtgcccagccccagcccccccccccacaagctggagctgcagaccctgaagctggaggagctgaccgtgaagcccagcgccgccagccacagaccccccctgcccagagccgccgacacccccggcaccgcccccgcccccacccccacccccgcccccgccgccgcccccgccctgacccccagcagcggccccggcagcgccgccctgaccctggaggaggagctgcaggaggccatcagaagagcccagctgctgcccaacagaggcatcgacgacatcctggaggaccaggtggagcccgacgaccccctgccccccatccccctggacttccccggcagcttcgacgtgctgagccccagccccgacagcgagggcctgagcagcgtgttcagcagcagcctgcccagccccaccaacagcagcagccccagccccagagaccccaccgacagcctggactggctggaggccctgagcggcggcccccccctgggcagcggcccccccccccccagcatcttcagcgccgacctgagcgacagcagcagcagcagactgtgggacctgctggaggacccctggtag

SEQ ID NO: 8648 - DNA, 939 bp, Artificial Sequence; identical to SEQ ID NO: 8646
  Description of Artificial Sequence: Synthetic coding sequence

SEQ ID NO: 8649 - DNA, 618 bp, Artificial Sequence
  Description of Artificial Sequence: Synthetic coding sequence
atgagcaagaagaagggcctgagcgccgaggagaagagaaccagaatgatggagatcttcagcgagaccaaggacgtgttccagctgaaggacctggagaagatcgcccccaaggagaagggcatcaccgccatgagcgtgaaggaggtgctgcagagcctggtggacgacggcatggtggactgcgagagaatcggcaccagcaactactactgggccttccccagcaaggccctgcacgccagaaagcacaagctggaggtgctggagagccagctgagcgagggcagccagaagcacgccagcctgcagaagagcatcgagaaggccaagatcggcagatgcgagaccgaggagagaaccagactggccaaggagctgagcagcctgagagaccagagagagcagctgaaggccgaggtggagaagtacaaggactgcgacccccaggtggtggaggagatcagacaggccaacaaggtggccaaggaggccgccaacagatggaccgacaacatcttcgccatcaagagctgggccaagagaaagttcggcttcgaggagaacaagatcgacagaaccttcggcatccccgaggacttcgactacatcgactag

SEQ ID NO: 8650 - DNA, 159 bp, Artificial Sequence
  Description of Artificial Sequence: Synthetic coding sequence
atgatcgaccagagcaacagaaccggccagggcgccgccttcagccccgagggccagcccatcggcggctacaccgagacccagccccacgtggccgtgagaccccccggcagcgtgggcatgagcctgaacctggagggcgagtggcactacctgtag

SEQ ID NO: 8651 - DNA, 1077 bp, Artificial Sequence
  Description of Artificial Sequence: Synthetic coding sequence
atggccagaagatacgacgagctgccccactaccccggcatcgtggacggccccgccgccctggccagcttccccgagaccgtgcccgccgtgcccggcccctacggcccccacagacccccccagcccctgccccccggcctggacagcgacggcctgaagagagagaaggacgagatctacggccaccccctgttccccctgctggccctggtgttcgagaagtgcgagctggccacctgcagccccagagacggcgccggcgccggcctgggcaccccccccggcggcgacgtgtgcagcagcgacagcttcaacgaggacatcgccgccttcgccaagcaggtgagaagcgagagacccctgttcagcagcaaccccgagctggacaacctgatgatccaggccatccaggtgctgagattccacctgctggagctggagaagggcaagatgcccatcgacctggtgatcgaggacagagacggcggctgcagagaggacttcgaggactaccccgccagctgccccagcctgcccgaccagaacaacatgtggatcagagaccacgaggacagcggcagcgtgcacctgggcacccccggccccagcagcggcggcctggccagccagagcggcgacaacagcagcgaccagggcgacggcctggacaccagcgtggccagccccagcagcggcggcgaggacgaggacctggaccaggagagaagaagaaacaagaagagaggcatcttccccaaggtggccaccaacatcatgagagcctggctgttccagcacctgagccacccctaccccagcgaggagcagaagaagcagctggcccaggacaccggcctgaccatcctgcaggtgaacaactggttcatcaacgccagaagaagaatcgtgcagcccatgatcgaccagagcaacagaaccggccagggcgccgccttcagccccgagggccagcccatcggcggctacaccgagacccagccccacgtggccgtgagaccccccggcagcgtgggcatgagcctgaacctggagggcgagtggcactacctgtag

SEQ ID NO: 8652 - DNA, 1128 bp, Artificial Sequence
  Description of Artificial Sequence: Synthetic coding sequence
atggccagaagatacgacgagctgccccactaccccggcatcgtggacggccccgccgccctggccagcttccccgagaccgtgcccgccgtgcccggcccctacggcccccacagacccccccagcccctgccccccggcctggacagcgacggcctgaagagagagaaggacgagatctacggccaccccctgttccccctgctggccctggtgttcgagaagtgcgagctggccacctgcagccccagagacggcgccggcgccggcctgggcaccccccccggcggcgacgtgtgcagcagcgacagcttcaacgaggacatcgccgccttcgccaagcaggtgagaagcgagagacccctgttcagcagcaaccccgagctggacaacctgatgatccaggccatccaggtgctgagattccacctgctggagctggagaaggtgcacgacctgtgcgacaacttctgccacagatacatcacctgcctgaagggcaagatgcccatcgacctggtgatcgaggacagagacggcggctgcagagaggacttcgaggactaccccgccagctgccccagcctgcccgaccagaacaacatgtggatcagagaccacgaggacagcggcagcgtgcacctgggcacccccggccccagcagcggcggcctggccagccagagcggcgacaacagcagcgaccagggcgacggcctggacaccagcgtggccagccccagcagcggcggcgaggacgaggacctggaccaggagagaagaagaaacaagaagagaggcatcttccccaaggtggccaccaacatcatgagagcctggctgttccagcacctgagccacccctaccccagcgaggagcagaagaagcagctggcccaggacaccggcctgaccatcctgcaggtgaacaactggttcatcaacgccagaagaagaatcgtgcagcccatgatcgaccagagcaacagaaccggccagggcgccgccttcagccccgagggccagcccatcggcggctacaccgagacccagccccacgtggccgtgagaccccccggcagcgtgggcatgagcctgaacctggagggcgagtggcactacctgtag

SEQ ID NO: 8653 - DNA, 1266 bp, Artificial Sequence
  Description of Artificial Sequence: Synthetic coding sequence
atggccagaagatacgacgagctgccccactaccccggcatcgtggacggccccgccgccctggccagcttccccgagaccgtgcccgccgtgcccggcccctacggcccccacagacccccccagcccctgccccccggcctggacagcgacggcctgaagagagagaaggacgagatctacggccaccccctgttccccctgctggccctggtgttcgagaagtgcgagctggccacctgcagccccagagacggcgccggcgccggcctgggcaccccccccggcggcgacgtgtgcagcagcgacagcttcaacgaggacatcgccgccttcgccaagcaggtgagaagcgagagacccctgttcagcagcaaccccgagctggacaacctgatgatccaggccatccaggtgctgagattccacctgctggagctggagaaggtgcacgacctgtgcgacaacttctgccacagatacatcacctgcctgaagggcaagatgcccatcgacctggtgatcgaggacagagacggcggctgcagagaggacttcgaggactaccccgccagctgccccagcctgcccgaccagaacaacatgtggatcagagaccacgaggacagcggcagcgtgcacctgggcacccccggccccagcagcggcggcctggccagccagagcggcgacaacagcagcgaccagggcgacggcctggacaccagcgtggccagccccagcagcggcggcgaggacgaggacctggaccaggagagaagaagaaacaagaagagaggcatcttccccaaggtggccaccaacatcatgagagcctggctgttccagcacctgagcagaagaagcgaggcccccgtgctgcccgacgtgtgcctgggcctgggcagccccagccccggccccagatgggccagaccctggggcagcgactgcggcagacccggcagacagagcgacagctgctggtggctgcagcacccctaccccagcgaggagcagaagaagcagctggcccaggacaccggcctgaccatcctgcaggtgaacaactggttcatcaacgccagaagaagaatcgtgcagcccatgatcgaccagagcaacagaaccggccagggcgccgccttcagccccgagggccagcccatcggcggctacaccgagacccagccccacgtggccgtgagaccccccggcagcgtgggcatgagcctgaacctggagggcgagtggcactacctgtag

SEQ ID NO: 8654 - DNA, 1266 bp, Artificial Sequence; identical to SEQ ID NO: 8653
  Description of Artificial Sequence: Synthetic coding sequence

SEQ ID NO: 8655 - DNA, 1266 bp, Artificial Sequence; identical to SEQ ID NO: 8653
  Description of Artificial Sequence: Synthetic coding sequence

SEQ ID NO: 8656 - DNA, 1929 bp, Artificial Sequence
  Description of Artificial Sequence: Synthetic coding sequence
atggtgagcgccagccagaacgaggtgcccgccgcccccctggaggagctggcctacagaagaagcctgagagtggccctggacgtgctgagcgagggcagcatctggagccaggagagcagcgccggcaccggcagagccgacagaagcctgagaggcaagcccatggagcacgtgagcagcccctgcgacagcaacagcagcagcctgcccagaggcgacgtgctgggcagcagcagaccccacagaagaagaccctgcgtgcagcagagcctgagcagcagcttcacctgcgagaaggaccccgagtgcaaggtggaccacaagaagggcctgagaaagagcgagaaccccagaggccccctggtgctgcccgccggcggcggcgcccaggacgagagcggcagcagaatccaccacaagaactggaccctggccagcaagagaggcggcaacagcgcccagaaggccagcctgtgcctgaacggcagcagcctgagcgaggacgacaccgagagagacatgggcagcaagggcggcagctgggccgcccccagcctgcccagcggcgtgagagaggacgacccctgcgccaacgccgagggccacgaccccggcctgcccctgggcagcctgaccgccccccccgcccccgagcccagcgcctgcagcgagcccggcgagtgccccgccaagaagagacccagactggacggcagccagagaccccccgccgtgcagctggagcccatggccgccggcgccgcccccagccccggccccggccccggccccagagagagcgtgacccccagaagcaccgccagactgggccccccccccagccacgccagcgccgacgccaccagatgcctgccctgccccgacagccagaagctggagaaggagtgccagagcagcgaggagagcatgggcagcaacagcatgagaagcatcctggaggaggacgaggaggacgaggagccccccagagtgctgctgtaccacgagcccagaagcttcgaggtgggcatgctggtgtggcacaagcacaagaagtaccccttctggcccgccgtggtgaagagcgtgagacagagagacaagaaggccagcgtgctgtacatcgagggccacatgaaccccaagatgaagggcttcaccgtgagcctgaagagcctgaagcacttcgactgcaaggagaagcagaccctgctgaaccaggccagagaggacttcaaccaggacatcggctggtgcgtgagcctgatcaccgactacagagtgagactgggctgcggcagcttcgccggcagcttcctggagtactacgccgccgacatcagctaccccgtgagaaagagcatccagcaggacgtgctgggcaccaagctgccccagctgagcaagggcagccccgaggagcccgtggtgggctgccccctgggccagagacagccctgcagaaagatgctgcccgacagaagcagagccgccagagacagagccaaccagaagctggtggagtacatcgtgaaggccaagggcgccgagagccacctgagagccatcctgaagagcagaaagcccagcagatggctgcagaccttcctgagcagcagccagtacgtgacctgcgtggagacctacctggaggacgagggccagctggacctggtggtgaagtacctgcagggcgtgtaccaggaggtgggcgccaaggtgctgcagagaaccaacggcgacagaatcagattcatcctggacgtgctgctgcccgaggccatcatctgcgccatcagcgccgtggacgaggtggactacaagaccgccgaggagaagtacatcaagggccccagcctgagctacagagagaaggagatcttcgacaaccagctgctggaggagagaaacagaagaagaagatag

SEQ ID NO: 8657 - DNA, 2136 bp, Artificial Sequence
  Description of Artificial Sequence: Synthetic coding sequence
atgatggccgacgccaagtacgtgctgtgcagatgggagaagagactgtggcccgccaaggtgctggccagaaccgccaccagcaccaagaacaagagaagaaaggagtacttcctggccgtgcagatcctgagcctggaggagaagatcaaggtgaagagcaccgaggtggagatcctggagaagagccagatcgaggccatcgccagcagcctggccagccagaacgaggtgcccgccgcccccctggaggagctggcctacagaagaagcctgagagtggccctggacgtgctgagcgagggcagcatctggagccaggagagcagcgccggcaccggcagagccgacagaagcctgagaggcaagcccatggagcacgtgagcagcccctgcgacagcaacagcagcagcctgcccagaggcgacgtgctgggcagcagcagaccccacagaagaagaccctgcgtgcagcagagcctgagcagcagcttcacctgcgagaaggaccccgagtgcaaggtggaccacaagaagggcctgagaaagagcgagaaccccagaggccccctggtgctgcccgccggcggcggcgcccaggacgagagcggcagcagaatccaccacaagaactggaccctggccagcaagagaggcggcaacagcgcccagaaggccagcctgtgcctgaacggcagcagcctgagcgaggacgacaccgagagagacatgggcagcaagggcggcagctgggccgcccccagcctgcccagcggcgtgagagaggacgacccctgcgccaacgccgagggccacgaccccggcctgcccctgggcagcctgaccgccccccccgcccccgagcccagcgcctgcagcgagcccggcgagtgccccgccaagaagagacccagactggacggcagccagagaccccccgccgtgcagctggagcccatggccgccggcgccgcccccagccccggccccggccccggccccagagagagcgtgacccccagaagcaccgccagactgggccccccccccagccacgccagcgccgacgccaccagatgcctgccctgccccgacagccagaagctggagaaggagtgccagagcagcgaggagagcatgggcagcaacagcatgagaagcatcctggaggaggacgaggaggacgaggagccccccagagtgctgctgtaccacgagcccagaagcttcgaggtgggcatgctggtgtggcacaagcacaagaagtaccccttctggcccgccgtggtgaagagcgtgagacagagagacaagaaggccagcgtgctgtacatcgagggccacatgaaccccaagatgaagggcttcaccgtgagcctgaagagcctgaagcacttcgactgcaaggagaagcagaccctgctgaaccaggccagagaggacttcaaccaggacatcggctggtgcgtgagcctgatcaccgactacagagtgagactgggctgcggcagcttcgccggcagcttcctggagtactacgccgccgacatcagctaccccgtgagaaagagcatccagcaggacgtgctgggcaccaagctgccccagctgagcaagggcagccccgaggagcccgtggtgggctgccccctgggccagagacagccctgcagaaagatgctgcccgacagaagcagagccgccagagacagagccaaccagaagctggtggagtacatcgtgaaggccaagggcgccgagagccacctgagagccatcctgaagagcagaaagcccagcagatggctgcagaccttcctgagcagcagccagtacgtgacctgcgtggagacctacctggaggacgagggccagctggacctggtggtgaagtacctgcagggcgtgtaccaggaggtgggcgccaaggtgctgcagagaaccaacggcgacagaatcagattcatcctggacgtgctgctgcccgaggccatcatctgcgccatcagcgccgtggacgaggtggactacaagaccgccgaggagaagtacatcaagggccccagcctgagctacagagagaaggagatcttcgacaaccagctgctggaggagagaaacagaagaagaagatag

SEQ ID NO: 8658 - DNA, 225 bp, Artificial Sequence
  Description of Artificial Sequence: Synthetic coding sequence
ggcggcggcggcggcggccacatcggcgtgagacccggcagcaccctgtgccagatcatcgccacctgccacatgagcgtgaacgacggcggctgctacgtgctgtgcagatgggagaagagactgtggcccgccaaggtgctggccagaaccgccaccagcaccaagaacaagagaagaaaggagtacttcctggccgtgcagatcctgagcctggaggagtag

SEQ ID NO: 8659 - DNA, 2199 bp, Artificial Sequence
  Description of Artificial Sequence: Synthetic coding sequence
atgatggccgacgccaagtacgtgctgtgcagatgggagaagagactgtggcccgccaaggtgctggccagaaccgccaccagcaccaagaacaagagaagaaaggagtacttcctggccgtgcagatcctgagcctggaggagaagatcaaggtgaagagcaccgaggtggagatcctggagaagagccagatcgaggccatcgccagcagcctggccagccagaacgaggtgcccgccgcccccctggaggagctggcctacagaagaagcctgagagtggccctggacgtgctgagcgagggcagcatctggagccaggagagcagcgccggcaccggcagagccgacagaagcctgagaggcaagcccatggagcacgtgagcagcccctgcgacagcaacagcagcagcctgcccagaggcgacgtgctgggcagcagcagaccccacagaagaagaccctgcgtgcagcagagcctgagcagcagcttcacctgcgagaaggaccccgagtgcaaggtggaccacaagaagggcctgagaaagagcgagaaccccagaggccccctggtgctgcccgccggcggcggcgcccaggacgagagcggcagcagaatccaccacaagaactggaccctggccagcaagagaggcggcaacagcgcccagaaggccagcctgtgcctgaacggcagcagcctgagcgaggacgacaccgagagagacatgggcagcaagggcggcagctgggccgcccccagcctgcccagcggcgtgagagaggacgacccctgcgccaacgccgagggccacgaccccggcctgcccctgggcagcctgaccgccccccccgcccccgagcccagcgcctgcagcgagcccggcgagtgccccgccaagaagagacccagactggacggcagccagagaccccccgccgtgcagctggagcccatggccgccggcgccgcccccagccccggccccggccccggccccagagagagcgtgacccccagaagcaccgccagactgggccccccccccagccacgccagcgccgacgccaccagatgcctgccctgccccgacagccagaagctggagaaggagtgccagagcagcgaggagagcatgggcagcaacagcatgagaagcatcctggaggaggacgaggaggacgaggagccccccagagtgctgctgtaccacgagcccagaagcttcgaggtgggcatgctggtgtggcacaagcacaagaagtaccccttctggcccgccgtggtgaagagcgtgagacagagagacaagaaggccagcgtgctgtacatcgagggccacatgaaccccaagatgaagggcttcaccgtgagcctgaagagcctgaagcacttcgactgcaaggagaagcagaccctgctgaaccaggccagagaggacttcaaccaggacatcggctggtgcgtgagcctgatcaccgactacagagtgagactgggctgcggcagcttcgccggcagcttcctggagtactacgccgccgacatcagctaccccgtgagaaagagcatccagcaggacgtgctgggcaccaagctgccccagctgagcaagggcagccccgaggagcccgtggtgggctgccccctgggccagagacagccctgcagaaagatgctgcccgacagaagcagagccgccagagacagagccaaccagaagctggtggagtacatcgtgaaggccaagggcgccgagagccacctgagagccatcctgaagagcagaaagcccagcagatggctgcagaccttcctgagcagcagccagtacgtgacctgcgtggagacctacctggaggacgagggccagctggacctggtggtgaagtacctgcagggcgtgtaccaggaggtgggcgccaaggtgctgcagagaaccaacggcgacagaatcagattcatcctggacgtgctgctgcccgagtgctgggagatgagagtgagagccctggaccccgtgagaagaagaagcagactgctggacccctgcgccgagatggagctgctgagaagctgccagcaccagggcgtgagaacccccagcctgctgagagcccacagatgcttccccgccagcgtgggccaccacctgtgcgacctgtgcggcggcagaggcggcctgcaggacggctag

SEQ ID NO: 8660 - DNA, 501 bp, Artificial Sequence
  Description of Artificial Sequence: Synthetic coding sequence
gtgctggccgccagccagaacgaggtgcccgcccacccctggaagaactggcccaccgacggcagagtggccctggacgtgctgagcgagggcagcatctggagccaggagagcagcgccggcaccggcagagccgacagaagcctgagaggcaagcccatggagcacgtgagcagcccctgcgacagcaacagcagcagcctgcccagaggcgacgtgctgggcagcagcagaccccacagaagaagaccctgcgtgcagcagagcctgagcagcagcttcacctgcgagaaggaccccgagtgcaaggtggaccacaagaagggcctgagaaagagcgagaaccccagaggccccctggtgctgcccgccggcggcggcgcccaggacgagagcggcagcagaatccaccacaagaactggaccctggccagcaagagaggcggcaacagcgcccagaaggccagcctgtgcctgaacggcagcagcctgagcgagtag

SEQ ID NO: 8661 - DNA, 1539 bp, Artificial Sequence
  Description of Artificial Sequence: Synthetic coding sequence
atggccgagcccagcgtggagagcagcagccccggcggcagcgccaccagcgacgaccacgagttcgaccccagcgccgacatgctggtgcacgacttcgacgacgagagaaccctggaggaggaggagatgatggagggcgagaccaacttcagcagcgagatcgaggacctggccagagagggcgacatgcccatccacgagctgctgagcctgtacggctacggcagcaccgtgagactgcccgaggaggacgaggaggaggaggaggaggaggaggagggcgaggacgacgaggacgccgacaacgacgacaacagcggctgcagcggcgagaacaaggaggagaacatcaaggacagcagcggccaggaggacgagacccagagcagcaacgacgaccccagccagagcgtggccagccaggacgcccaggagatcatcagacccagaagatgcaagtacttcgacaccaacagcgaggtggaggaggagagcgaggaggacgaggactacatccccagcgaggactggaagaaggagatcatggtgggcagcatgttccaggccgagatccccgtgggcatctgcagatacaaggagaacgagaaggtgtacgagaacgacgaccagctgctgtgggaccccgagtacctgcccgaggacaaggtgatcatcttcctgaaggacgccagcagaagaaccggcgacgagaagggcgtggaggccatccccgagggcagccacatcaaggacaacgagcaggccctgtacgagctggtgaagtgcaacttcgacaccgaggaggccctgagaagactgagattcaacgtgaaggccgccagagaggagctgagcgtgtggaccgaggaggagtgcagaaacttcgagcagggcctgaaggcctacggcaaggacttccacctgatccaggccaacaaggtgagaaccagaagcgtgggcgagtgcgtggccttctactacatgtggaagaagagcgagagatacgacttcttcgcccagcagaccagattcggcaagaagaagtacaacctgcaccccggcgtgaccgactacatggacagactgctggacgagagcgagagcgccgccagcagcagagcccccagccccccccccaccgccagcaacagcagcaacagccagagcgagaaggaggacggcaccgtgagcaccgccaaccagaacggcgtgagcagcaacggccccggcgagatcctgaacaaggaggaggtgaaggtggagggcctgcacatcaacggccccaccggcggcaacaagaagcccctgcacgccgacatggacaccaacggctacgagaccgacaacctgaccaccgaccccaagctggcccacatgaccgccagaaacgagaacgacttcgacgagaagagcgagagacccgccaagagaagaagagtgaacagcaacggcaaggagagccccggcagcagcgagttcttccaggaggccgtgagccacggcaagttcgaggagctggagaacaccgacgactag

SEQ ID NO: 8662 - DNA, 1113 bp, Artificial Sequence
  Description of Artificial Sequence: Synthetic coding sequence
atgcccatccacgagctgctgagcctgtacggctacggcagcaccgtgagactgcccgaggaggacgaggaggaggaggaggaggaggaggagggcgaggacgacgaggacgccgacaacgacgacaacagcggctgcagcggcgagaacaaggaggagaacatcaaggacagcagcggccaggaggacgagacccagagcagcaacgacgaccccagccagagcgtggccagccaggacgcccaggagatcatcagacccagaagatgcaagtacttcgacaccaacagcgaggtggaggaggagagcgaggaggacgaggactacatccccagcgaggactggaagaaggagatcatggtgggcagcatgttccaggccgagatccccgtgggcatctgcagatacaaggagaacgagaaggtgtacgagaacgacgaccagctgctgtgggaccccgagtacctgcccgaggacaaggtgatcatcttcctgaaggacgccagcagaagaaccggcgacgagaagggcgtggaggccatccccgagggcagccacatcaaggacaacgagcaggccctgtacgagctggtgaagtgcaacttcgacaccgaggaggccctgagaagactgagattcaacgtgaaggccgccagagaggagctgagcgtgtggaccgaggaggagtgcagaaacttcgagcagggcctgaaggcctacggcaaggacttccacctgatccaggccaacaaggtgagaaccagaagcgtgggcgagtgcgtggccttctactacatgtggaagaagagcgagagatacgacttcttcgcccagcagaccagattcggcaagaagaagtacaacctgcaccccggcgtgaccgactacatggacagactgctggacgagagcgagagcgccgccagcagcagagcccccagccccccccccaccgccagcaacagcagcaacagccagagcgagaaggaggacggcaccgtgagcaccgccaaccagaacggcgtgagcagcaacggccccggcatcctgcagatgctgctgcccgtgcacttcagcgccatcagcagcagagccaacgccttcctgaagtag

SEQ ID NO: 8663 - DNA, 1590 bp, Artificial Sequence
  Description of Artificial Sequence: Synthetic coding sequence
atgttcatgttcaactggttcaccgactgcctgtggaccctgttcctgagcaactaccagcccagcgtggagagcagcagccccggcggcagcgccaccagcgacgaccacgagttcgaccccagcgccgacatgctggtgcacgacttcgacgacgagagaaccctggaggaggaggagatgatggagggcgagaccaacttcagcagcgagatcgaggacctggccagagagggcgacatgcccatccacgagctgctgagcctgtacggctacggcagcaccgtgagactgcccgaggaggacgaggaggaggaggaggaggaggaggagggcgaggacgacgaggacgccgacaacgacgacaacagcggctgcagcggcgagaacaaggaggagaacatcaaggacagcagcggccaggaggacgagacccagagcagcaacgacgaccccagccagagcgtggccagccaggacgcccaggagatcatcagacccagaagatgcaagtacttcgacaccaacagcgaggtggaggaggagagcgaggaggacgaggactacatccccagcgaggactggaagaaggagatcatggtgggcagcatgttccaggccgagatccccgtgggcatctgcagatacaaggagaacgagaaggtgtacgagaacgacgaccagctgctgtgggaccccgagtacctgcccgaggacaaggtgatcatcttcctgaaggacgccagcagaagaaccggcgacgagaagggcgtggaggccatccccgagggcagccacatcaaggacaacgagcaggccctgtacgagctggtgaagtgcaacttcgacaccgaggaggccctgagaagactgagattcaacgtgaaggccgccagagaggagctgagcgtgtggaccgaggaggagtgcagaaacttcgagcagggcctgaaggcctacggcaaggacttccacctgatccaggccaacaaggtgagaaccagaagcgtgggcgagtgcgtggccttctactacatgtggaagaagagcgagagatacgacttcttcgcccagcagaccagattcggcaagaagaagtacaacctgcaccccggcgtgaccgactacatggacagactgctggacgagagcgagagcgccgccagcagcagagcccccagccccccccccaccgccagcaacagcagcaacagccagagcgagaaggaggacggcaccgtgagcaccgccaaccagaacggcgtgagcagcaacggccccggcgagatcctgaacaaggaggaggtgaaggtggagggcctgcacatcaacggccccaccggcggcaacaagaagcccctgcacgccgacatggacaccaacggctacgagaccgacaacctgaccaccgaccccaagctggcccacatgaccgccagaaacgagaacgacttcgacgagaagagcgagagacccgccaagagaagaagagtgaacagcaacggcaaggagagccccggcagcagcgagttcttccaggaggccgtgagccacggcaagttcgaggagctggagaacaccgacgactag

SEQ ID NO: 8664 - DNA, 1461 bp, Artificial Sequence
  Description of Artificial Sequence: Synthetic coding sequence
atggacggcgccagcagcggcggcggcggcagcagcgagggcggcggcggcagcagcggcagcggctacggcgtggtggccagattcagccagtgcctggccgagttcagaacctggctgagaaccaactggctgagattcaacgccgacaagaccgacgtgatgctgcccagcgtggagagcagcagccccggcggcagcgccaccagcgacgaccacgagttcgaccccagcgccgacatgctggtgcacgacttcgacgacgagagaaccctggaggaggaggagatgatggagggcgagaccaacttcagcagcgagatcgaggacctggccagagagggcgacatgcccatccacgagctgctgagcctgtacggctacggcagcaccgtgagactgcccgaggaggacgaggaggaggaggaggaggaggaggagggcgaggacgacgaggacgccgacaacgacgacaacagcggctgcagcggcgagaacaaggaggagaacatcaaggacagcagcggccaggaggacgagacccagagcagcaacgacgaccccagccagagcgtggccagccaggacgcccaggagatcatcagacccagaagatgcaagtacttcgacaccaacagcgaggtggaggaggagagcgaggaggacgaggactacatccccagcgaggactggaagaaggagatcatggtgggcagcatgttccaggccgagatccccgtgggcatctgcagatacaaggagaacgagaaggtgtacgagaacgacgaccagctgctgtgggaccccgagtacctgcccgaggacaaggtgatcatcttcctgaaggacgccagcagaagaaccggcgacgagaagggcgtggaggccatccccgagggcagccacatcaaggacaacgagcaggccctgtacgagctggtgaagtgcaacttcgacaccgaggaggccctgagaagactgagattcaacgtgaaggccgccagagaggagctgagcgtgtggaccgaggaggagtgcagaaacttcgagcagggcctgaaggcctacggcaaggacttccacctgatccaggccaacaaggtgagaaccagaagcgtgggcgagtgcgtggccttctactacatgtggaagaagagcgagagatacgacttcttcgcccagcagaccagattcggcaagaagaagtacaacctgcaccccggcgtgaccgactacatggacagactgctggacgagagcgagagcgccgccagcagcagagcccccagccccccccccaccgccagcaacagcagcaacagccagagcgagaaggaggacggcaccgtgagcaccgccaaccagaacggcgtgagcagcaacggccccggcatcctgcagatgctgctgcccgtgcacttcagcgccatcagcagcagagccaacgccttcctgaagtag

SEQ ID NO: 8665 - DNA, 1353 bp, Artificial Sequence
  Description of Artificial Sequence: Synthetic coding sequence
atgttcatgttcaactggttcaccgactgcctgtggaccctgttcctgagcaactaccagcccagcgtggagagcagcagccccggcggcagcgccaccagcgacgaccacgagttcgaccccagcgccgacatgctggtgcacgacttcgacgacgagagaaccctggaggaggaggagatgatggagggcgagaccaacttcagcagcgagatcgaggacctggccagagagggcgacatgcccatccacgagctgctgagcctgtacggctacggcagcaccgtgagactgcccgaggaggacgaggaggaggaggaggaggaggaggagggcgaggacgacgaggacgccgacaacgacgacaacagcggctgcagcggcgagaacaaggaggagaacatcaaggacagcagcggccaggaggacgagacccagagcagcaacgacgaccccagccagagcgtggccagccaggacgcccaggagatcatcagacccagaagatgcaagtacttcgacaccaacagcgaggtggaggaggagagcgaggaggacgaggactacatccccagcgaggactggaagaaggagatcatggtgggcagcatgttccaggccgagatccccgtgggcatctgcagatacaaggagaacgagaaggtgtacgagaacgacgaccagctgctgtgggaccccgagtacctgcccgaggacaaggtgatcatcttcctgaaggacgccagcagaagaaccggcgacgagaagggcgtggaggccatccccgagggcagccacatcaaggacaacgagcaggccctgtacgagctggtgaagtgcaacttcgacaccgaggaggccctgagaagactgagattcaacgtgaaggccgccagagaggagctgagcgtgtggaccgaggaggagtgcagaaacttcgagcagggcctgaaggcctacggcaaggacttccacctgatccaggccaacaaggtgagaaccagaagcgtgggcgagtgcgtggccttctactacatgtggaagaagagcgagagatacgacttcttcgcccagcagaccagattcggcaagaagaagtacaacctgcaccccggcgtgaccgactacatggacagactgctggacgagagcgagagcgccgccagcagcagagcccccagccccccccccaccgccagcaacagcagcaacagccagagcgagaaggaggacggcaccgtgagcaccgccaaccagaacggcgtgagcagcaacggccccggcatcctgcagatgctgctgcccgtgcacttcagcgccatcagcagcagagccaacgccttcctgaagtag

SEQ ID NO: 8666 - DNA, 1602 bp, Artificial Sequence
  Description of Artificial Sequence: Synthetic coding sequence
atgtgcatcagatgcctgtgcctgatcggcctgcagaccgtgtgcggcctgttcagctgccagatcaccagacccagcgtggagagcagcagccccggcggcagcgccaccagcgacgaccacgagttcgaccccagcgccgacatgctggtgcacgacttcgacgacgagagaaccctggaggaggaggagatgatggagggcgagaccaacttcagcagcgagatcgaggacctggccagagagggcgacatgcccatccacgagctgctgagcctgtacggctacggcagcaccgtgagactgcccgaggaggacgaggaggaggaggaggaggaggaggagggcgaggacgacgaggacgccgacaacgacgacaacagcggctgcagcggcgagaacaaggaggagaacatcaaggacagcagcggccaggaggacgagacccagagcagcaacgacgaccccagccagagcgtggccagccaggacgcccaggagatcatcagacccagaagatgcaagtacttcgacaccaacagcgaggtggaggaggagagcgaggaggacgaggactacatccccagcgaggactggaagaaggagatcatggtgggcagcatgttccaggccgagatccccgtgggcatctgcagatacaaggagaacgagaaggtgtacgagaacgacgaccagctgctgtgggaccccgagtacctgcccgaggacaaggtgatcatcttcctgaaggacgccagcagaagaaccggcgacgagaagggcgtggaggccatccccgagggcagccacatcaaggacaacgagcaggccctgtacgagctggtgaagtgcaacttcgacaccgaggaggccctgagaagactgagattcaacgtgaaggccgccagagaggagctgagcgtgtggaccgaggaggagtgcagaaacttcgagcagggcctgaaggcctacggcaaggacttccacctgatccaggccaacaaggtgagaaccagaagcgtgggcgagtgcgtggccttctactacatgtggaagaagagcgagagatacgacttcttcgcccagcagaccagattcggcaagaagaagtacaacctgcaccccggcgtgaccgactacatggacagactgctggacgagagcgagagcgccgccagcagcagagcccccagccccccccccaccgccagcaacagcagcaacagccagagcgagaaggaggacggcaccgtgagcaccgccaaccagaacggcgtgagcagcaacggccccggcgagatcctgaacaaggaggaggtgaaggtggagggcctgcacatcaacggccccaccggcggcaacaagaagcccctgcacgccgacatggacaccaacggctacgagaccgacaacctgaccaccgaccccaagctggcccacatgaccgccagaaacgagaacgacttcgacgagaagagcgagagacccgccaagagaagaagagtgaacagcaacggcaaggagagccccggcagcagcgagttcttccaggaggccgtgagccacggcaagttcgaggagctggagaacaccgacgactag

SEQ ID NO: 8667 - DNA, 1413 bp, Artificial Sequence
  Description of Artificial Sequence: Synthetic coding sequence
atgttcatgttcaactggttcaccgactgcctgtggaccctgttcctgagcaactaccagcccagcgtggagagcagcagccccggcggcagcgccaccagcgacgaccacgagttcgaccccagcgccgacatgctggtgcacgacttcgacgacgagagaaccctggaggaggaggagatgatggagggcgagaccaacttcagcagcgagatcgaggacctggccagagagggcgacatgcccatccacgagctgctgagcctgtacggctacggcagcaccgtgagactgcccgaggaggacgaggaggaggaggaggaggaggaggagggcgaggacgacgaggacgccgacaacgacgacaacagcggctgcagcggcgagaacaaggaggagaacatcaaggacagcagcggccaggaggacgagacccagagcagcaacgacgaccccagccagagcgtggccagccaggacgcccaggagatcatcagacccagaagatgcaagtacttcgacaccaacagcgaggtggaggaggagagcgaggaggacgaggactacatccccagcgaggactggaagaaggagatcatggtgggcagcatgttccaggccgagatccccgtgggcatctgcagatacaaggagaacgagaaggtgtacgagaacgacgaccagctgctgtgggaccccgagtacctgcccgaggacaaggtgatcatcttcctgaaggacgccagcagaagaaccggcgacgagaagggcgtggaggccatccccgagggcagccacatcaaggacaacgagcaggccctgtacgagctggtgaagtgcaacttcgacaccgaggaggccctgagaagactgagattcaacgtgaaggccgccagagaggagctgagcgtgtggaccgaggaggagtgcagaaacttcgagcagggcctgaaggcctacggcaaggacttccacctgatccaggccaacaaggtgagaaccagaagcgtgggcgagtgcgtggccttctactacatgtggaagaagagcgagagatacgacttcttcgcccagcagaccagattcggcaagaagaagtacaacctgcaccccggcgtgaccgactacatggacagactgctggacgagagcgagagcgccgccagcagcagagcccccagccccccccccaccgccagcaacagcagcaacagccagagcgagaaggaggacggcaccgtgagcaccgccaaccagaacggcgtgagcagcaacggccccggcgagatcctgaacaaggaggaggtgaaggtggagggcctgcacatcaacggccccaccggcatcctgcagatgctgctgcccgtgcacttcagcgccatcagcagcagagccaacgccttcctgaagtag

SEQ ID NO: 8668 - DNA, 1698 bp, Artificial Sequence
  Description of Artificial Sequence: Synthetic coding sequence
atggacggcgccagcagcggcggcggcggcagcagcgagggcggcggcggcagcagcggcagcggctacggcgtggtggccagattcagccagtgcctggccgagttcagaacctggctgagaaccaactggctgagattcaacgccgacaagaccgacgtgatgctgcccagcgtggagagcagcagccccggcggcagcgccaccagcgacgaccacgagttcgaccccagcgccgacatgctggtgcacgacttcgacgacgagagaaccctggaggaggaggagatgatggagggcgagaccaacttcagcagcgagatcgaggacctggccagagagggcgacatgcccatccacgagctgctgagcctgtacggctacggcagcaccgtgagactgcccgaggaggacgaggaggaggaggaggaggaggaggagggcgaggacgacgaggacgccgacaacgacgacaacagcggctgcagcggcgagaacaaggaggagaacatcaaggacagcagcggccaggaggacgagacccagagcagcaacgacgaccccagccagagcgtggccagccaggacgcccaggagatcatcagacccagaagatgcaagtacttcgacaccaacagcgaggtggaggaggagagcgaggaggacgaggactacatccccagcgaggactggaagaaggagatcatggtgggcagcatgttccaggccgagatccccgtgggcatctgcagatacaaggagaacgagaaggtgtacgagaacgacgaccagctgctgtgggaccccgagtacctgcccgaggacaaggtgatcatcttcctgaaggacgccagcagaagaaccggcgacgagaagggcgtggaggccatccccgagggcagccacatcaaggacaacgagcaggccctgtacgagctggtgaagtgcaacttcgacaccgaggaggccctgagaagactgagattcaacgtgaaggccgccagagaggagctgagcgtgtggaccgaggaggagtgcagaaacttcgagcagggcctgaaggcctacggcaaggacttccacctgatccaggccaacaaggtgagaaccagaagcgtgggcgagtgcgtggccttctactacatgtggaagaagagcgagagatacgacttcttcgcccagcagaccagattcggcaagaagaagtacaacctgcaccccggcgtgaccgactacatggacagactgctggacgagagcgagagcgccgccagcagcagagcccccagccccccccccaccgccagcaacagcagcaacagccagagcgagaaggaggacggcaccgtgagcaccgccaaccagaacggcgtgagcagcaacggccccggcgagatcctgaacaaggaggaggtgaaggtggagggcctgcacatcaacggccccaccggcggcaacaagaagcccctgcacgccgacatggacaccaacggctacgagaccgacaacctgaccaccgaccccaagctggcccacatgaccgccagaaacgagaacgacttcgacgagaagagcgagagacccgccaagagaagaagagtgaacagcaacggcaaggagagccccggcagcagcgagttcttccaggaggccgtgagccacggcaagttcgaggagctggagaacaccgacgactag

SEQ ID NO: 8669 - DNA, 1302 bp, Artificial Sequence
  Description of Artificial Sequence: Synthetic coding sequence
atggccgagcccagcgtggagagcagcagccccggcggcagcgccaccagcgacgaccacgagttcgaccccagcgccgacatgctggtgcacgacttcgacgacgagagaaccctggaggaggaggagatgatggagggcgagaccaacttcagcagcgagatcgaggacctggccagagagggcgacatgcccatccacgagctgctgagcctgtacggctacggcagcaccgtgagactgcccgaggaggacgaggaggaggaggaggaggaggaggagggcgaggacgacgaggacgccgacaacgacgacaacagcggctgcagcggcgagaacaaggaggagaacatcaaggacagcagcggccaggaggacgagacccagagcagcaacgacgaccccagccagagcgtggccagccaggacgcccaggagatcatcagacccagaagatgcaagtacttcgacaccaacagcgaggtggaggaggagagcgaggaggacgaggactacatccccagcgaggactggaagaaggagatcatggtgggcagcatgttccaggccgagatccccgtgggcatctgcagatacaaggagaacgagaaggtgtacgagaacgacgaccagctgctgtgggaccccgagtacctgcccgaggacaaggtgatcatcttcctgaaggacgccagcagaagaaccggcgacgagaagggcgtggaggccatccccgagggcagccacatcaaggacaacgagcaggccctgtacgagctggtgaagtgcaacttcgacaccgaggaggccctgagaagactgagattcaacgtgaaggccgccagagaggagctgagcgtgtggaccgaggaggagtgcagaaacttcgagcagggcctgaaggcctacggcaaggacttccacctgatccaggccaacaaggtgagaaccagaagcgtgggcgagtgcgtggccttctactacatgtggaagaagagcgagagatacgacttcttcgcccagcagaccagattcggcaagaagaagtacaacctgcaccccggcgtgaccgactacatggacagactgctggacgagagcgagagcgccgccagcagcagagcccccagccccccccccaccgccagcaacagcagcaacagccagagcgagaaggaggacggcaccgtgagcaccgccaaccagaacggcgtgagcagcaacggccccggcatcctgcagatgctgctgcccgtgcacttcagcgccatcagcagcagagccaacgccttcctgaagtag

SEQ ID NO: 8670 - DNA, 1638 bp, Artificial Sequence
  Description of Artificial Sequence: Synthetic coding sequence
atggccgaggccagcagcctgggcagacagagccccagagtggtgagctgcctggagcacagcctgtgccccggcgagcccggcctgcagaccaccgccgtggtgagcatgggcagcggcgaccaccagttcaacctggccgagatcctgagccagaactacagcgtgagaggcgagtgcgaggaggccagcagatgccccgacaagcccaaggaggagctggagaaggacttcatcagccagagcaacgacatgcccttcgacgagctgctggccctgtacggctacgaggccagcgaccccatcagcgacagagagagcgagggcggcgacgtggcccccaacctgcccgacatgaccctggacaaggagcagatcgccaaggacctgctgagcggcgaggaggaggaggagacccagagcagcgccgacgacctgacccccagcgtgaccagccacgaggccagcgacctgttccccaacagaagcggcagcagattcctggccgacgaggacagagagcccggcagcagcgccagcagcgacaccgaggaggacagcctgcccgccaacaagtgcaagaaggagatcatggtgggcccccagttccaggccgacctgagcaacctgcacctgaacagacactgcgagaagatctacgagaacgaggaccagctgctgtgggaccccagcgtgctgcccgagagagaggtggaggagttcctgtacagagccgtgaagagaagatggcacgagatggccggcccccagctgcccgagggcgaggccgtgaaggacagcgagcaggccctgtacgagctggtgaagtgcaacttcaacgtggaggaggccctgagaagactgagattcaacgtgaaggtgatcagagacggcctgtgcgcctggagcgaggaggagtgcagaaacttcgagcacggcttcagagtgcacggcaagaacttccacctgatccaggccaacaaggtgagaaccagaagcgtgggcgagtgcgtggagtactactacctgtggaagaagagcgagagatacgactacttcgcccagcagaccagactgggcagaagaaagtacgtgcccagcggcaccaccgacgccgaccaggacctggacggcagcgaccccgacggccccggcagacccagacccgagcaggacaccctgaccggcatgagaaccgaccccctgagcgtggacggcaccgccggcggcctggacgagcccggcgtggccagcgacggcctgcccagcagcgagcccggcccctgcagcttccagcagctggacgagagccccgccgtgcccctgagccacagaccccccgccctggccgaccccgccagctaccagcccgccgtgaccgcccccgagcccgacgccagccccagactggccgtggacttcgccctgcccaaggagctgcccctgatcagcagccacgtggacctgagcggcgaccccgaggagaccgtggcccccgcccaggtggccctgagcgtgaccgagttcggcctgatcggcatcggcgacgtgaaccccttcctggccgcccaccccacctgccccgcccccggcctgcacagcgagcccctgagccactgcaacgtgatgacctgctag

SEQ ID NO: 8671 - DNA, 1653 bp, Artificial Sequence
  Description of Artificial Sequence: Synthetic coding sequence
atggccgaggccagcttcggcagcagcagccccgtgggcagcctgagcagcgaggaccacgacttcgaccccaccgccgagatgctggtgcacgactacgacgacgagagaaccctggaggaggaggagatgatggacgagggcaagaacttcagcagcgagatcgaggacctggagaaggagggcaccatgcccctggaggacctgctggccttctacggctacgagcccaccatccccgccgtggccaacagcagcgccaacagcagccccagcgagctggccgacgagctgcccgacatgaccctggacaaggaggagatcgccaaggacctgctgagcggcgacgacgaggagacccagagcagcgccgacgacctgacccccagcgtgaccagccacgagaccagcgacttcttccccagacccctgagaagcaacaccgcctgcgacggcgacaaggagagcgaggtggaggacgtggagaccgacagcggcaacagccccgaggacctgagaaaggagatcatgatcggcctgcagtaccaggccgagatccccccctacctgggcgagtacgacggcaacgagaaggtgtacgagaacgaggaccagctgctgtggtgccccgacgtggtgctggagagcaaggtgaaggagtacctggtggagaccagcctgagaaccggcagcgagaagatcatggacagaatcagcgccggcacccacaccagagacaacgagcaggccctgtacgagctgctgaagtgcaaccacaacatcaaggaggccatcgagagatactgctgcaacggcaaggccagccaggagggcatgaccgcctggaccgaggaggagtgcagaagcttcgagcacgccctgatgctgttcggcaaggacttccacctgatccagaagaacaaggtgagaaccagaaccgtggccgagtgcgtggccttctactacatgtggaagaagagcgagagatacgactacttcgcccagcagaccagattcggcaagaagagatacaaccaccaccccggcgtgaccgactacatggacagactggtggacgagaccgaggccctgggcggcaccgtgaacgccagcgccctgaccagcaacagacccgagcccatccccgaccagcagctgaacatcctgaacagcttcaccgccagcgacctgaccgccctgaccaacagcgtggccaccgtgtgcgaccccaccgacgtgaactgcctggacgacagcttcccccccctgggcaacacccccagaggccaggtgaaccacgtgcccgtggtgaccgaggagctgctgaccctgcccagcaacggcgagagcgactgcttcaacctgttcgagaccggcttctaccacagcgagctgaaccccatgaacatgtgcagcgaggagagcgagagacccgccaagagactgaagatgggcatcgccgtgcccgagagcttcatgaacgaggtgagcgtgaacaacctgggcgtggacttcgagaaccacacccaccacatcaccagcgccaagatggccgtgagcgtggccgacttcggcagcctgagcgccaacgagaccaacggcttcatcagcgcccacgccctgcaccagcacgccgccctgcacagcgagtag

SEQ ID NO: 8672 - DNA, 1650 bp, Artificial Sequence
  Description of Artificial Sequence: Synthetic coding sequence
atggccgaggccagcttcggcagcagcagccccgtgggcagcctgagcagcgaggaccacgacttcgaccccaccgccgagatgctggtgcacgactacgacgacgagagaaccctggaggaggaggagatgatggacgagggcaagaacttcagcagcgagatcgaggacctggagaaggagggcaccatgcccctggaggacctgctggccttctacggctacgagcccaccatccccgccgtggccaacagcagcgccaacagcagccccagcgagctggccgacgagctgcccgacatgaccctggacaaggaggagatcgccaaggacctgctgagcggcgacgacgaggagacccagagcagcgccgacgacctgacccccagcgtgaccagccacgagaccagcgacttcttccccagacccctgagaagcaacaccgcctgcgacggcgacaaggagagcgaggtggaggacgtggagaccgacagcggcaacagccccgaggacctgagaaaggagatcatgatcggcctgcagtaccaggccgagatccccccctacctgggcgagtacgacggcaacgagaaggtgtacgagaacgaggaccagctgctgtggtgccccgacgtggtgctggagagcaaggtgaaggagtacctggtggagaccagcctgagaaccggcagcgagaagatcatggacagaatcagcgccggcacccacaccagagacaacgagcaggccctgtacgagctgctgaagtgcaaccacaacatcaaggaggccatcgagagatactgctgcaacggcaaggccagccagggcatgaccgcctggaccgaggaggagtgcagaagcttcgagcacgccctgatgctgttcggcaaggacttccacctgatccagaagaacaaggtgagaaccagaaccgtggccgagtgcgtggccttctactacatgtggaagaagagcgagagatacgactacttcgcccagcagaccagattcggcaagaagagatacaaccaccaccccggcgtgaccgactacatggacagactggtggacgagaccgaggccctgggcggcaccgtgaacgccagcgccctgaccagcaacagacccgagcccatccccgaccagcagctgaacatcctgaacagcttcaccgccagcgacctgaccgccctgaccaacagcgtggccaccgtgtgcgaccccaccgacgtgaactgcctggacgacagcttcccccccctgggcaacacccccagaggccaggtgaaccacgtgcccgtggtgaccgaggagctgctgaccctgcccagcaacggcgagagcgactgcttcaacctgttcgagaccggcttctaccacagcgagctgaaccccatgaacatgtgcagcgaggagagcgagagacccgccaagagactgaagatgggcatcgccgtgcccgagagcttcatgaacgaggtgagcgtgaacaacctgggcgtggacttcgagaaccacacccaccacatcaccagcgccaagatggccgtgagcgtggccgacttcggcagcctgagcgccaacgagaccaacggcttcatcagcgcccacgccctgcaccagcacgccgccctgcacagcgagtag

SEQ ID NO: 8673 - DNA, 807 bp, Artificial Sequence
  Description of Artificial Sequence: Synthetic coding sequence
atggcccagcccctgtgcccccccctgagcgagagctggatgctgagcgccgcctggggccccaccagaagacccccccccagcgacaaggactgcggcagaagcctggtgagcagccccgacagctggggcagcacccccgccgacagccccgtggccagccccgccagacccggcaccctgagagaccccagagcccccagcgtgggcagaagaggcgccagaagcagcagactgggcagcggccagagacagagcgccagcgagagagagaagctgagaatgagaaccctggccagagccctgcacgagctgagaagattcctgccccccagcgtggcccccgccggccagagcctgaccaagatcgagaccctgagactggccatcagatacatcggccacctgagcgccgtgctgggcctgagcgaggagagcctgcagagaagatgcagacagagaggcgacgccggcagccccagaggctgccccctgtgccccgacgactgccccgcccagatgcagaccagaacccaggccgagggccagggccagggcagaggcctgggcctggtgagcgccgtgagagccggcgccagctggggcagcccccccgcctgccccggcgccagagccgcccccgagcccagagacccccccgccctgttcgccgaggccgcctgccccgagggccaggccatggagcccagcccccccagccccctgctgcccggcgacgtgctggccctgctggagacctggatgcccctgagccccctggagtggctgcccgaggagcccaagtag

SEQ ID NO: 8674 - DNA, 2007 bp, Artificial Sequence
  Description of Artificial Sequence: Synthetic coding sequence
atggccgccaacatgtacagagtgggcgactacgtgtacttcgagaacagcagcagcaacccctacctggtgagaagaatcgaggagctgaacaagaccgccaacggcaacgtggaggccaaggtggtgtgcctgttcagaagaagagacatcagcagcagcctgaacagcctggccgacagcaacgccagagagttcgaggaggagagcaagcagcccggcgtgagcgagcagcagagacaccagctgaagcacagagagctgttcctgagcagacagttcgagagcctgcccgccacccacatcagaggcaagtgcagcgtgaccctgctgaacgagaccgacatcctgagccagtacctggagaaggaggactgcttcttctacagcctggtgttcgaccccgtgcagaagaccctgctggccgaccagggcgagatcagagtgggctgcaagtaccaggccgagatccccgacagactggtggagggcgagagcgacaacagaaaccagcagaagatggagatgaaggtgtgggaccccgacaaccccctgaccgacagacagatcgaccagttcctggtggtggccagagccgtgggcaccttcgccagagccctggactgcagcagcagcatcagacagcccagcctgcacatgagcgccgccgccgccagcagagacatcaccctgttccacgccatggacaccctgcagagaaacggctacgacctggccaaggccatgagcaccctggtgccccagggcggccccgtgctgtgcagagacgagatggaggagtggagcgccagcgaggccatgctgttcgaggaggccctggagaagtacggcaaggacttcaacgacatcagacaggacttcctgccctggaagagcctggccagcatcgtgcagttctactacatgtggaagaccaccgacagatacatccagcagaagagactgaaggccgccgaggccgacagcaagctgaagcaggtgtacatccccacctacaccaagcccaaccccaaccagatcatcagcgtgggcagcaagcccggcatgaacggcgccggcttccagaagggcctgacctgcgagagctgccacaccacccagagcgcccagtggtacgcctggggcccccccaacatgcagtgcagactgtgcgccagctgctggatctactggaagaagtacggcggcctgaagacccccacccagctggagggcgccaccagaggcaccaccgagccccacagcagaggccacctgagcagacccgaggcccagagcctgagcccctacaccaccagcgccaacagagccaagctgctggccaagaacagacagaccttcctgctgcagaccaccaagctgaccagactggccagaagaatgtgcagagacctgctgcagcccagaagagccgccagaagaccctacgcccccatcaacgccaacgccatcaaggccgagtgcagcatcagactgcccaaggccgccaagacccccctgaagatccaccccctggtgagactgcccctggccaccatcgtgaaggacctggtggcccaggcccccctgaagcccaagacccccagaggcaccaagacccccatcaacagaaaccagctgagccagaacagaggcctgggcggcatcatggtgaagagagcctacgagaccatggccggcgccggcgtgcccttcagcgccaacggcagacccctggccagcggcatcagaagcagcagccagcccgccgccaagagacagaagctgaaccccgccgacgcccccaaccccgtggtgttcgtggccaccaaggacaccagagccctgagaaaggccctgacccacctggagatgagaagagccgccagaagacccaacctgcccctgaaggtgaagcccaccctgatcgccgtgagaccccccgtgcccctgcccgcccccagccaccccgccagcaccaacgagcccatcgtgctggaggactag

SEQ ID NO: 8675 - DNA, 1488 bp, Artificial Sequence
  Description of Artificial Sequence: Synthetic coding sequence
atggagatgaaggtgtgggaccccgacaaccccctgaccgacagacagatcgaccagttcctggtggtggccagagccgtgggcaccttcgccagagccctggactgcagcagcagcatcagacagcccagcctgcacatgagcgccgccgccgccagcagagacatcaccctgttccacgccatggacaccctgcagagaaacggctacgacctggccaaggccatgagcaccctggtgccccagggcggccccgtgctgtgcagagacgagatggaggagtggagcgccagcgaggccatgctgttcgaggaggccctggagaagtacggcaaggacttcaacgacatcagacaggacttcctgccctggaagagcctggccagcatcgtgcagttctactacatgtggaagaccaccgacagatacatccagcagaagagactgaaggccgccgaggccgacagcaagctgaagcaggtgtacatccccacctacaccaagcccaaccccaaccagatcatcagcgtgggcagcaagcccggcatgaacggcgccggcttccagaagggcctgacctgcgagagctgccacaccacccagagcgcccagtggtacgcctggggcccccccaacatgcagtgcagactgtgcgccagctgctggatctactggaagaagtacggcggcctgaagacccccacccagctggagggcgccaccagaggcaccaccgagccccacagcagaggccacctgagcagacccgaggcccagagcctgagcccctacaccaccagcgccaacagagccaagctgctggccaagaacagacagaccttcctgctgcagaccaccaagctgaccagactggccagaagaatgtgcagagacctgctgcagcccagaagagccgccagaagaccctacgcccccatcaacgccaacgccatcaaggccgagtgcagcatcagactgcccaaggccgccaagacccccctgaagatccaccccctggtgagactgcccctggccaccatcgtgaaggacctggtggcccaggcccccctgaagcccaagacccccagaggcaccaagacccccatcaacagaaaccagctgagccagaacagaggcctgggcggcatcatggtgaagagagcctacgagaccatggccggcgccggcgtgcccttcagcgccaacggcagacccctggccagcggcatcagaagcagcagccagcccgccgccaagagacagaagctgaaccccgccgacgcccccaaccccgtggtgttcgtggccaccaaggacaccagagccctgagaaaggccctgacccacctggagatgagaagagccgccagaagacccaacctgcccctgaaggtgaagcccaccctgatcgccgtgagaccccccgtgcccctgcccgcccccagccaccccgccagcaccaacgagcccatcgtgctggaggactag

SEQ ID NO: 8676 - DNA, 1488 bp, Artificial Sequence; identical to SEQ ID NO: 8675
  Description of Artificial Sequence: Synthetic coding sequence

SEQ ID NO: 8677 - DNA, 1761 bp, Artificial Sequence
  Description of Artificial Sequence: Synthetic coding sequence
atggccgccaacatgtacagagtgggcgactacgtgtacttcgagaacagcagcagcaacccctacctgatcagaagaatcgaggagctgaacaagaccgccagcggcaacgtggaggccaaggtggtgtgcttctacagaagaagagacatcagcaacaccctgatcatgctggccgacaagcacgccaaggagatcgaggaggagagcgagaccaccgtggaggccgacctgaccgacaagcagaagcaccagctgaagcacagagagctgttcctgagcagacagtacgagagcctgcccgccacccacatcagaggcaagtgcagcgtggccctgctgaacgagaccgagagcgtgctgagctacctggacaaggaggacaccttcttctacagcctggtgtacgaccccagcctgaagaccctgctggccgacaagggcgagatcagagtgggccccagataccaggccgacatccccgagatgctgctggagggcgagagcgacgagagagagcagagcaagctggaggtgaaggtgtgggaccccaacagccccctgaccgacagacagatcgaccagttcctggtggtggccagagccgtgggcaccttcgccagagccctggactgcagcagcagcgtgagacagcccagcctgcacatgagcgccgccgccgccagcagagacatcaccctgttccacgccatggacaccctgtacagacacagctacgacctgagcagcgccatcagcgtgctggtgcccctgggcggccccgtgctgtgcagagacgagatggaggagtggagcgccagcgaggccagcctgttcgaggaggccctggagaagtacggcaaggacttcaacgacatcagacaggacttcctgccctggaagagcctgaccagcatcatcgagtactactacatgtggaagaccaccgacagatacgtgcagcagaagagactgaaggccgccgaggccgagagcaagctgaagcaggtgtacatccccacctacagcaagcccaaccccaaccagatcagcaccagcaacggcaagcccggcgccgtgaacggcgccgtgggcaccaccttccagccccagaaccccctgctgggcagagcctgcgagagctgctacgccacccagagccaccagtggtacagctggggcccccccaacatgcagtgcagactgtgcgccatctgctggctgtactggaagaagtacggcggcctgaagatgcccacccagagcgaggaggagaagctgagccccagccccaccaccgaggaccccagagtgagaagccacgtgagcagacaggccatgcagggcatgcccgtgagaaacaccggcagccccaagagcgccgtgaagaccagacaggccttcttcctgcacaccacctacttcaccaagttcgccagacaggtgtgcaagaacaccctgagactgagacaggccgccagaagacccttcgtggccatcaactacgccgccatcagagccgagtacgccgacagacacgccgagctgagcggcagccccctgaagagcaagagcaccagaaagcccctggcctgcatcatcggctacctggagatccaccccgccaagaagcccaacgtgatcagaagcacccccagcctgcagacccccaccaccaagagaatgctgaccacccccaaccacaccagcctgagcatcctgggcaagagaaactacagccaccacaacggcctggactag

SEQ ID NO: 8678 - DNA, 1785 bp, Artificial Sequence
  Description of Artificial Sequence: Synthetic coding sequence
atggccgccaacatgtacagagtgggcgactacgtgtacttcgagaacagcagcagcaacccctacctgatcagaagaatcgaggagctgaacaagaccgccagcggcaacgtggaggccaaggtggtgtgcttctacagaagaagagacatcagcaacaccctgatcatgctggccgacaagcacgccaaggagatcgaggaggagagcgagaccaccgtggaggccgacctgaccgacaagcagaagcaccagctgaagcacagagagctgttcctgagcagacagtacgagagcctgcccgccacccacatcagaggcaagtgcagcgtggccctgctgaacgagaccgagagcgtgctgagctacctggacaaggaggacaccttcttctacagcctggtgtacgaccccagcctgaagaccctgctggccgacaagggcgagatcagagtgggccccagataccaggccgacatccccgagatgctgctggagggcgagagcgacgagagagagcagagcaagctggaggtgaaggtgtgggaccccaacagccccctgaccgacagacagatcgaccagttcctggtggtggccagagccgtgggcaccttcgccagagccctggactgcagcagcagcgtgagacagcccagcctgcacatgagcgccgccgccgccagcagagacatcaccctgttccacgccatggacaccctgtacagacacagctacgacctgagcagcgccatcagcgtgctggtgcccctgggcggccccgtgctgtgcagagacgagatggaggagtggagcgccagcgaggccagcctgttcgaggaggccctggagaagtacggcaaggacttcaacgacatcagacaggacttcctgccctggaagagcctgaccagcatcatcgagtactactacatgtggaagaccaccgacagatacgtgcagcagaagagactgaaggccgccgaggccgagagcaagctgaagcaggtgtacatccccacctacagcaagcccaaccccaaccagatcagcaccagcaacggcaagcccggcgccgtgaacggcgccgtgggcaccaccttccagccccagaaccccctgctgggcagagcctgcgagagctgctacgccacccagagccaccagtggtacagctggggcccccccaacatgcagtgcagactgtgcgccatctgctggctgtactggaagaagtacggcggcctgaagatgcccacccagagcgaggaggagaagctgagccccagccccaccaccgaggaccccagagtgagaagccacgtgagcagacaggccatgcagggcatgcccgtgagaaacaccggcagccccaagagcgccgtgaagaccagacaggccttcttcctgcacaccacctacttcaccaagttcgccagacaggtgtgcaagaacaccctgagactgagacaggccgccagaagacccttcgtggccatcaactacgccgccatcagagccgagtacgccgacagacacgccgagctgagcggcagccccctgaagagcaagagcaccagaaagcccctggcctgcatcatcggctacctggagatccaccccgccaagaagcccaacgtgatcagaagcacccccagcctgcagacccccaccaccaagagaatgctgaccacccccaaccacaccagcctgagcatcctgggcaagagaaactacagccaccacaacggcctggacgagctgacctgctgcgtgagcgactag

SEQ ID NO: 8679 - DNA, 1548 bp, Artificial Sequence
  Description of Artificial Sequence: Synthetic coding sequence
atggccgccaacatgtacagagtgggcgactacgtgtacttcgagaacagcagcagcaacccctacctgatcagaagaatcgaggagctgaacaagaccgccagcggcaacgtggaggccaaggtggtgtgcttctacagaagaagagacatcagcaacaccctgatcatgctggccgacaagcacgccaaggagatcgaggaggagagcgagaccaccgtggaggccgacctgaccgacaagcagaagcaccagctgaagcacagagagctgttcctgagcagacagtacgagagcctgcccgccacccacatcagaggcaagtgcagcgtggccctgctgaacgagaccgagagcgtgctgagctacctggacaaggaggacaccttcttctacagcctggtgtacgaccccagcctgaagaccctgctggccgacaagggcgagatcagagtgggccccagataccaggccgacatccccgagatgctgctggagggcgagagcgacgagagagagcagagcaagctggaggtgaaggtgtgggaccccaacagccccctgaccgacagacagatcgaccagttcctggtggtggccagagccgtgggcaccttcgccagagccctggactgcagcagcagcgtgagacagcccagcctgcacatgagcgccgccgccgccagcagagacatcaccctgttccacgccatggacaccctgtacagacacagctacgacctgagcagcgccatcagcgtgctggtgcccctgggcggccccgtgctgtgcagagacgagatggaggagtggagcgccagcgaggccagcctgttcgaggaggccctggagaagtacggcaaggacttcaacgacatcagacaggacttcctgccctggaagagcctgaccagcatcatcgagtactactacatgtggaagaccaccgacagatacgtgcagcagaagagactgaaggccgccgaggccgagagcaagctgaagcaggtgtacatccccacctacagcaagcccaaccccaaccagatcagcaccagcaacggcaagcccggcgccgtgaacggcgccgtgggcaccaccttccagccccagaaccccctgctgggcagagcctgcgagagctgctacgccacccagagccaccagtggtacagctggggcccccccaacatgcagtgcagactgtgcgccatctgctggctgtactggaagaagtacggcggcctgaagatgcccacccagagcgaggaggagaagctgagccccagccccaccaccgaggaccccagagtgagaagccacgtgagcagacaggccatgcagggcatgcccgtgagaaacaccggcagccccaagagcgccgtgaagaccagacaggccttcttcctgcacaccacctacttcaccaagttcgccagacaggtgtgcaagaacaccctgagactgagacaggccgccagaagacccttcgtggccatcaactacgccgccatcagagccgagtgcaagatgctgctgaacagctag

SEQ ID NO: 8680 - DNA, 585 bp, Artificial Sequence
  Description of Artificial Sequence: Synthetic coding sequence
atggccaagagcagccagagaaagcagagagactgcgtgaaccagtgcaagagcaagcccggcctgagcaccagcatccccctgagaatgagcagctacaccttcaagagacccgtgaccagaatcaccccccaccccggcaacgaggtgagataccaccagtgggaggagagcctggagaagccccagcaggtgtgctggcagagaagactgcagggcctgcaggcctacagcagcgccggcgagctgagcagcaccctggacctggccaacaccctgcagaagctggtgcccagctacaccggcggcagcctgctggaggacctggccagcggcctggagcacagctgccccatgccccacctggcctgcagcagcgacgccgtggagatcatccccgccgagggcgtgggcatcagccagctgctgtgcaagcagttcctggtgaccgaggaggacatcagaaagcaggagggcaaggtgaagaccgtgagagagagactggccatcgccctgatcgccgacggcctggccaacgaggccgagaaggtgagagaccaggagggcagacccgagaagagatag

SEQ ID NO: 8681 - DNA, 1245 bp, Artificial Sequence
  Description of Artificial Sequence: Synthetic coding sequence
atgctgggcgccctgcccctgcccctgagcctgggccagcccccccccagccccctgctgaaccacagcctgttcggcgtgctgaccggcggcggcggccagcccccccccgagcccctgctgcccccccccggcggccccggcccccccctggcccccggcgagcccgagggccccagcctgctggtggccagcctgctgccccccccccccagcgacctgctgcccccccccagcgccccccccagcaacctgctggccagcttcctgcccctgctggccctgggccccaccgccggcgacggcgagggcagcgccgagggcgccggcggccccagcggcgagcccttcagcggcctgggcgacctgagccccctgctgttcccccccctgagcgccccccccaccctgatcgccctgaacagcgccctgctggccgccaccctggacccccccagcggcacccccccccagccctgcgtgctgagcgccccccagcccggcccccccaccagcagcgtgaccaccgccaccaccgaccccggcgccagcagcctgggcaaggcccccagcaacagcggcagacccccccagctgctgagccccctgctgggcgccagcctgctgggcgacctgagcagcctgaccagcagccccggcgccctgcccagcctgctgcagccccccggccccctgctgagcggccagctgggcctgcagctgctgcccggcggcggcgcccccccccccctgagcgaggccagcagccccctggcctgcctgctgcagagcctgcagatcccccccgagcagcccgaggccccctgcctgccccccgagagccccgccagcgccctggagcccgagcccgccagaccccccctgagcgccctggcccccccccacggcagccccgacccccccgtgcccgagctgctgaccggcagaggcagcggcaagagaggcagaagaggcggcggcggcctgagaggcatcaacggcgaggccagacccgccagaggcagaaagcccggcagcagaagagagcccggcagactggccctgaagtggggcaccagaggcggcttcaacggccagatggagagacaggaggagcccaccatcggcagcatcatgggcagctggctgaagggcgtgctgagccccagaatccaccccctgcccggccccatcctgagaaccctgagatgccccagcagccagaaggtgagcagctggccctag

SEQ ID NO: 8682 - DNA, 3012 bp, Artificial Sequence
  Description of Artificial Sequence: Synthetic coding sequence
atgaacggcggcaacgagagcagcggcgccgacagagccggcggccccgtggccaccagcgtgcccatcggctggcagagatgcgtgagagagggcgccgtgctgtacatcagccccagcggcaccgagctgagcagcctggagcagaccagaagctacctgctgagcgacggcacctgcaagtgcggcctggagtgccccctgaacgtgcccaaggtgttcaacttcgaccccctggcccccgtgacccccggcggcgccggcgtgggccccgccagcgaggaggacatgaccaagctgtgcaaccacagaagaaaggccgtggccatggccaccctgtacagaagcatggagaccacctgcagccacagcagccccggcgagggcgccagcccccagatgttccacaccgtgagccccggcccccccagcgccagacccccctgcagagtgccccccaccacccccctgaacggcggccccggcagcctgccccccgagccccccagcgtgagccaggccttccccaccctggccggccccggcggcctgttcccccccagactggccgaccccgtgcccagcggcggcagcagcagccccagattcctgcccagaggcaacgcccccagccccgcccccccccccccccccgccatcagcctgaacgcccccagctacaactggggcgccgccctgagaagcagcctggtgcccagcgacctgggcagcccccccgccccccacgccagcagcagcccccccagcgacccccccctgttccactgcagcgacgccctgacccccccccccctgccccccagcaacaacctgcccgcccaccccggccccgccagccagccccccgtgagcagcgccaccatgcacctgcccctggtgctgggccccctgggcggcgcccccaccgtggagggccccggcgccccccccttcctggccagcagcctgctgagcgccgccgccaaggcccagcacccccccctgcccccccccagcaccctgcagggcagaagacccagagcccaggcccccagcgccagccacagcagcagcctgagacccagccagagaagacccagaagaccccccaccgtgttcagactgctggagggcagaggcccccagacccccagaagaagcagacccagagcccccgcccccgtgccccagcccttcagcctgcccgagcccagccagcccatcctgcccagcgtgctgagcctgctgggcctgcccacccccggccccagccacagcgacggcagcttcaacctgctgggcagcgacgcccacctgccccccccccccaccctgagcagcggcagccccccccagcccagacaccccatccagcccagcctgcccggcaccaccagcggcagcctgagcagcgtgcccggcgcccccgccccccccgccgccagcaaggcccccgtggtgcccagccccgtgctgcagagccccagcgagggcctgggcatgggcgccggccccgcctgccccctgccccccctggccggcggcgaggccttccccttccccagccccgagcagggcctggccctgagcggcgccggcttccccggcatgctgggcgccctgcccctgcccctgagcctgggccagcccccccccagccccctgctgaaccacagcctgttcggcgtgctgaccggcggcggcggccagcccccccccgagcccctgctgcccccccccggcggccccggcccccccctggcccccggcgagcccgagggccccagcctgctggtggccagcctgctgccccccccccccagcgacctgctgcccccccccagcgccccccccagcaacctgctggccagcttcctgcccctgctggccctgggccccaccgccggcgacggcgagggcagcgccgagggcgccggcggccccagcggcgagcccttcagcggcctgggcgacctgagccccctgctgttcccccccctgagcgccccccccaccctgatcgccctgaacagcgccctgctggccgccaccctggacccccccagcggcacccccccccagccctgcgtgctgagcgccccccagcccggcccccccaccagcagcgtgaccaccgccaccaccgaccccggcgccagcagcctgggcaaggcccccagcaacagcggcagacccccccagctgctgagccccctgctgggcgccagcctgctgggcgacctgagcagcctgaccagcagccccggcgccctgcccagcctgctgcagccccccggccccctgctgagcggccagctgggcctgcagctgctgcccggcggcggcgcccccccccccctgagcgaggccagcagccccctggcctgcctgctgcagagcctgcagatcccccccgagcagcccgaggccccctgcctgccccccgagagccccgccagcgccctggagcccgagcccgccagaccccccctgagcgccctggcccccccccacggcagccccgacccccccgtgcccgagctgctgaccggcagaggcagcggcaagagaggcagaagaggcggcggcggcctgagaggcatcaacggcgaggccagacccgccagaggcagaaagcccggcagcagaagagagcccggcagactggccctgaagtggggcaccagaggcggcttcaacggccagatggagagaagccccagaagaacccaccactggcagcacaacggcgagctggccgagggcggcgccgagcccaaggacccccccccccccggcccccacagcgaggacctgaaggtgccccccggcgtggtgagaaagagcagaagaggcagaagaagaaagtacaaccccaccagaaacagcaacagcagcagacaggacatcaccctggagcccagccccaccgccagagccgccgtgcccctgccccccagagccagacccggcagacccgccaagaacaagagaagaaagctggccccctag

SEQ ID NO: 8683 - DNA, 3012 bp, Artificial Sequence; identical to SEQ ID NO: 8682
  Description of Artificial Sequence: Synthetic coding sequence

SEQ ID NO: 8684 - DNA, 162 bp, Artificial Sequence
  Description of Artificial Sequence: Synthetic coding sequence
atgaacggcggcaacgagagcagcggcgccgacagagccggcggccccgtggccaccagcgtgcccatcggctggcagagatgcgtgagagagggcgccgtgctgtacatcagccccagcggcaccgagctgagcagcctggagcagaccagaagctactag

SEQ ID NO: 8685 - DNA, 222 bp, Artificial Sequence
  Description of Artificial Sequence: Synthetic coding sequence
atgaacggcggcaacgagagcagcggcgccgacagagccggcggccccgtggccaccagcgtgcccatcggctggcagagatgcgtgagagagggcgccgtgctgtacatcagccccagcggcaccgagctgagcagcctggagcagaccagaagctacctgctgagcgacggcacctgcaagtgcggcctggagtgccccctgaacgtgcccaaggtgtag

SEQ ID NO: 8686 - DNA, 447 bp, Artificial Sequence
  Description of Artificial Sequence: Synthetic coding sequence
atgaacggcggcaacgagagcagcggcgccgacagagccggcggccccgtggccaccagcgtgcccatcggctggcagagatgcgtgagagagggcgccgtgctgtacatcagccccagcggcaccgagctgagcagcctggagcagaccagaagctacctgctgagcgacggcacctgcaagtgcggcctggagtgccccctgaacgtgcccaaggtgttcaacttcgaccccctggcccccgtgacccccggcggcgccggcgtgggccccgccagcgaggaggacatgaccaagctgtgcaaccacagaagaaaggccgtggccatggccaccctgtacagaagcatggagaccacctgcagccacagcagccccggcgagggcgccagcccccagatgttccacaccgtgagccccggcccccccagcgccagacccccctag

SEQ ID NO: 8687 - DNA, 162 bp, Artificial Sequence; identical to SEQ ID NO: 8684
  Description of Artificial Sequence: Synthetic coding sequence

SEQ ID NO: 8688 - DNA, 138 bp, Artificial Sequence
  Description of Artificial Sequence: Synthetic coding sequence
atgaacggcggcaacgagagcagcggcgccgacagagccggcggccccgtggccaccagcgtgcccatcggctggcagagatgcgtgagagagggcgccgtgctgtacatcagccccagcggcaccgagctgagctag

SEQ ID NO: 8689 - DNA, 672 bp, Artificial Sequence
  Description of Artificial Sequence: Synthetic coding sequence
atgaccagcgaggtgatcgaggacgagaagcagttctacagcaaggccaagacctactggaagcagatcccccccaccgtggacggcatgctgggcggctacggccacatcagcagcatcgacatcaacagcagcagaaagttcctgcagagattcctgagagagggccccaacaagaccggcaccagctgcgccctggactgcggcgccggcatcggcagaatcaccaagagactgctgctgcccctgttcagagaggtggacatggtggacatcaccgaggacttcctggtgcaggccaagacctacctgggcgaggagggcaagagagtgagaaactacttctgctgcggcctgcaggacttcacccccgagcccgacagctacgacgtgatctggatccagtgggtgatcggccacctgaccgaccagcacctggccgagttcctgagaagatgcaagggcagcctgagacccaacggcatcatcgtgatcaaggacaacatggcccaggagggcgtgatcctggacgacgtggacagcagcgtgtgcagagacctggacgtggtgagaagaatcatctgcagcgccggcctgagcctgctggccgaggagagacaggagaacctgcccgacgagatctaccacgtgtacagcttcgccctgagatag

SEQ ID NO: 8690 - DNA, 438 bp, Artificial Sequence
  Description of Artificial Sequence: Synthetic coding sequence
atgaccagcgaggtgatcgaggacgagaagcagttctacagcaaggccaagacctactggaagcagatcccccccaccgtggacggcatgctgggcggctacggccacatcagcagcatcgacatcaacagcagcagaaagttcctgcagagattcctgagagagggccccaacaagaccggcaccagctgcgccctggactgcggcgccggcatcggcagaatcaccaagagactgctgctgcccctgttcagagaggtggacatggtggacatcaccgaggacttcctggtgcaggccaagacctacctgggcgaggagggcaagagagccaccagccccatcagcacctggcccagcagctgcggcgccgccagagccgccagcgcccccaccgccagcagcagcagcaagaccacctggcccagaagagcctag

SEQ ID NO: 8691 - DNA, 672 bp, Artificial Sequence; identical to SEQ ID NO: 8689
  Description of Artificial Sequence: Synthetic coding sequence

SEQ ID NO: 8692 - DNA, 672 bp, Artificial Sequence; identical to SEQ ID NO: 8689
  Description of Artificial Sequence: Synthetic coding sequence

SEQ ID NO: 8693 - DNA, 1371 bp, Artificial Sequence
  Description of Artificial Sequence: Synthetic coding sequence
atggacagcagactgcaggagatcagagagagacagaagctgagaagacagctgctggcccagcagctgggcgccgagagcgccgacagcatcggcgccgtgctgaacagcaaggacgagcagagagagatcgccgagaccagagagacctgcagagccagctacgacaccagcgcccccaacgccaagagaaagtacctggacgagggcgagaccgacgaggacaagatggaggagtacaaggacgagctggagatgcagcaggacgaggagaacctgccctacgaggaggagatctacaaggacagcagcaccttcctgaagggcacccagagcctgaacccccacaacgactactgccagcacttcgtggacaccggccacagaccccagaacttcatcagagacgtgggcctggccgacagattcgaggagtaccccaagctgagagagctgatcagactgaaggacgagctgatcgccaagagcaacaccccccccatgtacctgcaggccgacatcgaggccttcgacatcagagagctgacccccaagttcgacgtgatcctgctggagccccccctggaggagtactacagagagaccggcatcaccgccaacgagaagtgctggacctgggacgacatcatgaagctggagatcgacgagatcgccgcccccagaagcttcatcttcctgtggtgcggcagcggcgagggcctggacctgggcagagtgtgcctgagaaagtggggctacagaagatgcgaggacatctgctggatcaagaccaacaagaacaaccccggcaagaccaagaccctggaccccaaggccgtgttccagagaaccaaggagcactgcctgatgggcatcaagggcaccgtgaagagaagcaccgacggcgacttcatccacgccaacgtggacatcgacctgatcatcaccgaggagcccgagatcggcaacatcgagaagcccgtggagatcttccacatcatcgagcacttctgcctgggcagaagaagactgcacctgttcggcagagacagcaccatcagacccggctggctgaccgtgggccccaccctgaccaacagcaactacaacgccgagacctacgccagctacttcagcgcccccaacagctacctgaccggctgcaccgaggagatcgagagactgagacccaagagccccccccccaagagcaagagcgacagaggcggcggcgcccccagaggcggcggcagaggcggcaccagcgccggcagaggcagagagagaaacagaagcaacttcagaggcgagagaggcggcttcagaggcggcagaggcggcgcccacagaggcggcttcccccccagatag

SEQ ID NO: 8694 - DNA, 3399 bp, Artificial Sequence
  Description of Artificial Sequence: Synthetic coding sequence
atgatcgccacccccctgaagcacagcagaatctacctgccccccgaggccagcagccagagaagaaacctgcccatggacgccatcttcttcgacagcatccccagcggcaccctgacccccgtgaaggacctggtgaagtaccagaacagcagcctgaagctgaacgaccacaagaagaaccagttcctgaagatgaccaccttcaacaacaagaacatcttccagagcaccatgctgaccgaggccaccaccagcaacagcagcctggacatcagcgccatcaagcccaacaaggacggcctgaagaacaaggccaactacgagagccccggcaagatcttcctgagaatgaaggagaaggtgctgagagacaagcaggagcagcccagcagaaacagcagcctgctggagccccagaagagcggcaacaacgagaccttcacccccaacagagtggagaagaagaagctgcagcacacctacctgtgcgaggagaaggagaacaacaagagcttccagagcgacgacagcagcctgagagccagcgtgcagggcgtgcccctggagagcagcaacaacgacatcttcctgcccgtgaagcagaagatccagtgccagcaggagaagaaggcccccctgcacaacctgacctacgagctgcccaccctgaaccaggagcaggagaacttcctggccgtggaggccagaaacaagaccctgaccagagcccagctggccaagcagatcttccacagcaaggagagcatcgtggccaccaccaagagcaagaaggacaccttcgtgctggagagcgtggacagcgccgacgagcagttccagaacaccaacgccgagaccctgagcaccaactgcatccccatcaagaacggcagcctgctgatggtgagcgacagcgagagaaccaccgagggcaccagccagcagaaggtgaaggagggcaacggcaagaccgtgcccggcgagaccggcctgcccggcagcatgaaggacacctgcaagatcgtgctggccacccccagactgcacatcaccatccccagaagaagcaagagaaacatcagcaagctgagcccccccagaatcttccagaccgtgaccaacggcctgaagaagaaccaggtggtgcagctgcaggagtggatgatcaagagcatcaacaacaacaccgccatctgcgtggagggcaagctgatcgacgtgaccaacatctactggcacagcaacgtgatcatcgagagaatcgagcacaacaagctgagaaccatcagcggcaacgtgtacatcctgaagggcatgatcgaccagatcagcatgaaggaggccggctaccccaactacctgatcagaaagttcatgttcggcttccccgagaactggaaggagcacatcgacaacttcctggagcagctgagagccggcgagaagaacagagagaagaccaagcagaagcagaagaccggcagaagcgtgagagacatcagaaagagcatgaagaacgacgccagagagaaccagaccgacaccgcccagagagccaccaccacctacgacttcgactgcgacaacctggagctgaagagcaacaagcacagcgagagccccggcgccaccgagctgaacatgtgccacagcaactgccagaacaagcccaccctgagattccccgacgaccaggtgaacaacaccatccagaacggcggcggcgacgacctgagcaaccaggagctgatcggcaagaaggagtacaagatgagcagcaagaagctgaagatcggcgagagaaccaacgagagaatcatcaagagccagaagcaggagaccaccgaggagctggacgtgagcatcgacatcctgaccagcagagagcagttcttcagcgacgaggagagaaagtacatggccatcaaccagaagaaggcctacatcctggtgacccccctgaagagcagaaaggtgatcgagcagagatgcatgagatacaacctgagcgccggcaccatcaaggccgtgaccgacttcgtgatccccgagtgccagaagaagagccccatcagcaagagcatgggcaccctggagaacaccttcgagggccacaagagcaagaacaaggaggactgcgacgagagagacctgctgaccgtgaacagaaagatcaagatcagcaacctggagaaggagcagatgctgaccagcgacttcaagaagaacaccagactgctgcccaagctgaagaagatcgagaaccaggtggccatgagcttctacaagcaccagagcagccccgacctgagcagcgaggagagcgagaccgagaaggagatcaagagaaaggccgaggtgaagaagaccaaggccggcaacaccaaggaggccgtggtgcacctgagaaagagcaccagaaacaccagcaacatccccgtgatcctggagcccgagaccgaggagagcgagaacgagttctacatcaagcagaagaaggccagacccagcgtgaaggagaccctgcagaagagcggcgtgagaaaggagttccccatcaccgaggccgtgggcagcgacaagaccaacagacaccccctggagtgcctgcccggcctgatccaggacaaggagtggaacgagaaggagctgcagaagctgcactgcgccttcgccagcctgcccaagcacaagcccggcttctggagcgaggtggccgccgccgtgggcagcagaagccccgaggagtgccagagaaagtacatggagaaccccagaggcaagggcagccagaagcacgtgaccaagaagaagcccgccaacagcaagggccagaacggcaagagaggcgacgccgaccagaagcagaccatcaagatcaccgccaaggtgggcaccctgaagagaaagcagcagatgagagagttcctggagcagctgcccaaggacgaccacgacgacttcttcagcaccacccccctgcagcaccagagaatcctgctgcccagcttccaggacagcgaggacgacgacgacatcctgcccaacatggacaagaaccccaccacccccagcagcgtgatcttccccctggtgaagaccccccagtgccagcacgtgagccccggcatgctgggcagcatcaacagaaacgactgcgacaagtacgtgttcagaatgcagaagtaccacaagagcaacggcggcatcgtgtggggcaacatcaagaagaagctggtggagaccgacttcagcacccccacccccagaagaaagacccccttcaacaccgacctgggcgagaacagcggcatcggcaagctgttcaccaacgccgtggagagcctggacgaggaggagaaggactactacttcagcaacagcgacagcgcctag

SEQ ID NO: 8695 - DNA, 468 bp, Artificial Sequence
  Description of Artificial Sequence: Synthetic coding sequence
atgatcgccacccccctgaagcacagcagaatctacctgccccccgaggccagcagccagagaagaaacctgcccatggacgccatcttcttcgacagcatccccagcggcaccctgacccccgtgaaggacctggtgaagtaccagaacagcagcctgaagctgaacgaccacaagaagaaccagttcctgaagatgaccaccttcaacaacaagaacatcttccagagcaccatgctgaccgaggccaccaccagcaacagcagcctggacatcagcgccatcaagcccaacaaggacggcctgaagaacaaggccaactacgagagccccggcaagatcttcctgagaatgaaggagaaggtgctgagagacaagcaggagcagcccagcagaaacagcagcctgctggagccccagaagagcggcaacaacgagaccttcacccccaacagagtggagaagtag

SEQ ID NO: 8696 - DNA, 702 bp, Artificial Sequence
  Description of Artificial Sequence: Synthetic coding sequence
atggccggcgtgagaagcctgagatgcagcagaggctgcgccggcggctgcgagtgcggcgacaagggcaagtgcagcgacagcagcctgctgggcaagagactgagcgaggacagcagcagacaccagctgctgcagaagtgggccagcatgtggagcagcatgagcgaggacgccagcgtggccgacatggagagagcccagctggaggaggaggccgccgccgccgaggagagacccctggtgttcctgtgcagcggctgcagaagacccctgggcgacagcctgagctgggtggccagccaggaggacaccaactgcatcctgctgagatgcgtgagctgcaacgtgagcgtggacaaggagcagaagctgagcaagagagagaaggagaacggctgcgtgctggagaccctgtgctgcgccggctgcagcctgaacctgggctacgtgtacagatgcacccccaagaacctggactacaagagagacctgttctgcctgagcgtggaggccatcgagagctacgtgctgggcagcagcgagaagcagatcgtgagcgaggacaaggagctgttcaacctggagagcagagtggagatcgagaagagcctgacccagatggaggacgtgctgaaggccctgcagatgaagctgtgggaggccgagagcaagctgagcttcgccacctgcaagagctag

SEQ ID NO: 8697 - DNA, 3150 bp, Artificial Sequence
  Description of Artificial Sequence: Synthetic coding sequence
atggaccacaccggcgccatcgacaccgaggacgaggtgggccccctggcccacctggcccccagcccccagagcgaggccgtggcccacgagttccaggagctgagcctgcagagcagccagaacctgccccccctgaacgagagaaagaacgtgctgcagctgagactgcagcagagaagaaccagagagcagctggtggaccagggcatcatgccccccctgaagagccccgccgccttccacgagcagatcaagagcctggagagagccagaaccgagaacttcctgaagcacaagatcagaagcagacccgacagaagcgagctggtgagaatgcacatcctggaggagaccttcgccgagcccagcctgcaggccacccagatgaagctgaagagagccagactggccgacgacctgaacgagaagatcgcccagagacccggccccatggagctggtggagaagaacatcctgcccgtggacagcagcgtgaaggaggccatcatcggcgtgggcaaggaggactacccccacacccagggcgacttcagcttcgacgaggacagcagcgacgccctgagccccgaccagcccgccagccaggagagccagggcagcgccgccagccccagcgagcccaaggtgagcgagagccccagccccgtgaccaccaacacccccgcccagttcgccagcgtgagccccaccgtgcccgagttcctgaagaccccccccaccgccgaccagcccccccccagacccgccgcccccgtgctgcccaccaacaccgtgagcagcgccaagcccggccccgccctggtgaagcagagccaccccaagaaccccaacgacaagcacagaagcaagaagtgcaaggaccccaagcccagagtgaagaagctgaagtaccaccagtacatcccccccgaccagaagggcgagaagaacgagccccagatggacagcaactacgccagactgctgcagcagcagcagctgttcctgcagctgcagatcctgagccagcagaagcagcactacaactaccagaccatcctgcccgcccccttcaagcccctgaacgacaagaacagcaacagcggcaacagcgccctgaacaacgccacccccaacacccccagacagaacaccagcacccccgtgagaaagcccggccccctgcccagcagcctggacgacctgaaggtgagcgagctgaagaccgagctgaagctgagaggcctgcccgtgagcggcaccaagcccgacctgatcgagagactgaagccctaccaggaggtgaacagcagcggcctggccgccggcggcatcgtggccgtgagcagcagcgccatcgtgaccagcaaccccgaggtgaccgtggccctgcccgtgaccaccctgcacaacaccgtgaccagcagcgtgagcaccctgaaggccgagctgccccccaccggcaccagcaacgccaccagagtggagaacgtgcacagccccctgcccatcagccccagccccagcgagcagagcagcctgagcaccgacgacaccaacatggccgacaccttcaccgagatcatgaccatgatgagccccagccagttcctgagcagcagccccctgagaatgaccaacaacgaggacagcctgagccccaccagcagcaccctgagcaacctggagctggacgccgccgagaaggacagaaagctgcaggagaaggagaagcagatcgaggagctgaagagaaagctggagcaggagcagaagctggtggaggtgctgaagatgcagctggaggtggagaagagaggccagcagcagagacccctggaggcccagcccagcgcccccggccacagcgtgaagagcgaccagaagcacggcagcctgggcagcagcatcaaggacgaggccagcctgcccgactgcagcagcagcagacagcccatccccgtggccagccacgccgtgggccagcccgtgagcaccggcggccagaccctggtggccaagaaggccgtggtgatcaagcaggaggtgcccgtgggccaggccgagcagcagagcgtggtgagccagttctacaccagcccccaggccggcatgcagacccagccccagatcgccaccgccgcccagatccccaccgccgccctggccagcggcctggcccccaccgtgccccagacccaggacaccttcccccagcacgtgctgagccagccccagcaggtgagaaaggtgttcaccaacagcgccagcagcaacaccgtgctgccctaccagagacaccccgcccccgccgtgcagcagcccttcatcaacaaggccagcaacagcgtgctgcagagcagaaacgcccccctgcccagcctgcagaacggccccaacacccccaacaagcccagcagccccccccccccccagcagttcgtggtgcagcacagcctgttcggcagccccgtggccaagaccaaggacccccccagatacgaggaggccatcaagcagaccagaagcacccaggcccccctgcccgagatcagcaacgcccacagccagcagatggacgacctgttcgacatcctgatcaagagcggcgagatcagcctgcccatcaaggaggagcccagccccatcagcaagatgagacccgtgaccgccagcatcaccaccatgcccgtgaacaccgtggtgagcagaccccccccccaggtgcagatggccccccccgtgagcctggagcccatgggcagcctgagcgccagcctggagaaccagctggaggccttcctggacggcaccctgcccagcgccaacgagatcccccccctgcagagcagcagcgaggacagagagcccttcagcctgatcgaggacctgcagaacgacctgctgagccacagcggcatgctggaccacagccacagccccatggagaccagcgagacccagttcgccgccggcaccccctgcctgagcctggacctgagcgacagcaacctggacaacatggagtggctggacatcaccatgcccaacagcagcagcggcctgacccccctgagcaccaccgcccccagcatgttcagcgccgacttcctggacccccaggacctgcccctgccctgggactag

SEQ ID NO: 8698 - DNA, 3267 bp, Artificial Sequence
  Description of Artificial Sequence: Synthetic coding sequence
atgatcgacagcagcaagaagcagcagcagggcttccccgagatcctgaccgccggcgacttcgagcccctgaaggagaaggagtgcctggagggcagcaaccagaagagcctgaaggaggtgctgcagctgagactgcagcagagaagaaccagagagcagctggtggaccagggcatcatgccccccctgaagagccccgccgccttccacgagcagatcaagagcctggagagagccagaaccgagaacttcctgaagcacaagatcagaagcagacccgacagaagcgagctggtgagaatgcacatcctggaggagaccttcgccgagcccagcctgcaggccacccagatgaagctgaagagagccagactggccgacgacctgaacgagaagatcgcccagagacccggccccatggagctggtggagaagaacatcctgcccgtggacagcagcgtgaaggaggccatcatcggcgtgggcaaggaggactacccccacacccagggcgacttcagcttcgacgaggacagcagcgacgccctgagccccgaccagcccgccagccaggagagccagggcagcgccgccagccccagcgagcccaaggtgagcgagagccccagccccgtgaccaccaacacccccgcccagttcgccagcgtgagccccaccgtgcccgagttcctgaagaccccccccaccgccgaccagcccccccccagacccgccgcccccgtgctgcccaccaacaccgtgagcagcgccaagcccggccccgccctggtgaagcagagccaccccaagaaccccaacgacaagcacagaagcaagaagtgcaaggaccccaagcccagagtgaagaagctgaagtaccaccagtacatcccccccgaccagaagggcgagaagaacgagccccagatggacagcaactacgccagactgctgcagcagcagcagctgttcctgcagctgcagatcctgagccagcagaagcagcactacaactaccagaccatcctgcccgcccccttcaagcccctgaacgacaagaacagcaacagcggcaacagcgccctgaacaacgccacccccaacacccccagacagaacaccagcacccccgtgagaaagcccggccccctgcccagcagcctggacgacctgaaggtgagcgagctgaagaccgagctgaagctgagaggcctgcccgtgagcggcaccaagcccgacctgatcgagagactgaagccctaccaggaggtgaacagcagcggcctggccgccggcggcatcgtggccgtgagcagcagcgccatcgtgaccagcaaccccgaggtgaccgtggccctgcccgtgaccaccctgcacaacaccgtgaccagcagcgtgagcaccctgaaggccgagctgccccccaccggcaccagcaacgccaccagagtggagaacgtgcacagccccctgcccatcagccccagccccagcgagcagagcagcctgagcaccgacgacaccaacatggccgacaccttcaccgagatcatgaccatgatgagccccagccagttcctgagcagcagccccctgagaatgaccaacaacgaggacagcctgagccccaccagcagcaccctgagcaacctggagctggacgccgccgagaaggacagaaagctgcaggagaaggagaagcagatcgaggagctgaagagaaagctggagcaggagcagaagctggtggaggtgctgaagatgcagctggaggtggagaagagaggccagcagcagagacccctggaggcccagcccagcgcccccggccacagcgtgaagagcgaccagaagcacggcagcctgggcagcagcatcaaggacgaggccagcctgcccgactgcagcagcagcagacagcccatccccgtggccagccacgccgtgggccagcccgtgagcaccggcggccagaccctggtggccaagaaggccgtggtgatcaagcaggaggtgcccgtgggccaggccgagcagcagagcgtggtgagccagttctacgtgagcagccagggccagcccccccccgccgtggtggcccagccccaggccctgctgaccacccagaccgcccagctgctgctgcccgtgagcatccagggcagcagcgtgaccagcgtgcagctgcccgtgggcagcctgaagctgcagaccagcccccaggccggcatgcagacccagccccagatcgccaccgccgcccagatccccaccgccgccctggccagcggcctggcccccaccgtgccccagacccaggacaccttcccccagcacgtgctgagccagccccagcaggtgagaaaggtgttcaccaacagcgccagcagcaacaccgtgctgccctaccagagacaccccgcccccgccgtgcagcagcccttcatcaacaaggccagcaacagcgtgctgcagagcagaaacgcccccctgcccagcctgcagaacggccccaacacccccaacaagcccagcagccccccccccccccagcagttcgtggtgcagcacagcctgttcggcagccccgtggccaagaccaaggacccccccagatacgaggaggccatcaagcagaccagaagcacccaggcccccctgcccgagatcagcaacgcccacagccagcagatggacgacctgttcgacatcctgatcaagagcggcgagatcagcctgcccatcaaggaggagcccagccccatcagcaagatgagacccgtgaccgccagcatcaccaccatgcccgtgaacaccgtggtgagcagaccccccccccaggtgcagatggccccccccgtgagcctggagcccatgggcagcctgagcgccagcctggagaaccagctggaggccttcctggacggcaccctgcccagcgccaacgagatcccccccctgcagagcagcagcgaggacagagagcccttcagcctgatcgaggacctgcagaacgacctgctgagccacagcggcatgctggaccacagccacagccccatggagaccagcgagacccagttcgccgccggcaccccctgcctgagcctggacctgagcgacagcaacctggacaacatggagtggctggacatcaccatgcccaacagcagcagcggcctgacccccctgagcaccaccgcccccagcatgttcagcgccgacttcctggacccccaggacctgcccctgccctgggactag

SEQ ID NO: 8699 - DNA, 1383 bp, Artificial Sequence
  Description of Artificial Sequence: Synthetic coding sequence
atgatcgacagcagcaagaagcagcagcagggcttccccgagatcctgaccgccggcgacttcgagcccctgaaggagaaggagtgcctggagggcagcaaccagaagagcctgaaggaggtgctgcagctgagactgcagcagagaagaaccagagagcagctggtggaccagggcatcatgccccccctgaagagccccgccgccttccacgagcagatcaagagcctggagagagccagaaccgagaacttcctgaagcacaagatcagaagcagacccgacagaagcgagctggtgagaatgcacatcctggaggagaccttcgccgagcccagcctgcaggccacccagatgaagctgaagagagccagactggccgacgacctgaacgagaagatcgcccagagacccggccccatggagctggtggagaagaacatcctgcccgtggacagcagcgtgaaggaggccatcatcggcgtgggcaaggaggactacccccacacccagggcgacttcagcttcgacgaggacagcagcgacgccctgagccccgaccagcccgccagccaggagagccagggcagcgccgccagccccagcgagcccaaggtgagcgagagccccagccccgtgaccaccaacacccccgcccagttcgccagcgtgagccccaccgtgcccgagttcctgaagaccccccccaccgccgaccagcccccccccagacccgccgcccccgtgctgcccaccaacaccgtgagcagcgccaagcccggccccgccctggtgaagcagagccaccccaagaaccccaacgacaagcacagaagcaagaagtgcaaggaccccaagcccagagtgaagaagctgaagtaccaccagtacatcccccccgaccagaagggcgagaagaacgagccccagatggacagcaactacgccagactgctgcagcagcagcagctgttcctgcagctgcagatcctgagccagcagaagcagcactacaactaccagaccatcctgcccgcccccttcaagtacggcggcgcccacgccatcctgaacgccggcttcagcgtgttcatgagaaactacaagctgcccaaggtggagtgctgccacctgttcgtgctgagcaacgacttccacttcttcgtgatcagagcctaccacaccgtgagcgaggtgcacatggtgagagtggcctgcatccccttccagttcctgagcagcaagatcggcagcgagttcctgcaggtgagaaacgccttcagccagctgttcatccagatctgcctgctgctggagcaccagaacagcaccagatgcagcgagaagagcgtgagcagcatcatccccggcatcaacagctag

SEQ ID NO: 8700 - DNA, 3732 bp, Artificial Sequence
  Description of Artificial Sequence: Synthetic coding sequence
atggagaactgcagcgccgccagcaccttcctgaccgacagcctggagctggagctgggcaccgagtggtgcaagcccccctacttcagctgcgccgtggacaacagaggcggcggcaagcacttcagcggcgagagctacctgtgcagcggcgccctgaagagactgatcctgaacctggaccccctgcccaccaacttcgaggaggacaccctggagatcttcggcatccagtgggtgaccgagaccgccctggtgaacagcagcagagagctgttccacctgttcagacagcagctgtacaacctggagaccctgctgcagagcagctgcgacttcggcaaggtgagcaccctgcactgcaaggccgacaacatcagacagcagtgcgtgctgttcctgcactacgtgaaggtgttcatcttcagatacctgaaggtgcagaacgccgagagccacgtgcccgtgcacccctacgaggccctggaggcccagctgcccagcgtgctgatcgacgagctgcacggcctgctgctgtacatcggccacctgagcgagctgcccagcgtgaacatcggcgccttcgtgaaccagaaccagatcaagctgttcccccccagctggcacctgctgcacctgcacctggacatccactggctggtgctggagatcctgtacatgctgggcgagaagctgaagcaggtggtgtacggccaccagttcatgaacctggccagcgacaacctgaccaacatcagcctgttcgaggagcactgcgagaccctgctgtgcgacctgatcagcctgagcctgaacagatacgacaaggtgagaagcagcgagagcctgatgagcgaccagtgcccctgcctgtgcatcaaggagctgtgggtgctgctgatccacctgctggaccacagaagcaagtggttcgtgagcgagagcttctggaactggctgaacaagctgctgaagaccctgctggagaagagcagcgacagaagaagaagcagcatgcccgtgatccagagcagagaccccctgggcttcagctggtggatcatcacccacgtggccagcttctacaagttcgacagacacggcgtgcccgacgagatgagaaaggtggagagcaactggaacttcgtggaggagctgctgaagaagagcatcagcgtgcagggcgtgatcctggaggagcagctgagaatgtacctgcactgctgcctgaccctgtgcgacttctgggagcccaacatcgccatcgtgaccatcctgtgggagtactacagcaagaacctgaacagcagcttcagcatcagctggctgcccttcaagggcctggccaacaccatgaagagccccctgagcatgctggagatggtgaagacctgctgctgcgacaagcaggaccaggagctgtacaagagcagcagcagctacaccatcttcctgtgcatcctggccaaggtggtgaagaaggccatgaagagcaacggcccccacccctggaagcaggtgaagggcagaatctacagcaagttccaccagaagagaatggaggagctgaccgaggtgggcctgcagaacttcttcagcctgttcctgctgctggccgccgtggccgaggtggaggacgtggccagccacgtgctggacctgctgaacttcctgaagcccgccttcgtgaccagccagagagccctgatctggaagggccacatggccttcctgctgatgtacgcccagaagaacctggacatcggcgtgctggccgagaagttcagctgcgccttcagagagaaggccaaggagttcctggtgagcaagaacgaggagatggtgcagagacagaccatctggaccctgctgagcatctacatcgacggcgtgcaggaggtgttcgagaccagctactgcctgtaccccagccacgagaagctgctgaacgacggcttcagcatgctgctgagagcctgcagagagagcgagctgagaaccgtgctgagcttcctgcaggccgtgctggccagaatcagaagcatgcaccagcagctgtgccaggagctgcagagagacaacgtggacctgttcgtgcagagcagcctgagcgccaaggagagacacctggccgccgtggccagcgccctgtggagacacttcttcagcttcctgaagagccagagaatgagccaggtggtgcccttcagccagctggccgacgccgccgccgacttcaccctgctggccatggacatgcccagcaccgcccccagcgacttccagccccagcccgtgatcagcatcatccagctgttcggctgggacgacatcatctgcccccaggtggtggccagatacctgagccacgtgctgcagaacagcaccctgtgcgaggccctgagccacagcggctacgtgagcttccaggccctgaccgtgagaagctggatcagatgcgtgctgcagatgtacatcaagaacctgagcggccccgacgacctgctgatcgacaagaacctggaggaggccgtggagaaggagtacatgaagcagctggtgaagctgaccagactgctgttcaacctgagcgaggtgaagagcatcttcagcaaggcccaggtggagtacctgagcatcagcgaggaccccaagaaggccctggtgagattcttcgaggccgtgggcgtgacctacggcaacgtgcagaccctgagcgacaagagcgccatggtgaccaagagcctggagtacctgggcgaggtgctgaagtacatcaagccctacctgggcaagaaggtgttcagcgccggcctgcagctgacctacggcatgatgggcatcctggtgaagagctgggcccagatcttcgccaccagcaaggcccagaagctgctgttcagaatcatcgactgcctgctgctgccccacgccgtgctgcagcaggagaaggagctgcccgcccccatgctgagcgccatccagaagagcctgcccctgtacctgcagggcatgtgcatcgtgtgctgccagagccagaaccccaacgcctacctgaaccagctgctgggcaacgtgatcgagcagtacatcggcagattcctgcccgccagcccctacgtgagcgacctgggccagcaccccgtgctgctggccctgagaaacaccgccaccatcccccccatcagcagcctgaagaagtgcatcgtgcaggtgatcagaaagagctacctggagtacaagggcagcagccccccccccagactggccagcatcctggccttcatcctgcagctgttcaaggagaccaacaccgacatctacgaggtggagctgctgctgcccggcatcctgaagtgcctggtgctggtgagcgagccccaggtgaagagactggccaccgagaacctgcagtacatggtgaaggcctgccaggtgggcagcgaggaggagcccagcagccagctgaccagcgtgttcagacagttcatccaggactacggcatgagatactactaccaggtgtacagcatcctggagaccgtggccaccctggaccagcaggtggtgatccacctgatcagcaccctgacccagagcctgaaggacagcgagcagaagtggggcctgggcagaaacatcgcccagagagaggcctacagcaagctgctgagccacctgggccagatgggccaggacgagatgcagagactggagaacgacaacacctag

SEQ ID NO: 8701 - DNA, 867 bp, Artificial Sequence
  Description of Artificial Sequence: Synthetic coding sequence
atgagcagcagaaagcagggcagccagcccagaggccagcagagcgccgaggaggagaacttcaagaagcccaccagaagcaacatgcagagaagcaagatgagaggcgccagcagcggcaagaagaccgccggcccccagcagaagaacctggagcccgccctgcccggcagatggggcggcagaagcgccgagaacccccccagcggcagcgtgagaaagaccagaaagaacaagcagaagacccccggcaacggcgacggcggcagcaccagcgaggccccccagccccccagaaagaagagagccagagccgaccccaccgtggagagcgaggaggccttcaagaacagaatggaggtgaaggtgaagatccccgaggagctgaagccctggctggtggaggactgggacctggtgaccagacagaagcagctgttccagctgcccgccaagaagaacgtggacgccatcctggaggagtacgccaactgcaagaagagccagggcaacgtggacaacaaggagtacgccgtgaacgaggtggtggccggcatcaaggagtacttcaacgtgatgctgggcacccagctgctgtacaagttcgagagaccccagtacgccgagatcctgctggcccaccccgacgcccccatgagccaggtgtacggcgccccccacctgctgagactgttcgtgagaatcggcgccatgctggcctacacccccctggacgagaagagcctggccctgctgctgggctacctgcacgacttcctgaagtacctggccaagaacagcgccagcctgttcaccgccagcgactacaaggtggccagcgccgagtaccacagaaaggccctgtag

SEQ ID NO: 8702 - DNA, 813 bp, Artificial Sequence
  Description of Artificial Sequence: Synthetic coding sequence
atgagcagcagaaagcagggcagccagcccagaggccagcagagcgccgaggaggagaacttcaagaagcccaccagaagcaacatgcagaagaacctggagcccgccctgcccggcagatggggcggcagaagcgccgagaacccccccagcggcagcgtgagaaagaccagaaagaacaagcagaagacccccggcaacggcgacggcggcagcaccagcgaggccccccagccccccagaaagaagagagccagagccgaccccaccgtggagagcgaggaggccttcaagaacagaatggaggtgaaggtgaagatccccgaggagctgaagccctggctggtggaggactgggacctggtgaccagacagaagcagctgttccagctgcccgccaagaagaacgtggacgccatcctggaggagtacgccaactgcaagaagagccagggcaacgtggacaacaaggagtacgccgtgaacgaggtggtggccggcatcaaggagtacttcaacgtgatgctgggcacccagctgctgtacaagttcgagagaccccagtacgccgagatcctgctggcccaccccgacgcccccatgagccaggtgtacggcgccccccacctgctgagactgttcgtgagaatcggcgccatgctggcctacacccccctggacgagaagagcctggccctgctgctgggctacctgcacgacttcctgaagtacctggccaagaacagcgccagcctgttcaccgccagcgactacaaggtggccagcgccgagtaccacagaaaggccctgtag

SEQ ID NO: 8703 - DNA, 513 bp, Artificial Sequence
  Description of Artificial Sequence: Synthetic coding sequence
atggaggtgaaggtgaagatccccgaggagctgaagccctggctggtggaggactgggacctggtgaccagacagaagcagctgttccagctgcccgccaagaagaacgtggacgccatcctggaggagtacgccaactgcaagaagagccagggcaacgtggacaacaaggagtacgccgtgaacgaggtggtggccggcatcaaggagtacttcaacgtgatgctgggcacccagctgctgtacaagttcgagagaccccagtacgccgagatcctgctggcccaccccgacgcccccatgagccaggtgtacggcgccccccacctgctgagactgttcgtgagaatcggcgccatgctggcctacacccccctggacgagaagagcctggccctgctgctgggctacctgcacgacttcctgaagtacctggccaagaacagcgccagcctgttcaccgccagcgactacaaggtggccagcgccgagtaccacagaaaggccctgtag

SEQ ID NO: 8704 - DNA, 534 bp, Artificial Sequence
  Description of Artificial Sequence: Synthetic coding sequence
atgagcagcagaaagcagggcagccagcccagaggccagcagagcgccgaggaggagaacttcaagaagcccaccagaagcaacatgcagagaagcaagatgagaggcgccagcagcggcaagaagaccgccggcccccagcagaagaacctggagcccgccctgcccggcagatggggcggcagaagcgccgagaacccccccagcggcagcgtgagaaagaccagaaagaacaagcagaagacccccggcaacggcgacggcggcagcaccagcgaggccccccagccccccagaaagaagagagccagagccgaccccaccgtggagagcgaggaggccttcaagaacagaatggaggtgaaggtgaagatccccgaggagctgaagccctggctggtggaggactgggacctggtgaccagacagaagcagctgttccagctgcccgccaagaagaacgtggacgccatcctggaggagtacgccaactgcaagaagagccagggcaacgtggacaacaaggagtactag

SEQ ID NO: 8705 - DNA, 867 bp, Artificial Sequence; identical to SEQ ID NO: 8701
  Description of Artificial Sequence: Synthetic coding sequence

SEQ ID NO: 8706 - DNA, 204 bp, Artificial Sequence
  Description of Artificial Sequence: Synthetic coding sequence
atgagcagcagaaagcagggcagccagcccagaggccagcagagcgccgaggaggagaacttcaagaagcccaccagaagcaacatgcagagaagcaagatgagaggcgccagcagcggcaagaagaccgccggcccccagcagaagaacctggagcccgccctgcccggcagatggggcggcagaagcgccgagaacccctag

SEQ ID NO: 8707 - DNA, 867 bp, Artificial Sequence; identical to SEQ ID NO: 8701
  Description of Artificial Sequence: Synthetic coding sequence

SEQ ID NO: 8708 - DNA, 867 bp, Artificial Sequence; identical to SEQ ID NO: 8701
  Description of Artificial Sequence: Synthetic coding sequence

SEQ ID NO: 8709 - DNA, 537 bp, Artificial Sequence
  Description of Artificial Sequence: Synthetic coding sequence
atgagcagcagaaagcagggcagccagcccagaggccagcagagcgccgaggaggagaacttcaagaagcccaccagaagcaacatgcagagaagcaagatgagaggcgccagcagcggcaagaagaccgccggcccccagcagaagaacctggagcccgccctgcccggcagatggggcggcagaagcgccgagaacccccccagcggcagcgtgagaaagaccagaaagaacaagcagaagacccccggcaacggcgacggcggcagcaccagcgaggccccccagccccccagaaagaagagagccagagccgaccccaccgtggagagcgaggaggccttcaagaacagaatggaggtgaaggtgaagatccccgaggagctgaagccctggctggtggaggactgggacctggtgaccagacagaagcagctgttccagctgcccgccaagaagaacgtggacgccatcctggaggagtacgccaactgcaagaagagccagggcaacgtggacaacaaggagtacgcctag

SEQ ID NO: 8710 - DNA, 867 bp, Artificial Sequence; identical to SEQ ID NO: 8701
  Description of Artificial Sequence: Synthetic coding sequence

SEQ ID NO: 8711 - DNA, 477 bp, Artificial Sequence
  Description of Artificial Sequence: Synthetic coding sequence
atgagcagcagaaagcagggcagccagcccagaggccagcagagcgccgaggaggagaacttcaagaagcccaccagaagcaacatgcagagaagcaagatgagaggcgccagcagcggcaagaagaccgccggcccccagcagaagaacctggagcccgccctgcccggcagatggggcggcagaagcgccgagaacccccccagcggcagcgtgagaaagaccagaaagaacaagcagaagacccccggcaacggcgacggcggcagcaccagcgaggccccccagccccccagaaagaagagagccagagccgaccccaccgtggagagcgaggaggccttcaagaacagaatggaggtgaaggtgaagatccccgaggagctgaagccctggctggtggaggactgggacctggtgaccagacagaagcagctgttccagctgcccgccaagaagaacgtggacgccatctag

SEQ ID NO: 8712 - DNA, 867 bp, Artificial Sequence; identical to SEQ ID NO: 8701
  Description of Artificial Sequence: Synthetic coding sequence

SEQ ID NO: 8713 - DNA, 2046 bp, Artificial Sequence
  Description of Artificial Sequence: Synthetic coding sequence
atggccccccaggtgtggagaagaagaaccctggagagatgcctgaccgaggtgggcaaggccaccggcagacccgagtgcttcctgaccatccaggagggcctggccagcaagttcaccagcctgaccaaggtgctgtacgacttcaacaagatcctggagaacggcagaatccacggcagccccctgcagaagctggtgatcgagaacttcgacgacgagcagatctggcagcagctggagctgcagaacgagcccatcctgcagtacttccagaacgccgtgagcgagaccatcaacgacgaggacatcagcctgctgcccgagagcgaggagcaggagagagaggaggacggcagcgagatcgaggccgacgacaaggaggacctggaggacctggaggaggaggaggtgagcgacatgggcaacgacgaccccgagatgggcgagagagccgagaacagcagcaagagcgacctgagaaagagccccgtgttcagcgacgaggacagcgacctggacttcgacatcagcaagctggagcagcagagcaaggtgcagaacaagggccagggcaagcccagagagaagagcatcgtggacgacaagttcttcaagctgagcgagatggaggcctacctggagaacatcgagaaggaggaggagagaaaggacgacaacgacgaggaggaggaggacatcgacttcttcgaggacatcgacagcgacgaggacgagggcggcctgttcggcagcaagaagctgaagagcggcaagagcagcagaaacctgaagtacaaggacttcttcgaccccgtggagagcgacgaggacatcaccaacgtgcacgacgacgagctggacagcaacaaggaggacgacgagatcgccgaggaggaggccgaggagctgagcatcagcgagaccgacgaggacgacgacctgcaggagaacgaggacaacaagcagcacaaggagagcctgaagagagtgaccttcgccctgcccgacgacgccgagaccgaggacaccggcgtgctgaacgtgaagaagaacagcgacgaggtgaagagcagcttcgagaagagacaggagaagatgaacgagaagatcgccagcctggagaaggagctgctggagaagaagccctggcagctgcagggcgaggtgaccgcccagaagagacccgagaacagcctgctggaggagaccctgcacttcgaccacgccgtgagaatggcccccgtgatcaccgaggagaccaccctgcagctggaggacatcatcaagcagagaatcagagaccaggcctgggacgacgtggtgagaaaggagaagcccaaggaggacgcctacgagtacaagaagagactgaccctggaccacgagaagagcaagctgagcctggccgagatctacgagcaggagtacatcaagctgaaccagcagaagaccgccgaggaggagaaccccgagcacgtggagatccagaagatgatggacagcctgttcctgaagctggacgccctgagcaacttccacttcatccccaagccccccgtgcccgagatcaaggtggtgagcaacctgcccgccatcaccatggaggaggtggcccccgtgagcgtgagcgacgccgccctgctggcccccgaggagatcaaggagaagaacaaggccggcgacatcaagaccgccgccgagaagaccgccaccgacaagaagagagagagaagaaagaagaagtaccagaagagaatgaagatcaaggagaaggagaagagaagaaagctgctggagaagagcagcgtggaccaggccggcaagtacagcaagaccgtggccagcgagaagctgaagcagctgaccaagaccggcaaggccagcttcatcaaggacgagggcaaggacaaggccctgaagagcagccaggccttcttcagcaagctgcaggaccaggtgaagatgcagatcaacgacgccaagaagaccgagaagaagaagaagaagagacaggacatcagcgtgcacaagctgaagctgtag

SEQ ID NO: 8714 - DNA, 720 bp, Artificial Sequence
  Description of Artificial Sequence: Synthetic coding sequence
atgcccaagagcaagagagacaagaaggtgagcctgaccaagaccgccaagaagggcctggagctgaagcagaacctgatcgaggagctgagaaagtgcgtggacacctacaagtacctgttcatcttcagcgtggccaacatgagaaacagcaagctgaaggacatcagaaacgcctggaagcacagcagaatgttcttcggcaagaacaaggtgatgatggtggccctgggcagaagccccagcgacgagtacaaggacaacctgcaccaggtgagcaagagactgagaggcgaggtgggcctgctgttcaccaacagaaccaaggaggaggtgaacgagtggttcaccaagtacaccgagatggactacgccagagccggcaacaaggccgccttcaccgtgagcctggaccccggccccctggagcagttcccccacagcatggagccccagctgagacagctgggcctgcccaccgccctgaagagaggcgtggtgaccctgctgagcgactacgaggtgtgcaaggagggcgacgtgctgacccccgagcaggccagagtgctgaagctgttcggctacgagatggccgagttcaaggtgaccatcaagtacatgtgggacagccagagcggcagattccagcagatgggcgacgacctgcccgagagcgccagcgagagcaccgaggagagcgacagcgaggacgacgactag

SEQ ID NO: 8715 - DNA, 621 bp, Artificial Sequence
  Description of Artificial Sequence: Synthetic coding sequence
atgagcaccggcagcgtgagcgaccccgaggagatggagctgagaggcctgcagagagagtaccccgtgcccgccagcaagagaccccccctgagaggcgtggagagaagctacgccagccccagcgacaacagcagcgccgaggaggaggaccccgacggcgaggaggagagatgcgccctgggcaccgccggcagcgccgagggctgcaagagaaagagacccagagtggccggcggcggcggcgccggcggcagcgccggcggcggcggcaagaagcccctgcccgccaagggcagcgccgccgagtgcaagcagagccagagaaacgccgccaacgccagagagagagccagaatgagagtgctgagcaaggccttcagcagactgaagaccagcctgccctgggtgccccccgacaccaagctgagcaagctggacaccctgagactggccagcagctacatcgcccacctgagacagctgctgcaggaggacagatacgagaacggctacgtgcaccccgtgaacctgacctggcccttcgtggtgagcggcagacccgacagcgacaccaaggaggtgagcgccgccaacagactgtgcggcaccaccgcctag

SEQ ID NO: 8716 - DNA, 249 bp, Artificial Sequence
  Description of Artificial Sequence: Synthetic coding sequence
atgagccaggccggcgcccaggaggcccccatcaagaagaagagaccccccgtgaaggacgaggacctgaagggcgccagaggcaacctgaccaagaaccaggagatcaagagcaagacctaccaggtgatgagagagtgcgagcaggccggcagcgccgcccccagcgtgttcagcagaaccagaaccggcaccgagaccgtgttcgagaagcccaaggccggccccaccaagagcgtgttcggctag

SEQ ID NO: 8717 - DNA, 2508 bp, Artificial Sequence
  Description of Artificial Sequence: Synthetic coding sequence
atggccagcctgggcgccaaccccagaagaaccccccagggccccagacccggcgccgccagcagcggcttccccagccccgcccccgtgcccggccccagagaggccgaggaggaggaggtggaggaggaggaggagctggccgagatccacctgtgcgtgctgtggaacagcggctacctgggcatcgcctactacgacaccagcgacagcaccatccacttcatgcccgacgcccccgaccacgagagcctgaagctgctgcagagagtgctggacgagatcaacccccagagcgtggtgaccagcgccaagcaggacgagaacatgaccagattcctgggcaagctggccagccaggagcacagagagcccaagagacccgagatcatcttcctgcccagcgtggacttcggcctggagatcagcaagcagagactgctgagcggcaactacagcttcatccccgacgccatgaccgccaccgagaagatcctgttcctgagcagcatcatccccttcgactgcctgctgaccgtgagagccctgggcggcctgctgaagttcctgggcagaagaagaatcggcgtggagctggaggactacaacgtgagcgtgcccatcctgggcttcaagaagttcatgctgacccacctggtgaacatcgaccaggacacctacagcgtgctgcagatcttcaagagcgagagccaccccagcgtgtacaaggtggccagcggcctgaaggagggcctgagcctgttcggcatcctgaacagatgccactgcaagtggggcgagaagctgctgagactgtggttcaccagacccacccacgacctgggcgagctgagcagcagactggacgtgatccagttcttcctgctgccccagaacctggacatggcccagatgctgcacagactgctgggccacatcaagaacgtgcccctgatcctgaagagaatgaagctgagccacaccaaggtgagcgactggcaggtgctgtacaagaccgtgtacagcgccctgggcctgagagacgcctgcagaagcctgccccagagcatccagctgttcagagacatcgcccaggagttcagcgacgacctgcaccacatcgccagcctgatcggcaaggtggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccagcaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgaccatggagacctgcgaggacggcaacgacctggtgttcttctaccaggtgtgcgagggcgtggccaaggccagccacgccagccacaccgccgcccaggccggcctgcccgacaagctggtggccagaggcaaggaggtgagcgacctgatcagaagcggcaagcccatcaagcccgtgaaggacctgctgaagaagaaccagatggagaactgccagaccctggtggacaagttcatgaagctggacctggaggaccccaacctggacctgaacgtgttcatgagccaggaggtgctgcccgccgccaccagcatcctgtag

SEQ ID NO: 8718 - DNA, 2469 bp, Artificial Sequence
  Description of Artificial Sequence: Synthetic coding sequence
atggccagcctgggcgccaaccccagaagaaccccccagggccccagacccggcgccgccagcagcggcttccccagccccgcccccgtgcccggccccagagaggccgaggaggaggaggtggaggaggaggaggagctggccgagatccacctgtgcgtgctgtggaacagcggctacctgggcatcgcctactacgacaccagcgacagcaccatccacttcatgcccgacgcccccgaccacgagagcctgaagctgctgcagagagtgctggacgagatcaacccccagagcgtggtgaccagcgccaagcaggacgagaacatgaccagattcctgggcaagctggccagccaggagcacagagagcccaagagacccgagatcatcttcctgcccagcgtggacttcggcctggagatcagcaagcagagactgctgagcggcaactacagcttcatccccgacgccatgaccgccaccgagaagatcctgttcctgagcagcatcatccccttcgactgcctgctgaccccccccggcgacctgagattcacccccatccccctgctgatccccagccaggtgagagccctgggcggcctgctgaagttcctgggcagaagaagaatcggcgtggagctggaggactacaacgtgagcgtgcccatcctgggcttcaagaagttcatgctgacccacctggtgaacatcgaccaggacacctacagcgtgctgcagatcttcaagagcgagagccaccccagcgtgtacaaggtggccagcggcctgaaggagggcctgagcctgttcggcatcctgaacagatgccactgcaagtggggcgagaagctgctgagactgtggttcaccagacccacccacgacctgggcgagctgagcagcagactggacgtgatccagttcttcctgctgccccagaacctggacatggcccagatgctgcacagactgctgggccacatcaagaacgtgcccctgatcctgaagagaatgaagctgagccacaccaaggtgagcgactggcaggtgctgtacaagaccgtgtacagcgccctgggcctgagagacgcctgcagaagcctgccccagagcatccagctgttcagagacatcgcccaggagttcagcgacgacctgcaccacatcgccagcctgatcggcaaggtggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccagcaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgaccatggagacctgcgaggacggcaacgacctggtgttcttctaccaggtgagcgacctgatcagaagcggcaagcccatcaagcccgtgaaggacctgctgaagaagaaccagatggagaactgccagaccctggtggacaagttcatgaagctggacctggaggaccccaacctggacctgaacgtgttcatgagccaggaggtgctgcccgccgccaccagcatcctgtag

SEQ ID NO: 8719 - DNA, 2556 bp, Artificial Sequence
  Description of Artificial Sequence: Synthetic coding sequence
atggccagcctgggcgccaaccccagaagaaccccccagggccccagacccggcgccgccagcagcggcttccccagccccgcccccgtgcccggccccagagaggccgaggaggaggaggtggaggaggaggaggagctggccgagatccacctgtgcgtgctgtggaacagcggctacctgggcatcgcctactacgacaccagcgacagcaccatccacttcatgcccgacgcccccgaccacgagagcctgaagctgctgcagagagtgctggacgagatcaacccccagagcgtggtgaccagcgccaagcaggacgagaacatgaccagattcctgggcaagctggccagccaggagcacagagagcccaagagacccgagatcatcttcctgcccagcgtggacttcggcctggagatcagcaagcagagactgctgagcggcaactacagcttcatccccgacgccatgaccgccaccgagaagatcctgttcctgagcagcatcatccccttcgactgcctgctgaccccccccggcgacctgagattcacccccatccccctgctgatccccagccaggtgagagccctgggcggcctgctgaagttcctgggcagaagaagaatcggcgtggagctggaggactacaacgtgagcgtgcccatcctgggcttcaagaagttcatgctgacccacctggtgaacatcgaccaggacacctacagcgtgctgcagatcttcaagagcgagagccaccccagcgtgtacaaggtggccagcggcctgaaggagggcctgagcctgttcggcatcctgaacagatgccactgcaagtggggcgagaagctgctgagactgtggttcaccagacccacccacgacctgggcgagctgagcagcagactggacgtgatccagttcttcctgctgccccagaacctggacatggcccagatgctgcacagactgctgggccacatcaagaacgtgcccctgatcctgaagagaatgaagctgagccacaccaaggtgagcgactggcaggtgctgtacaagaccgtgtacagcgccctgggcctgagagacgcctgcagaagcctgccccagagcatccagctgttcagagacatcgcccaggagttcagcgacgacctgcaccacatcgccagcctgatcggcaaggtggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgaccatggagacctgcgaggacggcaacgacctggtgttcttctaccaggtgtgcgagggcgtggccaaggccagccacgccagccacaccgccgcccaggccggcctgcccgacaagctggtggccagaggcaaggaggtgagcgacctgatcagaagcggcaagcccatcaagcccgtgaaggacctgctgaagaagaaccagatggagaactgccagaccctggtggacaagttcatgaagctggacctggaggaccccaacctggacctgaacgtgttcatgagccaggaggtgctgcccgccgccaccagcatcctgtag

SEQ ID NO: 8720 - DNA, 2505 bp, Artificial Sequence
  Description of Artificial Sequence: Synthetic coding sequence
atggccagcctgggcgccaaccccagaagaaccccccagggccccagacccggcgccgccagcagcggcttccccagccccgcccccgtgcccggccccagagaggccgaggaggaggaggtggaggaggaggaggagctggccgagatccacctgtgcgtgctgtggaacagcggctacctgggcatcgcctactacgacaccagcgacagcaccatccacttcatgcccgacgcccccgaccacgagagcctgaagctgctgcagagagtgctggacgagatcaacccccagagcgtggtgaccagcgccaagcaggacgagaacatgaccagattcctgggcaagctggccagccaggagcacagagagcccaagagacccgagatcatcttcctgcccagcgtggacttcggcctggagatcagcaagcagagactgctgagcggcaactacagcttcatccccgacgccatgaccgccaccgagaagatcctgttcctgagcagcatcatccccttcgactgcctgctgaccgtgagagccctgggcggcctgctgaagttcctgggcagaagaagaatcggcgtggagctggaggactacaacgtgagcgtgcccatcctgggcttcaagaagttcatgctgacccacctggtgaacatcgaccaggacacctacagcgtgctgcagatcttcaagagcgagagccaccccagcgtgtacaaggtggccagcggcctgaaggagggcctgagcctgttcggcatcctgaacagatgccactgcaagtggggcgagaagctgctgagactgtggttcaccagacccacccacgacctgggcgagctgagcagcagactggacgtgatccagttcttcctgctgccccagaacctggacatggcccagatgctgcacagactgctgggccacatcaagaacgtgcccctgatcctgaagagaatgaagctgagccacaccaaggtgagcgactggcaggtgctgtacaagaccgtgtacagcgccctgggcctgagagacgcctgcagaagcctgccccagagcatccagctgttcagagacatcgcccaggagttcagcgacgacctgcaccacatcgccagcctgatcggcaaggtggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgaccatggagacctgcgaggacggcaacgacctggtgttcttctaccaggtgtgcgagggcgtggccaaggccagccacgccagccacaccgccgcccaggccggcctgcccgacaagctggtggccagaggcaaggaggtgagcgacctgatcagaagcggcaagcccatcaagcccgtgaaggacctgctgaagaagaaccagatggagaactgccagaccctggtggacaagttcatgaagctggacctggaggaccccaacctggacctgaacgtgttcatgagccaggaggtgctgcccgccgccaccagcatcctgtag

SEQ ID NO: 8721 - DNA, 2505 bp, Artificial Sequence; identical to SEQ ID NO: 8720
  Description of Artificial Sequence: Synthetic coding sequence

SEQ ID NO: 8722 - DNA, 816 bp, Artificial Sequence
  Description of Artificial Sequence: Synthetic coding sequence
atgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctggactggcccagagtgagcggccaggagggcggcgactag

SEQ ID NO: 8723 - DNA, 1002 bp, Artificial Sequence
  Description of Artificial Sequence: Synthetic coding sequence
aagatcctgttcctgagcagcatcatccccttcgactgcctgctgaccgtgagagccctgggcggcctgctgaagttcctgggcagaagaagaatcggcgtggagctggaggactacaacgtgagcgtgcccatcctgggcttcaagaagttcatgctgacccacctggtgaacatcgaccaggacacctacagcgtgctgcagatcttcaagagcgagagccaccccagcgtgtacaaggtggccagcggcctgaaggagggcctgagcctgttcggcatcctgaacagatgccactgcaagtggggcgagaagctgctgagactgtggttcaccagacccacccacgacctgggcgagctgagcagcagactggacgtgatccagttcttcctgctgccccagaacctggacatggcccagatgctgcacagactgctgggccacatcaagaacgtgcccctgatcctgaagagaatgaagctgagccacaccaaggtgagcgactggcaggtgctgtacaagaccgtgtacagcgccctgggcctgagagacgcctgcagaagcctgccccagagcatccagctgttcagagacatcgcccaggagttcagcgacgacctgcaccacatcgccagcctgatcggcaaggtgtacctgagcccccaggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggctag

SEQ ID NO: 8724 - DNA, 1527 bp, Artificial Sequence
  Description of Artificial Sequence: Synthetic coding sequence
atgtggcccgtgctgctgttcgtgttcctgagccagaccgtgtacagcgccctgggcctgagagacgcctgcagaagcctgccccagagcatccagctgttcagagacatcgcccaggagttcagcgacgacctgcaccacatcgccagcctgatcggcaaggtggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgaccatggagacctgcgaggacggcaacgacctggtgttcttctaccaggtgtgcgagggcgtggccaaggccagccacgccagccacaccgccgcccaggccggcctgcccgacaagctggtggccagaggcaaggaggtgagcgacctgatcagaagcggcaagcccatcaagcccgtgaaggacctgctgaagaagaaccagatggagaactgccagaccctggtggacaagttcatgaagctggacctggaggaccccaacctggacctgaacgtgttcatgagccaggaggtgctgcccgccgccaccagcatcctgtag

SEQ ID NO: 8725 - DNA, 2505 bp, Artificial Sequence; identical to SEQ ID NO: 8720
  Description of Artificial Sequence: Synthetic coding sequence

SEQ ID NO: 8726 - DNA, 2508 bp, Artificial Sequence; identical to SEQ ID NO: 8717
  Description of Artificial Sequence: Synthetic coding sequence

SEQ ID NO: 8727 - DNA, 585 bp, Artificial Sequence
  Description of Artificial Sequence: Synthetic coding sequence
atggccagcctgggcgccaaccccagaagaaccccccagggccccagacccggcgccgccagcagcggcttccccagccccgcccccgtgcccggccccagagaggccgaggaggaggaggtggaggaggaggaggagctggccgagatccacctgtgcgtgctgtggaacagcggctacctgggcatcgcctactacgacaccagcgacagcaccatccacttcatgcccgacgcccccgaccacgagagcctgaagctgctgcagagagtgctggacgagatcaacccccagagcgtggtgaccagcgccaagcaggacgagaacatgaccagattcctgggcaagctggccagccaggagcacagagagcccaagagacccgagatcatcttcctgcccagcgtggacttcggcctggagatcagcaagcagagactgctgagcggcaactacagcttcatccccgacgccatgaccgccaccgagaagatcctgttcctgagcagcatcatccccttcgactgcctgctgaccgtgagagccctgggcggcctgctgaagttcctgggcagaagaagatag

SEQ ID NO: 8728 - DNA, 585 bp, Artificial Sequence; identical to SEQ ID NO: 8727
  Description of Artificial Sequence: Synthetic coding sequence

SEQ ID NO: 8729 - DNA, 2505 bp, Artificial Sequence; identical to SEQ ID NO: 8720
  Description of Artificial Sequence: Synthetic coding sequence

SEQ ID NO: 8730 - DNA, 585 bp, Artificial Sequence; identical to SEQ ID NO: 8727
  Description of Artificial Sequence: Synthetic coding sequence

SEQ ID NO: 8731 - DNA, 1602 bp, Artificial Sequence
  Description of Artificial Sequence: Synthetic coding sequence
atggcccagatgctgcacagactgctgggccacatcaagaacgtgcccctgatcctgaagagaatgaagctgagccacaccaaggtgagcgactggcaggtgctgtacaagaccgtgtacagcgccctgggcctgagagacgcctgcagaagcctgccccagagcatccagctgttcagagacatcgcccaggagttcagcgacgacctgcaccacatcgccagcctgatcggcaaggtggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgaccatggagacctgcgaggacggcaacgacctggtgttcttctaccaggtgtgcgagggcgtggccaaggccagccacgccagccacaccgccgcccaggccggcctgcccgacaagctggtggccagaggcaaggaggtgagcgacctgatcagaagcggcaagcccatcaagcccgtgaaggacctgctgaagaagaaccagatggagaactgccagaccctggtggacaagttcatgaagctggacctggaggaccccaacctggacctgaacgtgttcatgagccaggaggtgctgcccgccgccaccagcatcctgtag

SEQ ID NO: 8732 - DNA, 2508 bp, Artificial Sequence; identical to SEQ ID NO: 8717
  Description of Artificial Sequence: Synthetic coding sequence

SEQ ID NO: 8733 - DNA, 1002 bp, Artificial Sequence; identical to SEQ ID NO: 8723
  Description of Artificial Sequence: Synthetic coding sequence

SEQ ID NO: 8734 - DNA, 2508 bp, Artificial Sequence; identical to SEQ ID NO: 8717
  Description of Artificial Sequence: Synthetic coding sequence

SEQ ID NO: 8735 - DNA, 2466 bp, Artificial Sequence
  Description of Artificial Sequence: Synthetic coding sequence
atggccagcctgggcgccaaccccagaagaaccccccagggccccagacccggcgccgccagcagcggcttccccagccccgcccccgtgcccggccccagagaggccgaggaggaggaggtggaggaggaggaggagctggccgagatccacctgtgcgtgctgtggaacagcggctacctgggcatcgcctactacgacaccagcgacagcaccatccacttcatgcccgacgcccccgaccacgagagcctgaagctgctgcagagagtgctggacgagatcaacccccagagcgtggtgaccagcgccaagcaggacgagaacatgaccagattcctgggcaagctggccagccaggagcacagagagcccaagagacccgagatcatcttcctgcccagcgtggacttcggcctggagatcagcaagcagagactgctgagcggcaactacagcttcatccccgacgccatgaccgccaccgagaagatcctgttcctgagcagcatcatccccttcgactgcctgctgaccccccccggcgacctgagattcacccccatccccctgctgatccccagccaggtgagagccctgggcggcctgctgaagttcctgggcagaagaagaatcggcgtggagctggaggactacaacgtgagcgtgcccatcctgggcttcaagaagttcatgctgacccacctggtgaacatcgaccaggacacctacagcgtgctgcagatcttcaagagcgagagccaccccagcgtgtacaaggtggccagcggcctgaaggagggcctgagcctgttcggcatcctgaacagatgccactgcaagtggggcgagaagctgctgagactgtggttcaccagacccacccacgacctgggcgagctgagcagcagactggacgtgatccagttcttcctgctgccccagaacctggacatggcccagatgctgcacagactgctgggccacatcaagaacgtgcccctgatcctgaagagaatgaagctgagccacaccaaggtgagcgactggcaggtgctgtacaagaccgtgtacagcgccctgggcctgagagacgcctgcagaagcctgccccagagcatccagctgttcagagacatcgcccaggagttcagcgacgacctgcaccacatcgccagcctgatcggcaaggtggtggacttcgagggcagcctggccgagaacagattcaccgtgctgcccaacatcgaccccgagatcgacgagaagaagagaagactgatgggcctgcccagcttcctgaccgaggtggccagaaaggagctggagaacctggacagcagaatccccagctgcagcgtgatctacatccccctgatcggcttcctgctgagcatccccagactgcccagcatggtggaggccagcgacttcgagatcaacggcctggacttcatgttcctgagcgaggagaagctgcactacagaagcgccagaaccaaggagctggacgccctgctgggcgacctgcactgcgagatcagagaccaggagaccctgctgatgtaccagctgcagtgccaggtgctggccagagccgccgtgctgaccagagtgctggacctggccagcagactggacgtgctgctggccctggccagcgccgccagagactacggctacagcagacccagatacagcccccaggtgctgggcgtgagaatccagaacggcagacaccccctgatggagctgtgcgccagaaccttcgtgcccaacagcaccgagtgcggcggcgacaagggcagagtgaaggtgatcaccggccccaacagcagcggcaagagcatctacctgaagcaggtgggcctgatcaccttcatggccctggtgggcagcttcgtgcccgccgaggaggccgagatcggcgccgtggacgccatcttcaccagaatccacagctgcgagagcatcagcctgggcctgagcaccttcatgatcgacctgaaccaggtggccaaggccgtgaacaacgccaccgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctgaccatggagacctgcgaggacggcaacgacctggtgttcttctaccaggtgagcgacctgatcagaagcggcaagcccatcaagcccgtgaaggacctgctgaagaagaaccagatggagaactgccagaccctggtggacaagttcatgaagctggacctggaggaccccaacctggacctgaacgtgttcatgagccaggaggtgctgcccgccgccaccagcatcctgtag

SEQ ID NO: 8736 - DNA, 1527 bp, Artificial Sequence; identical to SEQ ID NO: 8724
  Description of Artificial Sequence: Synthetic coding sequence

SEQ ID NO: 8737 - DNA, 2505 bp, Artificial Sequence; identical to SEQ ID NO: 8720
  Description of Artificial Sequence: Synthetic coding sequence

SEQ ID NO: 8738 - DNA, 2505 bp, Artificial Sequence; identical to SEQ ID NO: 8720
  Description of Artificial Sequence: Synthetic coding sequence

SEQ ID NO: 8739 - DNA, 585 bp, Artificial Sequence; identical to SEQ ID NO: 8727
  Description of Artificial Sequence: Synthetic coding sequence

SEQ ID NO: 8740 - DNA, 2469 bp, Artificial Sequence; identical to SEQ ID NO: 8718
  Description of Artificial Sequence: Synthetic coding sequence

SEQ ID NO: 8741 - DNA, 471 bp, Artificial Sequence
  Description of Artificial Sequence: Synthetic coding sequence
accgcccagagcctggtgctgatcgacgagttcggcaagggcaccaacaccgtggacggcctggccctgctggccgccgtgctgagacactggctggccagaggccccacctgcccccacatcttcgtggccaccaacttcctgagcctggtgcagctgcagctgctgccccagggccccctggtgcagtacctggtgtgcgagggcgtggccaaggccagccacgccagccacaccgccgcccaggccggcctgcccgacaagctggtggccagaggcaaggaggtgagcgacctgatcagaagcggcaagcccatcaagcccgtgaaggacctgctgaagaagaaccagatggagaactgccagaccctggtggacaagttcatgaagctggacctggaggaccccaacctggacctgaacgtgttcatgagccaggaggtgctgcccgccgccaccagcatcctgtag

SEQ ID NO: 8742 - DNA, 2505 bp, Artificial Sequence; identical to SEQ ID NO: 8720
  Description of Artificial Sequence: Synthetic coding sequence

SEQ ID NO: 8743 - DNA, 2505 bp, Artificial Sequence; identical to SEQ ID NO: 8720
  Description of Artificial Sequence: Synthetic coding sequence

SEQ ID NO: 8744 - DNA, 471 bp, Artificial Sequence; identical to SEQ ID NO: 8741
  Description of Artificial Sequence: Synthetic coding sequence

SEQ ID NO: 8745 - DNA, 2466 bp, Artificial Sequence; identical to SEQ ID NO: 8735
  Description of Artificial Sequence: Synthetic coding sequence

SEQ ID NO: 8746 - DNA, 2556 bp, Artificial Sequence; identical to SEQ ID NO: 8719
  Description of Artificial Sequence: Synthetic coding sequence

SEQ ID NO: 8747 - DNA, 1602 bp, Artificial Sequence; identical to SEQ ID NO: 8731
  Description of Artificial Sequence: Synthetic coding sequence

SEQ ID NO: 8748 - DNA, 765 bp, Artificial Sequence
  Description of Artificial Sequence: Synthetic coding sequence
atggccagcctgggcgccaaccccagaagaaccccccagggccccagacccggcgccgccagcagcggcttccccagccccgcccccgtgcccggccccagagaggccgaggaggaggaggtggaggaggaggaggagctggccgagatccacctgtgcgtgctgtggaacagcggctacctgggcatcgcctactacgacaccagcgacagcaccatccacttcatgcccgacgcccccgaccacgagagcctgaagctgctgcagagagtgctggacgagatcaacccccagagcgtggtgaccagcgccaagcaggacgagaacatgaccagattcctgggcaagctggccagccaggagcacagagagcccaagagacccgagatcatcttcctgcccagcgtggacttcggcctggagatcagcaagcagagactgctgagcggcaactacagcttcatccccgacgccatgaccgccaccgagaagatcctgttcctgagcagcatcatccccttcgactgcctgctgaccgtgagagccctgggcggcctgctgaagttcctgggcagaagaagaatcggcgtggagctggaggactacaacgtgagcgtgcccatcctgggcttcaagaagttcatgctgacccacctggtgaacatcgaccaggacacctacagactggagtgcaacggcgccatcagcgcccagtgcaacctgtgcctgctgggcagcagcgacagccccgccagcgccagctag

SEQ ID NO: 8749 - DNA, 816 bp, Artificial Sequence; identical to SEQ ID NO: 8722
  Description of Artificial Sequence: Synthetic coding sequence

SEQ ID NO: 8750 - DNA, 1602 bp, Artificial Sequence; identical to SEQ ID NO: 8731
  Description of Artificial Sequence: Synthetic coding sequence

SEQ ID NO: 8751 - DNA, 816 bp, Artificial Sequence; identical to SEQ ID NO: 8722
  Description of Artificial Sequence: Synthetic coding sequence

SEQ ID NO: 8752 - DNA, 765 bp, Artificial Sequence; identical to SEQ ID NO: 8748
  Description of Artificial Sequence: Synthetic coding sequence

SEQ ID NO: 8753 - DNA, 765 bp, Artificial Sequence; identical to SEQ ID NO: 8748
  Description of Artificial Sequence: Synthetic coding sequence

SEQ ID NO: 8754 - DNA, 1602 bp, Artificial Sequence; identical to SEQ ID NO: 8731
  Description of Artificial Sequence: Synthetic coding sequence

SEQ ID NO: 8755 - DNA, 2556 bp, Artificial Sequence; identical to SEQ ID NO: 8719
  Description of Artificial Sequence: Synthetic coding sequence

SEQ ID NO: 8756 - DNA, 1200 bp, Artificial Sequence
  Description of Artificial Sequence: Synthetic coding sequence
atggccagcgccgccgccggcgaggccgaggagaccaccagactgagaaagcccagattcagcttcgaggagaaccagatcctgatcagagaggtgagagcccactacccccagctgtacggcgcccagagcagaagagtgagcgtggccgagagaagaagagtgtgggacggcatcgccgccaagatcaacggcatcaccagctggaagagaaccggccaggaggtgcagaagagatggaacgacttcaagagaagaaccaaggagaagctggccagagtgccccacagcacccagggcgccggccccgccgccgaggacgccttcagcgccgaggaggagaccatcttcgccatcctgggccccggcgtggccgcccccggcgccggcgccggcgccgaggagccccccgccgcccccagcagccagccccccccccccagcgcctgcccccagagatacgtgctgagcgaggacagaagagaggacagaagagccgacaccagcgcccacagcaaggccggcagcagcagccccgagccctgggccagacccagctgcaccccccaggagggcggctgccccagacccaaggagagagagagccccccccccagcgccctgcagcccgtgcagctgcccagactggccctgagcccccccccccccgccccccccctgcccccccccccccccctggcccaggtggcccccagcccccccagccccccccccccccccagacccccccccaccctgagcgccagcgaccccagcctggacttcctgagagcccagcaggagaccgccaacgccatcagagagctggccggcaccctgagacagggcctggccaagctgagcgaggccctgagcgccctgctgcccctgctgcccggcacccccgtggacagcctgcccccccccctgccccccccccccccccccccccccccccccagacccgtgctgcccccccccgcccccaaggtggagatcacccccgagcccgtgagcgtggtggccgccgtggtggacggcgccgtggtggccgccagaggcgtgatcatcgcccccagaagcgaggagggcgcccccagacccccccccgcccccctgcccccccacgacagccccccccacaagagaagaaagggcttccccaccagaaagagaagaggcagatggaagagcccctag

SEQ ID NO: 8757 - DNA, 708 bp, Artificial Sequence
  Description of Artificial Sequence: Synthetic coding sequence
atgagaacccaggtgtacgagggcctgtgcaagaactacttcagcctggccgtgctgcagagagacagaatcaagctgctgttcttcgacatcctggtgttcctgagcgtgttcctgctgttcctgctgttcctggtggacatcatggccaacaacaccaccagcctgggcagcccctggcccgagaacttctgggaggacctgatcatgagcttcaccgtgagcatggccatcggcctggtgctgggcggcttcatctgggccgtgttcatctgcctgagcagaagaagaagagccagcgcccccatcagccagtggagcagcagcagaagaagcagaagcagctacacccacggcctgaacagaaccggcttctacagacacagcggctgcgagagaagaagcaacctgagcctggccagcctgaccttccagagacaggccagcctggagcaggccaacagcttccccagaaagagcagcttcagagccagcaccttccaccccttcctgcagtgcccccccctgcccgtggagaccgagagccagctggtgaccctgcccagcagcaacatcagccccaccatcagcaccagccacagcctgagcagacccgactactggagcagcaacagcctgagagtgggcctgagcaccccccccccccccgcctacgagagcatcatcaaggccttccccgacagctag

SEQ ID NO: 8758 - DNA, 651 bp, Artificial Sequence
  Description of Artificial Sequence: Synthetic coding sequence
tgaagagacagaatcaagctgctgttcttcgacatcctggtgttcctgagcgtgttcctgctgttcctgctgttcctggtggacatcatggccaacaacaccaccagcctgggcagcccctggcccgagaacttctgggaggacctgatcatgagcttcaccgtgagcatggccatcggcctggtgctgggcggcttcatctgggccgtgttcatctgcctgagcagaagaagaagagccagcgcccccatcagccagtggagcagcagcagaagaagcagaagcagctacacccacggcctgaacagaaccggcttctacagacacagcggctgcgagagaagaagcaacctgagcctggccagcctgaccttccagagacaggccagcctggagcaggccaacagcttccccagaaagagcagcttcagagccagcaccttccaccccttcctgcagtgcccccccctgcccgtggagaccgagagccagctggtgaccctgcccagcagcaacatcagccccaccatcagcaccagccacagcctgagcagacccgactactggagcagcaacagcctgagagtgggcctgagcaccccccccccccccgcctacgagagcatcatcaaggccttccccgacagctag

SEQ ID NO: 8759 - DNA, 1833 bp, Artificial Sequence
  Description of Artificial Sequence: Synthetic coding sequence
atgcagtacagccaccactgcgagcacctgctggagagactgaacaagcagagagaggccggcttcctgtgcgactgcaccatcgtgatcggcgagttccagttcaaggcccacagaaacgtgctggccagcttcagcgagtacttcggcgccatctacagaagcaccagcgagaacaacgtgttcctggaccagagccaggtgaaggccgacggcttccagaagctgctggagttcatctacaccggcaccctgaacctggacagctggaacgtgaaggagatccaccaggccgccgactacctgaaggtggaggaggtggtgaccaagtgcaagatcaagatggaggacttcgccttcatcgccaaccccagcagcaccgagatcagcagcatcaccggcaacatcgagctgaaccagcagacctgcctgctgaccctgagagactacaacaacagagagaagagcgaggtgagcaccgacctgatccaggccaaccccaagcagggcgccctggccaagaagagcagccagaccaagaagaagaagaaggccttcaacagccccaagaccggccagaacaagaccgtgcagtaccccagcgacatcctggagaacgccagcgtggagctgttcctggacgccaacaagctgcccacccccgtggtggagcaggtggcccagatcaacgacaacagcgagctggagctgaccagcgtggtggagaacaccttccccgcccaggacatcgtgcacaccgtgaccgtgaagagaaagagaggcaagagccagcccaactgcgccctgaaggagcacagcatgagcaacatcgccagcgtgaagagcccctacgaggccgagaacagcggcgaggagctggaccagagatacagcaaggccaagcccatgtgcaacacctgcggcaaggtgttcagcgaggccagcagcctgagaagacacatgagaatccacaagggcgtgaagccctacgtgtgccacctgtgcggcaaggccttcacccagtgcaaccagctgaagacccacgtgagaacccacaccggcgagaagccctacaagtgcgagctgtgcgacaagggcttcgcccagaagtgccagctggtgttccacagcagaatgcaccacggcgaggagaagccctacaagtgcgacgtgtgcaacctgcagttcgccaccagcagcaacctgaagatccacgccagaaagcacagcggcgagaagccctacgtgtgcgacagatgcggccagagattcgcccaggccagcaccctgacctaccacgtgagaagacacaccggcgagaagccctacgtgtgcgacacctgcggcaaggccttcgccgtgagcagcagcctgatcacccacagcagaaagcacaccggcgagaagccctacatctgcggcatctgcggcaagagcttcatcagcagcggcgagctgaacaagcacttcagaagccacaccggcgagagacccttcatctgcgagctgtgcggcaacagctacaccgacatcaagaacctgaagaagcacaagaccaaggtgcacagcggcgccgacaagaccctggacagcagcgccgaggaccacaccctgagcgagcaggacagcatccagaagagccccctgagcgagaccatggacgtgaagcccagcgacatgaccctgcccctggccctgcccctgggcaccgaggaccaccacatgctgctgcccgtgaccgacacccagagccccaccagcgacaccctgctgagaagcaccgtgaacggctacagcgagccccagctgatcttcctgcagcagctgtactag

SEQ ID NO: 8760 - DNA, 1833 bp, Artificial Sequence; identical to SEQ ID NO: 8759
  Description of Artificial Sequence: Synthetic coding sequence

SEQ ID NO: 8761 - DNA, 1503 bp, Artificial Sequence
  Description of Artificial Sequence: Synthetic coding sequence
atgcagtacagccaccactgcgagcacctgctggagagactgaacaagcagagagaggccggcttcctgtgcgactgcaccatcgtgatcggcgagttccagttcaaggcccacagaaacgtgctggccagcttcagcgagtacttcggcgccatctacagaagcaccagcgagaacaacgtgttcctggaccagagccaggtgaaggccgacggcttccagaagctgctggagttcatctacaccggcaccctgaacctggacagctggaacgtgaaggagatccaccaggccgccgactacctgaaggtggaggaggtggtgaccaagtgcaagatcaagatggaggacttcgccttcatcgccaaccccagcagcaccgagatcagcagcatcaccggcaacatcgagctgaaccagcagacctgcctgctgaccctgagagactacaacaacagagagaagagcgaggtgagcaccgacctgatccaggccaaccccaagcagggcgccctggccaagaagagcagccagaccaagaagaagaagaaggccttcaacagccccaagaccggccagaacaagaccgtgcagtaccccagcgacatcctggagaacgccagcgtggagctgttcctggacgccaacaagctgcccacccccgtggtggagcaggtggcccagatcaacgacaacagcgagctggagctgaccagcgtggtggagaacaccttccccgcccaggacatcgtgcacaccgtgaccgtgaagagaaagagaggcaagagccagcccaactgcgccctgaaggagcacagcatgagcaacatcgccagcgtgaagagcccctacgaggccgagaacagcggcgaggagctggaccagagatacagcaaggccaagcccatgtgcaacacctgcggcaaggtgttcagcgaggccagcagcctgagaagacacatgagaatccacaagggcgtgaagccctacgtgtgccacctgtgcggcaaggccttcacccagtgcaaccagctgaagacccacgtgagaacccacaccggcgagaagccctacaagtgcgagctgtgcgacaagggcttcgcccagaagtgccagctggtgttccacagcagaatgcaccacggcgaggagaagccctacaagtgcgacgtgtgcaacctgcagttcgccaccagcagcaacctgaagatccacgccagaaagcacagcggcgagaagccctacgtgtgcgacagatgcggccagagattcgcccaggccagcaccctgacctaccacgtgagaagacacaccggcgagaagccctacgtgtgcgacacctgcggcaaggccttcgccgtgagcagcagcctgatcacccacagcagaaagcacaccggcgagaagccctacatctgcggcatctgcggcaagagcttcatcagcagcggcgagctgaacaagcacttcagaagccacaccgtggtgtggagcatgaactag

SEQ ID NO: 8762 - DNA, 1746 bp, Artificial Sequence
  Description of Artificial Sequence: Synthetic coding sequence
atgcagtacagccaccactgcgagcacctgctggagagactgaacaagcagagagaggccggcttcctgtgcgactgcaccatcgtgatcggcgagttccagttcaaggcccacagaaacgtgctggccagcttcagcgagtacttcggcgccatctacagaagcaccagcgagaacaacgtgttcctggaccagagccaggtgaaggccgacggcttccagaagctgctggagttcatctacaccggcaccctgaacctggacagctggaacgtgaaggagatccaccaggccgccgactacctgaaggtggaggaggtggtgaccaagtgcaagatcaagatggaggacttcgccttcatcgccaaccccagcagcaccgagatcagcagcatcaccggcaacatcgagctgaaccagcagacctgcctgctgaccctgagagactacaacaacagagagaagagcgaggtgagcaccgacctgatccaggccaaccccaagcagggcgccctggccaagaagagcagccagaccaagaagaagaagaaggccttcaacagccccaagaccggccagaacaagaccgtgcagtaccccagcgacatcctggagaacgccagcgtggagctgttcctggacgccaacaagctgcccacccccgtggtggagcaggtggcccagatcaacgacaacagcgagctggagctgaccagcgtggtggagaacaccttccccgcccaggacatcgtgcacaccgtgaccgtgaagagaaagagaggcaagagccagcccaactgcgccctgaaggagcacagcatgagcaacatcgccagcgtgaagagcccctacgaggccgagaacagcggcgaggagctggaccagagatacagcaaggccaagcccatgtgcaacacctgcggcaaggtgttcagcgaggccagcagcctgagaagacacatgagaatccacaagggcgtgaagccctacgtgtgccacctgtgcggcaaggccttcacccagtgcaaccagctgaagacccacgtgagaacccacaccggcgagaagccctacaagtgcgagctgtgcgacaagggcttcgcccagaagtgccagctggtgttccacagcagaatgcaccacggcgaggagaagccctacaagtgcgacgtgtgcaacctgcagttcgccaccagcagcaacctgaagatccacgccagaaagcacagcggcgagaagccctacgtgtgcgacagatgcggccagagattcgcccaggccagcaccctgacctaccacgtgagaagacacaccggcgagaagccctacgtgtgcgacacctgcggcaaggccttcgccgtgagcagcagcctgatcacccacagcagaaagcacaccggcgagaagccctacatctgcggcatctgcggcaagagcttcatcagcagcggcgagctgaacaagcacttcagaagccacaccggcgccgacaagaccctggacagcagcgccgaggaccacaccctgagcgagcaggacagcatccagaagagccccctgagcgagaccatggacgtgaagcccagcgacatgaccctgcccctggccctgcccctgggcaccgaggaccaccacatgctgctgcccgtgaccgacacccagagccccaccagcgacaccctgctgagaagcaccgtgaacggctacagcgagccccagctgatcttcctgcagcagctgtactag

SEQ ID NO: 8763 - DNA, 1167 bp, Artificial Sequence
  Description of Artificial Sequence: Synthetic coding sequence
atgctgaaggtgaagagactggaggagttcaacacctgctacaacagcaaccagctggagaagatggccttcttccagtgcagagaggaggtggagaaggtgaagtgcttcctggagaagaacagcggcgaccaggacagcagaagcggccacaacgaggccaaggaggtgtggagcaacgccgacctgaccgagagaatgcccgtgaagagcaagagaaccagcgccctggccgtggacatccccgccccccccgcccccttcgaccacagaatcgtgaccgccaagcagggcgccgtgaacagcttctacaccgtgagcaagaccgagatcctgggcggcggcagattcggccaggtgcacaagtgcgaggagaccgccaccggcctgaagctggccgccaagatcatcaagaccagaggcatgaaggacaaggaggaggtgaagaacgagatcagcgtgatgaaccagctggaccacgccaacctgatccagctgtacgacgccttcgagagcaagaacgacatcgtgctggtgatggagtacgtggacggcggcgagctgttcgacagaatcatcgacgagagctacaacctgaccgagctggacaccatcctgttcatgaagcagatctgcgagggcatcagacacatgcaccagatgtacatcctgcacctggacctgaagaccaccagcttccagtgcagcagattcctgatcgacaccagcatcctgcccctgtgcctgctgaactgcagatacaagcccagagagaagctgaaggtgaacttcggcacccccgagttcctggcccccgaggtggtgaactacgacttcgtgagcttccccaccgacatgtggagcgtgggcgtgatcgcctacatgctgctgagcggcctgagccccttcctgggcgacaacgacgccgagaccctgaacaacatcctggcctgcagatgggacctggaggacgaggagttccaggacatcagcgaggaggccaaggagttcatcagcaagctgctgatcaaggagaagagctggagaatcagcgccagcgaggccctgaagcacccctggctgagcgaccacaagctgcacagcagactgaacgcccagaagaagaagaacagaggcagcgacgcccaggacttcgtgaccaagtag

SEQ ID NO: 8764 - DNA, 1167 bp, Artificial Sequence
  Description of Artificial Sequence: Synthetic coding sequence
atgctgaaggtgaagagactggaggagttcaacacctgctacaacagcaaccagctggagaagatggccttcttccagtgcagagaggaggtggagaaggtgaagtgcttcctggagaagaacagcggcgaccaggacagcagaagcggccacaacgaggccaaggaggtgtggagcaacgccgacctgaccgagagaatgcccgtgaagagcaagagaaccagcgccctggccgtggacatccccgccccccccgcccccttcgaccacagaatcgtgaccgccaagcagggcgccgtgaacagcttctacaccgtgagcaagaccgagatcctgggcggcggcagattcggccaggtgcacaagtgcgaggagaccgccaccggcctgaagctggccgccaagatcatcaagaccagaggcatgaaggacaaggaggaggtgaagaacgagatcagcgtgatgaaccagctggaccacgccaacctgatccagctgtacgacgccttcgagagcaagaacgacatcgtgctggtgatggagtacgtggacggcggcgagctgttcgacagaatcatcgacgagagctacaacctgaccgagctggacaccatcctgttcatgaagcagatctgcgagggcatcagacacatgcaccagatgtacatcctgcacctggacctgaagcccgagaacatcctgtgcgtgaacagagacgccaagcagatcaagatcatcgacttcggcctggccagaagatacaagcccagagagaagctgaaggtgaacttcggcacccccgagttcctggcccccgaggtggtgaactacgacttcgtgagcttccccaccgacatgtggagcgtgggcgtgatcgcctacatgctgctgagcggcctgagccccttcctgggcgacaacgacgccgagaccctgaacaacatcctggcctgcagatgggacctggaggacgaggagttccaggacatcagcgaggaggccaaggagttcatcagcaagctgctgatcaaggagaagagctggagaatcagcgccagcgaggccctgaagcacccctggctgagcgaccacaagctgcacagcagactgaacgcccagaagaagaagaacagaggcagcgacgcccaggacttcgtgaccaagtag

SEQ ID NO: 8765 - DNA, 576 bp, Artificial Sequence
  Description of Artificial Sequence: Synthetic coding sequence
atggccatgcacaacaaggccgcccccccccagatccccgacaccagaagagagctggccgagctggtgaagagaaagcaggagctggccgagaccctggccaacctggagagacagatctacgccttcgagggcagctacctggaggacacccagatgtacggcaacatcatcagaggctgggacagatacctgaccaaccagaagaacagcaacagcaagaacgacagaagaaacagaaagttcaaggaggccgagagactgttcagcaagagcagcgtgaccagcgccgccgccgtgagcgccctggccggcgtgcaggaccagctgatcgagaagagagagcccggcagcggcaccgagagcgacaccagccccgacttccacaaccaggagaacgagcccagccaggaggaccccgaggacctggacggcagcgtgcagggcgtgaagccccagaaggccgccagcagcaccagcagcggcagccaccacagcagccacaagaagagaaagaacaagaacagacacagaatcgacctgaagctgaacaagaagcccagagccgactactag

SEQ ID NO: 8766 - DNA, 579 bp, Artificial Sequence
  Description of Artificial Sequence: Synthetic coding sequence
atggccatgcacaacaaggccgcccccccccagatccccgacaccagaagagagctggccgagctggtgaagagaaagcaggagctggccgagaccctggccaacctggagagacagatctacgccttcgagggcagctacctggaggacacccagatgtacggcaacatcatcagaggctgggacagatacctgaccaaccagaagaacagcaacagcaagaacgacagaagaaacagaaagttcaaggaggccgagagactgttcagcaagagcagcgtgaccagcgccgccgccgtgagcgccctggccggcgtgcaggaccagctgatcgagaagagagagcccggcagcggcaccgagagcgacaccagccccgacttccacaaccaggagaacgagcccagccaggaggaccccgaggacctggacggcagcgtgcagggcgtgaagccccagaaggccgccagcagcaccagcagcggcagccaccacagcagccacaagaagagaaagaacaagaacagacacagaatgaacgtgagccccaagaccggctggcaccagctgcacctgtag

SEQ ID NO: 8767 - DNA, 510 bp, Artificial Sequence
  Description of Artificial Sequence: Synthetic coding sequence
atgagcctgttcttcatcagccaggagaccctggccaacctggagagacagatctacgccttcgagggcagctacctggaggacacccagatgtacggcaacatcatcagaggctgggacagatacctgaccaaccagaagaacagcaacagcaagaacgacagaagaaacagaaagttcaaggaggccgagagactgttcagcaagagcagcgtgaccagcgccgccgccgtgagcgccctggccggcgtgcaggaccagctgatcgagaagagagagcccggcagcggcaccgagagcgacaccagccccgacttccacaaccaggagaacgagcccagccaggaggaccccgaggacctggacggcagcgtgcagggcgtgaagccccagaaggccgccagcagcaccagcagcggcagccaccacagcagccacaagaagagaaagaacaagaacagacacagaatcgacctgaagctgaacaagaagcccagagccgactactag

SEQ ID NO: 8768 - DNA, 606 bp, Artificial Sequence
  Description of Artificial Sequence: Synthetic coding sequence
atggccatgcacaacaaggccgcccccccccagatccccgacaccagaagagagctggccgagctggtgaagagaaagcaggagctggccgagaccctggccaacctggagagacagatctacgccttcgagggcagctacctggaggacacccagatgtacggcaacatcatcagaggctgggacagatacctgaccaaccagaagaacagcaacagcaagaacgacagaagaaacagaaagttcaaggaggccgagagactgttcagcaagagcagcgtgaccagcgccgccgccgtgagcgccctggccggcgtgcaggaccagctgatcgagaagagagagcccggcagcggcaccgagagcgacaccagccccgacttccacaaccaggagaacgagcccagccaggaggaccccgaggacctggacggcagcgtgcagggcgtgaagccccagaaggccgccagcagcaccagcagcggcagccaccacagcagccacaagaagagaaagaacaagaacagacacagccccagcggcatgttcgactacgacttcgagatcgacctgaagctgaacaagaagcccagagccgactactag

SEQ ID NO: 8769 - DNA, 576 bp, Artificial Sequence
  Description of Artificial Sequence: Synthetic coding sequence
atggccatgcacaacaaggccgcccccccccagatccccgacaccagaagagagctggccgagctggtgaagagaaagcaggagctggccgagaccctggccaacctggagagacagatctacgccttcgagggcagctacctggaggacacccagatgtacggcaacatcatcagaggctgggacagatacctgaccaaccagaagaacagcaacagcaagaacgacagaagaaacagaaagttcaaggaggccgagagactgttcagcaagagcagcgtgaccagcgccgccgccgtgagcgccctggccggcgtgcaggaccagctgatcgagaagagagagcccggcagcggcaccgagagcgacaccagccccgacttccacaaccaggagaacgagcccagccaggaggaccccgaggacctggacggcagcgtgcagggcgtgaagccccagaaggccgccagcagcaccagcagcggcagccaccacagcagccacaagaagagaaagaacaagaacagacacagccccagcggcatgttcgactacgacttcgagtacgtgtactag

SEQ ID NO: 8770 - DNA, 291 bp, Artificial Sequence
  Description of Artificial Sequence: Synthetic coding sequence
atgaccagcgccctggagaactacatcaacagaaccgtggccgtgatcaccagcgacggcagaatgatcgtgggcaccctgaagggcttcgaccagaccatcaacctgatcctggacgagagccacgagagagtgttcagcagcagccagggcgtggagcaggtggtgctgggcctgtacatcgtgagaggcgacaacgtggccgtgatcggcgagatcgacgaggagaccgacagcgccctggacctgggcaacatcagagccgagcccctgaacagcgtggcccactag

SEQ ID NO: 8771 - DNA, 1764 bp, Artificial Sequence
  Description of Artificial Sequence: Synthetic coding sequence
atgagccagatgctgcacatcgagatccccaacttcggcaacaccgtgctgggctgcctgaacgagcagagactgctgggcctgtactgcgacgtgagcatcgtggtgaagggccaggccttcaaggcccacagagccgtgctggccgccagcagcctgtacttcagagacctgttcagcggcaacagcaagagcgccttcgagctgcccggcagcgtgccccccgcctgcttccagcagatcctgagcttctgctacaccggcagactgaccatgaccgccagcgagcagctggtggtgatgtacaccgccggcttcctgcagatccagcacatcgtggagagaggcaccgacctgatgttcaaggtgagcagcccccactgcgacagccagaccgccgtgatcgaggacgccggcagcgagccccagagcccctgcaaccagctgcagcccgccgccgccgccgccgccccctacgtggtgagccccagcgtgcccatccccctgctgaccagagtgaagcacgaggccatggagctgccccccgccggccccggcctggcccccaagagacccctggagaccggccccagagacggcgtggccgtggccgccggcgccgccgtggccgccggcaccgcccccctgaagctgcccagagtgagctactacggcgtgcccagcctggccaccctgatccccggcatccagcagatgccctacccccagggcgagagaaccagccccggcgccagcagcctgcccaccaccgacagccccaccagctaccacaacgaggaggacgaggaggacgacgaggcctacgacaccatggtggaggagcagtacggccagatgtacatcaaggccagcggcagctacgccgtgcaggagaagcccgagcccgtgcccctggagagcagaagctgcgtgctgatcagaagagacctggtggccctgcccgccagcctgatcagccagatcggctacagatgccaccccaagctgtacagcgagggcgaccccggcgagaagctggagctggtggccggcagcggcgtgtacatcaccagaggccagctgatgaactgccacctgtgcgccggcgtgaagcacaaggtgctgctgagaagactgctggccaccttcttcgacagaaacaccctggccaacagctgcggcaccggcatcagaagcagcaccagcgaccccagcagaaagcccctggacagcagagtgctgaacgccgtgaagctgtactgccagaacttcgcccccagcttcaaggagagcgagatgaacgtgatcgccgccgacatgtgcaccaacgccagaagagtgagaaagagatggctgcccaagatcaagagcatgctgcccgagggcgtggagatgtacagaaccgtgatgggcagcgccgccgccagcgtgcccctggaccccgagttcccccccgccgccgcccaggtgttcgagcagagaatctacgccgagagaagaggcgacgccgccaccatcgtggccctgagaaccgacgccgtgaacgtggacctgagcgccgccgccaaccccgccttcgacgccggcgaggaggtggacggcgccggcagcgtgatccaggaggtggccgcccccgagcccctgcccgccgacggccagagccccccccagcccttcgagcagggcggcggcggccccagcagaccccagacccccgccgccgccgccagaagacccgagggcacctacgccggcaccctgtag

SEQ ID NO: 8772 - DNA, 1764 bp, Artificial Sequence; identical to SEQ ID NO: 8771
  Description of Artificial Sequence: Synthetic coding sequence

SEQ ID NO: 8773 - DNA, 3078 bp, Artificial Sequence
  Description of Artificial Sequence: Synthetic coding sequence
atgcacagaaagaaggtggacaacagaatcagaatcctgatcgagaacggcgtggccgagagacagagaagcctgttcgtggtggtgggcgacagaggcaaggaccaggtggtgatcctgcaccacatgctgagcaaggccaccgtgaaggccagacccagcgtgctgtggtgctacaagaaggagctgggcttcagcagccacagaaagaagagaatgagacagctgcagaagaagatcaagaacggcaccctgaacatcaagcaggacgaccccttcgagctgttcatcgccgccaccaacatcagatactgctactacaacgagacccacaagatcctgggcaacaccttcggcatgtgcgtgctgcaggacttcgaggccctgacccccaacctgctggccagaaccgtggagaccgtggagggcggcggcctggtggtgatcctgctgagaaccatgaacagcctgaagcagctgtacaccgtgaccatggacgtgcacagcagatacagaaccgaggcccaccaggacgtggtgggcagattcaacgagagattcatcctgagcctggccagctgcaagaagtgcctggtgatcgacgaccagctgaacatcctgcccatcagcagccacgtggccaccatggaggccctgcccccccagacccccgacgagagcctgggccccagcgacctggagctgagagagctgaaggagagcctgcaggacacccagcccgtgggcgtgctggtggactgctgcaagaccctggaccaggccaaggccgtgctgaagttcatcgagggcatcagcgagaagaccctgagaagcaccgtggccctgaccgccgccagaggcagaggcaagagcgccgccctgggcctggccatcgccggcgccgtggccttcggctacagcaacatcttcgtgaccagccccagccccgacaacctgcacaccctgttcgagttcgtgttcaagggcttcgacgccctgcagtaccaggagcacctggactacgagatcatccagagcctgaaccccgagttcaacaaggccgtgatcagagtgaacgtgttcagagagcacagacagaccatccagtacatccaccccgccgacgccgtgaagctgggccaggccgagctggtggtgatcgacgaggccgccgccatccccctgcccctggtgaagagcctgctgggcccctacctggtgttcatggccagcaccatcaacggctacgagggcaccggcagaagcctgagcctgaagctgatccagcagctgagacagcagagcgcccagagccaggtgagcaccaccgccgagaacaagaccaccaccaccgccagactggccagcgccagaaccctgtacgaggtgagcctgcaggagagcatcagatacgcccccggcgacgccgtggagaagtggctgaacgacctgctgtgcctggactgcctgaacatcaccagaatcgtgagcggctgccccctgcccgaggcctgcgagctgtactacgtgaacagagacaccctgttctgctaccacaaggccagcgaggtgttcctgcagagactgatggccctgtacgtggccagccactacaagaacagccccaacgacctgcagatgctgagcgacgcccccgcccaccacctgttctgcctgctgccccccgtgccccccacccagaacgccctgcccgaggtgctggccgtgatccaggtgtgcctggagggcgagatcagcagacagagcatcctgaacagcctgagcagaggcaagaaggccagcggcgacctgatcccctggaccgtgagcgagcagttccaggaccccgacttcggcggcctgagcggcggcagagtggtgagaatcgccgtgcaccccgactaccagggcatgggctacggcagcagagccctgcagctgctgcagatgtactacgagggcagattcccctgcctggaggagaaggtgctggagaccccccaggagatccacaccgtgagcagcgaggccgtgagcctgctggaggaggtgatcacccccagaaaggacctgccccccctgctgctgaagctgaacgagagacccgccgagagactggactacctgggcgtgagctacggcctgacccccagactgctgaagttctggaagagagccggcttcgtgcccgtgtacctgagacagacccccaacgacctgaccggcgagcacagctgcatcatgctgaagaccctgaccgacgaggacgaggccgaccagggcggctggctggccgccttctggaaggacttcagaagaagattcctggccctgctgagctaccagttcagcaccttcagccccagcctggccctgaacatcatccagaacagaaacatgggcaagcccgcccagcccgccctgagcagagaggagctggaggccctgttcctgccctacgacctgaagagactggagatgtacagcagaaacatggtggactaccacctgatcatggacatgatccccgccatcagcagaatctacttcctgaaccagctgggcgacctggccctgagcgccgcccagagcgccctgctgctgggcatcggcctgcagcacaagagcgtggaccagctggagaaggagatcgagctgcccagcggccagctgatgggcctgttcaacagaatcatcagaaaggtggtgaagctgttcaacgaggtgcaggagaaggccatcgaggagcagatggtggccgccaaggacgtggtgatggagcccaccatgaagaccctgagcgacgacctggacgaggccgccaaggagttccaggagaagcacaagaaggaggtgggcaagctgaagagcatggacctgagcgagtacatcatcagaggcgacgacgaggagtggaacgaggtgctgaacaaggccggccccaacgccagcatcatcagcctgaagagcgacaagaagagaaagctggaggccaagcaggagcccaagcagagcaagaagctgaagaacagagagaccaagaacaagaaggacatgaagctgaagagaaagaagtag

SEQ ID NO: 8774 - DNA, 2862 bp, Artificial Sequence
  Description of Artificial Sequence: Synthetic coding sequence
atgagacagctgcagaagaagatcaagaacggcaccctgaacatcaagcaggacgaccccttcgagctgttcatcgccgccaccaacatcagatactgctactacaacgagacccacaagatcctgggcaacaccttcggcatgtgcgtgctgcaggacttcgaggccctgacccccaacctgctggccagaaccgtggagaccgtggagggcggcggcctggtggtgatcctgctgagaaccatgaacagcctgaagcagctgtacaccgtgaccatggacgtgcacagcagatacagaaccgaggcccaccaggacgtggtgggcagattcaacgagagattcatcctgagcctggccagctgcaagaagtgcctggtgatcgacgaccagctgaacatcctgcccatcagcagccacgtggccaccatggaggccctgcccccccagacccccgacgagagcctgggccccagcgacctggagctgagagagctgaaggagagcctgcaggacacccagcccgtgggcgtgctggtggactgctgcaagaccctggaccaggccaaggccgtgctgaagttcatcgagggcatcagcgagaagaccctgagaagcaccgtggccctgaccgccgccagaggcagaggcaagagcgccgccctgggcctggccatcgccggcgccgtggccttcggctacagcaacatcttcgtgaccagccccagccccgacaacctgcacaccctgttcgagttcgtgttcaagggcttcgacgccctgcagtaccaggagcacctggactacgagatcatccagagcctgaaccccgagttcaacaaggccgtgatcagagtgaacgtgttcagagagcacagacagaccatccagtacatccaccccgccgacgccgtgaagctgggccaggccgagctggtggtgatcgacgaggccgccgccatccccctgcccctggtgaagagcctgctgggcccctacctggtgttcatggccagcaccatcaacggctacgagggcaccggcagaagcctgagcctgaagctgatccagcagctgagacagcagagcgcccagagccaggtgagcaccaccgccgagaacaagaccaccaccaccgccagactggccagcgccagaaccctgtacgaggtgagcctgcaggagagcatcagatacgcccccggcgacgccgtggagaagtggctgaacgacctgctgtgcctggactgcctgaacatcaccagaatcgtgagcggctgccccctgcccgaggcctgcgagctgtactacgtgaacagagacaccctgttctgctaccacaaggccagcgaggtgttcctgcagagactgatggccctgtacgtggccagccactacaagaacagccccaacgacctgcagatgctgagcgacgcccccgcccaccacctgttctgcctgctgccccccgtgccccccacccagaacgccctgcccgaggtgctggccgtgatccaggtgtgcctggagggcgagatcagcagacagagcatcctgaacagcctgagcagaggcaagaaggccagcggcgacctgatcccctggaccgtgagcgagcagttccaggaccccgacttcggcggcctgagcggcggcagagtggtgagaatcgccgtgcaccccgactaccagggcatgggctacggcagcagagccctgcagctgctgcagatgtactacgagggcagattcccctgcctggaggagaaggtgctggagaccccccaggagatccacaccgtgagcagcgaggccgtgagcctgctggaggaggtgatcacccccagaaaggacctgccccccctgctgctgaagctgaacgagagacccgccgagagactggactacctgggcgtgagctacggcctgacccccagactgctgaagttctggaagagagccggcttcgtgcccgtgtacctgagacagacccccaacgacctgaccggcgagcacagctgcatcatgctgaagaccctgaccgacgaggacgaggccgaccagggcggctggctggccgccttctggaaggacttcagaagaagattcctggccctgctgagctaccagttcagcaccttcagccccagcctggccctgaacatcatccagaacagaaacatgggcaagcccgcccagcccgccctgagcagagaggagctggaggccctgttcctgccctacgacctgaagagactggagatgtacagcagaaacatggtggactaccacctgatcatggacatgatccccgccatcagcagaatctacttcctgaaccagctgggcgacctggccctgagcgccgcccagagcgccctgctgctgggcatcggcctgcagcacaagagcgtggaccagctggagaaggagatcgagctgcccagcggccagctgatgggcctgttcaacagaatcatcagaaaggtggtgaagctgttcaacgaggtgcaggagaaggccatcgaggagcagatggtggccgccaaggacgtggtgatggagcccaccatgaagaccctgagcgacgacctggacgaggccgccaaggagttccaggagaagcacaagaaggaggtgggcaagctgaagagcatggacctgagcgagtacatcatcagaggcgacgacgaggagtggaacgaggtgctgaacaaggccggccccaacgccagcatcatcagcctgaagagcgacaagaagagaaagctggaggccaagcaggagcccaagcagagcaagaagctgaagaacagagagaccaagaacaagaaggacatgaagctgaagagaaagaagtag

SEQ ID NO: 8775 - DNA, 711 bp, Artificial Sequence
  Description of Artificial Sequence: Synthetic coding sequence
atgaccagcgagaagggccccagcaccggcgaccccaccctgagaagaagaatcgagccctgggagttcgacgtgttctacgaccccagagagctgagaaaggaggcctgcctgctgtacgagatcaagtggggcatgagcagaaagatctggagaagcagcggcaagaacaccaccaaccacgtggaggtgaacttcatcaagaagttcaccagcgagagagacttccaccccagcatgagctgcagcatcacctggttcctgagctggagcccctgctgggagtgcagccaggccatcagagagttcctgagcagacaccccggcgtgaccctggtgatctacgtggccagactgttctggcacatggaccagcagaacagacagggcctgagagacctggtgaacagcggcgtgaccatccagatcatgagagccagcgagtactaccactgctggagaaacttcgtgaactacccccccggcgacgaggcccactggccccagtacccccccctgtggatgatgctgtacgccctggagctgcactgcatcatcctgagcctgcccccctgcctgaagatcagcagaagatggcagaaccacctgaccttcttcagactgcacctgcagaactgccactaccagaccatccccccccacatcctgctggccaccggcctgatccaccccagcgtggcctggagatag

SEQ ID NO: 8776 - DNA, 870 bp, Artificial Sequence
  Description of Artificial Sequence: Synthetic coding sequence
atgagcgtggaccccgcctgcccccagagcctgccctgcttcgaggccagcgactgcaaggagagcagccccatgcccgtgatctgcggccccgaggagaactaccccagcctgcagatgagcagcgccgagatgccccacaccgagaccgtgagccccctgcccagcagcatggacctgctgatccaggacagccccgacagcagcaccagccccaagggcaagcagcccaccagcgccgagaagagcgtggccaagaaggaggacaaggtgcccgtgaagaagcagaagaccagaaccgtgttcagcagcacccagctgtgcgtgctgaacgacagattccagagacagaagtacctgagcctgcagcagatgcaggagctgagcaacatcctgaacctgagctacaagcaggtgaagacctggttccagaaccagagaatgaagagcaagagatggcagaagaacaactggcccaagaacagcaacggcgtgacccagggctgcctggtgaaccccaccggcaacctgcccatgtggagcaaccagacctggaacaacagcacctggagcaaccagacccagaacatccagagctggagcaaccacagctggaacacccagacctggtgcacccagagctggaacaaccaggcctggaacagccccttctacaactgcggcgaggagagcctgcagagctgcatgcagttccagcccaacagccccgccagcgacctggaggccgccctggaggccgccggcgagggcctgaacgtgatccagcagaccaccagatacttcagcaccccccagaccatggacctgttcctgaactacagcatgaacatgcagcccgaggacgtgtag

SEQ ID NO: 8777 - DNA, 567 bp, Artificial Sequence
  Description of Artificial Sequence: Synthetic coding sequence
atgcacagagccagatggctgacccccgtgatccccgccctgtgggaggccgaggccggcagaagcagaggccaggagatcgagaccatcctggccaacaagaagcagagcgccatgccctgggaccaggaccccgagcagagcaccggcaactacagcgaggacgagcagaacggcaagcagaagtggagagaggagggcgaggccggcagaaagagagagagagagaaggaggagaagaacgagaaggagctgcaggacgagcaggagaacaagagaaagagagagaacgagaagcagaagcagtaccccgagaagagactggtgagcaagagcctgatgcacaccctgtgggccaagttcaagctgaacagatgccccaccatccaggagagcctgagcctgagcttcgagttcgacatgacccacaagcagatcagccagtggttctgcaagaccagaaagaagtacaacaaggagatgagcaagagaaagcacaagaagaagcacatgagatggagaagcctgtgctgccagggctggagcagaacccccgccctgaagtag

SEQ ID NO: 8778 - DNA, 2691 bp, Artificial Sequence
  Description of Artificial Sequence: Synthetic coding sequence
atggccgccagagccgtgctggacgagttcaccgcccccgccgagaaggccgagctgctggagcagagcagaggcagaatcgagggcctgttcggcgtgagcctggccgtgctgggcgccctgggcgccgaggagcccctgcccgccagaatctggctgcagctgtgcggcgcccaggaggccgtgcacagcgccaaggagtacatcaagggcatctgcgagcccgagctggaggagagagagtgctaccccaaggacatgcactgcatcttcgtgggcgccgagagcctgttcctgaagagcctgatccaggacacctgcgccgacctgtgcatcctggacatcggcctgctgggcatcagaggcagcgccgaggccgtggtgatggccagaagccacatccagcagttcgtgaagctgttcgagaacaaggagaacctgcccagcagccagaaggagagcgaggtgaagagagagttcaagcagttcgtggaggcccacgccgacaactacaccatggacctgctgatcctgcccaccagcctgaagaaggagctgctgaccctgacccagggcgaggagaacctgttcgagaccggcgacgacgaggtgatcgagatgagagacagccagcagaccgagttcacccagaacgccgccaccggcctgaacatcagcagagacgagaccgtgctgcaggaggaggccagaaacaaggccggcacccccgtgagcgagctgaccaagcagatggacaccgtgctgagcagcagccccgacgtgctgttcgaccccatcaacggcctgacccccgacgaggaggccctgagcaacgagagaatctgccagaagagaagattcagcgacagcgaggagagacacaccaagaagcagttcagcctggagaacgtgcaggagggcgagatcctgcacgacgccaagaccctggccggcaacgtgatcgccgacctgagcgacagcagcgccgacagcgagaacctgagccccgacatcaaggagaccaccgaggagatggagtacaacatcctggtgaacttcttcaagaccatgggctacagccaggagatcgtggagaaggtgatcaaggtgtacggccccagcaccgagcccctgctgctgctggaggagatcgagaaggagaacaagagattccaggaggacagagagttcagcgccggcaccgtgtaccccgagaccaacaagaccaagaacaagggcgtgtacagcagcaccaacgagctgaccaccgacagcacccccaagaagacccaggcccacacccagcagaacatggtggagaagttcagccagctgcccttcaaggtggaggccaagccctgcaccagcaactgcagaatcaacaccttcagaaccgtgcccatcgagcagaagcacgaggtgtggggcagcaaccagaactacatctgcaacaccgaccccgagaccgacggcctgagccccagcgtggccagccccagccccaaggaggtgaacttcgtgagcagaggcgccagcagccaccagcccagagtgcccctgttccccgagaacggcctgcaccagcagcccgagcccctgctgcccaacaacatgaagagcgcctgcgagaagagactgggctgctgcagcagcccccacagcaagcccaactgcagcaccctgagcccccccatgcccctgccccagctgctgcccagcgtgaccgacgccagaagcgccggccccagcgaccacatcgacagcagcgtgaccggcgtgcagagattcagagacaccctgaagatcccctacaagctggagctgaagaacgagcccggcagaaccgacctgaagcacatcgtgatcgacggcagcaacgtggccatcacccacggcctgaagaagttcttcagctgcagaggcatcgccatcgccgtggagtacttctggaagctgggcaacagaaacatcaccgtgttcgtgccccagtggagaaccagaagagaccccaacgtgaccgagcagcacttcctgacccagctgcaggagctgggcatcctgagcctgacccccgccagaatggtgttcggcgagagaatcgccagccacgacgacagattcctgctgcacctggccgacaagaccggcggcatcatcgtgaccaacgacaacttcagagagttcgtgaacgagagcgtgagctggagagagatcatcaccaagagactgctgcagtacaccttcgtgggcgacatcttcatggtgcccgacgaccccctgggcagaagcggccccagactggaggagttcctgcagaaggaggtgtgcctgagagacatgcagcccctgctgagcgccctgcccaacgtgggcatgttcgaccccagcttcagagtgcccggcacccaggccgccagcaccagccaccagccccccaccagaatccagggcgcccccagcagccactggctgccccagcagccccacttccccctgctgcccgccctgcccagcctgcagcagaacctgcccatgcccgcccagagaagcagcgccgagaccaacgagctgagagaggccctgctgaagatcttccccgacagcgagcagagactgaagatcgaccagatcctggtggcccacccctacatgaaggacctgaacgccctgagcgccatggtgctggactag

SEQ ID NO: 8779 - DNA, 1848 bp, Artificial Sequence
  Description of Artificial Sequence: Synthetic coding sequence
atggcccagaagaagtacctgcaggccaagctgacccagttcctgagagaggacagaatccagctgtggaagcccccctacaccgacgagaacaagaaggtgggcctggccctgaaggacctggccaagcagtacagcgacagactggagtgctgcgagaacgaggtggagaaggtgatcgaggagatcagatgcaaggccatcgagagaggcaccggcaacgacaactacagaaccaccggcatcgccaccatcgaggtgttcctgccccccagactgaagaaggacagaaagaacctgctggagaccagactgcacatcaccggcagagagctgagaagcaagatcgccgagaccttcggcctgcaggagaactacatcaagatcgtgatcaacaagaagcagctgcagctgggcaagaccctggaggagcagggcgtggcccacaacgtgaaggccatggtgctggagctgaagcagagcgaggaggacgccagaaagaacttccagctggaggaggaggagcagaacgaggccaagctgaaggagaagcagatccagagaaccaagagaggcctggagatcctggccaagagagccgccgagaccgtggtggaccccgagatgaccccctacctggacatcgccaaccagaccggcagaagcatcagaatcccccccagcgagagaaaggccctgatgctggccatgggctaccacgagaagggcagagccttcctgaagagaaaggagtacggcatcgccctgccctgcctgctggacgccgacaagtacttctgcgagtgctgcagagagctgctggacaccgtggacaactacgccgtgctgcagctggacatcgtgtggtgctacttcagactggagcagctggagtgcctggacgacgccgagaagaagctgaacctggcccagaagtgcttcaagaactgctacggcgagaaccaccagagactggtgcacatcaagggcaactgcggcaaggagaaggtgctgttcctgagactgtacctgctgcagggcatcagaaactaccacagcggcaacgacgtggaggcctacgagtacctgaacaaggccagacagctgttcaaggagctgtacatcgaccccagcaaggtggacaacctgctgcagctgggcttcaccgcccaggaggccagactgggcctgagagcctgcgacggcaacgtggaccacgccgccacccacatcaccaacagaagagaggagctggcccagatcagaaaggaggagaaggagaagaagagaagaagactggagaacatcagattcctgaagggcatgggctacagcacccacgccgcccagcaggtgctgcacgccgccagcggcaacctggacgaggccctgaagatcctgctgagcaacccccagatgtggtggctgaacgacagcaaccccgagaccgacaacagacaggagagccccagccaggagaacatcgacagactggtgtacatgggcttcgacgccctggtggccgaggccgccctgagagtgttcagaggcaacgtgcagctggccgcccagaccctggcccacaacggcggcagcctgccccccgagctgcccctgagccccgaggacagcctgagcccccccgccaccagccccagcgacagcgccggcaccagcagcgccagcaccgacgaggacatggagaccgaggccgtgaacgagatcctggaggacatccccgagcacgaggaggactacctggacagcaccctggaggacgaggagatcatcatcgccgagtacctgagctacgtggagaacagaaagagcgccaccaagaagaactag

SEQ ID NO: 8780 - DNA, 1806 bp, Artificial Sequence
  Description of Artificial Sequence: Synthetic coding sequence
atggcccagaagaagtacctgcaggccaagctgacccagttcctgagagaggacagaatccagctgtggaagcccccctacaccgacgagaacaagaaggtgggcctggccctgaaggacctggccaagcagtacagcgacagactggagtgctgcgagaacgaggtggagaaggtgatcgaggagatcagatgcaaggccatcgagagaggcaccggcaacgacaactacagaaccaccggcatcgccaccatcgaggtgttcctgccccccagactgaagaaggacagaaagaacctgctggagaccagactgcacatcaccggcagagagctgagaagcaagatcgccgagaccttcggcctgcaggagaactacatcaagatcgtgatcaacaagaagcagctgcagctgggcaagaccctggaggagcagggcgtggcccacaacgtgaaggccatggtgctggagctgaagcagagcgaggaggacgccagaaagaacttccagctggaggaggaggagcagaacgaggccaagctgaaggagaagcagatccagagaaccaagagaggcctggagatcctggccaagagagccgccgagaccgtggtggaccccgagatgaccccctacctggacatcgccaaccagaccggcagaagcatcagaatcccccccagcgagagaaaggccctgatgctggccatgggctaccacgagaagggcagagccttcctgaagagaaaggagtacggcatcgccctgccctgcctgctggacgccgacaagtacttctgcgagtgctgcagagagctgctggacaccgtggacaactacgccgtgctgcagctggacatcgtgtggtgctacttcagactggagcagctggagtgcctggacgacgccgagaagaagctgaacctggcccagaagtgcttcaagaactgctacggcgagaaccaccagagactggtgcacatcaagggcaactgcggcaaggagaaggtgctgttcctgagactgtacctgctgcagggcatcagaaactaccacagcggcaacgacgtggaggcctacgagtacctgaacaaggccagacagctgttcaaggagctgtacatcgaccccagcaaggtggacaacctgctgcagctgggcttcaccgcccaggaggccagactgggcctgagagcctgcgacggcaacgtggaccacgccgccacccacatcaccaacagaagagaggagctggcccagatcagaaaggaggagaaggagaagaagagaagaagactggagaacatcagattcctgaagggcatgggctacagcacccacgccgcccagcagatcctgctgagcaacccccagatgtggtggctgaacgacagcaaccccgagaccgacaacagacaggagagccccagccaggagaacatcgacagactggtgtacatgggcttcgacgccctggtggccgaggccgccctgagagtgttcagaggcaacgtgcagctggccgcccagaccctggcccacaacggcggcagcctgccccccgagctgcccctgagccccgaggacagcctgagcccccccgccaccagccccagcgacagcgccggcaccagcagcgccagcaccgacgaggacatggagaccgaggccgtgaacgagatcctggaggacatccccgagcacgaggaggactacctggacagcaccctggaggacgaggagatcatcatcgccgagtacctgagctacgtggagaacagaaagagcgccaccaagaagaactag

SEQ ID NO: 8781 - DNA, 465 bp, Artificial Sequence
  Description of Artificial Sequence: Synthetic coding sequence
atggcccagaagaagtacctgcaggccaagctgacccagttcctgagagaggacagaatccagctgtggaagcccccctacaccgacgagaacaagaaggtgggcctggccctgaaggacctggccaagcagtacagcgacagactggagtgctgcgagaacgaggtggagaaggtgatcgaggagatcagatgcaaggccatcgagagaggcaccggcaacgacaactacagaaccaccggcatcgccaccatcgaggtgttcctgccccccagactgaagaaggacagaaagaacctgctggagaccagactgcacatcaccggcagagagctgagaagcaagatcgccgagaccttcggcctgcaggagaactacatcaagatcgtgatcaacaagaagcagctgcagctgggcaagaccctggaggagcagggcgtggcccacaacgtgaaggccatgtag

SEQ ID NO: 8782 - DNA, 765 bp, Artificial Sequence
  Description of Artificial Sequence: Synthetic coding sequence
atggcccagaagaagtacctgcaggccaagctgacccagttcctgagagaggacagaatccagctgtggaagcccccctacaccgacgagaacaagaaggtgggcctggccctgaaggacctggccaagcagtacagcgacagactggagtgctgcgagaacgaggtggagaaggtgatcgaggagatcagatgcaaggccatcgagagaggcaccggcaacgacaactacagaaccaccggcatcgccaccatcgaggtgttcctgccccccagactgaagaaggacagaaagaacctgctggagaccagactgcacatcaccggcagagagctgagaagcaagatcgccgagaccttcggcctgcaggagaactacatcaagatcgtgatcaacaagaagcagctgcagctgggcaagaccctggaggagcagggcgtggcccacaacgtgaaggccatggtgctggagctgaagcagagcgaggaggacgccagaaagaacttccagctggaggaggaggagcagaacgaggccaagctgaaggagaagcagatccagagaaccaagagaggcctggagatcctggccaagagagccgccgagaccgtggtggaccccgagatgaccccctacctggacatcgccaaccagaccggcagaagcatcagaatcccccccagcgagagaaaggccctgatgctggccatgggctaccacgagaagggcagagccttcctgaagagaaaggagtacggcatctag

SEQ ID NO: 8783 - DNA, 495 bp, Artificial Sequence
  Description of Artificial Sequence: Synthetic coding sequence
atggcccagaagaagtacctgcaggccaagctgacccagttcctgagagaggacagaatccagctgtggaagcccccctacaccgacgagaacaagaaggtgggcctggccctgaaggacctggccaagcagtacagcgacagactggagtgctgcgagaacgaggtggagaaggtgatcgaggagatcagatgcaaggccatcgagagaggcaccggcaacgacaactacagaaccaccggcatcgccaccatcgaggtgttcctgccccccagactgaagaaggacagaaagaacctgctggagaccagactgcacatcaccggcagagagctgagaagcaaggccgtgagaggcggcttcagaaagtggcacgccacccacatgagaagaagaatcgccgagaccttcggcctgcaggagaactacatcaagatcgtgatcaacaagaagcagctgcagctgggcccctacgtgagctacggcatcagctag

SEQ ID NO: 8784 - DNA, 1806 bp, Artificial Sequence; identical to SEQ ID NO: 8780
  Description of Artificial Sequence: Synthetic coding sequence

SEQ ID NO: 8785 - DNA, 1920 bp, Artificial Sequence
  Description of Artificial Sequence: Synthetic coding sequence
atgaagaccaacggcggcagatgcagaatcagagccctgtgctggagcagaagagagtggagaggcgccggcatggcccagaagaagtacctgcaggccaagctgacccagttcctgagagaggacagaatccagctgtggaagcccccctacaccgacgagaacaagaaggtgggcctggccctgaaggacctggccaagcagtacagcgacagactggagtgctgcgagaacgaggtggagaaggtgatcgaggagatcagatgcaaggccatcgagagaggcaccggcaacgacaactacagaaccaccggcatcgccaccatcgaggtgttcctgccccccagactgaagaaggacagaaagaacctgctggagaccagactgcacatcaccggcagagagctgagaagcaagatcgccgagaccttcggcctgcaggagaactacatcaagatcgtgatcaacaagaagcagctgcagctgggcaagaccctggaggagcagggcgtggcccacaacgtgaaggccatggtgctggagctgaagcagagcgaggaggacgccagaaagaacttccagctggaggaggaggagcagaacgaggccaagctgaaggagaagcagatccagagaaccaagagaggcctggagatcctggccaagagagccgccgagaccgtggtggaccccgagatgaccccctacctggacatcgccaaccagaccggcagaagcatcagaatcccccccagcgagagaaaggccctgatgctggccatgggctaccacgagaagggcagagccttcctgaagagaaaggagtacggcatcgccctgccctgcctgctggacgccgacaagtacttctgcgagtgctgcagagagctgctggacaccgtggacaactacgccgtgctgcagctggacatcgtgtggtgctacttcagactggagcagctggagtgcctggacgacgccgagaagaagctgaacctggcccagaagtgcttcaagaactgctacggcgagaaccaccagagactggtgcacatcaagggcaactgcggcaaggagaaggtgctgttcctgagactgtacctgctgcagggcatcagaaactaccacagcggcaacgacgtggaggcctacgagtacctgaacaaggccagacagctgttcaaggagctgtacatcgaccccagcaaggtggacaacctgctgcagctgggcttcaccgcccaggaggccagactgggcctgagagcctgcgacggcaacgtggaccacgccgccacccacatcaccaacagaagagaggagctggcccagatcagaaaggaggagaaggagaagaagagaagaagactggagaacatcagattcctgaagggcatgggctacagcacccacgccgcccagcaggtgctgcacgccgccagcggcaacctggacgaggccctgaagatcctgctgagcaacccccagatgtggtggctgaacgacagcaaccccgagaccgacaacagacaggagagccccagccaggagaacatcgacagactggtgtacatgggcttcgacgccctggtggccgaggccgccctgagagtgttcagaggcaacgtgcagctggccgcccagaccctggcccacaacggcggcagcctgccccccgagctgcccctgagccccgaggacagcctgagcccccccgccaccagccccagcgacagcgccggcaccagcagcgccagcaccgacgaggacatggagaccgaggccgtgaacgagatcctggaggacatccccgagcacgaggaggactacctggacagcaccctggaggacgaggagatcatcatcgccgagtacctgagctacgtggagaacagaaagagcgccaccaagaagaactag

SEQ ID NO: 8786 - DNA, 246 bp, Artificial Sequence
  Description of Artificial Sequence: Synthetic coding sequence
atgctgatcaaggtgaagaccctgaccggcaaggagatcgagatcgacatcgagcccaccgacaaggtggagagaatcaaggagagagtggaggagaaggagggcatccccccccagcagcagagactgatctacagcggcaagcagatgaacgacgagaagaccgccgccgactacaagatcctgggcggcagcgtgctgcacctggtgctggccctgagaggcggcggcggcctgagacagtag

SEQ ID NO: 8787 - DNA, 819 bp, Artificial Sequence
  Description of Artificial Sequence: Synthetic coding sequence
atgttcgtgaagagcgagaccctggagctgaaggaggaggaggacgtgctggtgctgctgggcagcgccagccccgccctggccgccctgacccccctgagcagcagcgccgacgaggaggaggaggaggagcccggcgccagcggcggcgccagaagacagagaggcgccgaggccggccagggcgccagaggcggcgtggccgccggcgccgagggctgcagacccgccagactgctgggcctggtgcacgactgcaagagaagacccagcagagccagagccgtgagcagaggcgccaagaccgccgagaccgtgcagagaatcaagaagaccagaagactgaaggccaacaacagagagagaaacagaatgcacaacctgaacgccgccctggacgccctgagagaggtgctgcccaccttccccgaggacgccaagctgaccaagatcgagaccctgagattcgcccacaactacatctgggccctgaccgagaccctgagactggccgaccactgcggcggcggcggcggcggcctgcccggcgccctgttcagcgaggccgtgctgctgagccccggcggcgccagcgccgccctgagcagcagcggcgacagccccagccccgccagcacctggagctgcaccaacagccccgcccccagcagcagcgtgagcagcaacagcaccagcccctacagctgcaccctgagccccgccagccccgccggcagcgacatggactactggcagccccccccccccgacaagcacagatacgccccccacctgcccatcgccagagactgcatctag

SEQ ID NO: 8788 - DNA, 1158 bp, Artificial Sequence
  Description of Artificial Sequence: Synthetic coding sequence
atgccccagaacgtggccaagaccgagcccgtgagcatcctgcagccccagaccaccgtgaaccccgacagaatcaagcagaccctgcccagcagccccaccaccaccaagagcagccccagcgaccccatgaccaccagcagagccaaccaggtgaagatcatcgtgcccaacagcaccgccggcctgatcatcggcaagggcggcgccaccgtgaaggccgtgatggagcagagcggcgcctgggtgcagctgagccagaagcccgacggcatcaacctgcaggagagagtggtgaccgtgagcggcgagcccgagcagaacagaaaggccgtggagctgatcatccagaagatccaggaggacccccagagcggcagctgcctgaacatcagctacgccaacgtgaccggccccgtggccaacagcaaccccaccggcagcccctacgccaacaccgccgaggtgctgcccaccgccgccgccgccgccggcctgctgggccacgccaacctggccggcgtggccgccttccccgccgtgctgagcggcttcaccggcaacgacctggtggccatcaccagcgccctgaacaccctggccagctacggctacaacctgaacaccctgggcctgggcctgagccaggccgccgccaccggcgccctggccgccgccgccgccagcgccaaccccgccgccgccgccgccaacctgctggccacctacgccagcgaggccagcgccagcggcagcaccgccggcggcaccgccggcaccttcgccctgggcagcctggccgccgccaccgccgccaccaacggctacttcggcgccgccagccccctggccgccagcgccatcctgggcaccgagaagagcaccgacggcagcaaggacgtggtggagatcgccgtgcccgagaacctggtgggcgccatcctgggcaagggcggcaagaccctggtggagtaccaggagctgaccggcgccagaatccagatcagcaagaagggcgagttcgtgcccggcaccagaaacagaaaggtgaccatcaccggcacccccgccgccacccaggccgcccagtacctgatcacccagagaatcacctacgagcagggcgtgagagccgccaacccccagaaggtgggctag

SEQ ID NO: 8789 - DNA, 546 bp, Artificial Sequence
  Description of Artificial Sequence: Synthetic coding sequence
atgatggccgccgcccccatccagcagaacggcacccacaccggcgtgcccatcgacctggacccccccgacagcagaaagagacccctggaggccccccccgaggccggcagcaccaagagaaccaacaccggcgaggacggccagtacttcctgaaggtgctgatccccagctacgccgccggcagcatcatcggcaagggcggccagaccatcgtgcagctgcagaaggagaccggcgccaccatcaagctgagcaagagcaaggacttctaccccggcaccaccgagagagtgtgcctgatccagggcaccgtggaggccctgaacgccgtgcacggcttcatcgccgagaagatcagagagatgccccagaacgtggccaagaccgagcccgtgagcatcctgcagccccagaccaccgtgaaccccgacagaatcaagcagaccctgcccagcagccccaccaccaccaagagcagccccagcgaccccatgaccaccagcagagccaaccagaagcacaacatcagctggatcagctag

SEQ ID NO: 8790 - DNA, 1452 bp, Artificial Sequence
  Description of Artificial Sequence: Synthetic coding sequence
atgatggccgccgcccccatccagcagaacggcacccacaccggcgtgcccatcgacctggacccccccgacagcagaaagagacccctggaggccccccccgaggccggcagcaccaagagaaccaacaccggcgaggacggccagtacttcctgaaggtgctgatccccagctacgccgccggcagcatcatcggcaagggcggccagaccatcgtgcagctgcagaaggagaccggcgccaccatcaagctgagcaagagcaaggacttctaccccggcaccaccgagagagtgtgcctgatccagggcaccgtggaggccctgaacgccgtgcacggcttcatcgccgagaagatcagagagatgccccagaacgtggccaagaccgagcccgtgagcatcctgcagccccagaccaccgtgaaccccgacagaatcaagcaggtgaagatcatcgtgcccaacagcaccgccggcctgatcatcggcaagggcggcgccaccgtgaaggccgtgatggagcagagcggcgcctgggtgcagctgagccagaagcccgacggcatcaacctgcaggagagagtggtgaccgtgagcggcgagcccgagcagaacagaaaggccgtggagctgatcatccagaagatccaggaggacccccagagcggcagctgcctgaacatcagctacgccaacgtgaccggccccgtggccaacagcaaccccaccggcagcccctacgccaacaccgccgaggtgctgcccaccgccgccgccgccgccggcctgctgggccacgccaacctggccggcgtggccgccttccccgccgtgctgagcggcttcaccggcaacgacctggtggccatcaccagcgccctgaacaccctggccagctacggctacaacctgaacaccctgggcctgggcctgagccaggccgccgccaccggcgccctggccgccgccgccgccagcgccaaccccgccgccgccgccgccaacctgctggccacctacgccagcgaggccagcgccagcggcagcaccgccggcggcaccgccggcaccttcgccctgggcagcctggccgccgccaccgccgccaccaacggctacttcggcgccgccagccccctggccgccagcgccatcctgggcaccgagaagagcaccgacggcagcaaggacgtggtggagatcgccgtgcccgagaacctggtgggcgccatcctgggcaagggcggcaagaccctggtggagtaccaggagctgaccggcgccagaatccagatcagcaagaagggcgagttcgtgcccggcaccagaaacagaaaggtgaccatcaccggcacccccgccgccacccaggccgcccagtacctgatcacccagagaatcacctacgagcagggcgtgagagccgccaacccccagaaggtgggctag

SEQ ID NO: 8791 - DNA, 1524 bp, Artificial Sequence
  Description of Artificial Sequence: Synthetic coding sequence
atgatggccgccgcccccatccagcagaacggcacccacaccggcgtgcccatcgacctggacccccccgacagcagaaagagacccctggaggccccccccgaggccggcagcaccaagagaaccaacaccggcgaggacggccagtacttcctgaaggtgctgatccccagctacgccgccggcagcatcatcggcaagggcggccagaccatcgtgcagctgcagaaggagaccggcgccaccatcaagctgagcaagagcaaggacttctaccccggcaccaccgagagagtgtgcctgatccagggcaccgtggaggccctgaacgccgtgcacggcttcatcgccgagaagatcagagagatgccccagaacgtggccaagaccgagcccgtgagcatcctgcagccccagaccaccgtgaaccccgacagaatcaagcagaccctgcccagcagccccaccaccaccaagagcagccccagcgaccccatgaccaccagcagagccaaccaggtgaagatcatcgtgcccaacagcaccgccggcctgatcatcggcaagggcggcgccaccgtgaaggccgtgatggagcagagcggcgcctgggtgcagctgagccagaagcccgacggcatcaacctgcaggagagagtggtgaccgtgagcggcgagcccgagcagaacagaaaggccgtggagctgatcatccagaagatccaggaggacccccagagcggcagctgcctgaacatcagctacgccaacgtgaccggccccgtggccaacagcaaccccaccggcagcccctacgccaacaccgccgaggtgctgcccaccgccgccgccgccgccggcctgctgggccacgccaacctggccggcgtggccgccttccccgccgtgctgagcggcttcaccggcaacgacctggtggccatcaccagcgccctgaacaccctggccagctacggctacaacctgaacaccctgggcctgggcctgagccaggccgccgccaccggcgccctggccgccgccgccgccagcgccaaccccgccgccgccgccgccaacctgctggccacctacgccagcgaggccagcgccagcggcagcaccgccggcggcaccgccggcaccttcgccctgggcagcctggccgccgccaccgccgccaccaacggctacttcggcgccgccagccccctggccgccagcgccatcctgggcaccgagaagagcaccgacggcagcaaggacgtggtggagatcgccgtgcccgagaacctggtgggcgccatcctgggcaagggcggcaagaccctggtggagtaccaggagctgaccggcgccagaatccagatcagcaagaagggcgagttcgtgcccggcaccagaaacagaaaggtgaccatcaccggcacccccgccgccacccaggccgcccagtacctgatcacccagagaatcacctacgagcagggcgtgagagccgccaacccccagaaggtgggctag

SEQ ID NO: 8792 - DNA, 1479 bp, Artificial Sequence
  Description of Artificial Sequence: Synthetic coding sequence
atggagcccgaggcccccgacagcagaaagagacccctggagaccccccccgaggtggtgtgcaccaagagaagcaacaccggcgaggagggcgagtacttcctgaaggtgctgatccccagctacgccgccggcagcatcatcggcaagggcggccagaccatcgtgcagctgcagaaggagaccggcgccaccatcaagctgagcaagagcaaggacttctaccccggcaccaccgagagagtgtgcctggtgcagggcaccgccgaggccctgaacgccgtgcacagcttcatcgccgagaaggtgagagagatcccccaggccatgaccaagcccgaggtggtgaacatcctgcagccccagaccaccatgaaccccgacagagccaagcaggccaagctgatcgtgcccaacagcaccgccggcctgatcatcggcaagggcggcgccaccgtgaaggccgtgatggagcagagcggcgcctgggtgcagctgagccagaagcccgagggcatcaacctgcaggagagagtggtgaccgtgagcggcgagcccgagcaggtgcacaaggccgtgagcgccatcgtgcagaaggtgcaggaggacccccagagcagcagctgcctgaacatcagctacgccaacgtggccggccccgtggccaacagcaaccccaccggcagcccctacgccagccccgccgacgtgctgcccgccgccgccgccgccagcgccgccgccgccagcggcctgctgggccccgccggcctggccggcgtgggcgccttccccgccgccctgcccgccttcagcggcaccgacctgctggccatcagcaccgccctgaacaccctggccagctacggctacaacaccaacagcctgggcctgggcctgaacagcgccgccgccagcggcgtgctggccgccgtggccgccggcgccaaccccgccgccgccgccgccgccaacctgctggccagctacgccggcgaggccggcgccggccccgccggcggcgccgcccccccccccccccccccccccggcgccctgggcagcttcgccctggccgccgccgccaacggctacctgggcgccggcgccggcggcggcgccggcggcggcggcggccccctggtggccgccgccgccgccgccggcgccgccggcggcttcctgaccgccgagaagctggccgccgagagcgccaaggagctggtggagatcgccgtgcccgagaacctggtgggcgccatcctgggcaagggcggcaagaccctggtggagtaccaggagctgaccggcgccagaatccagatcagcaagaagggcgagttcctgcccggcaccagaaacagaagagtgaccatcaccggcagccccgccgccacccaggccgcccagtacctgatcagccagagagtgacctacgagcagggcgtgagagccagcaacccccagaaggtgggctag

SEQ ID NO: 8793 - DNA, 840 bp, Artificial Sequence
  Description of Artificial Sequence: Synthetic coding sequence
atggagaacagcgagaagaccgaggtggtgctgctggcctgcggcagcttcaaccccatcaccaacatgcacctgagactgttcgagctggccaaggactacatgaacggcaccggcagatacaccgtggtgaagggcatcatcagccccgtgggcgacgcctacaagaagaagggcctgatccccgcctaccacagagtgatcatggccgagctggccaccaagaacagcaagtgggtggaggtggacacctgggagagcctgcagaaggagtggaaggagaccctgaaggtgctgagacaccaccaggagaagctggaggccagcgactgcgaccaccagcagaacagccccaccctggagagacccggcagaaagagaaagtggaccgagacccaggacagcagccagaagaagagcctggagcccaagaccaaggccgtgcccaaggtgaagctgctgtgcggcgccgacctgctggagagcttcgccgtgcccaacctgtggaagagcgaggacatcacccagatcgtggccaactacggcctgatctgcgtgaccagagccggcaacgacgcccagaagttcatctacgagagcgacgtgctgtggaagcacagaagcaacatccacgtggtgaacgagtggatcgccaacgacatcagcagcaccaagatcagaagagccctgagaagaggccagagcatcagatacctggtgcccgacctggtgcaggagtacatcgagaagcacaacctgtacagcagcgagagcgaggacagaaacgccggcgtgatcctggcccccctgcagagaaacaccgccgaggccaagacctag

SEQ ID NO: 8794 - DNA, 483 bp, Artificial Sequence
  Description of Artificial Sequence: Synthetic coding sequence
atggagaacagcgagaagaccgaggtggtgctgctggcctgcggcagcttcaaccccatcaccaacatgcacctgagactgttcgagctggccaaggactacatgaacggcaccggcagatacaccgtggtgaagggcatcatcagccccgtgggcgacgcctacaagaagaagggcctgatccccgcctaccacagagtgatcatggccgagctggccaccaagaacagcaagtgggtggaggtggacacctgggagagcctgcagaaggagtggaaggagaccctgaaggtgctgagacaccaccaggagaagctggaggccagcgactgcgaccaccagcagaacagccccaccctggagagacccggcagaaagagaaagtggaccgagacccaggacagcagccagaagaagagcctggagcccaagaccaaggacggcgtgagcctgtaccaccccggctggagcgccgtggcctag

SEQ ID NO: 8795 - DNA, 840 bp, Artificial Sequence; identical to SEQ ID NO: 8793
  Description of Artificial Sequence: Synthetic coding sequence

SEQ ID NO: 8796 - DNA, 1239 bp, Artificial Sequence
  Description of Artificial Sequence: Synthetic coding sequence
atggcccccgtggagcacgtggtggccgacgccggcgccttcctgagacacgccgccctgcaggacatcggcaagaacatctacaccatcagagaggtggtgaccgagatcagagacaaggccaccagaagaagactggccgtgctgccctacgagctgagattcaaggagcccctgcccgagtacgtgagactggtgaccgagttcagcaagaagaccggcgactaccccagcctgagcgccaccgacatccaggtgctggccctgacctaccagctggaggccgagttcgtgggcgtgagccacctgaagcaggagccccagaaggtgaaggtgagcagcagcatccagcaccccgagacccccctgcacatcagcggcttccacctgccctacaagcccaagcccccccaggagaccgagaagggccacagcgcctgcgagcccgagaacctggagttcagcagcttcatgttctggagaaaccccctgcccaacatcgaccacgagctgcaggagctgctgatcgacagaggcgaggacgtgcccagcgaggaggaggaggaggaggagaacggcttcgaggacagaaaggacgacagcgacgacgacggcggcggctggatcacccccagcaacatcaagcagatccagcaggagctggagcagtgcgacgtgcccgaggacgtgagagtgggctgcctgaccaccgacttcgccatgcagaacgtgctgctgcagatgggcctgcacgtgctggccgtgaacggcatgctgatcagagaggccagaagctacatcctgagatgccacggctgcttcaagaccaccagcgacatgagcagagtgttctgcagccactgcggcaacaagaccctgaagaaggtgagcgtgaccgtgagcgacgacggcaccctgcacatgcacttcagcagaaaccccaaggtgctgaaccccagaggcctgagatacagcctgcccacccccaagggcggcaagtacgccatcaacccccacctgaccgaggaccagagattcccccagctgagactgagccagaaggccagacagaagaccaacgtgttcgcccccgactacatcgccggcgtgagccccttcgtggagaacgacatcagcagcagaagcgccaccctgcaggtgagagacagcaccctgggcgccggcagaagaagactgaaccccaacgccagcagaaagaagttcgtgaagaagagatag

SEQ ID NO: 8797 - DNA, 1236 bp, Artificial Sequence
  Description of Artificial Sequence: Synthetic coding sequence
atggacggcagagccgagctgcccgccttccccagagccggcgccccccccctggccgccagcgacaccgtgcccgccgcccccgagggcgccggcgccgccagacccgccgcccccctgagacccaccagcttcagcgtgctggacatcctggaccccaacaagttcaacagcagaagaagaagatgcgtgctgctgggccccgtggcccccgccgcctgcgccccctgcgccagcgccccctgcgcccccgcccccgccgccagcggcagaccccccagagccgaggagctggagagaagagccctggccggcgccggcggcgtgggcgccgccggcgccgagccccccaacgccggcgaccccttcaaggccggcgaggccgagaccaacgacaccaacggctacagcagcggcggcggcggccacagccccagcgccgacagcggcgacgaggtgcccgacgacgaggacgacgacgaggacgaggcccccgagaccgaggccgccagaggcgccgaggaggccagaggcggcggcggcggcctgggcgccagaggcagcggctgccagggcgccgccgagaccgacgccagccccggcgccaccgtggacgaggccgccgcccccggccccagagagaacagccccgtggcccagggcccccccggcggcgccgccgcccccggcggcgccggcaccaccccccagggcaccgccaccgccgccaagcccaagagaaagagaaccggcagcgacagcaagagcggcaagcccagaagagccagaaccgccttcacctacgagcagctggtggccctggagaacaagttcaaggccaccagatacctgagcgtgtgcgagagactgaacctggccctgagcctgagcctgaccgagacccaggtgaagatctggttccagaacagaagaaccaagtggaagaagcagaaccccggcgccgacaccagcgcccccaccggcggcggcggcggccccggccccggcgccggccccggcaccggcctgcccggcggcctgagccccctgagccccagcccccccatgggcgcccccctgggcatgcacggccccgccggctaccccgcccacggccccggcggcctggtgtgcgccgcccagctgcccttcctgagcagccccgccgtgctgagccccttcgtgctgggcagccagacctacggcgcccccgccttctacgccccccacctgtag

SEQ ID NO: 8798 - DNA, 1095 bp, Artificial Sequence
  Description of Artificial Sequence: Synthetic coding sequence
atgatgctgcccagccccgtgaccagcacccccttcagcgtgaaggacatcctgaacctggagcagcagcaccagcacttccacggcgcccacctgcaggccgacctggagcaccacttccacagcgccccctgcatgctggccgccgccgagggcacccagttcagcgacggcggcgaggaggacgaggaggacgagggcgagaagctgagctacctgaacagcctggccgccgccgacggccacggcgacagcggcctgtgcccccagggctacgtgcacaccgtgctgagagacagctgcagcgagcccaaggagcacgaggaggagcccgaggtggtgagagacagaagccagaagagctgccagctgaagaagagcctggagaccgccggcgactgcaaggccgccgaggagagcgagagacccaagcccagaagcagaagaaagcccagagtgctgttcagccaggcccaggtgttcgagctggagagaagattcaagcagcagagatacctgagcgcccccgagagagagcacctggccagcagcctgaagctgaccagcacccaggtgaagatctggttccagaacagaagatacaagtgcaagagacagagacaggacaagagcctggagctgggcgcccacgcccccccccccccccccagaagagtggccgtgcccgtgctggtgagagacggcaagccctgcgtgacccccagcgcccaggcctacggcgccccctacagcgtgggcgccagcgcctacagctacaacagcttccccgcctacggctacggcaacagcgccgccgccgccgccgccgccgccgccgccgccgccgccgccgccgcctacagcagcagctacggctgcgcctaccccgccggcggcggcggcggcggcggcggcaccagcgccgccaccaccgccatgcagcccgcctgcagcgccgccggcggcggccccttcgtgaacgtgagcaacctgggcggcttcggcagcggcggcagcgcccagcccctgcaccagggcaccgccgccggcgccgcctgcgcccagggcaccctgcagggcatcagagcctggtag

SEQ ID NO: 8799 - DNA, 1104 bp, Artificial Sequence
  Description of Artificial Sequence: Synthetic coding sequence
atgctggccgtgggcgccatggagggcaccagacagagcgccttcctgctgagcagcccccccctggccgccctgcacagcatggccgagatgaagacccccctgtaccccgccgcctacccccccctgcccgccggcccccccagcagcagcagcagcagcagcagcagcagcagccccagcccccccctgggcacccacaaccccggcggcctgaagccccccgccaccggcggcctgagcagcctgggcagccccccccagcagctgagcgccgccaccccccacggcatcaacgacatcctgagcagacccagcatgcccgtggccagcggcgccgccctgcccagcgccagccccagcggcagcagcagcagcagcagcagcagcgccagcgccagcagcgccagcgccgccgccgccgccgccgccgccgccgccgccgccgccagcagccccgccggcctgctggccggcctgcccagattcagcagcctgagcccccccccccccccccccggcctgtacttcagccccagcgccgccgccgtggccgccgtgggcagataccccaagcccctggccgagctgcccggcagaacccccatcttctggcccggcgtgatgcagagccccccctggagagacgccagactggcctgcaccccccaccagggcagcatcctgctggacaaggacggcaagagaaagcacaccagacccaccttcagcggccagcagatcttcgccctggagaagaccttcgagcagaccaagtacctggccggccccgagagagccagactggcctacagcctgggcatgaccgagagccaggtgaaggtgtggttccagaacagaagaaccaagtggagaaagaagcacgccgccgagatggccaccgccaagaagaagcaggacagcgagaccgagagactgaagggcgccagcgagaacgaggaggaggacgacgactacaacaagcccctggaccccaacagcgacgacgagaagatcacccagctgctgaagaagcacaagagcagcagcggcggcggcggcggcctgctgctgcacgccagcgagcccgagagcagcagctag

SEQ ID NO: 8800 - DNA, 834 bp, Artificial Sequence
  Description of Artificial Sequence: Synthetic coding sequence
atggacaccaacagacccggcgccttcgtgctgagcagcgcccccctggccgccctgcacaacatggccgagatgaagaccagcctgttcccctacgccctgcagggccccgccggcttcaaggcccccgccctgggcggcctgggcgcccagctgcccctgggcaccccccacggcatcagcgacatcctgggcagacccgtgggcgccgccggcggcggcctgctgggcggcctgcccagactgaacggcctggccagcagcgccggcgtgtacttcggccccgccgccgccgtggccagaggctaccccaagcccctggccgagctgcccggcagaccccccatcttctggcccggcgtggtgcagggcgccccctggagagaccccagactggccggccccgcccccgccggcggcgtgctggacaaggacggcaagaagaagcacagcagacccaccttcagcggccagcagatcttcgccctggagaagaccttcgagcagaccaagtacctggccggccccgagagagccagactggcctacagcctgggcatgaccgagagccaggtgaaggtgtggttccagaacagaagaaccaagtggagaaagagacacgccgtggagatggccagcgccaagaagaagcaggacagcgacgccgagaagctgaaggtgggcggcagcgacgccgaggacgacgacgagtacaacagacccctggaccccaacagcgacgacgagaagatcaccagactgctgaagaagcacaagcccagcaacctggccctggtgagcccctgcggcggcggcgccggcgacgccctgtag

SEQ ID NO: 8801 - DNA, 225 bp, Artificial Sequence
  Description of Artificial Sequence: Synthetic coding sequence
atggtggccctgagaggcctgggcagcggcctgcagccctggtgccccctggacctgagactggagtgggtggacaccgtgtgggagctggacttcaccgagaccgagcccctggaccccagcatcgaggccgagatcatcgagaccggcctggccgccttcaccaagctgtacgagagcctgctgcccttcgccaccggcgagcacggcagcatggaggtgtag

SEQ ID NO: 8802 - DNA, 108 bp, Artificial Sequence
  Description of Artificial Sequence: Synthetic coding sequence
atggtggccctgagaggcctgggcagcggcctgcagccctggtgccccctggacctgagactggagtgggtggacaccgtgtgggagctggacttcaccgagacctag

SEQ ID NO: 8803 - DNA, 4497 bp, Artificial Sequence
  Description of Artificial Sequence: Synthetic coding sequence
atggtggccctgagaggcctgggcagcggcctgcagccctggtgccccctggacctgagactggagtgggtggacaccgtgtgggagctggacttcaccgagaccgagcccctggaccccagcatcgaggccgagatcatcgagaccggcctggccgccttcaccaagctgtacgagagcctgctgcccttcgccaccggcgagcacggcagcatggagagcatctggaccttcttcatcgagaacaacgtgagccacagcaccctggtggccctgttctaccacttcgtgcagatcgtgcacaagaagaacgtgagcgtgcagtacagagagtacggcctgcacgccgccggcctgtacttcctgctgctggaggtgcccggcagcgtggccaaccaggtgttccaccccgtgatgttcgacaagtgcatccagaccctgaagaagagctggccccaggagagcaacctgaacagaaagagaaagaaggagcagcccaagagcagccaggccaaccccggcagacacagaaagagaggcaagccccccagaagagaggacatcgagatggacgagatcatcgaggagcaggaggacgagaacatctgcttcagcgccagagacctgagccagatcagaaacgccatcttccacctgctgaagaacttcctgagactgctgcccaagttcagcctgaaggagaagccccagtgcgtgcagaactgcatcgaggtgttcgtgagcctgaccaacttcgagcccgtgctgcacgagtgccacgtgacccaggccagagccctgaaccaggccaagtacatccccgagctggcctactacggcctgtacctgctgtgcagccccatccacggcgagggcgacaaggtgatcagctgcgtgttccaccagatgctgagcgtgatcctgatgctggaggtgggcgagggcagccacagagcccccctggccgtgaccagccaggtgatcaactgcagaaaccaggccgtgcagttcatcagcgccctggtggacgagctgaaggagagcatcttccccgtggtgagaatcctgctgcagcacatctgcgccaaggtggtggacaagagcgagtacagaaccttcgccgcccagagcctggtgcagctgctgagcaagctgccctgcggcgagtacgccatgttcatcgcctggctgtacaagtacagcagaagcagcaagatcccccacagagtgttcaccctggacgtggtgctggccctgctggagctgcccgagagagaggtggacaacaccctgagcctggagcaccagaagttcctgaagcacaagttcctggtgcaggagatcatgttcgacagatgcctggacaaggcccccaccgtgagaagcaaggccctgagcagcttcgcccactgcctggagctgaccgtgaccagcgccagcgagagcatcctggagctgctgatcaacagccccaccttcagcgtgatcgagagccaccccggcaccctgctgagaaacagcagcgccttcagctaccagagacagaccagcaacagaagcgagcccagcggcgagatcaacatcgacagcagcggcgagaccgtgggcagcggcgagagatgcgtgatggccatgctgagaagaagaatcagagacgagaagaccaacgtgagaaagagcgccctgcaggtgctggtgagcatcctgaagcactgcgacgtgagcggcatgaaggaggacctgtggatcctgcaggaccagtgcagagaccccgccgtgagcgtgagaaagcaggccctgcagagcctgaccgagctgctgatggcccagcccagatgcgtgcagatccagaaggcctggctgagaggcgtggtgcccgtggtgatggactgcgagagcaccgtgcaggagaaggccctggagttcctggaccagctgctgctgcagaacatcagacaccacagccacttccacagcggcgacgacagccaggtgctggcctgggccctgctgaccctgctgaccaccgagagccaggagctgagcagatacctgaacaaggccttccacatctggagcaagaaggagaagttcagccccaccttcatcaacaacgtgatcagccacaccggcaccgagcacagcgcccccgcctggatgctgctgagcaagatcgccggcagcagccccagactggactacagcagaatcatccagagctgggagaagatcagcagccagcagaaccccaacagcaacaccctgggccacatcctgtgcgtgatcggccacatcgccaagcacctgcccaagagcaccagagacaaggtgaccgacgccgtgaagtgcaagctgaacggcttccagtggagcctggaggtgatcagcagcgccgtggacgccctgcagagactgtgcagagccagcgccgagacccccgccgaggagcaggagctgctgacccaggtgtgcggcgacgtgctgagcacctgcgagcacagactgagcaacatcgtgctgaaggagaacggcaccggcaacatggacgaggacctgctggtgaagtacatcttcaccctgggcgacatcgcccagctgtgccccgccagagtggagaagagaatcttcctgctgatccagagcgtgctggccagcagcgccgacgccgaccacagccccagcagccagggcagcagcgaggcccccgccagccagccccccccccaggtgagaggcagcgtgatgcccagcgtgatcagagcccacgccatcatcaccctgggcaagctgtgcctgcagcacgaggacctggccaagaagagcatccccgccctggtgagagagctggaggtgtgcgaggacgtggccgtgagaaacaacgtgatcatcgtgatgtgcgacctgtgcatcagatacaccatcatggtggacaagtacatccccaacatcagcatgtgcctgaaggacagcgaccccttcatcagaaagcagaccctgatcctgctgaccaacctgctgcaggaggagttcgtgaagtggaagggcagcctgttcttcagattcgtgagcaccctgatcgacagccaccccgacatcgccagcttcggcgagttctgcctggcccacctgctgctgaagagaaaccccgtgatgttcttccagcacttcatcgagtgcatcttccacttcaacaactacgagaagcacgagaagtacaacaagttcccccagagcgagagagagaagagactgttcagcctgaagggcaagagcaacaaggagagaagaatgaagatctacaagttcctgctggagcacttcaccgacgagcagagattcaacatcaccagcaagatctgcctgagcatcctggcctgcttcgccgacggcatcctgcccctggacctggacgccagcgagctgctgagcgacaccttcgaggtgctgagcagcaaggagatcaagctgctggccatgagaagcaagcccgacaaggacctgctgatggaggaggacgacatggccctggccaacgtggtgatgcaggaggcccagaagaagctgatcagccaggtgcagaagagaaacttcatcgagaacatcatccccatcatcatcagcctgaagaccgtgctggagaagaacaagatccccgccctgagagagctgatgcactacctgagagaggtgatgcaggactacagagacgagctgaaggacttcttcgccgtggacaagcagctggccagcgagctggagtacgacatgaagaagtaccaggagcagctggtgcaggagcaggagctggccaagcacgccgacgtggccggcaccgccggcggcgccgaggtggcccccgtggcccaggtggccctgtgcctggagaccgtgcccgtgcccgccggccaggagaaccccgccatgagccccgccgtgagccagccctgcacccccagagccagcgccggccacgtggccgtgagcagccccacccccgagaccggccccctgcagagactgctgcccaaggccagacccatgagcctgagcaccatcgccatcctgaacagcgtgaagaaggccgtggagagcaagagcagacacagaagcagaagcctgggcgtgctgcccttcaccctgaacagcggcagccccgagaagacctgcagccaggtgagcagctacagcctggagcaggagagcaacggcgagatcgagcacgtgaccaagagagccatcagcacccccgagaagagcatcagcgacgtgaccttcggcgccggcgtgagctacatcggcacccccagaacccccagcagcgccaaggagaagatcgagggcagaagccagggcaacgacatcctgtgcctgagcctgcccgacaagccccccccccagccccagcagtggaacgtgagaagccccgccagaaacaaggacacccccgcctgcagcagaagaagcctgagaaagacccccctgaagaccgccaactag

SEQ ID NO: 8804 - DNA, 2667 bp, Artificial Sequence
  Description of Artificial Sequence: Synthetic coding sequence
atgctgctggagtgcttcatcaacatcaactacatcaagaaggaggagggcagaagattcctgagctgcctgttcaactggaacatcaacttcatcaagatgatccacggcaccatcaagaaccagctgcagggcctgcagaagagcctgatggtgtacatcgccgagatctacttcagagcctggaagaaggccagcggcaagatcctggaggccatcgagaacgactgcatccaggacttcatgttccacggcatccacctgcccagaagaagccccgtgcacagcaaggtgagagaggtgctgagctacttccaccaccagaagaaggtgagacagggcgtggaggagatgctgtacagactgtacaagcccatcctgtggagaggcctgaaggccagaaacagcgaggtgagaagcaacgccgccctgctgttcgtggaggccttccccatcagagaccccaacctgcacgccatcgagatggacagcgagatccagaagcagttcgaggagctgtacagcctgctggaggacccctaccccatggtgagaagcaccggcatcctgggcgtgtgcaagatcaccagcaagtactgggagatgatgccccccaccatcctgatcgacctgctgaagaaggtgaccggcgagctggccttcgacaccagcagcgccgacgtgagatgcagcgtgttcaagtgcctgcccatgatcctggacaacaagctgagccaccccctgctggagcagctgctgcccgccctgagatacagcctgcacgacaacagcgagaaggtgagagtggccttcgtggacatgctgctgaagatcaaggccgtgagagccgccaagttctggaagatctgccccatggagcacatcctggtgagactggagaccgacagcagacccgtgagcagaagactggtgagcctgatcttcaacagcttcctgcccgtgaaccagcccgaggaggtgtggtgcgagagatgcgtgaccctggtgcagatgaaccacgccgccgccagaagattctaccagtacgcccacgagcacaccgcctgcaccaacatcgccaagctgatccacgtgatcagacactgcctgaacgcctgcatccagagagccgtgagagagccccccgaggacgaggaggaggaggacggcagagagaaggagaacgtgaccgtgctggacaagaccctgagcgtgaacgacgtggcctgcatggccggcctgctggagatcatcgtgatcctgtggaagagcatcgacagaagcatggagaacaacaaggaggccaagctgtacaccatcaacaagttcgccagcgtgctgcccgagtacctgaaggtgttcaaggacgacagatgcaagatccccctgttcatgctgatgagcttcatgcccgccagcgccgtgccccccttcagctgcggcgtgatcagcaccctgagaagcagagaggagggcgccgtggacaagagctactgcaccctgctggactgcctgtgcagctggggccaggtgggccacatcctggagctggtggacaactggctgcccaccgagcacgcccaggccaagagcaacaccgccagcaagggcagagtgcagatccacgacaccagacccgtgaagcccgagctggccctggtgtacatcgagtacctgctgacccaccccaagaacagagagtgcctgctgagcgcccccagaaagaagctgaaccacctgctgaaggccctggagaccagcaaggccgacctggagagcctgctgcagacccccggcggcaagcccagaggcttcagcgaggccgccgcccccagagccttcggcctgcactgcagactgagcatccacctgcagcacaagttctgcagcgagggcaaggtgtacctgagcatgctggaggacaccggcttctggctggagagcaagatcctgagcttcatccaggaccaggaggaggactacctgaagctgcacagagtgatctaccagcagatcatccagacctacctgaccgtgtgcaaggacgtggtgatggtgggcctgggcgaccaccagttccagatgcagctgctgcagagaagcctgggcatcatgcagaccgtgaagggcttcttctacgtgagcctgctgctggacatcctgaaggagatcaccggcagcagcctgatccagaagaccgacagcgacgaggaggtggccatgctgctggacaccgtgcagaaggtgttccagaagatgctggagtgcatcgccagaagcttcagaaagcagcccgaggagggcctgagagtgagcgacgtggaggagctgaccccccccgagcacctgagcgacctgccccccttcagcagatgcctgatcggcatcatcatcaagagcagcaacgtggtgagaagcttcctggacgagctgaaggcctgcgtggccagcaacgacatcgagggcatcgtgtgcctgaccgccgccgtgcacatcatcctggtgatcaacgccggcaagcacaagagcagcaaggtgagagaggtggccgccaccgtgcacagaaagctgaagaccttcatggagatcaccctggaggaggacagcatcgagagattcctgtacgagagcagcagcagaaccctgggcgagctgctgaacagctag

SEQ ID NO: 8805 - DNA, 3432 bp, Artificial Sequence
  Description of Artificial Sequence: Synthetic coding sequence
atggagaagagagagaccttcgtgcaggccgtgagcaaggagctggtgggcgagttcctgcagttcgtgcagctggacaaggaggccagcgaccccttcagcctgaacgagctgctggacgagctgagcagaaagcagaaggaggagctgtggcagagactgaagaacctgctgaccgacgtgctgctggagagccccgtggacggctggcaggtggtggaggcccagggcgaggacaacatggagaccgagcacggcagcaagatgagaaagagcatcgagatcatctacgccatcaccagcgtgatcctggccagcgtgagcgtgatcaacgagagcgagaactacgaggccctgctggagtgcgtgatcatcctgaacggcatcctgtacgccctgcccgagagcgagagaaagctgcagagcagcatccaggacctgtgcgtgacctggtgggagaagggcctgcccgccaaggaggacaccggcaagaccgccttcgtgatgctgctgagaagaagcctggagaccaagaccggcgccgacgtgtgcagactgtggagaatccaccaggccctgtactgcttcgactacgacctggaggagagcggcgagatcaaggacatgctgctggagtgcttcatcaacatcaactacatcaagaaggaggagggcagaagattcctgagctgcctgttcaactggaacatcaacttcatcaagatgatccacggcaccatcaagaaccagctgcagggcctgcagaagagcctgatggtgtacatcgccgagatctacttcagagcctggaagaaggccagcggcaagatcctggaggccatcgagaacgactgcatccaggacttcatgttccacggcatccacctgcccagaagaagccccgtgcacagcaaggtgagagaggtgctgagctacttccaccaccagaagaaggtgagacagggcgtggaggagatgctgtacagactgtacaagcccatcctgtggagaggcctgaaggccagaaacagcgaggtgagaagcaacgccgccctgctgttcgtggaggccttccccatcagagaccccaacctgcacgccatcgagatggacagcgagatccagaagcagttcgaggagctgtacagcctgctggaggacccctaccccatggtgagaagcaccggcatcctgggcgtgtgcaagatcaccagcaagtactgggagatgatgccccccaccatcctgatcgacctgctgaagaaggtgaccggcgagctggccttcgacaccagcagcgccgacgtgagatgcagcgtgttcaagtgcctgcccatgatcctggacaacaagctgagccaccccctgctggagcagctgctgcccgccctgagatacagcctgcacgacaacagcgagaaggtgagagtggccttcgtggacatgctgctgaagatcaaggccgtgagagccgccaagttctggaagatctgccccatggagcacatcctggtgagactggagaccgacagcagacccgtgagcagaagactggtgagcctgatcttcaacagcttcctgcccgtgaaccagcccgaggaggtgtggtgcgagagatgcgtgaccctggtgcagatgaaccacgccgccgccagaagattctaccagtacgcccacgagcacaccgcctgcaccaacatcgccaagctgatccacgtgatcagacactgcctgaacgcctgcatccagagagccgtgagagagccccccgaggacgaggaggaggaggacggcagagagaaggagaacgtgaccgtgctggacaagaccctgagcgtgaacgacgtggcctgcatggccggcctgctggagatcatcgtgatcctgtggaagagcatcgacagaagcatggagaacaacaaggaggccaagctgtacaccatcaacaagttcgccagcgtgctgcccgagtacctgaaggtgttcaaggacgacagatgcaagatccccctgttcatgctgatgagcttcatgcccgccagcgccgtgccccccttcagctgcggcgtgatcagcaccctgagaagcagagaggagggcgccgtggacaagagctactgcaccctgctggactgcctgtgcagctggggccaggtgggccacatcctggagctggtggacaactggctgcccaccgagcacgcccaggccaagagcaacaccgccagcaagggcagagtgcagatccacgacaccagacccgtgaagcccgagctggccctggtgtacatcgagtacctgctgacccaccccaagaacagagagtgcctgctgagcgcccccagaaagaagctgaaccacctgctgaaggccctggagaccagcaaggccgacctggagagcctgctgcagacccccggcggcaagcccagaggcttcagcgaggccgccgcccccagagccttcggcctgcactgcagactgagcatccacctgcagcacaagttctgcagcgagggcaaggtgtacctgagcatgctggaggacaccggcttctggctggagagcaagatcctgagcttcatccaggaccaggaggaggactacctgaagctgcacagagtgatctaccagcagatcatccagacctacctgaccgtgtgcaaggacgtggtgatggtgggcctgggcgaccaccagttccagatgcagctgctgcagagaagcctgggcatcatgcagaccgtgaagggcttcttctacgtgagcctgctgctggacatcctgaaggagatcaccggcagcagcctgatccagaagaccgacagcgacgaggaggtggccatgctgctggacaccgtgcagaaggtgttccagaagatgctggagtgcatcgccagaagcttcagaaagcagcccgaggagggcctgagactgctgtacagcgtgcagagacccctgcacgagttcatcaccgccgtgcagagcagacacaccgacacccccgtgcacagaggcgtgctgagcaccctgatcgccggccccgtggtggagatcagccaccagctgagaaaggtgagcgacgtggaggagctgaccccccccgagcacctgagcgacctgccccccttcagcagatgcctgatcggcatcatcatcaagagcagcaacgtggtgagaagcttcctggacgagctgaaggcctgcgtggccagcaacgacatcgagggcatcgtgtgcctgaccgccgccgtgcacatcatcctggtgatcaacgccggcaagcacaagagcagcaaggtgagagaggtggccgccaccgtgcacagaaagctgaagaccttcatggagatcaccctggaggaggacagcatcgagagattcctgtacgagagcagcagcagaaccctgggcgagctgctgaacagctag

SEQ ID NO: 8806 - DNA, 3471 bp, Artificial Sequence
  Description of Artificial Sequence: Synthetic coding sequence
atggagaagagagagaccttcgtgcaggccgtgagcaaggagctggtgggcgagttcctgcagttcgtgcagctggacaaggaggccagcgaccccttcagcctgaacgagctgctggacgagctgagcagaaagcagaaggaggagctgtggcagagactgaagaacctgctgaccgacgtgctgctggagagccccgtggacggctggcaggtggtggaggcccagggcgaggacaacatggagaccgagcacggcagcaagatgagaaagagcatcgagatcatctacgccatcaccagcgtgatcctggccagcgtgagcgtgatcaacgagagcgagaactacgaggccctgctggagtgcgtgatcatcctgaacggcatcctgtacgccctgcccgagagcgagagaaagctgcagagcagcatccaggacctgtgcgtgacctggtgggagaagggcctgcccgccaaggaggacaccggcaagaccgccttcgtgatgctgctgagaagaagcctggagaccaagaccggcgccgacgtgtgcagactgtggagaatccaccaggccctgtactgcttcgactacgacctggaggagagcggcgagatcaaggacatgctgctggagtgcttcatcaacatcaactacatcaagaaggaggagggcagaagattcctgagctgcctgttcaactggaacatcaacttcatcaagatgatccacggcaccatcaagaaccagctgcagggcctgcagaagagcctgatggtgtacatcgccgagatctacttcagagcctggaagaaggccagcggcaagatcctggaggccatcgagaacgactgcatccaggacttcatgttccacggcatccacctgcccagaagaagccccgtgcacagcaaggtgagagaggtgctgagctacttccaccaccagaagaaggtgagacagggcgtggaggagatgctgtacagactgtacaagcccatcctgtggagaggcctgaaggccagaaacagcgaggtgagaagcaacgccgccctgctgttcgtggaggccttccccatcagagaccccaacctgcacgccatcgagatggacagcgagatccagaagcagttcgaggagctgtacagcctgctggaggacccctaccccatggtgagaagcaccggcatcctgggcgtgtgcaagatcaccagcaagtactgggagatgatgccccccaccatcctgatcgacctgctgaagaaggtgaccggcgagctggccttcgacaccagcagcgccgacgtgagatgcagcgtgttcaagtgcctgcccatgatcctggacaacaagctgagccaccccctgctggagcagctgctgcccgccctgagatacagcctgcacgacaacagcgagaaggtgagagtggccttcgtggacatgctgctgaagatcaaggccgtgagagccgccaagttctggaagatctgccccatggagcacatcctggtgagactggagaccgacagcagacccgtgagcagaagactggtgagcctgatcttcaacagcttcctgcccgtgaaccagcccgaggaggtgtggtgcgagagatgcgtgaccctggtgcagatgaaccacgccgccgccagaagattctaccagtacgcccacgagcacaccgcctgcaccaacatcgccaagctgatccacgtgatcagacactgcctgaacgcctgcatccagagagccgtgagagagccccccgaggacgaggaggaggaggacggcagagagaaggagaacgtgaccgtgctggacaagaccctgagcgtgaacgacgtggcctgcatggccggcctgctggagatcatcgtgatcctgtggaagagcatcgacagaagcatggagaacaacaaggaggccaagctgtacaccatcaacaagttcgccagcgtgctgcccgagtacctgaaggtgttcaaggacgacagatgcaagatccccctgttcatgctgatgagcttcatgcccgccagcgccgtgccccccttcagctgcggcgtgatcagcaccctgagaagcagagaggagggcgccgtggacaagagctactgcaccctgctggactgcctgtgcagctggggccaggtgggccacatcctggagctggtggacaactggctgcccaccgagcacgcccaggccaagagcaacaccgccagcaagggcagagtgcagatccacgacaccagacccgtgaagcccgagctggccctggtgtacatcgagtacctgctgacccaccccaagaacagagagtgcctgctgagcgcccccagaaagaagctgaaccacctgctgaaggccctggagaccagcaaggccgacctggagagcctgctgcagacccccggcggcaagcccagaggcttcagcgaggccgccgcccccagagccttcggcctgcactgcagactgagcatccacctgcagcacaagttctgcagcgagggcaaggtgtacctgagcatgctggaggacaccggcttctggctggagagcaagatcctgagcttcatccaggaccaggaggaggactacctgaagctgcacagagtgatctaccagcagatcatccagacctacctgaccgtgtgcaaggacgtggtgatggtgggcctgggcgaccaccagttccagatgcagctgctgcagagaagcctgggcatcatgcagaccgtgaagggcttcttctacgtgagcctgctgctggacatcctgaaggagatcaccggcagcagcctgatccagaagaccgacagcgacgaggaggtggccatgctgctggacaccgtgcagaaggtgttccagaagatgctggagtgcatcgccagaagcttcagaaagcagcccgaggagggcctgagactgctgtacagcgtgcagagacccctgcacgagttcatcaccgccgtgcagagcagacacaccgacacccccgtgcacagaggcgtgctgagcaccctgatcgccggccccgtggtggagatcagccaccagctgagaaaggtgagcgacgtggaggagctgaccccccccgagcacctgagcgacctgccccccttcagcagatgcctgatcggcatcatcatcaagagcagcaacgtggtgagaagcttcctggacgagctgaaggcctgcgtggccagcaacgacatcgagggcatcgtgtgcctgaccgccgccgtgcacatcatcctggtgatcaacgccggcaagcacaagagcagcaaggtgagagaggtggccgccaccgtgcacagaaagctgaagaccttcatggagatcaccctggaggaggacagcatcgagagatacgaggacctgctgtgctgccccggctgggccctgacccccggcctgctggacagcatctaccccagcgccagcgtgcccatcggctag

SEQ ID NO: 8807 - DNA, 3432 bp, Artificial Sequence; identical to SEQ ID NO: 8805
  Description of Artificial Sequence: Synthetic coding sequence

SEQ ID NO: 8808 - DNA, 2697 bp, Artificial Sequence
  Description of Artificial Sequence: Synthetic coding sequence
tgactggaggagagcggcgagatcaaggacatgctgctggagtgcttcatcaacatcaactacatcaagaaggaggagggcagaagattcctgagctgcctgttcaactggaacatcaacttcatcaagatgatccacggcaccatcaagaaccagctgcagggcctgcagaagagcctgatggtgtacatcgccgagatctacttcagagcctggaagaaggccagcggcaagatcctggaggccatcgagaacgactgcatccaggacttcatgttccacggcatccacctgcccagaagaagccccgtgcacagcaaggtgagagaggtgctgagctacttccaccaccagaagaaggtgagacagggcgtggaggagatgctgtacagactgtacaagcccatcctgtggagaggcctgaaggccagaaacagcgaggtgagaagcaacgccgccctgctgttcgtggaggccttccccatcagagaccccaacctgcacgccatcgagatggacagcgagatccagaagcagttcgaggagctgtacagcctgctggaggacccctaccccatggtgagaagcaccggcatcctgggcgtgtgcaagatcaccagcaagtactgggagatgatgccccccaccatcctgatcgacctgctgaagaaggtgaccggcgagctggccttcgacaccagcagcgccgacgtgagatgcagcgtgttcaagtgcctgcccatgatcctggacaacaagctgagccaccccctgctggagcagctgctgcccgccctgagatacagcctgcacgacaacagcgagaaggtgagagtggccttcgtggacatgctgctgaagatcaaggccgtgagagccgccaagttctggaagatctgccccatggagcacatcctggtgagactggagaccgacagcagacccgtgagcagaagactggtgagcctgatcttcaacagcttcctgcccgtgaaccagcccgaggaggtgtggtgcgagagatgcgtgaccctggtgcagatgaaccacgccgccgccagaagattctaccagtacgcccacgagcacaccgcctgcaccaacatcgccaagctgatccacgtgatcagacactgcctgaacgcctgcatccagagagccgtgagagagccccccgaggacgaggaggaggaggacggcagagagaaggagaacgtgaccgtgctggacaagaccctgagcgtgaacgacgtggcctgcatggccggcctgctggagatcatcgtgatcctgtggaagagcatcgacagaagcatggagaacaacaaggaggccaagctgtacaccatcaacaagttcgccagcgtgctgcccgagtacctgaaggtgttcaaggacgacagatgcaagatccccctgttcatgctgatgagcttcatgcccgccagcgccgtgccccccttcagctgcggcgtgatcagcaccctgagaagcagagaggagggcgccgtggacaagagctactgcaccctgctggactgcctgtgcagctggggccaggtgggccacatcctggagctggtggacaactggctgcccaccgagcacgcccaggccaagagcaacaccgccagcaagggcagagtgcagatccacgacaccagacccgtgaagcccgagctggccctggtgtacatcgagtacctgctgacccaccccaagaacagagagtgcctgctgagcgcccccagaaagaagctgaaccacctgctgaaggccctggagaccagcaaggccgacctggagagcctgctgcagacccccggcggcaagcccagaggcttcagcgaggccgccgcccccagagccttcggcctgcactgcagactgagcatccacctgcagcacaagttctgcagcgagggcaaggtgtacctgagcatgctggaggacaccggcttctggctggagagcaagatcctgagcttcatccaggaccaggaggaggactacctgaagctgcacagagtgatctaccagcagatcatccagacctacctgaccgtgtgcaaggacgtggtgatggtgggcctgggcgaccaccagttccagatgcagctgctgcagagaagcctgggcatcatgcagaccgtgaagggcttcttctacgtgagcctgctgctggacatcctgaaggagatcaccggcagcagcctgatccagaagaccgacagcgacgaggaggtggccatgctgctggacaccgtgcagaaggtgttccagaagatgctggagtgcatcgccagaagcttcagaaagcagcccgaggagggcctgagagtgagcgacgtggaggagctgaccccccccgagcacctgagcgacctgccccccttcagcagatgcctgatcggcatcatcatcaagagcagcaacgtggtgagaagcttcctggacgagctgaaggcctgcgtggccagcaacgacatcgagggcatcgtgtgcctgaccgccgccgtgcacatcatcctggtgatcaacgccggcaagcacaagagcagcaaggtgagagaggtggccgccaccgtgcacagaaagctgaagaccttcatggagatcaccctggaggaggacagcatcgagagattcctgtacgagagcagcagcagaaccctgggcgagctgctgaacagctag

SEQ ID NO: 8809 - DNA, 3471 bp, Artificial Sequence; identical to SEQ ID NO: 8806
  Description of Artificial Sequence: Synthetic coding sequence

SEQ ID NO: 8810 - DNA, 1794 bp, Artificial Sequence
  Description of Artificial Sequence: Synthetic coding sequence
atggagcacatcctggtgagactggagaccgacagcagacccgtgagcagaagactggtgagcctgatcttcaacagcttcctgcccgtgaaccagcccgaggaggtgtggtgcgagagatgcgtgaccctggtgcagatgaaccacgccgccgccagaagattctaccagtacgcccacgagcacaccgcctgcaccaacatcgccaagctgatccacgtgatcagacactgcctgaacgcctgcatccagagagccgtgagagagccccccgaggacgaggaggaggaggacggcagagagaaggagaacgtgaccgtgctggacaagaccctgagcgtgaacgacgtggcctgcatggccggcctgctggagatcatcgtgatcctgtggaagagcatcgacagaagcatggagaacaacaaggaggccaagctgtacaccatcaacaagttcgccagcgtgctgcccgagtacctgaaggtgttcaaggacgacagatgcaagatccccctgttcatgctgatgagcttcatgcccgccagcgccgtgccccccttcagctgcggcgtgatcagcaccctgagaagcagagaggagggcgccgtggacaagagctactgcaccctgctggactgcctgtgcagctggggccaggtgggccacatcctggagctggtggacaactggctgcccaccgagcacgcccaggccaagagcaacaccgccagcaagggcagagtgcagatccacgacaccagacccgtgaagcccgagctggccctggtgtacatcgagtacctgctgacccaccccaagaacagagagtgcctgctgagcgcccccagaaagaagctgaaccacctgctgaaggccctggagaccagcaaggccgacctggagagcctgctgcagacccccggcggcaagcccagaggcttcagcgaggccgccgcccccagagccttcggcctgcactgcagactgagcatccacctgcagcacaagttctgcagcgagggcaaggtgtacctgagcatgctggaggacaccggcttctggctggagagcaagatcctgagcttcatccaggaccaggaggaggactacctgaagctgcacagagtgatctaccagcagatcatccagacctacctgaccgtgtgcaaggacgtggtgatggtgggcctgggcgaccaccagttccagatgcagctgctgcagagaagcctgggcatcatgcagaccgtgaagggcttcttctacgtgagcctgctgctggacatcctgaaggagatcaccggcagcagcctgatccagaagaccgacagcgacgaggaggtggccatgctgctggacaccgtgcagaaggtgttccagaagatgctggagtgcatcgccagaagcttcagaaagcagcccgaggagggcctgagagtgagcgacgtggaggagctgaccccccccgagcacctgagcgacctgccccccttcagcagatgcctgatcggcatcatcatcaagagcagcaacgtggtgagaagcttcctggacgagctgaaggcctgcgtggccagcaacgacatcgagggcatcgtgtgcctgaccgccgccgtgcacatcatcctggtgatcaacgccggcaagcacaagagcagcaaggtgagagaggtggccgccaccgtgcacagaaagctgaagaccttcatggagatcaccctggaggaggacagcatcgagagattcctgtacgagagcagcagcagaaccctgggcgagctgctgaacagctag

SEQ ID NO: 8811 - DNA, 1716 bp, Artificial Sequence
  Description of Artificial Sequence: Synthetic coding sequence
atggagcacatcctggtgagactggagaccgacagcagacccgtgagcagaagactggtgagcctgatcttcaacagcttcctgcccgtgaaccagcccgaggaggtgtggtgcgagagatgcgtgaccctggtgcagatgaaccacgccgccgccagaagattctaccagtacgcccacgagcacaccgcctgcaccaacatcgccaagctgatccacgtgatcagacactgcctgaacgcctgcatccagagagccgtgagagagccccccgaggacgaggaggaggaggacggcagagagaaggagaacgtgaccgacgacagatgcaagatccccctgttcatgctgatgagcttcatgcccgccagcgccgtgccccccttcagctgcggcgtgatcagcaccctgagaagcagagaggagggcgccgtggacaagagctactgcaccctgctggactgcctgtgcagctggggccaggtgggccacatcctggagctggtggacaactggctgcccaccgagcacgcccaggccaagagcaacaccgccagcaagggcagagtgcagatccacgacaccagacccgtgaagcccgagctggccctggtgtacatcgagtacctgctgacccaccccaagaacagagagtgcctgctgagcgcccccagaaagaagctgaaccacctgctgaaggccctggagaccagcaaggccgacctggagagcctgctgcagacccccggcggcaagcccagaggcttcagcgaggccgccgcccccagagccttcggcctgcactgcagactgagcatccacctgcagcacaagttctgcagcgagggcaaggtgtacctgagcatgctggaggacaccggcttctggctggagagcaagatcctgagcttcatccaggaccaggaggaggactacctgaagctgcacagagtgatctaccagcagatcatccagacctacctgaccgtgtgcaaggacgtggtgatggtgggcctgggcgaccaccagttccagatgcagctgctgcagagaagcctgggcatcatgcagaccgtgaagggcttcttctacgtgagcctgctgctggacatcctgaaggagatcaccggcagcagcctgatccagaagaccgacagcgacgaggaggtggccatgctgctggacaccgtgcagaaggtgttccagaagatgctggagtgcatcgccagaagcttcagaaagcagcccgaggagggcctgagactgctgtacagcgtgcagagacccctgcacgagttcatcaccgccgtgcagagcagacacaccgacacccccgtgcacagaggcgtgctgagcaccctgatcgccggccccgtggtggagatcagccaccagctgagaaaggtgagcgacgtggaggagctgaccccccccgagcacctgagcgacctgccccccttcagcagatgcctgatcggcatcatcatcaagagcagcaacgtggtgagaagcttcctggacgagctgaaggcctgcgtggccagcaacgacatcgagggcatcgtgtgcctgaccgccgccgtgcacatcatcctggtgatcaacgccggcaagcacaagagcagcaaggtgagagaggtggccgccaccgtgcacagaaagctgaagaccttcatggagatcaccctggaggaggacagcatcgagagaatctag

SEQ ID NO: 8812 - DNA, 1821 bp, Artificial Sequence
  Description of Artificial Sequence: Synthetic coding sequence
atggaggacgtggaggccagattcgcccacctgctgcagcccatcagagacctgaccaagaactgggaggtggacgtggccgcccagctgggcgagtacctggaggagctggaccagatctgcatcagcttcgacgagggcaagaccaccatgaacttcatcgaggccgccctgctgatccagggcagcgcctgcgtgtacagcaagaaggtggagtacctgtacagcctggtgtaccaggccctggacttcatcagcggcaagagaagagccaagcagctgagcagcgtgcaggaggacagagccaacggcgtggccagcagcggcgtgccccaggaggccgagaacgagttcctgagcctggacgacttccccgacagcagaaccaacgtggacctgaagaacgaccagacccccagcgaggtgctgatcatccccctgctgcccatggccctggtggcccccgacgagatggagaagaacaacaaccccctgtacagcagacagggcgaggtgctggccagcagaaaggacttcagaatgaacacctgcgtgccccaccccagaggcgccttcatgctggagcccgagggcatgagccccatggagcccgccggcgtgagccccatgcccggcacccagaaggacaccggcagaaccgaggagcagcccatggaggtgagcgtgtgcagaagccccgtgcccgccctgggcttcagccaggagcccggccccagccccgagggccccatgcccctgggcggcggcgaggacgaggacgccgaggaggccgtggagctgcccgaggccagcgcccccaaggccgccctggagcccaaggagagcagaagcccccagcagagcgccgccctgcccagaagatacatgctgagagagagagagggcgcccccgagcccgccagctgcgtgaaggagacccccgacccctggcagagcctggaccccttcgacagcctggagagcaagcccttcaagaagggcagaccctacagcgtgcccccctgcgtggaggaggccctgggccagaagagaaagagaaagggcgccgccaagctgcaggacttccaccagtggtacctggccgcctacgccgaccacgccgacagcagaagactgagaagaaagggccccagcttcgccgacatggaggtgctgtactggacccacgtgaaggagcagctggagaccctgagaaagctgcagagaagagaggtggccgagcagtggctgagacccgccgaggaggaccacctggaggacagcctggaggacctgggcgccgccgccgacgacttcctggagcccgaggagtacatggagcccgagggcgccgaccccagagaggccgccgacctggacgccgtgcccatgagcctgagctacgaggagctggtgagaagaaacgtggagctgttcatcgccaccagccagaagttcgtgcaggagaccgagctgagccagagaatcagagactgggaggacaccgtgcagcccctgctgcaggagcaggagcagcacgtgcccttcgacatccacacctacggcgaccagctggtgagcagattcccccagctgaacgagtggtgccccttcgccgagctggtggccggccagcccgccttcgaggtgtgcagaagcatgctggccagcctgcagctggccaacgactacaccgtggagatcacccagcagcccggcctggagatggccgtggacaccatgagcctgagactgctgacccaccagagagcccacaagagattccagacctacgccgcccccagcatggcccagccctag

SEQ ID NO: 8813 - DNA, 900 bp, Artificial Sequence
  Description of Artificial Sequence: Synthetic coding sequence
atggaggacgtggaggccagattcgcccacctgctgcagcccatcagagacctgaccaagaactgggaggtggacgtggccgcccagctgggcgagtacctggaggagctggaccagatctgcatcagcttcgacgagggcaagaccaccatgaacttcatcgaggccgccctgctgatccagggcagcgcctgcgtgtacagcaagaaggtggagtacctgtacagcctggtgtaccaggccctggacttcatcagcggcaagagaagagccaagcagctgagcagcgtgcaggaggacagagccaacggcgtggccagcagcggcgtgccccaggaggccgagaacgagttcctgagcctggacgacttccccgacagcagaaccaacgtggacctgaagaacgaccagacccccagcgaggtgctgatcatccccctgctgcccatggccctggtggcccccgacgagatggagaagaacaacaaccccctgtacagcagacagggcgaggtgctggccagcagaaaggacttcagaatgaacacctgcgtgccccaccccagaggcgccttcatgctggagcccgagggcatgagccccatggagcccgccggcgtgagccccatgcccggcacccagaaggacaccggcagaaccgaggagcagcccatggaggtgagcgtgtgcagaagccccgtgcccgccctgggcttcagccaggagcccggccccagccccgagggccccatgcccctgggcggcggcgaggacgaggacgccgaggaggccgtggagctgcccgaggccagcgcccccaaggccgccctggagcccaaggagagcagaagcccccagcaggtgggccccacctggagacccgccgagcccgagctgtag

SEQ ID NO: 8814 - DNA, 1818 bp, Artificial Sequence
  Description of Artificial Sequence: Synthetic coding sequence
atggaggacgtggaggccagattcgcccacctgctgcagcccatcagagacctgaccaagaactgggaggtggacgtggccgcccagctgggcgagtacctggaggagctggaccagatctgcatcagcttcgacgagggcaagaccaccatgaacttcatcgaggccgccctgctgatccagggcagcgcctgcgtgtacagcaagaaggtggagtacctgtacagcctggtgtaccaggccctggacttcatcagcggcaagagaagagccaagcagctgagcagcgtgcaggaggacagagccaacggcgtggccagcagcggcgtgccccaggaggccgagaacgagttcctgagcctggacgacttccccgacagcagaaccaacgtggacctgaagaacgaccagacccccagcgaggtgctgatcatccccctgctgcccatggccctggtggcccccgacgagatggagaagaacaacaaccccctgtacagcagacagggcgaggtgctggccagcagaaaggacttcagaatgaacacctgcgtgccccaccccagaggcgccttcatgctggagcccgagggcatgagccccatggagcccgccggcgtgagccccatgcccggcacccagaaggacaccggcagaaccgaggagcagcccatggaggtgagcgtgtgcagaagccccgtgcccgccctgggcttcagccaggagcccggccccagccccgagggccccatgcccctgggcggcggcgaggacgaggacgccgaggaggccgtggagctgcccgaggccagcgcccccaaggccgccctggagcccaaggagagcagaagcccccagcagagcgccgccctgcccagaagatacatgctgagagagagagagggcgcccccgagcccgccagctgcgtgaaggagacccccgacccctggcagagcctggaccccttcgacagcctggagagcaagcccttcaagaagggcagaccctacagcgtgcccccctgcgtggaggaggccctgggccagaagagaaagagaaagggcgccgccaagctgcaggacttccaccagtggtacctggccgcctacgccgaccacgccgacagcagaagactgagaagaaagggccccagcttcgccgacatggaggtgctgtactggacccacgtgaaggagcagctggagaccctgagaaagctgcagagaagagaggtggccgagcagtggctgagacccgccgaggaggaccacctggaggacagcctggaggacctgggcgccgccgacgacttcctggagcccgaggagtacatggagcccgagggcgccgaccccagagaggccgccgacctggacgccgtgcccatgagcctgagctacgaggagctggtgagaagaaacgtggagctgttcatcgccaccagccagaagttcgtgcaggagaccgagctgagccagagaatcagagactgggaggacaccgtgcagcccctgctgcaggagcaggagcagcacgtgcccttcgacatccacacctacggcgaccagctggtgagcagattcccccagctgaacgagtggtgccccttcgccgagctggtggccggccagcccgccttcgaggtgtgcagaagcatgctggccagcctgcagctggccaacgactacaccgtggagatcacccagcagcccggcctggagatggccgtggacaccatgagcctgagactgctgacccaccagagagcccacaagagattccagacctacgccgcccccagcatggcccagccctag

SEQ ID NO: 8815 - DNA, 801 bp, Artificial Sequence
  Description of Artificial Sequence: Synthetic coding sequence
atgcagggcagcaccagaagaatgggcgtgatgaccgacgtgcacagaagattcctgcagctgctgatgacccacggcgtgctggaggagtgggacgtgaagagactgcagacccactgctacaaggtgcacgacagaaacgccaccgtggacaagctggaggacttcatcaacaacatcaacagcgtgctggagagcctgtacatcgagatcaagagaggcgtgaccgaggacgacggcagacccatctacgccctggtgaacctggccaccaccagcatcagcaagatggccaccgacttcgccgagaacgagctggacctgttcagaaaggccctggagctgatcatcgacagcgagaccggcttcgccagcagcaccaacatcctgaacctggtggaccagctgaagggcaagaagatgagaaagaaggaggccgagcaggtgctgcagaagttcgtgcagaacaagtggctgatcgagaaggagggcgagttcaccctgcacggcagagccatcctggagatggagcagtacatcagagagacctaccccgacgccgtgaagatctgcaacatctgccacagcctgctgatccagggccagagctgcgagacctgcggcatcagaatgcacctgccctgcgtggccaagtacttccagagcaacgccgagcccagatgcccccactgcaacgactactggccccacgagatccccaaggtgttcgaccccgagaaggagagagagagcggcgtgctgaagagcaacaagaagagcctgagaagcagacagcactag

SEQ ID NO: 8816 - DNA, 744 bp, Artificial Sequence
  Description of Artificial Sequence: Synthetic coding sequence
atgcccggcagaagcagcagcaacagcggcagcaccggcttcatcagcttcagcggcgtggagagcgccctgagcagcctgaagaacttccaggcctgcatcaacagcggcatggacaccgccagcagcgtggccctggacctggtggagagccagaccgaggtgagcagcgagtacagcatggacaaggccatggtggagttcgccaccctggacagacagctgaaccactacgtgaaggccgtgcagagcaccatcaaccacgtgaaggaggagagacccgagaagatccccgacctgaagctgctggtggagaagaagttcctggccctgcagagcaagaacagcgacgccgacttccagaacaacgagaagttcgtgcagttcaagcagcagctgaaggagctgaagaagcagtgcggcctgcaggccgacagagaggccgacggcaccgagggcgtggacgaggacatcatcgtgacccagagccagaccaacttcacctgccccatcaccaaggaggagatgaagaagcccgtgaagaacaaggtgtgcggccacacctacgaggaggacgccatcgtgagaatgatcgagagcagacagaagagaaagaagaaggcctactgcccccagatcggctgcagccacaccgacatcagaaagagcgacctgatccaggacgaggccctgagaagagccatcgagaaccacaacaagaagagacacagacacagcgagtag

SEQ ID NO: 8817 - DNA, 582 bp, Artificial Sequence
  Description of Artificial Sequence: Synthetic coding sequence
atgcccggcagaagcagcagcaacagcggcagcaccggcttcatcagcttcagcggcgtggagagcgccctgagcagcctgaagaacttccaggcctgcatcaacagcggcatggacaccgccagcagcgtggccctggacctggtggagagccagaccgaggtgagcagcgagtacagcatggacaaggccatggtggagttcgccaccctggacagacagctgaaccactacgtgaaggccgtgcagagcaccatcaaccacgtgaaggaggagagacccgagaagatccccgacctgaagctgctggtggagaagaagttcctggccctgcagagcaagaacagcgacgccgacttccagaacaacgagaagttcgtgcagttcaagcagcagctgaaggagctgaagaagcagtgcggcctgcaggccgacagagaggccgacggcaccgagggcgtggacgaggacatcatcgtgacccagagccagaccaacttcacctgccccatcaccaaggaggagatgaagaagcccgtgaagaacaaggtgtgcggccacacctacgaggaggacgcctag

SEQ ID NO: 8818 - DNA, 138 bp, Artificial Sequence
  Description of Artificial Sequence: Synthetic coding sequence
atgcccggcagaagcagcagcaacagcggcagcaccggcttcatcagcttcagcggcgtggagagcgccctgagcagcctgaagaacttccaggcctgcatcaacagcggcatggacaccgccagcagcgtggcctag

SEQ ID NO: 8819 - DNA, 744 bp, Artificial Sequence; identical to SEQ ID NO: 8816
  Description of Artificial Sequence: Synthetic coding sequence

SEQ ID NO: 8820 - DNA, 420 bp, Artificial Sequence
  Description of Artificial Sequence: Synthetic coding sequence
atgcccggcagaagcagcagcaacagcggcagcaccggcttcatcagcttcagcggcgtggagagcgccctgagcagcctgaagaacttccaggcctgcatcaacagcggcatggacaccgccagcagcgtggccctggacctggtggagagccagaccgaggtgagcagcgagtacagcatggacaaggccatggtggagttcgccaccctggacagacagctgaaccactacgtgaaggccgtgcagagcaccatcaaccacgtgaaggaggagagacccgagaagatccccgacctgaagctgctggtggagaagaagttcctggccctgcagagcaagaacagcgacgccgacttccagaacaacgagaagttcgtgcagttcaagcagcagctgaaggagctgaagaagcagtag

SEQ ID NO: 8821 - DNA, 705 bp, Artificial Sequence
  Description of Artificial Sequence: Synthetic coding sequence
atgctggacggcagacagagaagaggcagcaacgcccccaccagcgacatgcccggcaccaccctgaacagatacggcagaacctggcccagatggggctggctgtggacccccaccggcggcgccctgagaaagagaaaggtgaaggccatggaggtggacatcgaggagagacccaaggagctggtgagaaagccctacgtgctgaacgacctggaggccgaggccagcctgcccgagaagaagggcaacaccctgagcagagacctgatcgactacgtgagatacatggtggagaaccacggcgaggactacaaggccatggccgtgatgagaagaatcaccatcaagatcccccagaacagattcggcgtgagaagcaccagcatcaacgccttcacccagcagagcggcaagaccagcagcatcctgtgcagaagaggcagatggagatggagcgactggttcaccagccagctgccccaggccgaggccagccccggccccgtgaagctggagcccggctgcaaggccagaagatgctgcgtggcccccgaggagctggccagaagccacggcatcagaagactgcacgtgcacacccccagaagcggcgagggcaccgtgctgagaggcagcaacctgtacagcagcggcggcagcagaaagagccagaacctgctgttcagcggctgggtgatgtag

SEQ ID NO: 8822 - DNA, 537 bp, Artificial Sequence
  Description of Artificial Sequence: Synthetic coding sequence
atgcccaaggccaagggcaagaccagaagacagaagttcggctacagcgtgaacagaaagagactgaacagaaacgccagaagaaaggccgcccccagaatcgagtgcagccacatcagacacgcctgggaccacgccaagagcgtgagacagaacctggccgagatgggcctggccgtggaccccaacagagccgtgcccctgagaaagagaaaggtgaaggccatggaggtggacatcgaggagagacccaaggagctggtgagaaagccctacgtgctgaacgacctggaggccgaggccagcctgcccgagaagaagggcaacaccctgagcagagacctgatcgactacgtgagatacatggtggagaaccacggcgaggactacaaggccatggccagagacgagaagaactactaccaggacacccccaagcagatcagaagcaagatcaacgtgtacaagagattctaccccgccgagtggcaggacttcctggacagcctgcagaagagaaagatggaggtggagtag

SEQ ID NO: 8823 - DNA, 696 bp, Artificial Sequence
  Description of Artificial Sequence: Synthetic coding sequence
atgcccaaggccaagggcaagaccagaagacagaagttcggctacagcgtgaacagaaagagactgaacagaaacgccagaagaaaggccgcccccagaatcgagtgcagccacatcagacacgcctgggaccacgccaagagcgtgagacagaacctggccgagatgggcctggccgtggaccccaacagagccgtgcccctgagaaagagaaaggtgaaggccatggaggtggacatcgaggagagacccaaggagctggtgagaaagccctacgtgctgaacgacctggaggccgaggccagcctgcccgagaagaagggcaacaccctgagcagagacctgatcgactacgtgagatacatggtggagaaccacggcgaggactacaagcagagcggcaagaccagcagcatcctgtgcagaagaggcagatggagatggagcgactggttcaccagccagctgccccaggccgaggccagccccggccccgtgaagctggagcccggctgcaaggccagaagatgctgcgtggcccccgaggagctggccagaagccacggcatcagaagactgcaccacgtgcacacccccagaagcggcgagggcaccgtgctgagaggcagcaacctgtacagcagcggcggcagcagaaagagccagaacctgctgttcagcggctgggtgatgtag

SEQ ID NO: 8824 - DNA, 711 bp, Artificial Sequence
  Description of Artificial Sequence: Synthetic coding sequence
atgcccaaggccaagggcaagaccagaagacagaagttcggctacagcgtgaacagaaagagactgaacagaaacgccagaagaaaggccgcccccagaatcgagtgcagccacatcagacacgcctgggaccacgccaagagcgtgagacagaacctggccgagatgggcctggccgtggaccccaacagagccgtgcccctgagaaagagaaaggtgaaggccatggaggtggacatcgaggagagacccaaggagctggtgagaaagccctacgtgctgaacgacctggaggccgaggccagcctgcccgagaagaagggcaacaccctgagcagagacctgatcgactacgtgagatacatggtggagaaccacggcgaggactacaagagcggcaagaccagcagcatcctgtgcagaagaggcagatggagatggagcgactggttcaccagccagctgccccaggccgaggccagccccggccccgtgaagctggagcccggctgcaaggccagaagatgctgcgtggcccccgaggagctggccagaagccacggcatcagaagactgcacaccagagcccacagccccctgtggggcagaaactgcagccagagactgcagttcatcttcatctggggcttcaccgagaagcccgagcccgccgtgttcagagtgggcgacgtgaacatcgtgtgcacctag

SEQ ID NO: 8825 - DNA, 2439 bp, Artificial Sequence
  Description of Artificial Sequence: Synthetic coding sequence
atgggcagaaagctggaccccaccaaggagaagagaggccccggcagaaaggccagaaagcagaagggcgccgagaccgagctggtgagattcctgcccgccgtgagcgacgagaacagcaagagactgagcagcagagccagaaagagagccgccaagagaagactgggcagcgtggaggcccccaagaccaacaagagccccgaggccaagcccctgcccggcaagctgcccaagggcatcagcgccggcgccgtgcagaccgccggcaagaagggcccccagagcctgttcaacgcccccagaggcaagaagagacccgcccccggcagcgacgaggaggaggaggaggaggacagcgaggaggacggcatggtgaaccacggcgacctgtggggcagcgaggacgacgccgacaccgtggacgactacggcgccgacagcaacagcgaggacgaggaggagggcgaggccctgctgcccatcgagagagccgccagaaagcagaaggccagagaggccgccgccggcatccagtggagcgaggaggagaccgaggacgaggaggaggagaaggaggtgacccccgagagcggcccccccaaggtggaggaggccgacggcggcctgcagatcaacgtggacgaggagcccttcgtgctgccccccgccggcgagatggagcaggacgcccaggcccccgacctgcagagagtgcacaagagaatccaggacatcgtgggcatcctgagagacttcggcgcccagagagaggagggcagaagcagaagcgagtacctgaacagactgaagaaggacctggccatctactacagctacggcgacttcctgctgggcaagctgatggacctgttccccctgagcgagctggtggagttcctggaggccaacgaggtgcccagacccgtgaccctgagaaccaacaccctgaagaccagaagaagagacctggcccaggccctgatcaacagaggcgtgaacctggaccccctgggcaagtggagcaagaccggcctggtggtgtacgacagcagcgtgcccatcggcgccacccccgagtacctggccggccactacatgctgcagggcgccagcagcatgctgcccgtgatggccctggccccccaggagcacgagagaatcctggacatgtgctgcgcccccggcggcaagaccagctacatggcccagctgatgaagaacaccggcgtgatcctggccaacgacgccaacgccgagagactgaagagcgtggtgggcaacctgcacagactgggcgtgaccaacaccatcatcagccactacgacggcagacagttccccaaggtggtgggcggcttcgacagagtgctgctggacgccccctgcagcggcaccggcgtgatcagcaaggaccccgccgtgaagaccaacaaggacgagaaggacatcctgagatgcgcccacctgcagaaggagctgctgctgagcgccatcgacagcgtgaacgccaccagcaagaccggcggctacctggtgtactgcacctgcagcatcaccgtggaggagaacgagtgggtggtggactacgccctgaagaagagaaacgtgagactggtgcccaccggcctggacttcggccaggagggcttcaccagattcagagagagaagattccaccccagcctgagaagcaccagaagattctacccccacacccacaacatggacggcttcttcatcgccaagttcaagaagttcagcaacagcatcccccagagccagaccggcaacagcgagaccgccacccccaccaacgtggacctgccccaggtgatccccaagagcgagaacagcagccagcccgccaagaaggccaagggcgccgccaagaccaagcagcagctgcagaagcagcagcaccccaagaaggccagcttccagaagctgaacggcatcagcaagggcgccgacagcgagctgagcaccgtgcccagcgtgaccaagacccaggccagcagcagcttccaggacagcagccagcccgccggcaaggccgagggcatcagagagcccaaggtgaccggcaagctgaagcagagaagccccaagctgcagagcagcaagaaggtggccttcctgagacagaacgccccccccaagggcaccgacacccagacccccgccgtgctgagccccagcaagacccaggccaccctgaagcccaaggaccaccaccagcccctgggcagagccaagggcgtggagaagcagcagctgcccgagcagcccttcgagaaggccgccttccagaagcagaacgacacccccaagggcccccagccccccaccgtgagccccatcagaagcagcagacccccccccgccaagagaaagaagagccagagcagaggcaacagccagctgctgctgagctag

SEQ ID NO: 8826 - DNA, 2427 bp, Artificial Sequence
  Description of Artificial Sequence: Synthetic coding sequence
atgggcagaaagctggaccccaccaaggagaagagaggccccggcagaaaggccagaaagcagaagggcgccgagaccgagctggtgagattcctgcccgccgtgagcgacgagaacagcaagagactgagcagcagagccagaaagagagccgccaagagaagactgggcagcgtggaggcccccaagaccaacaagagccccgaggccaagcccctgcccggcaagctgcccaagggcgccgtgcagaccgccggcaagaagggcccccagagcctgttcaacgcccccagaggcaagaagagacccgcccccggcagcgacgaggaggaggaggaggaggacagcgaggaggacggcatggtgaaccacggcgacctgtggggcagcgaggacgacgccgacaccgtggacgactacggcgccgacagcaacagcgaggacgaggaggagggcgaggccctgctgcccatcgagagagccgccagaaagcagaaggccagagaggccgccgccggcatccagtggagcgaggaggagaccgaggacgaggaggaggagaaggaggtgacccccgagagcggcccccccaaggtggaggaggccgacggcggcctgcagatcaacgtggacgaggagcccttcgtgctgccccccgccggcgagatggagcaggacgcccaggcccccgacctgcagagagtgcacaagagaatccaggacatcgtgggcatcctgagagacttcggcgcccagagagaggagggcagaagcagaagcgagtacctgaacagactgaagaaggacctggccatctactacagctacggcgacttcctgctgggcaagctgatggacctgttccccctgagcgagctggtggagttcctggaggccaacgaggtgcccagacccgtgaccctgagaaccaacaccctgaagaccagaagaagagacctggcccaggccctgatcaacagaggcgtgaacctggaccccctgggcaagtggagcaagaccggcctggtggtgtacgacagcagcgtgcccatcggcgccacccccgagtacctggccggccactacatgctgcagggcgccagcagcatgctgcccgtgatggccctggccccccaggagcacgagagaatcctggacatgtgctgcgcccccggcggcaagaccagctacatggcccagctgatgaagaacaccggcgtgatcctggccaacgacgccaacgccgagagactgaagagcgtggtgggcaacctgcacagactgggcgtgaccaacaccatcatcagccactacgacggcagacagttccccaaggtggtgggcggcttcgacagagtgctgctggacgccccctgcagcggcaccggcgtgatcagcaaggaccccgccgtgaagaccaacaaggacgagaaggacatcctgagatgcgcccacctgcagaaggagctgctgctgagcgccatcgacagcgtgaacgccaccagcaagaccggcggctacctggtgtactgcacctgcagcatcaccgtggaggagaacgagtgggtggtggactacgccctgaagaagagaaacgtgagactggtgcccaccggcctggacttcggccaggagggcttcaccagattcagagagagaagattccaccccagcctgagaagcaccagaagattctacccccacacccacaacatggacggcttcttcatcgccaagttcaagaagttcagcaacagcatcccccagagccagaccggcaacagcgagaccgccacccccaccaacgtggacctgccccaggtgatccccaagagcgagaacagcagccagcccgccaagaaggccaagggcgccgccaagaccaagcagcagctgcagaagcagcagcaccccaagaaggccagcttccagaagctgaacggcatcagcaagggcgccgacagcgagctgagcaccgtgcccagcgtgaccaagacccaggccagcagcagcttccaggacagcagccagcccgccggcaaggccgagggcatcagagagcccaaggtgaccggcaagctgaagcagagaagccccaagctgcagagcagcaagaaggtggccttcctgagacagaacgccccccccaagggcaccgacacccagacccccgccgtgctgagccccagcaagacccaggccaccctgaagcccaaggaccaccaccagcccctgggcagagccaagggcgtggagaagcagcagctgcccgagcagcccttcgagaaggccgccttccagaagcagaacgacacccccaagggcccccagccccccaccgtgagccccatcagaagcagcagacccccccccgccaagagaaagaagagccagagcagaggcaacagccagctgctgctgagctag

SEQ ID NO: 8827 - DNA, 2439 bp, Artificial Sequence; identical to SEQ ID NO: 8825
  Description of Artificial Sequence: Synthetic coding sequence

SEQ ID NO: 8828 - DNA, 2427 bp, Artificial Sequence; identical to SEQ ID NO: 8826
  Description of Artificial Sequence: Synthetic coding sequence

SEQ ID NO: 8829 - DNA, 2538 bp, Artificial Sequence
  Description of Artificial Sequence: Synthetic coding sequence
atgggcagaaagctggaccccaccaaggagaagagaggccccggcagaaaggccagaaagcagaagggcgccgagaccgagctggtgagattcctgcccgccgtgagcgacgagaacagcaagagactgagcagcagagccagaaagagagccgccaagagaagactgggcagcgtggaggcccccaagaccaacaagagccccgaggccaagcccctgcccggcaagctgcccaagggcatcagcgccggcgccgtgcagaccgccggcaagaagggcccccagagcctgttcaacgcccccagaggcaagaagagacccgcccccggcagcgacgaggaggaggaggaggaggacagcgaggaggacggcatggtgaaccacggcgacctgtggggcagcgaggacgacgccgacaccgtggacgactacggcgccgacagcaacagcgaggacgaggaggagggcgaggccgccggcgtgcagtggctgggcctgggcagcctgcagccccccccccccggcttcaagcagttcagctgcctgagcttccccagcagctgggacctgcagctgctgcccatcgagagagccgccagaaagcagaaggccagagaggccgccgccggcatccagtggagcgaggaggagaccgaggacgaggaggaggagaaggaggtgacccccgagagcggcccccccaaggtggaggaggccgacggcggcctgcagatcaacgtggacgaggagcccttcgtgctgccccccgccggcgagatggagcaggacgcccaggcccccgacctgcagagagtgcacaagagaatccaggacatcgtgggcatcctgagagacttcggcgcccagagagaggagggcagaagcagaagcgagtacctgaacagactgaagaaggacctggccatctactacagctacggcgacttcctgctgggcaagctgatggacctgttccccctgagcgagctggtggagttcctggaggccaacgaggtgcccagacccgtgaccctgagaaccaacaccctgaagaccagaagaagagacctggcccaggccctgatcaacagaggcgtgaacctggaccccctgggcaagtggagcaagaccggcctggtggtgtacgacagcagcgtgcccatcggcgccacccccgagtacctggccggccactacatgctgcagggcgccagcagcatgctgcccgtgatggccctggccccccaggagcacgagagaatcctggacatgtgctgcgcccccggcggcaagaccagctacatggcccagctgatgaagaacaccggcgtgatcctggccaacgacgccaacgccgagagactgaagagcgtggtgggcaacctgcacagactgggcgtgaccaacaccatcatcagccactacgacggcagacagttccccaaggtggtgggcggcttcgacagagtgctgctggacgccccctgcagcggcaccggcgtgatcagcaaggaccccgccgtgaagaccaacaaggacgagaaggacatcctgagatgcgcccacctgcagaaggagctgctgctgagcgccatcgacagcgtgaacgccaccagcaagaccggcggctacctggtgtactgcacctgcagcatcaccgtggaggagaacgagtgggtggtggactacgccctgaagaagagaaacgtgagactggtgcccaccggcctggacttcggccaggagggcttcaccagattcagagagagaagattccaccccagcctgagaagcaccagaagattctacccccacacccacaacatggacggcttcttcatcgccaagttcaagaagttcagcaacagcatcccccagagccagaccggcaacagcgagaccgccacccccaccaacgtggacctgccccaggtgatccccaagagcgagaacagcagccagcccgccaagaaggccaagggcgccgccaagaccaagcagcagctgcagaagcagcagcaccccaagaaggccagcttccagaagctgaacggcatcagcaagggcgccgacagcgagctgagcaccgtgcccagcgtgaccaagacccaggccagcagcagcttccaggacagcagccagcccgccggcaaggccgagggcatcagagagcccaaggtgaccggcaagctgaagcagagaagccccaagctgcagagcagcaagaaggtggccttcctgagacagaacgccccccccaagggcaccgacacccagacccccgccgtgctgagccccagcaagacccaggccaccctgaagcccaaggaccaccaccagcccctgggcagagccaagggcgtggagaagcagcagctgcccgagcagcccttcgagaaggccgccttccagaagcagaacgacacccccaagggcccccagccccccaccgtgagccccatcagaagcagcagacccccccccgccaagagaaagaagagccagagcagaggcaacagccagctgctgctgagctag

SEQ ID NO: 8830 - DNA, 1887 bp, Artificial Sequence
  Description of Artificial Sequence: Synthetic coding sequence
atgggcagaaagctggaccccaccaaggagaagagaggccccggcagaaaggccagaaagcagaagggcgccgagaccgagctggtgagattcctgcccgccgtgagcgacgagaacagcaagagactgagcagcagagccagaaagagagccgccaagagaagactgggcagcgtggaggcccccaagaccaacaagagccccgaggccaagcccctgcccggcaagctgcccaagggcgccgtgcagaccgccggcaagaagggcccccagagcctgttcaacgcccccagaggcaagaagagacccgcccccggcagcgacgaggaggaggaggaggaggacagcgaggaggacggcatggtgaaccacggcgacctgtggggcagcgaggacgacgccgacaccgtggacgactacggcgccgacagcaacagcgaggacgaggaggagggcgaggccctgctgcccatcgagagagccgccagaaagcagaaggccagagaggccgccgccggcatccagtggagcgaggaggagaccgaggacgaggaggaggagaaggaggtgacccccgagagcggcccccccaaggtggaggaggccgacggcggcctgcagatcaacgtggacgaggagcccttcgtgctgccccccgccggcgagatggagcaggacgcccaggcccccgacctgcagagagtgcacaagagaatccaggacatcgtgggcatcctgagagacttcggcgcccagagagaggagggcagaagcagaagcgagtacctgaacagactgaagaaggacctggccatctactacagctacggcgacttcctgctgggcaagctgatggacctgttccccctgagcgagctggtggagttcctggaggccaacgaggtgcccagacccgtgaccctgagaaccaacaccctgaagaccagaagaagagacctggcccaggccctgatcaacagaggcgtgaacctggaccccctgggcaagtggagcaagaccggcctggtggtgtacgacagcagcgtgcccatcggcgccacccccgagtacctggccggccactacatgctgcagggcgccagcagcatgctgcccgtgatggccctggccccccaggagcacgagagaatcctggacatgtgctgcgcccccggcggcaagaccagctacatggcccagctgatgaagaacaccggcgtgatcctggccaacgacgccaacgccgagagactgaagagcgtggtgggcaacctgcacagactgggcgtgaccaacaccatcatcagccactacgacggcagacagttccccaaggtggtgggcggcttcgacagagtgctgctggacgccccctgcagcggcaccggcgtgatcagcaaggaccccgccgtgaagaccaacaaggacgagaaggacatcctgagatgcgcccacctgcagaaggagctgctgctgagcgccatcgacagcgtgaacgccaccagcaagaccggcggctacctggtgtactgcacctgcagcatcaccgtggaggagaacgagtgggtggtggactacgccctgaagaagagaaacgtgagactggtgcccaccggcctggacttcggccaggagggcttcaccagattcagagagagaagattccaccccagcctgagaagcaccagaagattctacccccacacccacaacatggacggcttcttcatcgccaagttcaagaagttcagcaacagcatcccccagagccagaccgacggcgtgctgctgtgcagaagcggctggaccgccgtggtgcagagccagctgatcgccaccagcaccttccaggtgcaggccatcctggtgccccagacccccaagtag

SEQ ID NO: 8831 - DNA, 582 bp, Artificial Sequence
  Description of Artificial Sequence: Synthetic coding sequence
atggccctgagcaccgactacgccctgagaaccggcgccttcgagcccgccgaggccagcgtgaacccccaggacctgcagggcagcctgcaggagctgaaggagagagccctgagcagatacaacctggtgagaggccagggccccgagagactggtgagcggcagcgacgacttcaccctgttcctgtggagccccgccgaggacaagaagcccctgaccagaatgaccggccaccaggccctgatcaaccaggtgctgttcagccccgacagcagaatcgtggccagcgccagcttcgacaagagcatcaagctgtgggacggcagaaccggcaagtacctggccagcctgagaggccacgtggccgccgtgtaccagatcgcctggagcgccgacagcagactgctggtgagcggcagcagcgacagcaccctgaaggtgtgggacgtgaaggcccagaagctggccatggacctgcccggccacgccgacgaggtgtacgccgtggactggagccccgacggccagagagtggccagcggcggcaaggacaagtgcctgagaatctggagaagatag

SEQ ID NO: 8832 - DNA, 915 bp, Artificial Sequence
  Description of Artificial Sequence: Synthetic coding sequence
tgaagcagcaaggacggcagcgtgagaatctgggacaccaccgccggcagatgcgagagaatcctgaccggccacacccagagcgtgacctgcctgagatggggcggcgacggcctgctgtacagcgccagccaggacagaaccatcaaggtgtggagagcccacgacggcgtgctgtgcagaaccctgcagggccacggccactgggtgaacaccatggccctgagcaccgactacgccctgagaaccggcgccttcgagcccgccgaggccagcgtgaacccccaggacctgcagggcagcctgcaggagctgaaggagagagccctgagcagatacaacctggtgagaggccagggccccgagagactggtgagcggcagcgacgacttcaccctgttcctgtggagccccgccgaggacaagaagcccctgaccagaatgaccggccaccaggccctgatcaaccaggtgctgttcagccccgacagcagaatcgtggccagcgccagcttcgacaagagcatcaagctgtgggacggcagaaccggcaaggacgacttccacagcgtgacctggtgcagcagcggcagcagcgccgccgccagaagctggctgatcaccaccagcgccagctgggtgcaggtgatcctgctgccccagccccccagatacctggccagcctgagaggccacgtggccgccgtgtaccagatcgcctggagcgccgacagcagactgctggtgagcggcagcagcgacagcaccctgaaggtgtgggacgtgaaggcccagaagctggccatggacctgcccggccacgccgacgaggtgtacgccgtggactggagccccgacggccagagagtggccagcggcggcaaggacaagtgcctgagaatctggagaagatag

SEQ ID NO: 8833 - DNA, 1458 bp, Artificial Sequence
  Description of Artificial Sequence: Synthetic coding sequence
atggccgccgccgtgcccgacgaggccgtggccagagacgtgcagagactgctggtgcagttccaggacgagggcggccagctgctgggcagccccttcgacgtgcccgtggacatcacccccgacagactgcagctggtgtgcaacgccctgctggcccaggaggaccccctgcccctggccttcttcgtgcacgacgccgagatcgtgagcagcctgggcaagaccctggagagccaggccgtggagaccgagaaggtgctggacatcatctaccagccccaggccatcttcagagtgagagccgtgaccagatgcaccagcagcctggagggccacagcgaggccgtgatcagcgtggccttcagccccaccggcaagtacctggccagcggcagcggcgacaccaccgtgagattctgggacctgagcaccgagaccccccacttcacctgcaagggccacagacactgggtgctgagcatcagctggagccccgacggcagaaagctggccagcggctgcaagaacggccagatcctgctgtgggaccccagcaccggcaagcaggtgggcagaaccctggccggccacagcaagtggatcaccggcctgagctgggagcccctgcacgccaaccccgagtgcagatacgtggccagcagcagcaaggacggcagcgtgagaatctgggacaccaccgccggcagatgcgagagaatcctgaccggccacacccagagcgtgacctgcctgagatggggcggcgacggcctgctgtacagcgccagccaggacagaaccatcaaggtgtggagagcccacgacggcgtgctgtgcagaaccctgcagggccacggccactgggtgaacaccatggccctgagcaccgactacgccctgagaaccggcgccttcgagcccgccgaggccagcgtgaacccccaggacctgcagggcagcctgcaggagctgaaggagagagccctgagcagatacaacctggtgagaggccagggccccgagagactggtgagcggcagcgacgacttcaccctgttcctgtggagccccgccgaggacaagaagcccctgaccagaatgaccggccaccaggccctgatcaaccaggtgctgttcagccccgacagcagaatcgtggccagcgccagcttcgacaagagcatcaagctgtgggacggcagaaccggcaagtacctggccagcctgagaggccacgtggccgccgtgtaccagatcgcctggagcgccgacagcagactgctggtgagcggcagcagcgacagcaccctgaaggtgtgggacgtgaaggcccagaagctggccatggacctgcccggccacgccgacgaggtgtacgccgtggactggagccccgacggccagagagtggccagcggcggcaaggacaagtgcctgagaatctggagaagatag

SEQ ID NO: 8834 - DNA, 1386 bp, Artificial Sequence
  Description of Artificial Sequence: Synthetic coding sequence
atggccgccgccgtgcccgacgaggccgtggccagagacgtgcagagactgctggtgcagttccaggacgagggcggccagctgctgggcagccccttcgacgtgcccgtggacatcacccccgacagactgcagctggtgtgcaacgccctgctggcccaggaggaccccctgcccctggccttcttcgtgcacgacgccgagatcgtgagcagcctgggcaagaccctggagagccaggccgtggagaccgagaaggtgctggacatcatctaccagccccaggccatcttcagagtgagagccgtgaccagatgcaccagcagcctggagggccacagcgaggccgtgatcagcgtggccttcagccccaccggcaagtacctggccagcggcagcggcgacaccaccgtgagattctgggacctgagcaccgagaccccccacttcacctgcaagggccacagacactgggtgctgagcatcagctggagccccgacggcagaaagctggccagcggctgcaagaacggccagatcctgctgtgggagcccctgcacgccaaccccgagtgcagatacgtggccagcagcagcaaggacggcagcgtgagaatctgggacaccaccgccggcagatgcgagagaatcctgaccggccacacccagagcgtgacctgcctgagatggggcggcgacggcctgctgtacagcgccagccaggacagaaccatcaaggtgtggagagcccacgacggcgtgctgtgcagaaccctgcagggccacggccactgggtgaacaccatggccctgagcaccgactacgccctgagaaccggcgccttcgagcccgccgaggccagcgtgaacccccaggacctgcagggcagcctgcaggagctgaaggagagagccctgagcagatacaacctggtgagaggccagggccccgagagactggtgagcggcagcgacgacttcaccctgttcctgtggagccccgccgaggacaagaagcccctgaccagaatgaccggccaccaggccctgatcaaccaggtgctgttcagccccgacagcagaatcgtggccagcgccagcttcgacaagagcatcaagctgtgggacggcagaaccggcaagtacctggccagcctgagaggccacgtggccgccgtgtaccagatcgcctggagcgccgacagcagactgctggtgagcggcagcagcgacagcaccctgaaggtgtgggacgtgaaggcccagaagctggccatggacctgcccggccacgccgacgaggtgtacgccgtggactggagccccgacggccagagagtggccagcggcggcaaggacaagtgcctgagaatctggagaagatag

SEQ ID NO: 8835 - DNA, 582 bp, Artificial Sequence; identical to SEQ ID NO: 8831
  Description of Artificial Sequence: Synthetic coding sequence

SEQ ID NO: 8836 - DNA, 756 bp, Artificial Sequence
  Description of Artificial Sequence: Synthetic coding sequence
atgcccagccccagacccagaggcagccccccccccgcccccagcggcagcagagtgagaccccccagaagcggcagaagccccgcccccagaagccccaccggccccaacacccccagagcccccggcagattcgagagccccttcagcgtggaggccatcctggccagacccgacccctgcgcccccgccgccagccagcccagcggcagcgcctgcgtgcaccccgccttctggaccgccgccagcctgtgcgccaccggcggcctgccctgggcctgccccaccagctggctgcccgcctacctgagcgtgggcttctaccccgtgcccggccccagagtggcccccgtgtgcggcctgctgggcttcggcgtgaccggcctggagctggcccactgcagcggcctgtgggccttccccgactgggcccccaccgaggacctgcaggacaccgagagacagcagaagagagtgagaaccatgttcaacctggagcagctggaggagctggagaaggtgttcgccaagcagcacaacctggtgggcaagaagagagcccagctggccgccagactgaagctgaccgagaaccaggtgagagtgtggttccagaacagaagagtgaagtaccagaagcagcagaagctgagagccgccgtgaccagcgccgaggccgccagcctggacgagcccagcagcagcagcatcgccagcatccagagcgacgacgccgagagcggcgtggacggctag

SEQ ID NO: 8837 - DNA, 1110 bp, Artificial Sequence
  Description of Artificial Sequence: Synthetic coding sequence
atgttctgctgcctgggctacgagtggctgagcggcggctgcaagacctggcacagcgcctgggtgatcaacaccctggccgaccacagacacagaggcaccgacttcggcggcagcccctggctgctgatcatcaccgtgttcctgagaagctacaagttcgccatcagcctgtgcaccagctacctgtgcgtgagcttcctgaagaccatcttccccagccagaacggccacgacggcagcaccgacgtgcagcagagagccagaagaagcaactgcagaagacaggagggcatcaagatcgtgctggaggacatcttcaccctgtggagacaggtggagaccaaggtgagagccaagatcagaaagatgaaggtgaccaccaaggtgaacagacacgacaagatcaacggcaagagaaagaccgccaaggagcacctgagaaagctgagcatgaaggagagagagcacggcgagaaggagagacaggtgagcgaggccgaggagaacggcaagctggacatgaaggagatccacacctacatggagatgttccagagagcccaggccctgagaagaagagccgaggactactacagatgcaagatcacccccagcgccagaaagcccctgtgcaacagagtgagaatggccgccgtggagcacagacacagcagcggcctgccctactggccctacctgaccgccgagaccctgaagaacagaatgggccaccagccccccccccccacccagcagcacagcatcatcgacaacagcctgagcctgaagacccccagcgagtgcgtgctgtaccccctgccccccagcgccgacgacaacctgaagaccccccccgagtgcctgctgacccccctgccccccagcgccctgcccagcgccgacgacaacctgaagacccccgccgagtgcctgctgtaccccctgccccccagcgccgacgacaacctgaagaccccccccgagtgcctgctgacccccctgccccccagcgccccccccagcgccgacgacaacctgaagaccccccccgagtgcgtgtgcagcctgcccttccacccccagagaatgatcatcagcagaaactag

SEQ ID NO: 8838 - DNA, 1110 bp, Artificial Sequence; identical to SEQ ID NO: 8837
  Description of Artificial Sequence: Synthetic coding sequence

SEQ ID NO: 8839 - DNA, 1110 bp, Artificial Sequence; identical to SEQ ID NO: 8837
  Description of Artificial Sequence: Synthetic coding sequence

SEQ ID NO: 8840 - DNA, 699 bp, Artificial Sequence
  Description of Artificial Sequence: Synthetic coding sequence
atgttctgctgcctgggctacgagtggctgagcggcggctgcaagacctggcacagcgcctgggtgatcaacaccctggccgaccacagacacagaggcaccgacttcggcggcagcccctggctgctgatcatcaccgtgttcctgagaagctacaagttcgccatcagcctgtgcaccagctacctgtgcgtgagcttcctgaagaccatcttccccagccagaacggccacgacggcagcaccgacgtgcagcagagagccagaagaagcaactgcagaagacaggagggcatcaagatcgtgctggaggacatcttcaccctgtggagacaggtggagaccaaggtgagagccaagatcagaaagatgaaggtgaccaccaaggtgaacagacacgacaagatcaacggcaagagaaagaccgccaaggagcacctgagaaagctgagcatgaaggagagagagcacggcgagaaggagagacaggtgagcgaggccgaggagaacggcaagctggacatgaaggagatccacacctacatggagatgttccagagagcccaggccctgagaagaagagccgaggactactacagatgcaagatcacccccagcgccagaaagcccctgtgcaacagatgcacctacaacctggtgctgcccggcagcgagaagaagtactacagccacgcctag

SEQ ID NO: 8841 - DNA, 699 bp, Artificial Sequence; identical to SEQ ID NO: 8840
  Description of Artificial Sequence: Synthetic coding sequence

SEQ ID NO: 8842 - DNA, 1110 bp, Artificial Sequence; identical to SEQ ID NO: 8837
  Description of Artificial Sequence: Synthetic coding sequence

SEQ ID NO: 8843 - DNA, 2067 bp, Artificial Sequence
  Description of Artificial Sequence: Synthetic coding sequence
atggagaacggcgtgctgggcaacgccctggagggcgtgcacgtggaggaggaggagggcgagaagaccgaggacgagagcctggtggagaacaacgacaacatcgacgaggaggccagagaggagctgagagagcaggtgtacgacgccatgggcgagaaggaggaggccaagaagaccgaggacaagagcctggccaagcccgagaccgacaaggagcaggacagcgagatggagaagggcggcagagaggacatggacatcagcaagagcgccgaggagccccaggagaaggtggacctgaccctggactggctgaccgagaccagcgaggaggccaagggcggcgccgcccccgagggccccaacgaggccgaggtgaccagcggcaagcccgagcaggaggtgcccgacgccgaggaggagaagagcgtgagcggcaccgacgtgcaggaggagtgcagagagaagggcggccaggagaagcagggcgaggtgatcgtgagcatcgaggagaagcccaaggaggtgagcgaggagcagcccgtggtgaccctggagaagcagggcaccgccgtggaggtggaggccgagagcctggaccccaccgtgaagcccgtggacgtgggcggcgacgagcccgaggagaaggtggtgaccagcgagaacgaggccggcaaggccgtgctggagcagctggtgggccaggaggtgccccccgccgaggagagccccgaggtgaccaccgaggccgccgaggccagcgccgtggaggccggcagcgaggtgagcgagaagcccggccaggaggcccccgtgctgcccaaggacggcgccgtgaacggccccagcgtggtgggcgaccagacccccatcgagccccagaccagcatcgagagactgaccgagaccaaggacggcagcggcctggaggagaaggtgagagccaagctggtgcccagccaggaggagaccaagctgagcgtggaggagagcgaggccgccggcgacggcgtggacaccaaggtggcccagggcgccaccgagaagagccccgaggacaaggtgcagatcgccgccaacgaggagacccaggagagagaggagcagatgaaggagggcgaggagaccgagggcagcgaggaggacgacaaggagaacgacaagaccgaggagatgcccaacgacagcgtgctggagaacaagagcctgcaggagaacgaggaggaggagatcggcaacctggagctggcctgggacatgctggacctggccaagatcatcttcaagagacaggagaccaaggaggcccagctgtacgccgcccaggcccacctgaagctgggcgaggtgagcgtggagagcgagaactacgtgcaggccgtggaggagttccagagctgcctgaacctgcaggagcagtacctggaggcccacgacagactgctggccgagacccactaccagctgggcctggcctacggctacaacagccagtacgacgaggccgtggcccagttcagcaagagcatcgaggtgatcgagaacagaatggccgtgctgaacgagcaggtgaaggaggccgagggcagcagcgccgagtacaagaaggagatcgaggagctgaaggagctgctgcccgagatcagagagaagatcgaggacgccaaggagagccagagaagcggcaacgtggccgagctggccctgaaggccaccctggtggagagcagcaccagcggcttcacccccggcggcggcggcagcagcgtgagcatgatcgccagcagaaagcccaccgacggcgccagcagcagcaactgcgtgaccgacatcagccacctggtgagaaagaagagaaagcccgaggaggagagccccagaaaggacgacgccaagaaggccaagcaggagcccgaggtgaacggcggcagcggcgacgccgtgcccagcggcaacgaggtgagcgagaacatggaggaggaggccgagaaccaggccgagagcagagccgccgtggagggcaccgtggaggccggcgccaccgtggagagcaccgcctgctag

SEQ ID NO: 8844 - DNA, 2367 bp, Artificial Sequence
  Description of Artificial Sequence: Synthetic coding sequence
atggccatggagagcaccgccaccgccgccgtggccgccgagctggtgagcgccgacaagatcgaggacgtgcccgcccccagcaccagcgccgacaaggtggagagcctggacgtggacagcgaggccaagaagctgctgggcctgggccagaagcacctggtgatgggcgacatccccgccgccgtgaacgccttccaggaggccgccagcctgctgggcaagaagtacggcgagaccgccaacgagtgcggcgaggccttcttcttctacggcaagagcctgctggagctggccagaatggagaacggcgtgctgggcaacgccctggagggcgtgcacgtggaggaggaggagggcgagaagaccgaggacgagagcctggtggagaacaacgacaacatcgacgaggaggccagagaggagctgagagagcaggtgtacgacgccatgggcgagaaggaggaggccaagaagaccgaggacaagagcctggccaagcccgagaccgacaaggagcaggacagcgagatggagaagggcggcagagaggacatggacatcagcaagagcgccgaggagccccaggagaaggtggacctgaccctggactggctgaccgagaccagcgaggaggccaagggcggcgccgcccccgagggccccaacgaggccgaggtgaccagcggcaagcccgagcaggaggtgcccgacgccgaggaggagaagagcgtgagcggcaccgacgtgcaggaggagtgcagagagaagggcggccaggagaagcagggcgaggtgatcgtgagcatcgaggagaagcccaaggaggtgagcgaggagcagcccgtggtgaccctggagaagcagggcaccgccgtggaggtggaggccgagagcctggaccccaccgtgaagcccgtggacgtgggcggcgacgagcccgaggagaaggtggtgaccagcgagaacgaggccggcaaggccgtgctggagcagctggtgggccaggaggtgccccccgccgaggagagccccgaggtgaccaccgaggccgccgaggccagcgccgtggaggccggcagcgaggtgagcgagaagcccggccaggaggcccccgtgctgcccaaggacggcgccgtgaacggccccagcgtggtgggcgaccagacccccatcgagccccagaccagcatcgagagactgaccgagaccaaggacggcagcggcctggaggagaaggtgagagccaagctggtgcccagccaggaggagaccaagctgagcgtggaggagagcgaggccgccggcgacggcgtggacaccaaggtggcccagggcgccaccgagaagagccccgaggacaaggtgcagatcgccgccaacgaggagacccaggagagagaggagcagatgaaggagggcgaggagaccgagggcagcgaggaggacgacaaggagaacgacaagaccgaggagatgcccaacgacagcgtgctggagaacaagagcctgcaggagaacgaggaggaggagatcggcaacctggagctggcctgggacatgctggacctggccaagatcatcttcaagagacaggagaccaaggaggcccagctgtacgccgcccaggcccacctgaagctgggcgaggtgagcgtggagagcgagaactacgtgcaggccgtggaggagttccagagctgcctgaacctgcaggagcagtacctggaggcccacgacagactgctggccgagacccactaccagctgggcctggcctacggctacaacagccagtacgacgaggccgtggcccagttcagcaagagcatcgaggtgatcgagaacagaatggccgtgctgaacgagcaggtgaaggaggccgagggcagcagcgccgagtacaagaaggagatcgaggagctgaaggagctgctgcccgagatcagagagaagatcgaggacgccaaggagagccagagaagcggcaacgtggccgagctggccctgaaggccaccctggtggagagcagcaccagcggcttcacccccggcggcggcggcagcagcgtgagcatgatcgccagcagaaagcccaccgacggcgccagcagcagcaactgcgtgaccgacatcagccacctggtgagaaagaagagaaagcccgaggaggagagccccagaaaggacgacgccaagaaggccaagcaggagcccgaggtgaacggcggcagcggcgacgccgtgcccagcggcaacgaggtgagcgagaacatggaggaggaggccgagaaccaggccgagagcagagccgccgtggagggcaccgtggaggccggcgccaccgtggagagcaccgcctgctag

SEQ ID NO: 8845 - DNA, 1350 bp, Artificial Sequence
  Description of Artificial Sequence: Synthetic coding sequence
atggccatggagagcaccgccaccgccgccgtggccgccgagctggtgagcgccgacaagatcgaggacgtgcccgcccccagcaccagcgccgacaaggtggagagcctggacgtggacagcgaggccaagaagctgctgggcctgggccagaagcacctggtgatgggcgacatccccgccgccgtgaacgccttccaggaggccgccagcctgctgggcaagaagtacggcgagaccgccaacgagtgcggcgaggccttcttcttctacggcaagagcctgctggagctggccagaatggagaacggcgtgctgggcaacgccctggagggcgtgcacgtggaggaggaggagggcgagaagaccgaggacgagagcctggtggagaacaacgacaacatcgacgagaccgagggcagcgaggaggacgacaaggagaacgacaagaccgaggagatgcccaacgacagcgtgctggagaacaagagcctgcaggagaacgaggaggaggagatcggcaacctggagctggcctgggacatgctggacctggccaagatcatcttcaagagacaggagaccaaggaggcccagctgtacgccgcccaggcccacctgaagctgggcgaggtgagcgtggagagcgagaactacgtgcaggccgtggaggagttccagagctgcctgaacctgcaggagcagtacctggaggcccacgacagactgctggccgagacccactaccagctgggcctggcctacggctacaacagccagtacgacgaggccgtggcccagttcagcaagagcatcgaggtgatcgagaacagaatggccgtgctgaacgagcaggtgaaggaggccgagggcagcagcgccgagtacaagaaggagatcgaggagctgaaggagctgctgcccgagatcagagagaagatcgaggacgccaaggagagccagagaagcggcaacgtggccgagctggccctgaaggccaccctggtggagagcagcaccagcggcttcacccccggcggcggcggcagcagcgtgagcatgatcgccagcagaaagcccaccgacggcgccagcagcagcaactgcgtgaccgacatcagccacctggtgagaaagaagagaaagcccgaggaggagagccccagaaaggacgacgccaagaaggccaagcaggagcccgaggtgaacggcggcagcggcgacgccgtgcccagcggcaacgaggtgagcgagaacatggaggaggaggccgagaaccaggccgagagcagagccgccgtggagggcaccgtggaggccggcgccaccgtggagagcaccgcctgctag

SEQ ID NO: 8846 - DNA, 2373 bp, Artificial Sequence
  Description of Artificial Sequence: Synthetic coding sequence
atgttcctgctgctgctgcacctgcagatcaagtggagagccaccatcaacctgctgagcgtgaccgaggacggcctgcacttcgtggagtactacctgaacagaatcatccacctggacgtggacagcgaggccaagaagctgctgggcctgggccagaagcacctggtgatgggcgacatccccgccgccgtgaacgccttccaggaggccgccagcctgctgggcaagaagtacggcgagaccgccaacgagtgcggcgaggccttcttcttctacggcaagagcctgctggagctggccagaatggagaacggcgtgctgggcaacgccctggagggcgtgcacgtggaggaggaggagggcgagaagaccgaggacgagagcctggtggagaacaacgacaacatcgacgaggaggccagagaggagctgagagagcaggtgtacgacgccatgggcgagaaggaggaggccaagaagaccgaggacaagagcctggccaagcccgagaccgacaaggagcaggacagcgagatggagaagggcggcagagaggacatggacatcagcaagagcgccgaggagccccaggagaaggtggacctgaccctggactggctgaccgagaccagcgaggaggccaagggcggcgccgcccccgagggccccaacgaggccgaggtgaccagcggcaagcccgagcaggaggtgcccgacgccgaggaggagaagagcgtgagcggcaccgacgtgcaggaggagtgcagagagaagggcggccaggagaagcagggcgaggtgatcgtgagcatcgaggagaagcccaaggaggtgagcgaggagcagcccgtggtgaccctggagaagcagggcaccgccgtggaggtggaggccgagagcctggaccccaccgtgaagcccgtggacgtgggcggcgacgagcccgaggagaaggtggtgaccagcgagaacgaggccggcaaggccgtgctggagcagctggtgggccaggaggtgccccccgccgaggagagccccgaggtgaccaccgaggccgccgaggccagcgccgtggaggccggcagcgaggtgagcgagaagcccggccaggaggcccccgtgctgcccaaggacggcgccgtgaacggccccagcgtggtgggcgaccagacccccatcgagccccagaccagcatcgagagactgaccgagaccaaggacggcagcggcctggaggagaaggtgagagccaagctggtgcccagccaggaggagaccaagctgagcgtggaggagagcgaggccgccggcgacggcgtggacaccaaggtggcccagggcgccaccgagaagagccccgaggacaaggtgcagatcgccgccaacgaggagacccaggagagagaggagcagatgaaggagggcgaggagaccgagggcagcgaggaggacgacaaggagaacgacaagaccgaggagatgcccaacgacagcgtgctggagaacaagagcctgcaggagaacgaggaggaggagatcggcaacctggagctggcctgggacatgctggacctggccaagatcatcttcaagagacaggagaccaaggaggcccagctgtacgccgcccaggcccacctgaagctgggcgaggtgagcgtggagagcgagaactacgtgcaggccgtggaggagttccagagctgcctgaacctgcaggagcagtacctggaggcccacgacagactgctggccgagacccactaccagctgggcctggcctacggctacaacagccagtacgacgaggccgtggcccagttcagcaagagcatcgaggtgatcgagaacagaatggccgtgctgaacgagcaggtgaaggaggccgagggcagcagcgccgagtacaagaaggagatcgaggagctgaaggagctgctgcccgagatcagagagaagatcgaggacgccaaggagagccagagaagcggcaacgtggccgagctggccctgaaggccaccctggtggagagcagcaccagcggcttcacccccggcggcggcggcagcagcgtgagcatgatcgccagcagaaagcccaccgacggcgccagcagcagcaactgcgtgaccgacatcagccacctggtgagaaagaagagaaagcccgaggaggagagccccagaaaggacgacgccaagaaggccaagcaggagcccgaggtgaacggcggcagcggcgacgccgtgcccagcggcaacgaggtgagcgagaacatggaggaggaggccgagaaccaggccgagagcagagccgccgtggagggcaccgtggaggccggcgccaccgtggagagcaccgcctgctag

SEQ ID NO: 8847 - DNA, 771 bp, Artificial Sequence
  Description of Artificial Sequence: Synthetic coding sequence
atggccatggagagcaccgccaccgccgccgtggccgccgagctggtgagcgccgacaagatcgaggacgtgcccgcccccagcaccagcgccgacaaggtggagagcctggacgtggacagcgaggccaagaagctgctgggcctgggccagaagcacctggtgatgggcgacatccccgccgccgtgaacgccttccaggaggccgccagcctgctgggcaagaagtacggcgagaccgccaacgagtgcggcgaggccttcttcttctacggcaagagcctgctggagctggccagaatggagaacggcgtgctgggcaacgccctggagggcgtgcacgtggaggaggaggagggcgagaagaccgaggacgagagcctggtggagaacaacgacaacatcgacgagaccgagggcagcgaggaggacgacaaggagaacgacaagaccgaggagatgcccaacgacagcgtgctggagaacaagagcctgcaggagaacgaggaggaggagatcggcaacctggagctggcctgggacatgctggacctggccaagatcatcttcaagagacaggagaccaaggaggcccagctgtacgccgcccaggcccacctgaagctgggcgaggtgagcgtggagagcgagaactacgtgcaggccgtggaggagttccagagctgcctgaacctgcaggagcagtacctggaggcccacgacagactgctggccgagacccactaccagctgggcctggcctacggctag

SEQ ID NO: 8848 - DNA, 2175 bp, Artificial Sequence
  Description of Artificial Sequence: Synthetic coding sequence
atggccatggagagcaccgccaccgccgccgtggccgccgagctggtgagcgccgacaagatcgaggacgtgcccgcccccagcaccagcgccgacaaggtggagagaatggagaacggcgtgctgggcaacgccctggagggcgtgcacgtggaggaggaggagggcgagaagaccgaggacgagagcctggtggagaacaacgacaacatcgacgaggaggccagagaggagctgagagagcaggtgtacgacgccatgggcgagaaggaggaggccaagaagaccgaggacaagagcctggccaagcccgagaccgacaaggagcaggacagcgagatggagaagggcggcagagaggacatggacatcagcaagagcgccgaggagccccaggagaaggtggacctgaccctggactggctgaccgagaccagcgaggaggccaagggcggcgccgcccccgagggccccaacgaggccgaggtgaccagcggcaagcccgagcaggaggtgcccgacgccgaggaggagaagagcgtgagcggcaccgacgtgcaggaggagtgcagagagaagggcggccaggagaagcagggcgaggtgatcgtgagcatcgaggagaagcccaaggaggtgagcgaggagcagcccgtggtgaccctggagaagcagggcaccgccgtggaggtggaggccgagagcctggaccccaccgtgaagcccgtggacgtgggcggcgacgagcccgaggagaaggtggtgaccagcgagaacgaggccggcaaggccgtgctggagcagctggtgggccaggaggtgccccccgccgaggagagccccgaggtgaccaccgaggccgccgaggccagcgccgtggaggccggcagcgaggtgagcgagaagcccggccaggaggcccccgtgctgcccaaggacggcgccgtgaacggccccagcgtggtgggcgaccagacccccatcgagccccagaccagcatcgagagactgaccgagaccaaggacggcagcggcctggaggagaaggtgagagccaagctggtgcccagccaggaggagaccaagctgagcgtggaggagagcgaggccgccggcgacggcgtggacaccaaggtggcccagggcgccaccgagaagagccccgaggacaaggtgcagatcgccgccaacgaggagacccaggagagagaggagcagatgaaggagggcgaggagaccgagggcagcgaggaggacgacaaggagaacgacaagaccgaggagatgcccaacgacagcgtgctggagaacaagagcctgcaggagaacgaggaggaggagatcggcaacctggagctggcctgggacatgctggacctggccaagatcatcttcaagagacaggagaccaaggaggcccagctgtacgccgcccaggcccacctgaagctgggcgaggtgagcgtggagagcgagaactacgtgcaggccgtggaggagttccagagctgcctgaacctgcaggagcagtacctggaggcccacgacagactgctggccgagacccactaccagctgggcctggcctacggctacaacagccagtacgacgaggccgtggcccagttcagcaagagcatcgaggtgatcgagaacagaatggccgtgctgaacgagcaggtgaaggaggccgagggcagcagcgccgagtacaagaaggagatcgaggagctgaaggagctgctgcccgagatcagagagaagatcgaggacgccaaggagagccagagaagcggcaacgtggccgagctggccctgaaggccaccctggtggagagcagcaccagcggcttcacccccggcggcggcggcagcagcgtgagcatgatcgccagcagaaagcccaccgacggcgccagcagcagcaactgcgtgaccgacatcagccacctggtgagaaagaagagaaagcccgaggaggagagccccagaaaggacgacgccaagaaggccaagcaggagcccgaggtgaacggcggcagcggcgacgccgtgcccagcggcaacgaggtgagcgagaacatggaggaggaggccgagaaccaggccgagagcagagccgccgtggagggcaccgtggaggccggcgccaccgtggagagcaccgcctgctag

SEQ ID NO: 8849 - DNA, 453 bp, Artificial Sequence
  Description of Artificial Sequence: Synthetic coding sequence
atgagaagctgctgcgtggtgcaggccggcctgcagctgctggccagcagcgacccccccagcagcgccagccagagcgccagaatcaccggcgtgaaccacagaaccccccccagagagatcaagagcaacaagaccgtgctgcacctggccgtgcaggccgccaaccccaccctggtgcagctgctgctggagctgcccagaggcgacctgagaaccttcgtgaacatgaaggcccacggcaacaccgccctgcacatggccgccgccctgccccccggccccgcccaggaggccatcgtgagacacctgctggccgccggcgccgaccccaccctgagaaacctggagaacgagcagcccgtgcacctgctgagacccggccccggccccgagggcctgagacagctgctgaagagaagcagagtggccccccccggcctgagcagctag

SEQ ID NO: 8850 - DNA, 1398 bp, Artificial Sequence
  Description of Artificial Sequence: Synthetic coding sequence
atgtgggtgtgcctgagaggcatcctggacagccaggccttctggcacgagaccctgagaagatgggagtgcctgctggccgagatgaaggtgagcagaggcgagagaagccactgccccacccagaccgtgaagaagctgctggaggagcagagaagaagacagcagcagcagcccgacgccggcggcgtgcagggccagttcctgcccccccccgagcagcccctgacccccagcgtgaacgaggccgtgaccggccacccccccttccccgcccacagcgagaccgtgggcagcggccccagcagcctgggcttccccgactgggaccccaacacccacgccgcctacaccgacagcccctacagctgccccgccagcgccgccgagaacttcctgccccccgacttctacccccccagcgaccccggccagccctgccccttcccccagggcatggaggccggcccctggagagtgagcgccccccccagcggccccccccagttccccgccgtggtgcccggccccagcctggaggtggccagagcccacatgctggccctgggcccccagcagctgctggcccaggacgaggagggcgacaccctgctgcacctgttcgccgccagaggcctgagatgggccgcctacgccgccgccgaggtgctgcaggtgtacagaagactggacatcagagagcacaagggcaagacccccctgctggtggccgccgccgccaaccagcccctgatcgtggaggacctgctgaacctgggcgccgagcccaacgccgccgaccaccagggcagaagcgtgctgcacgtggccgccacctacggcctgcccggcgtgctgctggccgtgctgaacagcggcgtgcaggtggacctggaggccagagacttcgagggcctgacccccctgcacaccgccatcctggccctgaacgtggccatgagacccagcgacctgtgccccagagtgctgagcacccaggccagagacagactggactgcgtgcacatgctgctgcagatgggcgccaaccacaccagccaggagatcaagagcaacaagaccgtgctgcacctggccgtgcaggccgccaaccccaccctggtgcagctgctgctggagctgcccagaggcgacctgagaaccttcgtgaacatgaaggcccacggcaacaccgccctgcacatggccgccgccctgccccccggccccgcccaggaggccatcgtgagacacctgctggccgccggcgccgaccccaccctgagaaacctggagaacgagcagcccgtgcacctgctgagacccggccccggccccgagggcctgagacagctgctgaagagaagcagagtggccccccccggcctgagcagctag

SEQ ID NO: 8851 - DNA, 942 bp, Artificial Sequence
  Description of Artificial Sequence: Synthetic coding sequence
atggaggccggcccctggagagtgagcgccccccccagcggccccccccagttccccgccgtggtgcccggccccagcctggaggtggccagagcccacatgctggccctgggcccccagcagctgctggcccaggacgaggagggcgacaccctgctgcacctgttcgccgccagaggcctgagatgggccgcctacgccgccgccgaggtgctgcaggtgtacagaagactggacatcagagagcacaagggcaagacccccctgctggtggccgccgccgccaaccagcccctgatcgtggaggacctgctgaacctgggcgccgagcccaacgccgccgaccaccagggcagaagcgtgctgcacgtggccgccacctacggcctgcccggcgtgctgctggccgtgctgaacagcggcgtgcaggtggacctggaggccagagacttcgagggcctgacccccctgcacaccgccatcctggccctgaacgtggccatgagacccagcgacctgtgccccagagtgctgagcacccaggccagagacagactggactgcgtgcacatgctgctgcagatgggcgccaaccacaccagccaggagatcaagagcaacaagaccgtgctgcacctggccgtgcaggccgccaaccccaccctggtgcagctgctgctggagctgcccagaggcgacctgagaaccttcgtgaacatgaaggcccacggcaacaccgccctgcacatggccgccgccctgccccccggccccgcccaggaggccatcgtgagacacctgctggccgccggcgccgaccccaccctgagaaacctggagaacgagcagcccgtgcacctgctgagacccggccccggccccgagggcctgagacagctgctgaagagaagcagagtggccccccccggcctgagcagctag

SEQ ID NO: 8852 - DNA, 543 bp, Artificial Sequence
  Description of Artificial Sequence: Synthetic coding sequence
atgagacccctgaccgaggaggagaccagagtgatgttcgagaagatcgccaagtacatcggcgagaacctgcagctgctggtggacagacccgacggcacctactgcttcagactgcacaacgacagagtgtactacgtgagcgagaagatcatgaagctggccgccaacatcagcggcgacaagctggtgagcctgggcacctgcttcggcaagttcaccaagacccacaagttcagactgcacgtgaccgccctggactacctggccccctacgccaagtacaaggtgtggatcaagcccggcgccgagcagagcttcctgtacggcaaccacgtgctgaagagcggcctgggcagaatcaccgagaacaccagccagtaccagggcgtggtggtgtacagcatggccgacatccccctgggcttcggcgtggccgccaagagcacccaggactgcagaaaggtggaccccatggccatcgtggtgttccaccaggccgacatcggcgagtacgtgagacacgaggagaccctgacctag

SEQ ID NO: 8853 - DNA, 402 bp, Artificial Sequence
  Description of Artificial Sequence: Synthetic coding sequence
atgagacccctgaccgaggaggagaccagagtgatgttcgagaagatcgccaagtacatcggcgagaacctgcagctgctggtggacagacccgacggcacctactgcttcagactgcacaacgacagagtgtactacgtgagcgagaagatcatgaagctggccgccaacatcagcggcgacaagctggtgagcctgggcacctgcttcggcaagttcaccaagacccacaagttcagactgcacgtgaccgccctggactacctggccccctacgccaagggcttcggcgtggccgccaagagcacccaggactgcagaaaggtggaccccatggccatcgtggtgttccaccaggccgacatcggcgagtacgtgagacacgaggagaccctgacctag

SEQ ID NO: 8854 - DNA, 249 bp, Artificial Sequence
  Description of Artificial Sequence: Synthetic coding sequence
atggccaccttcccccccgccaccagcgccccccagcagccccccggccccgaggacgaggacagcagcctggacgagagcgacctgtacagcctggcccacagctacctgggcggcggcggcagaaagggcagaaccaagagagaggccgccgccaacaccaacagacccagccccggcggccacgagagaaagctggtgaccaagctgcagaacagcgagagaaagaagagaggcgccagaagatag

SEQ ID NO: 8855 - DNA, 303 bp, Artificial Sequence
  Description of Artificial Sequence: Synthetic coding sequence
atggccaccttcccccccgccaccagcgccccccagcagccccccggccccgaggacgaggacagcagcctggacgagagcgacctgtacagcctggcccacagctacctgggccccctgatcatgcccatgcccaccagccccctgacccccgccctggtgaccggcggcggcggcagaaagggcagaaccaagagagaggccgccgccaacaccaacagacccagccccggcggccacgagagaaagctggtgaccaagctgcagaacagcgagagaaagaagagaggcgccagaagatag

SEQ ID NO: 8856 - DNA, 420 bp, Artificial Sequence
  Description of Artificial Sequence: Synthetic coding sequence
atgacccacagcctggtgtgccccgagaccgtgagcagagtgagcagcgtgctgaacagaaacaccagacagttcggcaagaagcacctgttcgaccaggacgaggagacctgctggaacagcgaccagggccccagccagtgggtgaccctggagttcccccagctgatcagagtgagccagctgcagatccagttccagggcggcttcagcagcagaagaggctgcctggagggcagccagggcacccaggccctgcacaagatcgtggacttctaccccgaggacaacaacagcctgcagaccttccccatccccgccgccgaggtggacagactgaaggtgaccttcgaggacgccaccgacttcttcggcagagtggtgatctaccacctgagagtgctgggcgagaaggtgtag

SEQ ID NO: 8857 - DNA, 1740 bp, Artificial Sequence
  Description of Artificial Sequence: Synthetic coding sequence
atgaacaccgcccccagcagacccagccccaccagaagagacccctacggcttcggcgacagcagagacagcagaagagacagaagccccatcagaggcagccccagaagagagcccagagacggcagaaacggcagagacgccagagacagcagagacatcagagaccccagagacctgagagaccacagacacagcagagacctgagagaccacagagacagcagaagcgtgagagacgtgagagacgtgagagacctgagagacttcagagacctgagagacagcagagacttcagagaccagagagaccccatgtacgacagatacagagacatgagagacagcagagaccccatgtacagaagagagggcagctacgacagatacctgagaatggacgactactgcagaagaaaggacgacagctacttcgacagatacagagacagcttcgacggcagaggcccccccggccccgagagccagagcagagccaaggagagactgaagagagaggagagaagaagagaggagctgtacagacagtacttcgaggagatccagagaagattcgacgccgagagacccgtggactgcagcgtgatcgtggtgaacaagcagaccaaggactacgccgagagcgtgggcagaaaggtgagagacctgggcatggtggtggacctgatcttcctgaacaccgaggtgagcctgagccaggccctggaggacgtgagcagaggcggcagccccttcgccatcgtgatcacccagcagcaccagatccacagaagctgcaccgtgaacatcatgttcggcaccccccaggagcacagaaacatgccccaggccgacgccatggtgctggtggccagaaactacgagagatacaagaacgagtgcagagagaaggagagagaggagatcgccagacaggccgccaagatggccgacgaggccatcctgcaggagagagagagaggcggccccgaggagggcgtgagaggcggccacccccccgccatccagagcctgatcaacctgctggccgacaacagatacctgaccgccgaggagaccgacaagatcatcaactacctgagagagagaaaggagagactgatgagaagcagcaccgacagcctgcccggccccatcagcagacagcccctgggcgccaccagcggcgccagcctgaagacccagcccagcagccagcccctgcagagcggccaggtgctgcccagcgccacccccacccccagcgccccccccaccagccagcaggagctgcaggccaagatcctgagcctgttcaacagcggcaccgtgaccgccaacagcagcagcgccagccccagcgtggccgccggcaacacccccaaccagaacttcagcaccgccgccaacagccagccccagcagagaagccaggccagcggcaaccagccccccagcatcctgggccagggcggcagcgcccagaacatgggccccagacccggcgcccccagccagggcctgttcggccagcccagcagcagactggcccccgccagcaacatgaccagccagagacccgtgagcagcaccggcatcaacttcgacaaccccagcgtgcagaaggccctggacaccctgatccagagcggccccgccctgagccacctggtgagccagaccaccgcccagatgggccagccccaggcccccatgggcagctaccagagacactactag

SEQ ID NO: 8858 - DNA, 315 bp, Artificial Sequence
  Description of Artificial Sequence: Synthetic coding sequence
atgtacgacagatacagagacatgagagacagcagagaccccatgtacagaagagagggcagctacgacagatacctgagaatggacgactactgcagaagaaaggacgacagctacttcgacagatacagagacagcttcgacggcagaggcccccccggccccgagagccagagcagagccaaggagagactgaagagagaggagagaagaagagaggagctgtacagacagtacttcgaggagatccagagaagattcgacgccgagagacccgtggactgcagcgtgatcgtggtgaacaagcagacctag

SEQ ID NO: 8859 - DNA, 1278 bp, Artificial Sequence
  Description of Artificial Sequence: Synthetic coding sequence
atgggcagcaagatgaacctgatcgagcacagccacctgcccaccaccgacgagttcagcttcagcgagaacctgttcggcgtgctgaccgagcaggtggccggccccctgggccagaacctggaggtggagccctacagccagtacagcaacgtgcagttcccccaggtgcagccccagatcagcagcagcagctactacagcaacctgggcttctacccccagcagcccgaggagtggtacagccccggcatctacgagctgagaagaatgcccgccgagaccctgtaccagggcgagaccgaggtggccgagatgcccgtgaccaagaagcccagaatgggcgccagcgccggcagaatcaagggcgacgagctgtgcgtggtgtgcggcgacagagccagcggctaccactacaacgccctgacctgcgagggctgcaagggcctgctgaccgagatccagtgcaagagcaagagactgagaaagaacgtgaagcagcacgccgaccagaccgtgaacgaggacagcgagggcagagacctgagacaggtgaccagcaccaccaagagctgcagagagaagaccgagctgacccccgaccagcagaccctgctgcacttcatcatggacagctacaacaagcagagaatgccccaggagatcaccaacaagatcctgaaggaggagttcagcgccgaggagaacttcctgatcctgaccgagatggccaccaaccacgtgcaggtgctggtggagttcaccaagaagctgcccggcttccagaccctggaccacgaggaccagatcgccctgctgaagggcagcgccgtggaggccatgttcctgagaagcgccgagatcttcaacaagaagctgcccagcggccacagcgacctgctggaggagagaatcagaaacagcggcatcagcgacgagtacatcacccccatgttcagcttctacaagagcatcggcgagctgaagatgacccaggaggagtacgccctgctgaccgccatcgtgatcctgagccccgacagacagtacatcaaggacagagaggccgtggagaagctgcaggagcccctgctggacgtgctgcagaagctgtgcaagatccaccagcccgagaacccccagcacttcgcctgcctgctgggcagactgaccgagctgagaaccttcaaccaccaccacgccgagatgctgatgagctggagagtgaacgaccacaagttcacccccctgctgtgcgagatctgggacgtgcagtag

SEQ ID NO: 8860 - DNA, 1740 bp, Artificial Sequence
  Description of Artificial Sequence: Synthetic coding sequence
atggaggtgaacgccggcggcgtgatcgcctacatcagcagcagcagcagcgccagcagccccgccagctgccacagcgagggcagcgagaacagcttccagagcagcagcagcagcgtgcccagcagccccaacagcagcaacagcgacaccaacggcaaccccaagaacggcgacctggccaacatcgagggcatcctgaagaacgacagaatcgactgcagcatgaagaccagcaagagcagcgcccccggcatgaccaagagccacagcggcgtgaccaagttcagcggcatggtgctgctgtgcaaggtgtgcggcgacgtggccagcggcttccactacggcgtgcacgcctgcgagggctgcaagggcttcttcagaagaagcatccagcagaacatccagtacaagaagtgcctgaagaacgagaactgcagcatcatgagaatgaacagaaacagatgccagcagtgcagattcaagaagtgcctgagcgtgggcatgagcagagacgccgtgagattcggcagaatccccaagagagagaagcagagaatgctgatcgagatgcagagcgccatgaagaccatgatgaacagccagttcagcggccacctgcagaacgacaccctggtggagcaccacgagcagaccgccctgcccgcccaggagcagctgagacccaagccccagctggagcaggagaacatcaagagcagcagcccccccagcagcgacttcgccaaggaggaggtgatcggcatggtgaccagagcccacaaggacaccttcatgtacaaccaggagcagcaggagaacagcgccgagagcatgcagccccagagaggcgagagaatccccaagaacatggagcagtacaacctgaaccacgaccactgcggcaacggcctgagcagccacttcccctgcagcgagagccagcagcacctgaacggccagttcaagggcagaaacatcatgcactaccccaacggccacgccatctgcatcgccaacggccactgcatgaacttcagcaacgcctacacccagagagtgtgcgacagagtgcccatcgacggcttcagccagaacgagaacaagaacagctacctgtgcaacaccggcggcagaatgcacctggtgtgccccctgagcaagagcccctacgtggacccccacaagagcggccacgagatctgggaggagttcagcatgagcttcacccccgccgtgaaggaggtggtggagttcgccaagagaatccccggcttcagagacctgagccagcacgaccaggtgaacctgctgaaggccggcaccttcgaggtgctgatggtgagattcgccagcctgttcgacgccaaggagagaaccgtgaccttcctgagcggcaagaagtacagcgtggacgacctgcacagcatgggcgccggcgacctgctgaacagcatgttcgagttcagcgagaagctgaacgccctgcagctgagcgacgaggagatgagcctgttcaccgccgtggtgctggtgagcgccgacagaagcggcatcgagaacgtgaacagcgtggaggccctgcaggagaccctgatcagagccctgagaaccctgatcatgaagaaccaccccaacgaggccagcatcttcaccaagctgctgctgaagctgcccgacctgagaagcctgaacaacatgcacagcgaggagctgctggccttcaaggtgcacccctag

SEQ ID NO: 8861 - DNA, 1227 bp, Artificial Sequence
  Description of Artificial Sequence: Synthetic coding sequence
atggaggtgaacgccggcggcgtgatcgcctacatcagcagcagcagcagcgccagcagccccgccagctgccacagcgagggcagcgagaacagcttccagagcagcagcagcagcgtgcccagcagccccaacagcagcaacagcgacaccaacggcaaccccaagaacggcgacctggccaacatcgagggcatcctgaagaacgacagaatcgactgcagcatgaagaccagcaagagcagcgcccccggcatgaccaagagccacagcggcgtgaccaagttcagcggcatggtgctgctgtgcaaggtgtgcggcgacgtggccagcggcttccactacggcgtgcacgcctgcgagggctgcaagggcttcttcagaagaagcatccagcagaacatccagtacaagaagtgcctgaagaacgagaactgcagcatcatgagaatgaacagaaacagatgccagcagtgcagattcaagaagtgcctgagcgtgggcatgagcagagacgccgtgagattcggcagaatccccaagagagagaagcagagaatgctgatcgagatgcagagcgccatgaagaccatgatgaacagccagttcagcggccacctgcagaacgacaccctggtggagcaccacgagcagaccgccctgcccgcccaggagcagctgagacccaagccccagctggagcaggagaacatcaagagcagcagcccccccagcagcgacttcgccaaggaggaggtgatcggcatggtgaccagagcccacaaggacaccttcatgtacaaccaggagcagcaggagaacagcgccgagagcatgcagccccagagaggcgagagaatccccaagaacatggagcagtacaacctgaaccacgaccactgcggcaacggcctgagcagccacttcccctgcagcgagagccagcagcacctgaacggccagttcaagggcagaaacatcatgcactaccccaacggccacgccatctgcatcgccaacggccactgcatgaacttcagcaacgcctacacccagagagtgtgcgacagagtgcccatcgacggcttcagccagaacgagaacaagaacagctacctgtgcaacaccggcggcagaatgcacctgtacagcgtgcacatccagcccaagttccaccagaagcagcagtaccacaccatcagcagcctgaaccacgaggtgctgtag

SEQ ID NO: 8862 - DNA, 1740 bp, Artificial Sequence; identical to SEQ ID NO: 8860
  Description of Artificial Sequence: Synthetic coding sequence

SEQ ID NO: 8863 - DNA, 1449 bp, Artificial Sequence
  Description of Artificial Sequence: Synthetic coding sequence
atggtgatgcagttccagggcctggagaaccccatccagatcagcccccactgcagctgcacccccagcggcttcttcatggagatgatgagcatgaagcccgccaagggcgtgctgaccgagcaggtggccggccccctgggccagaacctggaggtggagccctacagccagtacagcaacgtgcagttcccccaggtgcagccccagatcagcagcagcagctactacagcaacctgggcttctacccccagcagcccgaggagtggtacagccccggcatctacgagctgagaagaatgcccgccgagaccctgtaccagggcgagaccgaggtggccgagatgcccgtgaccaagaagcccagaatgggcgccagcgccggcagaatcaagggcgacgagctgtgcgtggtgtgcggcgacagagccagcggctaccactacaacgccctgacctgcgagggctgcaagggcttcttcagaagaagcatcaccaagaacgccgtgtacaagtgcaagaacggcggcaactgcgtgatggacatgtacatgagaagaaagtgccaggagtgcagactgagaaagtgcaaggagatgggcatgctggccgagtgcctgctgaccgagatccagtgcaagagcaagagactgagaaagaacgtgaagcagcacgccgaccagaccgtgaacgaggacagcgagggcagagacctgagacaggtgaccagcaccaccaagagctgcagagagaagaccgagctgacccccgaccagcagaccctgctgcacttcatcatggacagctacaacaagcagagaatgccccaggagatcaccaacaagatcctgaaggaggagttcagcgccgaggagaacttcctgatcctgaccgagatggccaccaaccacgtgcaggtgctggtggagttcaccaagaagctgcccggcttccagaccctggaccacgaggaccagatcgccctgctgaagggcagcgccgtggaggccatgttcctgagaagcgccgagatcttcaacaagaagctgcccagcggccacagcgacctgctggaggagagaatcagaaacagcggcatcagcgacgagtacatcacccccatgttcagcttctacaagagcatcggcgagctgaagatgacccaggaggagtacgccctgctgaccgccatcgtgatcctgagccccgacagacagtacatcaaggacagagaggccgtggagaagctgcaggagcccctgctggacgtgctgcagaagctgtgcaagatccaccagcccgagaacccccagcacttcgcctgcctgctgggcagactgaccgagctgagaaccttcaaccaccaccacgccgagatgctgatgagctggagagtgaacgaccacaagttcacccccctgctgtgcgagatctgggacgtgcagtag

SEQ ID NO: 8864 - DNA, 1431 bp, Artificial Sequence
  Description of Artificial Sequence: Synthetic coding sequence
atgggcagcaagatgaacctgatcgagcacagccacctgcccaccaccgacgagttcagcttcagcgagaacctgttcggcgtgctgaccgagcaggtggccggccccctgggccagaacctggaggtggagccctacagccagtacagcaacgtgcagttcccccaggtgcagccccagatcagcagcagcagctactacagcaacctgggcttctacccccagcagcccgaggagtggtacagccccggcatctacgagctgagaagaatgcccgccgagaccctgtaccagggcgagaccgaggtggccgagatgcccgtgaccaagaagcccagaatgggcgccagcgccggcagaatcaagggcgacgagctgtgcgtggtgtgcggcgacagagccagcggctaccactacaacgccctgacctgcgagggctgcaagggcttcttcagaagaagcatcaccaagaacgccgtgtacaagtgcaagaacggcggcaactgcgtgatggacatgtacatgagaagaaagtgccaggagtgcagactgagaaagtgcaaggagatgggcatgctggccgagtgcatgtacaccggcctgctgaccgagatccagtgcaagagcaagagactgagaaagaacgtgaagcagcacgccgaccagaccgtgaacgaggacagcgagggcagagacctgagacaggtgaccagcaccaccaagagctgcagagagaagaccgagctgacccccgaccagcagaccctgctgcacttcatcatggacagctacaacaagcagagaatgccccaggagatcaccaacaagatcctgaaggaggagttcagcgccgaggagaacttcctgatcctgaccgagatggccaccaaccacgtgcaggtgctggtggagttcaccaagaagctgcccggcttccagaccctggaccacgaggaccagatcgccctgctgaagggcagcgccgtggaggccatgttcctgagaagcgccgagatcttcaacaagaagctgcccagcggccacagcgacctgctggaggagagaatcagaaacagcggcatcagcgacgagtacatcacccccatgttcagcttctacaagagcatcggcgagctgaagatgacccaggaggagtacgccctgctgaccgccatcgtgatcctgagccccgacagacagtacatcaaggacagagaggccgtggagaagctgcaggagcccctgctggacgtgctgcagaagctgtgcaagatccaccagcccgagaacccccagcacttcgcctgcctgctgggcagactgaccgagctgagaaccttcaaccaccaccacgccgagatgctgatgagctggagagtgaacgaccacaagttcacccccctgctgtgcgagatctgggacgtgcagtag

SEQ ID NO: 8865 - DNA, 1419 bp, Artificial Sequence
  Description of Artificial Sequence: Synthetic coding sequence
atgggcagcaagatgaacctgatcgagcacagccacctgcccaccaccgacgagttcagcttcagcgagaacctgttcggcgtgctgaccgagcaggtggccggccccctgggccagaacctggaggtggagccctacagccagtacagcaacgtgcagttcccccaggtgcagccccagatcagcagcagcagctactacagcaacctgggcttctacccccagcagcccgaggagtggtacagccccggcatctacgagctgagaagaatgcccgccgagaccctgtaccagggcgagaccgaggtggccgagatgcccgtgaccaagaagcccagaatgggcgccagcgccggcagaatcaagggcgacgagctgtgcgtggtgtgcggcgacagagccagcggctaccactacaacgccctgacctgcgagggctgcaagggcttcttcagaagaagcatcaccaagaacgccgtgtacaagtgcaagaacggcggcaactgcgtgatggacatgtacatgagaagaaagtgccaggagtgcagactgagaaagtgcaaggagatgggcatgctggccgagtgcctgctgaccgagatccagtgcaagagcaagagactgagaaagaacgtgaagcagcacgccgaccagaccgtgaacgaggacagcgagggcagagacctgagacaggtgaccagcaccaccaagagctgcagagagaagaccgagctgacccccgaccagcagaccctgctgcacttcatcatggacagctacaacaagcagagaatgccccaggagatcaccaacaagatcctgaaggaggagttcagcgccgaggagaacttcctgatcctgaccgagatggccaccaaccacgtgcaggtgctggtggagttcaccaagaagctgcccggcttccagaccctggaccacgaggaccagatcgccctgctgaagggcagcgccgtggaggccatgttcctgagaagcgccgagatcttcaacaagaagctgcccagcggccacagcgacctgctggaggagagaatcagaaacagcggcatcagcgacgagtacatcacccccatgttcagcttctacaagagcatcggcgagctgaagatgacccaggaggagtacgccctgctgaccgccatcgtgatcctgagccccgacagacagtacatcaaggacagagaggccgtggagaagctgcaggagcccctgctggacgtgctgcagaagctgtgcaagatccaccagcccgagaacccccagcacttcgcctgcctgctgggcagactgaccgagctgagaaccttcaaccaccaccacgccgagatgctgatgagctggagagtgaacgaccacaagttcacccccctgctgtgcgagatctgggacgtgcagtag

SEQ ID NO: 8866 - DNA, 1461 bp, Artificial Sequence
  Description of Artificial Sequence: Synthetic coding sequence
atggtgatgcagttccagggcctggagaaccccatccagatcagcccccactgcagctgcacccccagcggcttcttcatggagatgatgagcatgaagcccgccaagggcgtgctgaccgagcaggtggccggccccctgggccagaacctggaggtggagccctacagccagtacagcaacgtgcagttcccccaggtgcagccccagatcagcagcagcagctactacagcaacctgggcttctacccccagcagcccgaggagtggtacagccccggcatctacgagctgagaagaatgcccgccgagaccctgtaccagggcgagaccgaggtggccgagatgcccgtgaccaagaagcccagaatgggcgccagcgccggcagaatcaagggcgacgagctgtgcgtggtgtgcggcgacagagccagcggctaccactacaacgccctgacctgcgagggctgcaagggcttcttcagaagaagcatcaccaagaacgccgtgtacaagtgcaagaacggcggcaactgcgtgatggacatgtacatgagaagaaagtgccaggagtgcagactgagaaagtgcaaggagatgggcatgctggccgagtgcatgtacaccggcctgctgaccgagatccagtgcaagagcaagagactgagaaagaacgtgaagcagcacgccgaccagaccgtgaacgaggacagcgagggcagagacctgagacaggtgaccagcaccaccaagagctgcagagagaagaccgagctgacccccgaccagcagaccctgctgcacttcatcatggacagctacaacaagcagagaatgccccaggagatcaccaacaagatcctgaaggaggagttcagcgccgaggagaacttcctgatcctgaccgagatggccaccaaccacgtgcaggtgctggtggagttcaccaagaagctgcccggcttccagaccctggaccacgaggaccagatcgccctgctgaagggcagcgccgtggaggccatgttcctgagaagcgccgagatcttcaacaagaagctgcccagcggccacagcgacctgctggaggagagaatcagaaacagcggcatcagcgacgagtacatcacccccatgttcagcttctacaagagcatcggcgagctgaagatgacccaggaggagtacgccctgctgaccgccatcgtgatcctgagccccgacagacagtacatcaaggacagagaggccgtggagaagctgcaggagcccctgctggacgtgctgcagaagctgtgcaagatccaccagcccgagaacccccagcacttcgcctgcctgctgggcagactgaccgagctgagaaccttcaaccaccaccacgccgagatgctgatgagctggagagtgaacgaccacaagttcacccccctgctgtgcgagatctgggacgtgcagtag

SEQ ID NO: 8867 - DNA, 1074 bp, Artificial Sequence
  Description of Artificial Sequence: Synthetic coding sequence
atggccagcagagaggacgagctgagaaactgcgtggtgtgcggcgaccaggccaccggctaccacttcaacgccctgacctgcgagggctgcaagggcttcttcagaagaaccgtgagcaagagcatcggccccacctgccccttcgccggcagctgcgaggtgagcaagacccagagaagacactgccccgcctgcagactgcagaagtgcctggacgccggcatgagaaaggacatgatcctgagcgccgaggccctggccctgagaagagccaagcaggcccagagaagagcccagcagacccccgtgcagctgagcaaggagcaggaggagctgatcagaaccctgctgggcgcccacaccagacacatgggcaccatgttcgagcagttcgtgcagttcagaccccccgcccacctgttcatccaccaccagcccctgcccaccctggcccccgtgctgcccctggtgacccacttcgccgacatcaacaccttcatggtgctgcaggtgatcaagttcaccaaggacctgcccgtgttcagaagcctgcccatcgaggaccagatcagcctgctgaagggcgccgccgtggagatctgccacatcgtgctgaacaccaccttctgcctgcagacccagaacttcctgtgcggccccctgagatacaccatcgaggacggcgccagagtgagccccaccgtgggcttccaggtggagttcctggagctgctgttccacttccacggcaccctgagaaagctgcagctgcaggagcccgagtacgtgctgctggccgccatggccctgttcagccccgccccctacctgaccgacagacccggcgtgacccagagagacgagatcgaccagctgcaggaggagatggccctgaccctgcagagctacatcaagggccagcagagaagacccagagacagattcctgtacgccaagctgctgggcctgctggccgagctgagaagcatcaacgaggcctacggctaccagatccagcacatccagggcctgagcgccatgatgcccctgctgcaggagatctgcagctag

SEQ ID NO: 8868 - DNA, 1074 bp, Artificial Sequence; identical to SEQ ID NO: 8867
  Description of Artificial Sequence: Synthetic coding sequence

SEQ ID NO: 8869 - DNA, 975 bp, Artificial Sequence
  Description of Artificial Sequence: Synthetic coding sequence
atgctgcccaagagaagcagaagaaccgtgagcaagagcatcggccccacctgccccttcgccggcagctgcgaggtgagcaagacccagagaagacactgccccgcctgcagactgcagaagtgcctggacgccggcatgagaaaggacatgatcctgagcgccgaggccctggccctgagaagagccaagcaggcccagagaagagcccagcagacccccgtgcagctgagcaaggagcaggaggagctgatcagaaccctgctgggcgcccacaccagacacatgggcaccatgttcgagcagttcgtgcagttcagaccccccgcccacctgttcatccaccaccagcccctgcccaccctggcccccgtgctgcccctggtgacccacttcgccgacatcaacaccttcatggtgctgcaggtgatcaagttcaccaaggacctgcccgtgttcagaagcctgcccatcgaggaccagatcagcctgctgaagggcgccgccgtggagatctgccacatcgtgctgaacaccaccttctgcctgcagacccagaacttcctgtgcggccccctgagatacaccatcgaggacggcgccagagtgggcttccaggtggagttcctggagctgctgttccacttccacggcaccctgagaaagctgcagctgcaggagcccgagtacgtgctgctggccgccatggccctgttcagccccgccccctacctgaccgacagacccggcgtgacccagagagacgagatcgaccagctgcaggaggagatggccctgaccctgcagagctacatcaagggccagcagagaagacccagagacagattcctgtacgccaagctgctgggcctgctggccgagctgagaagcatcaacgaggcctacggctaccagatccagcacatccagggcctgagcgccatgatgcccctgctgcaggagatctgcagctag

SEQ ID NO: 8870 - DNA, 1059 bp, Artificial Sequence
  Description of Artificial Sequence: Synthetic coding sequence
atggccagcagagaggacgagctgagaaactgcgtggtgtgcggcgaccaggccaccggctaccacttcaacgccctgacctgcgagggctgcaagggcttcttcagaagaaccgtgagcaagagcatcggccccacctgccccttcgccggcagctgcgaggtgagcaagacccagagaagacactgccccgcctgcagactgcagaagtgcctggacgccggcatgagaaaggacatgatcctgagcgccgaggccctggccctgagaagagccaagcaggcccagagaagagcccagcagacccccgtgcagctgagcaaggagcaggaggagctgatcagaaccctgctgggcgcccacaccagacacatgggcaccatgttcgagcagttcgtgcagttcagaccccccgcccacctgttcatccaccaccagcccctgcccaccctggcccccgtgctgcccctggtgacccacttcgccgacatcaacaccttcatggtgctgcaggtgatcaagttcaccaaggacctgcccgtgttcagaagcctgcccatcgaggaccagatcagcctgctgaagggcgccgccgtggagatctgccacatcgtgctgaacaccaccttctgcctgcagacccagaacttcctgtgcggccccctgagatacaccatcgaggacggcgccagagtgagccccaccgtgggcttccaggtggagttcctggagctgctgttccacttccacggcaccctgagaaagctgcagctgcaggagcccgagtacgtgctgctggccgccatggccctgttcagccccgacagacccggcgtgacccagagagacgagatcgaccagctgcaggaggagatggccctgaccctgcagagctacatcaagggccagcagagaagacccagagacagattcctgtacgccaagctgctgggcctgctggccgagctgagaagcatcaacgaggcctacggctaccagatccagcacatccagggcctgagcgccatgatgcccctgctgcaggagatctgcagctag

SEQ ID NO: 8871 - DNA, 1047 bp, Artificial Sequence
  Description of Artificial Sequence: Synthetic coding sequence
atggccagcagagaggacgagctgagaaactgcgtggtgtgcggcgaccaggccaccggctaccacttcaacgccctgacctgcgagggctgcaagggcttcttcagaagaaccgtgagcaagagcatcggccccacctgccccttcgccggcagctgcgaggtgagcaagacccagagaagacactgccccgcctgcagactgcagaagtgcctggacgccggcatgagaaaggacatgatcctgagcgccgaggccctggccctgagaagagccaagcaggcccagagaagagcccagcagacccccgtgcagctgagcaaggagcaggaggagctgatcagaaccctgctgggcgcccacaccagacacatgggcaccatgttcgagcagttcgtgcagttcagaccccccgcccacctgttcatccaccaccagcccctgcccaccctggcccccgtgctgcccctggtgacccacttcgccgacatcaacaccttcatggtgctgcaggtgatcaagttcaccaaggacctgcccgtgttcagaagcctgcccatcgaggaccagatcagcctgctgaagggcgccgccgtggagatctgccacatcgtgctgaacaccaccttctgcctgcagacccagaacttcctgtgcggccccctgagatacaccatcgaggacggcgccagagtgggcttccaggtggagttcctggagctgctgttccacttccacggcaccctgagaaagctgcagctgcaggagcccgagtacgtgctgctggccgccatggccctgttcagccccgacagacccggcgtgacccagagagacgagatcgaccagctgcaggaggagatggccctgaccctgcagagctacatcaagggccagcagagaagacccagagacagattcctgtacgccaagctgctgggcctgctggccgagctgagaagcatcaacgaggcctacggctaccagatccagcacatccagggcctgagcgccatgatgcccctgctgcaggagatctgcagctag

SEQ ID NO: 8872 - DNA, 930 bp, Artificial Sequence
  Description of Artificial Sequence: Synthetic coding sequence
atggccagcagagaggacgagctgagaaactgcgtggtgtgcggcgaccaggccaccggctaccacttcaacgccctgacctgcgagggctgcaagggcttcttcagaagaaccgtgagcaagagcatcggccccacctgccccttcgccggcagctgcgaggtgagcaagacccagagaagacactgccccgcctgcagactgcagaagtgcctggacgccggcatgagaaaggacatgatcctgagcgccgaggccctggccctgagaagagccaagcaggcccagagaagagcccagcagacccccgtgcagctgagcaaggagcaggaggagctgatcagaaccctgctgggcgcccacaccagacacatgggcaccatgttcgagcagttcgtgcagttcagaccccccgcccacctgttcatccaccaccagcccctgcccaccctggcccccgtgctgcccctggtgacccacttcgccgacatcaacaccttcatggtgctgcaggtgatcaagttcaccaaggacctgcccgtgttcagaagcctgcccatcgaggaccagatcagcctgctgaagggcgccgccgtggagatctgccacatcgtgctgaacaccaccttctgcctgcagacccagaacttcctgtgcggccccctgagatacaccatcgaggacggcgccagagacagacccggcgtgacccagagagacgagatcgaccagctgcaggaggagatggccctgaccctgcagagctacatcaagggccagcagagaagacccagagacagattcctgtacgccaagctgctgggcctgctggccgagctgagaagcatcaacgaggcctacggctaccagatccagcacatccagggcctgagcgccatgatgcccctgctgcaggagatctgcagctag

SEQ ID NO: 8873 - DNA, 945 bp, Artificial Sequence
  Description of Artificial Sequence: Synthetic coding sequence
atggccagcagagaggacgagctgagaaactgcgtggtgtgcggcgaccaggccaccggctaccacttcaacgccctgacctgcgagggctgcaagggcttcttcagaagaaccgtgagcaagagcatcggccccacctgccccttcgccggcagctgcgaggtgagcaagacccagagaagacactgccccgcctgcagactgcagaagtgcctggacgccggcatgagaaaggacatgatcctgagcgccgaggccctggccctgagaagagccaagcaggcccagagaagagcccagcagacccccgtgcagctgagcaaggagcaggaggagctgatcagaaccctgctgggcgcccacaccagacacatgggcaccatgttcgagcagttcgtgcagttcagaccccccgcccacctgttcatccaccaccagcccctgcccaccctggcccccgtgctgcccctggtgacccacttcgccgacatcaacaccttcatggtgctgcaggtgatcaagttcaccaaggacctgcccgtgttcagaagcctgcccatcgaggaccagatcagcctgctgaagggcgccgccgtggagatctgccacatcgtgctgaacaccaccttctgcctgcagacccagaacttcctgtgcggccccctgagatacaccatcgaggacggcgccagagccccctacctgaccgacagacccggcgtgacccagagagacgagatcgaccagctgcaggaggagatggccctgaccctgcagagctacatcaagggccagcagagaagacccagagacagattcctgtacgccaagctgctgggcctgctggccgagctgagaagcatcaacgaggcctacggctaccagatccagcacatccagggcctgagcgccatgatgcccctgctgcaggagatctgcagctag

SEQ ID NO: 8874 - DNA, 948 bp, Artificial Sequence
  Description of Artificial Sequence: Synthetic coding sequence
atgctgcccaagagaagcagaagaaccgtgagcaagagcatcggccccacctgccccttcgccggcagctgcgaggtgagcaagacccagagaagacactgccccgcctgcagactgcagaagtgcctggacgccggcatgagaaaggacatgatcctgagcgccgaggccctggccctgagaagagccaagcaggcccagagaagagcccagcagacccccgtgcagctgagcaaggagcaggaggagctgatcagaaccctgctgggcgcccacaccagacacatgggcaccatgttcgagcagttcgtgcagttcagaccccccgcccacctgttcatccaccaccagcccctgcccaccctggcccccgtgctgcccctggtgacccacttcgccgacatcaacaccttcatggtgctgcaggtgatcaagttcaccaaggacctgcccgtgttcagaagcctgcccatcgaggaccagatcagcctgctgaagggcgccgccgtggagatctgccacatcgtgctgaacaccaccttctgcctgcagacccagaacttcctgtgcggccccctgagatacaccatcgaggacggcgccagagtgagccccaccgtgggcttccaggtggagttcctggagctgctgttccacttccacggcaccctgagaaagctgcagctgcaggagcccgagtacgtgctgctggccgccatggccctgttcagccccgccccctacctgaccgacagacccggcgtgacccagagagacgagatcgaccagctgcaggaggagatggccctgaccctgcagagctacatcaagggccagcagagaagacccagagacagaagccccggcaccccctggatccactggagcggcaagatgctgggccccaagatcggccccggcagcaagggcgcccagtggctgcagtag

SEQ ID NO: 8875 - DNA, 1023 bp, Artificial Sequence
  Description of Artificial Sequence: Synthetic coding sequence
atggccagcagagaggacgagctgagaaactgcgtggtgtgcggcgaccaggccaccggctaccacttcaacgccctgacctgcgagggctgcaagggcttcttcagaagaaccgtgagcaagagcatcggccccacctgccccttcgccggcagctgcgaggtgagcaagacccagagaagacactgccccgcctgcagactgcagaagtgcctggacgccggcatgagaaaggacatgatcctgagcgccgaggccctggccctgagaagagccaagcaggcccagagaagagcccagcagacccccgtgcagctgagcaaggagcaggaggagctgatcagaaccctgctgggcgcccacaccagacacatgggcaccatgttcgagcagttcgtgcagttcagaccccccgcccacctgttcatccaccaccagcccctgcccaccctggcccccgtgctgcccctggtgacccacttcgccgacatcaacaccttcatggtgctgcaggtgatcaagttcaccaaggacctgcccgtgttcagaagcctgcccatcgaggaccagatcagcctgctgaagggcgccgccgtggagatctgccacatcgtgctgaacaccaccttctgcctgcagacccagaacttcctgtgcggccccctgagatacaccatcgaggacggcgccagagtgggcttccaggtggagttcctggagctgctgttccacttccacggcaccctgagaaagctgcagctgcaggagcccgagtacgtgctgctggccgccatggccctgttcagccccgccccctacctgaccgacagacccggcgtgacccagagagacgagatcgaccagctgcaggaggagatggccctgaccctgcagagctacatcaagggccagcagagaagacccagagacagaagccccggcaccccctggatccactggagcggcaagatgctgggccccaagatcggccccggcagcaagggcgcccagtggctgcagtag

SEQ ID NO: 8876 - DNA, 921 bp, Artificial Sequence
  Description of Artificial Sequence: Synthetic coding sequence
atgctgcccaagagaagcagaagaaccgtgagcaagagcatcggccccacctgccccttcgccggcagctgcgaggtgagcaagacccagagaagacactgccccgcctgcagactgcagaagtgcctggacgccggcatgagaaaggacatgatcctgagcgccgaggccctggccctgagaagagccaagcaggcccagagaagagcccagcagacccccgtgcagctgagcaaggagcaggaggagctgatcagaaccctgctgggcgcccacaccagacacatgggcaccatgttcgagcagttcgtgcagttcagaccccccgcccacctgttcatccaccaccagcccctgcccaccctggcccccgtgctgcccctggtgacccacttcgccgacatcaacaccttcatggtgctgcaggtgatcaagttcaccaaggacctgcccgtgttcagaagcctgcccatcgaggaccagatcagcctgctgaagggcgccgccgtggagatctgccacatcgtgctgaacaccaccttctgcctgcagacccagaacttcctgtgcggccccctgagatacaccatcgaggacggcgccagagtgggcttccaggtggagttcctggagctgctgttccacttccacggcaccctgagaaagctgcagctgcaggagcccgagtacgtgctgctggccgccatggccctgttcagccccgacagacccggcgtgacccagagagacgagatcgaccagctgcaggaggagatggccctgaccctgcagagctacatcaagggccagcagagaagacccagagacagaagccccggcaccccctggatccactggagcggcaagatgctgggccccaagatcggccccggcagcaagggcgcccagtggctgcagtag

SEQ ID NO: 8877 - DNA, 1020 bp, Artificial Sequence
  Description of Artificial Sequence: Synthetic coding sequence
atggccagcagagaggacgagctgagaaactgcgtggtgtgcggcgaccaggccaccggctaccacttcaacgccctgacctgcgagggctgcaagggcttcttcagaagaaccgtgagcaagagcatcggccccacctgccccttcgccggcagctgcgaggtgagcaagacccagagaagacactgccccgcctgcagactgcagaagtgcctggacgccggcatgagaaaggacatgatcctgagcgccgaggccctggccctgagaagagccaagcaggcccagagaagagcccagcagacccccgtgcagctgagcaaggagcaggaggagctgatcagaaccctgctgggcgcccacaccagacacatgggcaccatgttcgagcagttcgtgcagttcagaccccccgcccacctgttcatccaccaccagcccctgcccaccctggcccccgtgctgcccctggtgacccacttcgccgacatcaacaccttcatggtgctgcaggtgatcaagttcaccaaggacctgcccgtgttcagaagcctgcccatcgaggaccagatcagcctgctgaagggcgccgccgtggagatctgccacatcgtgctgaacaccaccttctgcctgcagacccagaacttcctgtgcggccccctgagatacaccatcgaggacggcgccagagtgagccccaccgtgggcttccaggtggagttcctggagctgctgttccacttccacggcaccctgagaaagctgcagctgcaggagcccgagtacgtgctgctggccgccatggccctgttcagccccgacagacccggcgtgacccagagagacgagatcgaccagctgcaggaggagatggccctgaccctgcagagctacatcaagggccagcagagaagacccagagacagaagccccggcaccccctggatccactggagcggcaagatgctgggccccaagatcggccccggcagcaagggcgcccagtggctgcagtag

SEQ ID NO: 8878 - DNA, 360 bp, Artificial Sequence
  Description of Artificial Sequence: Synthetic coding sequence
atggccagcagagaggacgagctgagaaactgcgtggtgtgcggcgaccaggccaccggctaccacttcaacgccctgacctgcgagggctgcaagggcttcttcagaagaaccgtgagcaagagcatcggccccacctgccccttcgccggcagctgcgaggtgagcaagacccagagaagacactgccccgcctgcagactgcagaagtgcctggacgccggcatgagaaaggacaccagcagcagcagcgtgcaccccagccccgccctggcccaccccggcccctgcgccgccagcggccacaccctgagaagacaccagcacttccacggcaccgccagccaccaggtgtactag

SEQ ID NO: 8879 - DNA, 444 bp, Artificial Sequence
  Description of Artificial Sequence: Synthetic coding sequence
atggccagcagagaggacgagctgagaaactgcgtggtgtgcggcgaccaggccaccggctaccacttcaacgccctgacctgcgagggctgcaagggcttcttcagaagaaccgtgagcaagagcatcggccccacctgccccttcgccggcagctgcgaggtgagcaagacccagagaagacactgccccgcctgcagactgcagaagtgcctggacgccggcatgagaaaggacatcccctgccccctgaagaccagaagccccttcagcagagagcagctgtggaagagcgtgaccagctacagcatccccctgagcgtgagcaagcacaagaccagcagcgccggcctgttcgccacccagctgaagatggagcccgtgaccgacctggagctgcccagagagatgagactgatcagctgcaagagaagatggcactag

SEQ ID NO: 8880 - DNA, 843 bp, Artificial Sequence
  Description of Artificial Sequence: Synthetic coding sequence
atgctgcccaagagaagcagaagaaccgtgagcaagagcatcggccccacctgccccttcgccggcagctgcgaggtgagcaagacccagagaagacactgccccgcctgcagactgcagaagtgcctggacgccggcatgagaaaggacatgatcctgagcgccgaggccctggccctgagaagagccaagcaggcccagagaagagcccagcagacccccgtgcagctgagcaaggagcaggaggagctgatcagaaccctgctgggcgcccacaccagacacatgggcaccatgttcgagcagttcgtgcagttcagaccccccgcccacctgttcatccaccaccagcccctgcccaccctggcccccgtgctgcccctggtgacccacttcgccgacatcaacaccttcatggtgctgcaggtgatcaagttcaccaaggacctgcccgtgttcagaagcctgcccatcgaggaccagatcagcctgctgaagggcgccgccgtggagatctgccacatcgtgctgaacaccaccttctgcctgcagacccagaacttcctgtgcggccccctgagatacaccatcgaggacggcgccagagacagacccggcgtgacccagagagacgagatcgaccagctgcaggaggagatggccctgaccctgcagagctacatcaagggccagcagagaagacccagagacagattcctgtacgccaagctgctgggcctgctggccgagctgagaagcatcaacgaggcctacggctaccagatccagcacatccagggcctgagcgccatgatgcccctgctgcaggagatctgcagctag

SEQ ID NO: 8881 - DNA, 891 bp, Artificial Sequence
  Description of Artificial Sequence: Synthetic coding sequence
atggccagcagagaggacgagctgagaaactgcgtggtgtgcggcgaccaggccaccggctaccacttcaacgccctgacctgcgagggctgcaagggcttcttcagaagaaccgtgagcaagagcatcggccccacctgccccttcgccggcagctgcgaggtgagcaagacccagagaagacactgccccgcctgcagactgcagaagtgcctggacgccggcatgagaaaggacatgatcctgagcgccgaggccctggccctgagaagagccaagcaggcccagagaagagcccagcagacccccgtgcagctgagcaaggagcaggaggagctgatcagaaccctgctgggcgcccacaccagacacatgggcaccatgttcgagcagttcgtgcagttcagaccccccgcccacctgttcatccaccaccagcccctgcccaccctggcccccgtgctgcccctggtgacccacttcgccgacatcaacaccttcatggtgctgcaggtgatcaagttcaccaaggacctgcccgtgttcagaagcctgcccatcgaggaccagatcagcctgctgaagggcgccgccgtggagatctgccacatcgtgctgaacaccaccttctgcctgcagacccagaacttcctgtgcggccccctgagatacaccatcgaggacggcgccagagacagacccggcgtgacccagagagacgagatcgaccagctgcaggaggagatggccctgaccctgcagagctacatcaagggccagcagagaagacccagagacagaagccccggcaccccctggatccactggagcggcaagatgctgggccccaagatcggccccggcagcaagggcgcccagtggctgcagtag

SEQ ID NO: 8882 - DNA, 825 bp, Artificial Sequence
  Description of Artificial Sequence: Synthetic coding sequence
atgctgcccaagagaagcagaagaaccgtgagcaagagcatcggccccacctgccccttcgccggcagctgcgaggtgagcaagacccagagaagacactgccccgcctgcagactgcagaagtgcctggacgccggcatgagaaaggacatgatcctgagcgccgaggccctggccctgagaagagccaagcaggcccagagaagagcccagcagacccccgtgcagctgagcaaggagcaggaggagctgatcagaaccctgctgggcgcccacaccagacacatgggcaccatgttcgagcagttcgtgcagttcagaccccccgcccacctgttcatccaccaccagcccctgcccaccctggcccccgtgctgcccctggtgacccacttcgccgacatcaacaccttcatggtgctgcaggtgatcaagttcaccaaggacctgcccgtgttcagaagcctgcccatcgaggaccagatcagcctgctgaagggcgccgccgtggagatctgccacatcgtgctgaacaccaccttctgcctgcagacccagaacttcctgtgcggccccctgagatacaccatcgaggacggcgccagagtgagccccaccgtgggcttccaggtggagttcctggagctgctgttccacttccacggcaccctgagaaagctgcagctgcaggagcccgagtacgtgctgctggccgccatggccctgttcagccccggcgagcacctgcccaagcccagagccttctgctgcaccaccagcgcccagatcctgagcagcctgagccccagcacccaggccttctag

SEQ ID NO: 8883 - DNA, 273 bp, Artificial Sequence
  Description of Artificial Sequence: Synthetic coding sequence
atgctgcccaagagaagcagaagaaccgtgagcaagagcatcggccccacctgccccttcgccggcagctgcgaggtgagcaagacccagagaagacactgccccgcctgcagactgcagaagtgcctggacgccggcatgagaaaggacaccagcagcagcagcgtgcaccccagccccgccctggcccaccccggcccctgcgccgccagcggccacaccctgagaagacaccagcacttccacggcaccgccagccaccaggtgtactag

SEQ ID NO: 8884 - DNA, 357 bp, Artificial Sequence
  Description of Artificial Sequence: Synthetic coding sequence
atgctgcccaagagaagcagaagaaccgtgagcaagagcatcggccccacctgccccttcgccggcagctgcgaggtgagcaagacccagagaagacactgccccgcctgcagactgcagaagtgcctggacgccggcatgagaaaggacatcccctgccccctgaagaccagaagccccttcagcagagagcagctgtggaagagcgtgaccagctacagcatccccctgagcgtgagcaagcacaagaccagcagcgccggcctgttcgccacccagctgaagatggagcccgtgaccgacctggagctgcccagagagatgagactgatcagctgcaagagaagatggcactag

SEQ ID NO: 8885 - DNA, 936 bp, Artificial Sequence
  Description of Artificial Sequence: Synthetic coding sequence
atgctgcccaagagaagcagaagaaccgtgagcaagagcatcggccccacctgccccttcgccggcagctgcgaggtgagcaagacccagagaagacactgccccgcctgcagactgcagaagtgcctggacgccggcatgagaaaggacatgatcctgagcgccgaggccctggccctgagaagagccaagcaggcccagagaagagcccagcagacccccgtgcagctgagcaaggagcaggaggagctgatcagaaccctgctgggcgcccacaccagacacatgggcaccatgttcgagcagttcgtgcagttcagaccccccgcccacctgttcatccaccaccagcccctgcccaccctggcccccgtgctgcccctggtgacccacttcgccgacatcaacaccttcatggtgctgcaggtgatcaagttcaccaaggacctgcccgtgttcagaagcctgcccatcgaggaccagatcagcctgctgaagggcgccgccgtggagatctgccacatcgtgctgaacaccaccttctgcctgcagacccagaacttcctgtgcggccccctgagatacaccatcgaggacggcgccagagtgggcttccaggtggagttcctggagctgctgttccacttccacggcaccctgagaaagctgcagctgcaggagcccgagtacgtgctgctggccgccatggccctgttcagccccgccccctacctgaccgacagacccggcgtgacccagagagacgagatcgaccagctgcaggaggagatggccctgaccctgcagagctacatcaagggccagcagagaagacccagagacagaagccccggcaccccctggatccactggagcggcaagatgctgggccccaagatcggccccggcagcaagggcgcccagtggctgcagtag

SEQ ID NO: 8886 - DNA, 273 bp, Artificial Sequence; identical to SEQ ID NO: 8883
  Description of Artificial Sequence: Synthetic coding sequence

SEQ ID NO: 8887 - DNA, 960 bp, Artificial Sequence
  Description of Artificial Sequence: Synthetic coding sequence
atgctgcccaagagaagcagaagaaccgtgagcaagagcatcggccccacctgccccttcgccggcagctgcgaggtgagcaagacccagagaagacactgccccgcctgcagactgcagaagtgcctggacgccggcatgagaaaggacatgatcctgagcgccgaggccctggccctgagaagagccaagcaggcccagagaagagcccagcagacccccgtgcagctgagcaaggagcaggaggagctgatcagaaccctgctgggcgcccacaccagacacatgggcaccatgttcgagcagttcgtgcagttcagaccccccgcccacctgttcatccaccaccagcccctgcccaccctggcccccgtgctgcccctggtgacccacttcgccgacatcaacaccttcatggtgctgcaggtgatcaagttcaccaaggacctgcccgtgttcagaagcctgcccatcgaggaccagatcagcctgctgaagggcgccgccgtggagatctgccacatcgtgctgaacaccaccttctgcctgcagacccagaacttcctgtgcggccccctgagatacaccatcgaggacggcgccagagtgggcttccaggtggagttcctggagctgctgttccacttccacggcaccctgagaaagctgcagctgcaggagcccgagtacgtgctgctggccgccatggccctgttcagccccgacagacccggcgtgacccagagagacgagatcgaccagctgcaggaggagatggccctgaccctgcagagctacatcaagggccagcagagaagacccagagacagattcctgtacgccaagctgctgggcctgctggccgagctgagaagcatcaacgaggcctacggctaccagatccagcacatccagggcctgagcgccatgatgcccctgctgcaggagatctgcagctag

SEQ ID NO: 8888 - DNA, 357 bp, Artificial Sequence; identical to SEQ ID NO: 8884
  Description of Artificial Sequence: Synthetic coding sequence

SEQ ID NO: 8889 - DNA, 444 bp, Artificial Sequence; identical to SEQ ID NO: 8879
  Description of Artificial Sequence: Synthetic coding sequence

SEQ ID NO: 8890 - DNA, 273 bp, Artificial Sequence; identical to SEQ ID NO: 8883
  Description of Artificial Sequence: Synthetic coding sequence

SEQ ID NO: 8891 - DNA, 804 bp, Artificial Sequence
  Description of Artificial Sequence: Synthetic coding sequence
atgctgcccaagagaagcagaagaaccgtgagcaagagcatcggccccacctgccccttcgccggcagctgcgaggtgagcaagacccagagaagacactgccccgcctgcagactgcagaagtgcctggacgccggcatgagaaaggacatgatcctgagcgccgaggccctggccctgagaagagccaagcaggcccagagaagagcccagcagacccccgtgcagctgagcaaggagcaggaggagctgatcagaaccctgctgggcgcccacaccagacacatgggcaccatgttcgagcagttcgtgcagttcagaccccccgcccacctgttcatccaccaccagcccctgcccaccctggcccccgtgctgcccctggtgacccacttcgccgacatcaacaccttcatggtgctgcaggtgatcaagttcaccaaggacctgcccgtgttcagaagcctgcccatcgaggaccagatcagcctgctgaagggcgccgccgtggagatctgccacatcgtgctgaacaccaccttctgcctgcagacccagaacttcctgtgcggccccctgagatacaccatcgaggacggcgccagagacagacccggcgtgacccagagagacgagatcgaccagctgcaggaggagatggccctgaccctgcagagctacatcaagggccagcagagaagacccagagacagaagccccggcaccccctggatccactggagcggcaagatgctgggccccaagatcggccccggcagcaagggcgcccagtggctgcagtag

SEQ ID NO: 8892 - DNA, 717 bp, Artificial Sequence
  Description of Artificial Sequence: Synthetic coding sequence
atggccagcagagaggacgagctgagaaactgcgtggtgtgcggcgaccaggccaccggctaccacttcaacgccctgacctgcgagggctgcaagggcttcttcagaagaaccgtgagcaagagcatcggccccacctgccccttcgccggcagctgcgaggtgagcaagacccagagaagacactgccccgcctgcagactgcagaagtgcctggacgccggcatgagaaaggacatgatcctgagcgccgaggccctggccctgagaagagccaagcaggcccagagaagagcccagcagacccccgtgcagctgagcaaggagcaggaggagctgatcagaaccctgctgggcgcccacaccagacacatgggcaccatgttcgagcagttcgtgcagttcagaccccccgcccacctgttcatccaccaccagcccctgcccaccctggcccccgtgctgcccctggtgacccacttcgccgacatcaacaccttcatggtgctgcaggtgatcaagttcaccaaggacctgcccgtgttcagaagcctgcccatcgaggaccagatcagcctgctgaagggcgccgccgtggagatctgccacatcgtgctgaacaccaccttctgcctgcagacccagaacttcctgtgcggccccctgagatacaccatcgaggacggcgccagaggcgagatggtgctggagcagtag

SEQ ID NO: 8893 - DNA, 1452 bp, Artificial Sequence
  Description of Artificial Sequence: Synthetic coding sequence
atggccaccatcgaggagatcgcccaccagatcatcgagcagcagatgggcgagatcgtgaccgagcagcagaccggccagaagatccagatcgtgaccgccctggaccacaacacccagggcaagcagttcatcctgaccaaccacgacggcagcacccccagcaaggtgatcctggccagacaggacagcacccccggcaaggtgttcctgaccacccccgacgccgccggcgtgaaccagctgttcttcaccacccccgacctgagcgcccagcacctgcagctgctgaccgacaacagccccgaccagggccccaacaaggtgttcgacctgtgcgtggtgtgcggcgacaaggccagcggcagacactacggcgccgtgacctgcgagggctgcaagggcttcttcaagagaagcatcagaaagaacctggtgtacagctgcagaggcagcaaggactgcatcatcaacaagcaccacagaaacagatgccagtactgcagactgcagagatgcatcgccttcggcatgaagcaggacagcgtgcagtgcgagagaaagcccatcgaggtgagcagagagaagagcagcaactgcgccgccagcaccgagaagatctacatcagaaaggacctgagaagccccctgaccgccacccccaccttcgtgaccgacagcgagagcaccagaagcaccggcctgctggacagcggcatgttcatgaacatccaccccagcggcgtgaagaccgagagcgccgtgctgatgaccagcgacaaggccgagagctgccagggcgacctgagcaccctggccaacgtggtgaccagcctggccaacctgggcaagaccaaggacctgagccagaacagcaacgagatgagcatgatcgagagcctgagcaacgacgacaccagcctgtgcgagttccaggagatgcagaccaacggcgacgtgagcagagccttcgacaccctggccaaggccctgaaccccggcgagagcaccgcctgccagagcagcgtggccggcatggagggcagcgtgcacctgatcaccggcgacagcagcatcaactacaccgagaaggagggccccctgctgagcgacagccacgtggccttcagactgaccatgcccagccccatgcccgagtacctgaacgtgcactacatcggcgagagcgccagcagactgctgttcctgagcatgcactgggccctgagcatccccagcttccaggccctgggccaggagaacagcatcagcctggtgaaggcctactggaacgagctgttcaccctgggcctggcccagtgctggcaggtgatgaacgtggccaccatcctggccaccttcgtgaactgcctgcacaacagcctgcagcaggacgccaaggtgatcgccgccctgatccacttcaccagaagagccatcaccgacctgtag

SEQ ID NO: 8894 - DNA, 1812 bp, Artificial Sequence
  Description of Artificial Sequence: Synthetic coding sequence
atggccaccatcgaggagatcgcccaccagatcatcgagcagcagatgggcgagatcgtgaccgagcagcagaccggccagaagatccagatcgtgaccgccctggaccacaacacccagggcaagcagttcatcctgaccaaccacgacggcagcacccccagcaaggtgatcctggccagacaggacagcacccccggcaaggtgttcctgaccacccccgacgccgccggcgtgaaccagctgttcttcaccacccccgacctgagcgcccagcacctgcagctgctgaccgacaacagccccgaccagggccccaacaaggtgttcgacctgtgcgtggtgtgcggcgacaaggccagcggcagacactacggcgccgtgacctgcgagggctgcaagggcttcttcaagagaagcatcagaaagaacctggtgtacagctgcagaggcagcaaggactgcatcatcaacaagcaccacagaaacagatgccagtactgcagactgcagagatgcatcgccttcggcatgaagcaggacagcgtgcagtgcgagagaaagcccatcgaggtgagcagagagaagagcagcaactgcgccgccagcaccgagaagatctacatcagaaaggacctgagaagccccctgaccgccacccccaccttcgtgaccgacagcgagagcaccagaagcaccggcctgctggacagcggcatgttcatgaacatccaccccagcggcgtgaagaccgagagcgccgtgctgatgaccagcgacaaggccgagagctgccagggcgacctgagcaccctggccaacgtggtgaccagcctggccaacctgggcaagaccaaggacctgagccagaacagcaacgagatgagcatgatcgagagcctgagcaacgacgacaccagcctgtgcgagttccaggagatgcagaccaacggcgacgtgagcagagccttcgacaccctggccaaggccctgaaccccggcgagagcaccgcctgccagagcagcgtggccggcatggagggcagcgtgcacctgatcaccggcgacagcagcatcaactacaccgagaaggagggccccctgctgagcgacagccacgtggccttcagactgaccatgcccagccccatgcccgagtacctgaacgtgcactacatcggcgagagcgccagcagactgctgttcctgagcatgcactgggccctgagcatccccagcttccaggccctgggccaggagaacagcatcagcctggtgaaggcctactggaacgagctgttcaccctgggcctggcccagtgctggcaggtgatgaacgtggccaccatcctggccaccttcgtgaactgcctgcacaacagcctgcagcaggacaagatgagcaccgagagaagaaagctgctgatggagcacatcttcaagctgcaggagttctgcaacagcatggtgaagctgtgcatcgacggctacgagtacgcctacctgaaggccatcgtgctgttcagccccgaccaccccagcctggagaacatggagcagatcgagaagttccaggagaaggcctacgtggagttccaggactacatcaccaagacctaccccgacgacacctacagactgagcagactgctgctgagactgcccgccctgagactgatgaacgccaccatcaccgaggagctgttcttcaagggcctgatcggcaacatcagaatcgacagcgtgatcccccacatcctgaagatggagcccgccgactacaacagccagatcatcggccacagcatctag

SEQ ID NO: 8895 - DNA, 1404 bp, Artificial Sequence
  Description of Artificial Sequence: Synthetic coding sequence
atggccaccatcgaggagatcgcccaccagatcatcgagcagcagatgggcgagatcgtgaccgagcagcagaccggccagaagatccagatcgtgaccgccctggaccacaacacccagggcaagcagttcatcctgaccaaccacgacggcagcacccccagcaaggtgatcctggccagacaggacagcacccccggcaaggtgttcctgaccacccccgacgccgccggcgtgaaccagctgttcttcaccacccccgacctgagcgcccagcacctgcagctgctgaccgacaacagccccgaccagggccccaacaaggtgttcgacctgtgcgtggtgtgcggcgacaaggccagcggcagacactacggcgccgtgacctgcgagggctgcaagggcttcttcaagagaagcatcagaaagaacctggtgtacagctgcagaggcagcaaggactgcatcatcaacaagcaccacagaaacagatgccagtactgcagactgcagagatgcatcgccttcggcatgaagcaggacagcgtgcagtgcgagagaaagcccatcgaggtgagcagagagaagagcagcaactgcgccgccagcaccgagaagatctacatcagaaaggacctgagaagccccctgaccgccacccccaccttcgtgaccgacagcgagagcaccagaagcaccggcctgctggacagcggcatgttcatgaacatccaccccagcggcgtgaagaccgagagcgccgtgctgatgaccagcgacaaggccgagagctgccagggcgacctgagcaccctggccaacgtggtgaccagcctggccaacctgggcaagaccaaggacctgagccagaacagcaacgagatgagcatgatcgagagcctgagcaacgacgacaccagcctgtgcgagttccaggagatgcagaccaacggcgacgtgagcagagccttcgacaccctggccaaggccctgaaccccggcgagagcaccgcctgccagagcagcgtggccggcatggagggcagcgtgcacctgatcaccggcgacagcagcatcaactacaccgagaaggagggccccctgctgagcgacagccacgtggccttcagactgaccatgcccagccccatgcccgagtacctgaacgtgcactacatcggcgagagcgccagcagactgctgttcctgagcatgcactgggccctgagcatccccagcttccaggccctgggccaggagaacagcatcagcctggtgaaggcctactggaacgagctgttcaccctgggcctggcccagtgctggcaggtgatgaacgtggccaccatcctggccaccttcgtgaactgcctgcacaacagcctgcagcaggccgagggctag

SEQ ID NO: 8896 - DNA, 51 bp, Artificial Sequence
  Description of Artificial Sequence: Synthetic coding sequence
atggccaccatcgaggagatcgcccaccagatcatcgagcagcagatgtag

SEQ ID NO: 8897 - DNA, 969 bp, Artificial Sequence
  Description of Artificial Sequence: Synthetic coding sequence
atgtgccccgtggacaaggcccacagaaaccagtgccaggcctgcagactgaagaagtgcctgcaggccggcatgaaccaggacgccgtgcagaacgagagacagcccagaagcaccgcccaggtgcacctggacagcatggagagcaacaccgagagcagacccgagagcctggtggccccccccgcccccgccggcagaagccccagaggccccacccccatgagcgccgccagagccctgggccaccacttcatggccagcctgatcaccgccgagacctgcgccaagctggagcccgaggacgccgacgagaacatcgacgtgaccagcaacgaccccgagttccccagcagcccctacagcagcagcagcccctgcggcctggacagcatccacgagaccagcgccagactgctgttcatggccgtgaagtgggccaagaacctgcccgtgttcagcagcctgcccttcagagaccaggtgatcctgctggaggaggcctggagcgagctgttcctgctgggcgccatccagtggagcctgcccctggacagctgccccctgctggccccccccgaggccagcgccgccggcggcgcccagggcagactgaccctggccagcatggagaccagagtgctgcaggagaccatcagcagattcagagccctggccgtggaccccaccgagttcgcctgcatgaaggccctggtgctgttcaagcccgagaccagaggcctgaaggaccccgagcacgtggaggccctgcaggaccagagccaggtgatgctgagccagcacagcaaggcccaccaccccagccagcccgtgagattcggcaagctgctgctgctgctgcccagcctgagattcatcaccgccgagagaatcgagctgctgttcttcagaaagaccatcggcaacacccccatggagaagctgctgtgcgacatgttcaagaactag

SEQ ID NO: 8898 - DNA, 1104 bp, Artificial Sequence
  Description of Artificial Sequence: Synthetic coding sequence
atggagaccagacccaccgccctgatgagcagcaccgtggccgccgccgcccccgccgccggcgccgccagcagaaaggagagccccggcagatggggcctgggcgaggaccccaccggcgtgagccccagcctgcagtgcagagtgtgcggcgacagcagcagcggcaagcactacggcatctacgcctgcaacggctgcagcggcttcttcaagagaagcgtgagaagaagactgatctacagatgccaggtgggcgccggcatgtgccccgtggacaaggcccacagaaaccagtgccaggcctgcagactgaagaagtgcctgcaggccggcatgaaccaggacgccgtgcagaacgagagacagcccagaagcaccgcccaggtgcacctggacagcatggagagcaacaccgagagcagacccgagagcctggtggccccccccgcccccgccggcagaagccccagaggccccacccccatgagcgccgccagagccctgggccaccacttcatggccagcctgatcaccgccgagacctgcgccaagctggagcccgaggacgccgacgagaacatcgacgtgaccagcaacgaccccgagttccccagcagcccctacagcagcagcagcccctgcggcctggacagcatccacgagaccagcgccagactgctgttcatggccgtgaagtgggccaagaacctgcccgtgttcagcagcctgcccttcagagaccaggtgatcctgctggaggaggcctggagcgagctgttcctgctgggcgccatccagtggagcctgcccctggacagctgccccctgctggccccccccgaggccagcgccgccggcggcgcccagggcagactgaccctggccagcatggagaccagagtgctgcaggagaccatcagcagattcagagccctggccgtggaccccaccgagttcgcctgcatgaaggccctggtgctgttcaagcccgagaccagaggcctgaaggaccccgagcacgtggaggccctgcaggaccagagccaggtgatgctgagccagcacagcaaggcccaccaccccagccagcccgtgagatag

SEQ ID NO: 8899 - DNA, 1431 bp, Artificial Sequence
  Description of Artificial Sequence: Synthetic coding sequence
atggagagagacgagcccccccccagcggcggcggcggcggcggcggcagcgccggcttcctggagccccccgccgccctgccccccccccccagaaacggcttctgccaggacgagctggccgagctggaccccggcaccaacgacagagccgagcagagaacctgcctgatctgcggcgacagagccaccggcctgcactacggcatcatcagctgcgagggctgcaagggcttcttcaagagaagcatctgcaacaagagagtgtacagatgcagcagagacaagaactgcgtgatgagcagaaagcagagaaacagatgccagtactgcagactgctgaagtgcctgcagatgggcatgaacagaaaggccatcagagaggacggcatgcccggcggcagaaacaagagcatcggccccgtgcagatcagcgaggaggagatcgagagaatcatgagcggccaggagttcgaggaggaggccaaccactggagcaaccacggcgacagcgaccacagcagccccggcaacagagccagcgagagcaaccagcccagccccggcagcaccctgagcagcagcagaagcgtggagctgaacggcttcatggccttcagagagcagtacatgggcatgagcgtgcccccccactaccagtacatcccccacctgttcagctacagcggccacagccccctgctgccccagcaggccagaagcctggacccccagagctacagcctgatccaccagctgctgagcgccgaggacctggagcccctgggcacccccatgctgatcgaggacggctacgccgtgacccaggccgagctgttcgccctgctgtgcagactggccgacgagctgctgttcagacagatcgcctggatcaagaagctgcccttcttctgcgagctgagcatcaaggactacacctgcctgctgagcagcacctggcaggagctgatcctgctgagcagcctgaccgtgtacagcaagcagatcttcggcgagctggccgacgtgaccgccaagtacagccccagcgacgaggagctgcacagattcagcgacgagggcatggaggtgatcgagagactgatctacctgtaccacaagttccaccagctgaaggtgagcaacgaggagtacgcctgcatgaaggccatcaacttcctgaaccaggacatcagaggcctgaccagcgccagccagctggagcagctgaacaagagatactggtacatctgccaggacttcaccgagtacaagtacacccaccagcccaacagattccccgacctgatgatgtgcctgcccgagatcagatacatcgccggcaagatggtgaacgtgcccctggagcagctgcccctgctgttcaaggtggtgctgcacagctgcaagaccagcgtgggcaaggagtag

SEQ ID NO: 8900 - DNA, 1428 bp, Artificial Sequence
  Description of Artificial Sequence: Synthetic coding sequence
atggagagagacgagcccccccccagcggcggcggcggcggcggcggcagcgccggcttcctggagccccccgccgccctgccccccccccccagaaacggcttctgccaggacgagctggccgagctggaccccggcaccaacgacagagccgagcagagaacctgcctgatctgcggcgacagagccaccggcctgcactacggcatcatcagctgcgagggctgcaagggcttcttcaagagaagcatctgcaacaagagagtgtacagatgcagcagagacaagaactgcgtgatgagcagaaagcagagaaacagatgccagtactgcagactgctgaagtgcctgcagatgggcatgaacagaaaggccatcagagaggacggcatgcccggcggcagaaacaagagcatcggccccgtgcagatcagcgaggaggagatcgagagaatcatgagcggccaggagttcgaggaggaggccaaccactggagcaaccacggcgacagcgaccacagcagccccggcaacagagccagcgagagcaaccagcccagccccggcagcaccctgagcagcagaagcgtggagctgaacggcttcatggccttcagagagcagtacatgggcatgagcgtgcccccccactaccagtacatcccccacctgttcagctacagcggccacagccccctgctgccccagcaggccagaagcctggacccccagagctacagcctgatccaccagctgctgagcgccgaggacctggagcccctgggcacccccatgctgatcgaggacggctacgccgtgacccaggccgagctgttcgccctgctgtgcagactggccgacgagctgctgttcagacagatcgcctggatcaagaagctgcccttcttctgcgagctgagcatcaaggactacacctgcctgctgagcagcacctggcaggagctgatcctgctgagcagcctgaccgtgtacagcaagcagatcttcggcgagctggccgacgtgaccgccaagtacagccccagcgacgaggagctgcacagattcagcgacgagggcatggaggtgatcgagagactgatctacctgtaccacaagttccaccagctgaaggtgagcaacgaggagtacgcctgcatgaaggccatcaacttcctgaaccaggacatcagaggcctgaccagcgccagccagctggagcagctgaacaagagatactggtacatctgccaggacttcaccgagtacaagtacacccaccagcccaacagattccccgacctgatgatgtgcctgcccgagatcagatacatcgccggcaagatggtgaacgtgcccctggagcagctgcccctgctgttcaaggtggtgctgcacagctgcaagaccagcgtgggcaaggagtag

SEQ ID NO: 8901 - DNA, 1443 bp, Artificial Sequence
  Description of Artificial Sequence: Synthetic coding sequence
atggagagagacgagcccccccccagcggcggcggcggcggcggcggcagcgccggcttcctggagccccccgccgccctgccccccccccccagaaacggcttctgccaggacgagctggccgagctggaccccggcaccatcagcgtgagcgacgacagagccgagcagagaacctgcctgatctgcggcgacagagccaccggcctgcactacggcatcatcagctgcgagggctgcaagggcttcttcaagagaagcatctgcaacaagagagtgtacagatgcagcagagacaagaactgcgtgatgagcagaaagcagagaaacagatgccagtactgcagactgctgaagtgcctgcagatgggcatgaacagaaaggccatcagagaggacggcatgcccggcggcagaaacaagagcatcggccccgtgcagatcagcgaggaggagatcgagagaatcatgagcggccaggagttcgaggaggaggccaaccactggagcaaccacggcgacagcgaccacagcagccccggcaacagagccagcgagagcaaccagcccagccccggcagcaccctgagcagcagcagaagcgtggagctgaacggcttcatggccttcagagagcagtacatgggcatgagcgtgcccccccactaccagtacatcccccacctgttcagctacagcggccacagccccctgctgccccagcaggccagaagcctggacccccagagctacagcctgatccaccagctgctgagcgccgaggacctggagcccctgggcacccccatgctgatcgaggacggctacgccgtgacccaggccgagctgttcgccctgctgtgcagactggccgacgagctgctgttcagacagatcgcctggatcaagaagctgcccttcttctgcgagctgagcatcaaggactacacctgcctgctgagcagcacctggcaggagctgatcctgctgagcagcctgaccgtgtacagcaagcagatcttcggcgagctggccgacgtgaccgccaagtacagccccagcgacgaggagctgcacagattcagcgacgagggcatggaggtgatcgagagactgatctacctgtaccacaagttccaccagctgaaggtgagcaacgaggagtacgcctgcatgaaggccatcaacttcctgaaccaggacatcagaggcctgaccagcgccagccagctggagcagctgaacaagagatactggtacatctgccaggacttcaccgagtacaagtacacccaccagcccaacagattccccgacctgatgatgtgcctgcccgagatcagatacatcgccggcaagatggtgaacgtgcccctggagcagctgcccctgctgttcaaggtggtgctgcacagctgcaagaccagcgtgggcaaggagtag

SEQ ID NO: 8902 - DNA, 1677 bp, Artificial Sequence
  Description of Artificial Sequence: Synthetic coding sequence
atggccatccccggcagacagtacggcctgatcctgcccaagaagacccagcagctgcaccccgtgctgcagaagcccagcgtgttcggcaacgacagcgacgacgacgacgagaccagcgtgagcgagagcctgcagagagaggccgccaagaagcaggccatgaagcagaccaagctggagatccagaaggccctggccgaggacgccaccgtgtacgagtacgacagcatctacgacgagatgcagaagaagaaggaggagaacaaccccaagctgctgctgggcaaggacagaaagcccaagtacatccacaacctgctgaaggccgtggagatcagaaagaaggagcaggagaagagaatggagaagaagatccagagagagagagagatggagaagggcgagttcgacgacaaggaggccttcgtgaccagcgcctacaagaagaagctgcaggagagagccgaggaggaggagagagagaagagagccgccgccctggaggcctgcctggacgtgaccaagcagaaggacctgagcggcttctacagacacctgctgaaccaggccgtgggcgaggaggaggtgcccaagtgcagcttcagagaggccagaagcggcatcaaggaggagaagagcagaggcttcagcaacgaggtgagcagcaagaacagaatcccccaggagaagtgcatcctgcagaccgacgtgaaggtggaggagaaccccgacgccgacagcgacttcgacgccaagagcagcgccgacgacgagatcgaggagaccagagtgaactgcagaagagagaaggtgatcgagacccccgagaacgacttcaagcaccacagaagccagaaccacagcagaagccccagcgaggagagaggccacagcaccagacaccacaccaagggcagcagaaccagcagaggccacgagaagagagaggaccagcaccagcagaagcagagcagagaccaggagaaccactacaccgacagagactacagaaaggagagagacagccacagacacagagaggccagccacagagacagccactggaagagacacgagcaggaggacaagcccagagccagagaccagagagagagaagcgacagagtgtggaagagagagaaggacagagagaagtacagccagagagagcaggagagagacagacagcagaacgaccagaacagacccagcgagaagggcgagaaggaggagaagagcaaggccaaggaggagcacatgaaggtgagaaaggagagatacgagaacaacgacaagtacagagacagagagaagagagaggtgggcgtgcagagcagcgagagaaaccaggacagaaaggagagcagccccaacagcagagccaaggacaagttcctggaccaggagagaagcaacaagatgagaaacatggccaaggacaaggagagaaaccaggagaagcccagcaacagcgagagcagcctgggcgccaagcacagactgaccgaggagggccaggagaagggcaaggagcaggagagaccccccgaggccgtgagcaagttcgccaagagaaacaacgaggagaccgtgatgagcgccagagacagatacctggccagacagatggccagagtgaacgccaagacctacatcgagaaggaggacgactag

SEQ ID NO: 8903 - DNA, 1062 bp, Artificial Sequence
  Description of Artificial Sequence: Synthetic coding sequence
ctgaagatgaccaagctggagatccagaaggccctggccgaggacgccaccgtgtacgagtacgacagcatctacgacgagatgcagaagaagaaggaggagaacaaccccaagctgctgctgggcaaggacagaaagcccaagtacatccacaacctgctgaaggccgtggagatcagaaagaaggagcaggagaagagaatggagaagaagatccagagagagagagagatggagaagggcgagttcgacgacaaggaggccttcgtgaccagcgcctacaagaagaagctgcaggagagagccgaggaggaggagagagagaagagagccgccgccctggaggcctgcctggacgtgaccaagcagaaggacctgagcggcttctacagacacctgctgaaccaggccgtgggcgaggaggaggtgcccaagtgcagcttcagagaggccagaagcggcatcaaggaggagaagagcagaggcttcagcaacgaggtgagcagcaagaacagaatcccccaggagaagtgcatcctgcagaccgacgtgaaggtggaggagaaccccgacgccgacagcgacttcgacgccaagagcagcgccgacgacgagatcgaggagaccagagtgaactgcagaagagagaaggtgatcgagacccccgagaacgacttcaagcaccacagaagccagaaccacagcagaagccccagcgaggagagaggccacagcaccagacaccacaccaagggcagcagaaccagcagaggccacgagaagagagaggaccagcaccagcagaagcagagcagagaccaggagaaccactacaccgacagagactacagaaaggagagagacagccacagacacagagaggccagccacagagacagccactggaagagacacgagcaggaggacaagcccagagccagagaccagagagagagaagcgacagagtgtggaagagagagaaggacagagagaagtacagccagagagagcaggagagagacagacagcagaacgaccagaacagacccagcgagaagtag

SEQ ID NO: 8904 - DNA, 1470 bp, Artificial Sequence
  Description of Artificial Sequence: Synthetic coding sequence
atgctgctgtgcatgaacatgaccgtgttcatgatgaagtgcagaaagaaggaggagaacaaccccaagctgctgctgggcaaggacagaaagcccaagtacatccacaacctgctgaaggccgtggagatcagaaagaaggagcaggagaagagaatggagaagaagatccagagagagagagagatggagaagggcgagttcgacgacaaggaggccttcgtgaccagcgcctacaagaagaagctgcaggagagagccgaggaggaggagagagagaagagagccgccgccctggaggcctgcctggacgtgaccaagcagaaggacctgagcggcttctacagacacctgctgaaccaggccgtgggcgaggaggaggtgcccaagtgcagcttcagagaggccagaagcggcatcaaggaggagaagagcagaggcttcagcaacgaggtgagcagcaagaacagaatcccccaggagaagtgcatcctgcagaccgacgtgaaggtggaggagaaccccgacgccgacagcgacttcgacgccaagagcagcgccgacgacgagatcgaggagaccagagtgaactgcagaagagagaaggtgatcgagacccccgagaacgacttcaagcaccacagaagccagaaccacagcagaagccccagcgaggagagaggccacagcaccagacaccacaccaagggcagcagaaccagcagaggccacgagaagagagaggaccagcaccagcagaagcagagcagagaccaggagaaccactacaccgacagagactacagaaaggagagagacagccacagacacagagaggccagccacagagacagccactggaagagacacgagcaggaggacaagcccagagccagagaccagagagagagaagcgacagagtgtggaagagagagaaggacagagagaagtacagccagagagagcaggagagagacagacagcagaacgaccagaacagacccagcgagaagggcgagaaggaggagaagagcaaggccaaggaggagcacatgaaggtgagaaaggagagatacgagaacaacgacaagtacagagacagagagaagagagaggtgggcgtgcagagcagcgagagaaaccaggacagaaaggagagcagccccaacagcagagccaaggacaagttcctggaccaggagagaagcaacaagatgagaaacatggccaaggacaaggagagaaaccaggagaagcccagcaacagcgagagcagcctgggcgccaagcacagactgaccgaggagggccaggagaagggcaaggagcaggagagaccccccgaggccgtgagcaagttcgccaagagaaacaacgaggagaccgtgatgagcgccagagacagatacctggccagacagatggccagagtgaacgccaagacctacatcgagaaggaggacgactag

SEQ ID NO: 8905 - DNA, 474 bp, Artificial Sequence
  Description of Artificial Sequence: Synthetic coding sequence
atgggcaagcacgagttcagaagcaacatcccctgccacctggtggacatcagctgcggcctgccctgcagcgccaccctgccctgcggcatgcacaagtgccagagactgtgccacaagggcgagtgcctggtggacgagccctgcaagcagccctgcaccacccccagagccgactgcggccacccctgcatggccccctgccacaccagcagcccctgccccgtgaccgcctgcaaggccaaggtggtggagctgcagtgcgagtgcggcagaagaaaggagatggtgatctgcagcgaggccagcagcacctaccagagactggtgatcgccgccatcagcatggccagcaagatcaccgacatgcagctgggcggcagcgtggagatcagcaagctgatcaccaagaaggaggtgcaccaggccagactggagtgcgacgaggagtgcagcgccctggagagaaagtag

SEQ ID NO: 8906 - DNA, 2502 bp, Artificial Sequence
  Description of Artificial Sequence: Synthetic coding sequence
atggccgaggccccccccgtgagcggcaccttcaagttcaacaccgacgccgccgagttcatcccccaggagaagaagaacagcggcctgaactgcggcacccagagaagactggacagcaacagaatcggcagaagaaactacagcagcccccccccctgccacctgagcagacaggtgccctacgacgagatcagcgccgtgcaccagcacagctaccaccccagcggcagcaagcccaagagccagcagaccagcttccagagcagcccctgcaacaagagccccaagagccacggcctgcagaaccagccctggcagaagctgagaaacgagaagcaccacatcagagtgaagaaggcccagagcctggccgagcagaccagcgacaccgccggcctggagagcagcaccagaagcgagagcggcaccgacctgagagagcacagccccagcgagagcgagaaggaggtggtgggcgccgaccccagaggcgccaagcccaagaaggccacccagttcgtgtacagctacggcagaggccccaaggtgaagggcaagctgaagtgcgagtggagcaacagaaccacccccaagcccgaggacgccggccccgagagcaccaagcccgtgggcgtgttccaccccgacagcagcgaggccagcagcagaaagggcgtgctggacggctacggcgccagaagaaacgagcagagaagatacccccagaagagacccccctgggaggtggagggcgccagacccagacccggcagaaacccccccaagcaggagggccacagacacaccaacgccggccacagaaacaacatgggccccatccccaaggacgacctgaacgagagacccgccaagagcacctgcgacagcgagaacctggccgtgatcaacaagagcagcagaagagtggaccaggagaagtgcaccgtgagaagacaggacccccaggtggtgagccccttcagcagaggcaagcagaaccacgtgctgaagaacgtggagacccacaccggcagcctgatcgagcagctgaccaccgagaagtacgagtgcatggtgtgctgcgagctggtgagagtgaccgcccccgtgtggagctgccagagctgctaccacgtgttccacctgaactgcatcaagaagtgggccagaagccccgccagccaggccgacggccagagcggctggagatgccccgcctgccagaacgtgagcgcccacgtgcccaacacctacacctgcttctgcggcaaggtgaagaaccccgagtggagcagaaacgagatcccccacagctgcggcgaggtgtgcagaaagaagcagcccggccaggactgcccccacagctgcaacctgctgtgccaccccggcccctgccccccctgccccgccttcatgaccaagacctgcgagtgcggcagaaccagacacaccgtgagatgcggccaggccgtgagcgtgcactgcagcaacccctgcgagaacatcctgaactgcggccagcaccagtgcgccgagctgtgccacggcggccagtgccagccctgccagatcatcctgaaccaggtgtgctactgcggcagcaccagcagagacgtgctgtgcggcaccgacgtgggcaagagcgacggcttcggcgacttcagctgcctgaagatctgcggcaaggacctgaagtgcggcaaccacacctgcagccaggtgtgccacccccagccctgccagcagtgccccagactgccccagctggtgagatgctgcccctgcggccagacccccctgagccagctgctggagctgggcagcagcagcagaaagacctgcatggaccccgtgcccagctgcggcaaggtgtgcggcaagcccctgccctgcggcagcctggacttcatccacacctgcgagaagctgtgccacgagggcgactgcggcccctgcagcagaaccagcgtgatcagctgcagatgcagcttcagaaccaaggagctgccctgcaccagcctgaagagcgaggacgccaccttcatgtgcgacaagagatgcaacaagaagagactgtgcggcagacacaagtgcaacgagatctgctgcgtggacaaggagcacaagtgccccctgatctgcggcagaaagctgagatgcggcctgcacagatgcgaggagccctgccacagaggcaactgccagacctgctggcaggccagcttcgacgagctgacctgccactgcggcgccagcgtgatctacccccccgtgccctgcggcaccagaccccccgagtgcacccagacctgcgccagagtgcacgagtgcgaccaccccgtgtaccacagctgccacagcgaggagaagtgccccccctgcaccttcctgacccagaagtggtgcatgggcaagcacgagcagagccactactgggccagcacccagaagaagagaagccactacatgaagaagatccccgcccacgcctgcctgtag

SEQ ID NO: 8907 - DNA, 3075 bp, Artificial Sequence
  Description of Artificial Sequence: Synthetic coding sequence
atggccgaggccccccccgtgagcggcaccttcaagttcaacaccgacgccgccgagttcatcccccaggagaagaagaacagcggcctgaactgcggcacccagagaagactggacagcaacagaatcggcagaagaaactacagcagcccccccccctgccacctgagcagacaggtgccctacgacgagatcagcgccgtgcaccagcacagctaccaccccagcggcagcaagcccaagagccagcagaccagcttccagagcagcccctgcaacaagagccccaagagccacggcctgcagaaccagccctggcagaagctgagaaacgagaagcaccacatcagagtgaagaaggcccagagcctggccgagcagaccagcgacaccgccggcctggagagcagcaccagaagcgagagcggcaccgacctgagagagcacagccccagcgagagcgagaaggaggtggtgggcgccgaccccagaggcgccaagcccaagaaggccacccagttcgtgtacagctacggcagaggccccaaggtgaagggcaagctgaagtgcgagtggagcaacagaaccacccccaagcccgaggacgccggccccgagagcaccaagcccgtgggcgtgttccaccccgacagcagcgaggccagcagcagaaagggcgtgctggacggctacggcgccagaagaaacgagcagagaagatacccccagaagagacccccctgggaggtggagggcgccagacccagacccggcagaaacccccccaagcaggagggccacagacacaccaacgccggccacagaaacaacatgggccccatccccaaggacgacctgaacgagagacccgccaagagcacctgcgacagcgagaacctggccgtgatcaacaagagcagcagaagagtggaccaggagaagtgcaccgtgagaagacaggacccccaggtggtgagccccttcagcagaggcaagcagaaccacgtgctgaagaacgtggagacccacaccggcagcctgatcgagcagctgaccaccgagaagtacgagtgcatggtgtgctgcgagctggtgagagtgaccgcccccgtgtggagctgccagagctgctaccacgtgttccacctgaactgcatcaagaagtgggccagaagccccgccagccaggccgacggccagagcggctggagatgccccgcctgccagaacgtgagcgcccacgtgcccaacacctacacctgcttctgcggcaaggtgaagaaccccgagtggagcagaaacgagatcccccacagctgcggcgaggtgtgcagaaagaagcagcccggccaggactgcccccacagctgcaacctgctgtgccaccccggcccctgccccccctgccccgccttcatgaccaagacctgcgagtgcggcagaaccagacacaccgtgagatgcggccaggccgtgagcgtgcactgcagcaacccctgcgagaacatcctgaactgcggccagcaccagtgcgccgagctgtgccacggcggccagtgccagccctgccagatcatcctgaaccaggtgtgctactgcggcagcaccagcagagacgtgctgtgcggcaccgacgtgggcaagagcgacggcttcggcgacttcagctgcctgaagatctgcggcaaggacctgaagtgcggcaaccacacctgcagccaggtgtgccacccccagccctgccagcagtgccccagactgccccagctggtgagatgctgcccctgcggccagacccccctgagccagctgctggagctgggcagcagcagcagaaagacctgcatggaccccgtgcccagctgcggcaaggtgtgcggcaagcccctgccctgcggcagcctggacttcatccacacctgcgagaagctgtgccacgagggcgactgcggcccctgcagcagaaccagcgtgatcagctgcagatgcagcttcagaaccaaggagctgccctgcaccagcctgaagagcgaggacgccaccttcatgtgcgacaagagatgcaacaagaagagactgtgcggcagacacaagtgcaacgagatctgctgcgtggacaaggagcacaagtgccccctgatctgcggcagaaagctgagatgcggcctgcacagatgcgaggagccctgccacagaggcaactgccagacctgctggcaggccagcttcgacgagctgacctgccactgcggcgccagcgtgatctacccccccgtgccctgcggcaccagaccccccgagtgcacccagacctgcgccagagtgcacgagtgcgaccaccccgtgtaccacagctgccacagcgaggagaagtgccccccctgcaccttcctgacccagaagtggtgcatgggcaagcacgagttcagaagcaacatcccctgccacctggtggacatcagctgcggcctgccctgcagcgccaccctgccctgcggcatgcacaagtgccagagactgtgccacaagggcgagtgcctggtggacgagccctgcaagcagccctgcaccacccccagagccgactgcggccacccctgcatggccccctgccacaccagcagcccctgccccgtgaccgcctgcaaggccaaggtggagctgcagtgcgagtgcggcagaagaaaggagatggtgatctgcagcgaggccagcagcacctaccagagaatcgccgccatcagcatggccagcaagatcaccgacatgcagctgggcggcagcgtggagatcagcaagctgatcaccaagaaggaggtgcaccaggccagactggagtgcgacgaggagtgcagcgccctggagagaaagaagagactggccgaggccttccacatcagcgaggacagcgaccccttcaacatcagaagcagcggcagcaagttcagcgacagcctgaaggaggacgccagaaaggacctgaagttcgtgagcgacgtggagaaggagatggagaccctggtggaggccgtgaacaaggtggaggtggagaccagccactggaccttcctgtag

SEQ ID NO: 8908 - DNA, 3363 bp, Artificial Sequence
  Description of Artificial Sequence: Synthetic coding sequence
atggccgaggccccccccgtgagcggcaccttcaagttcaacaccgacgccgccgagttcatcccccaggagaagaagaacagcggcctgaactgcggcacccagagaagactggacagcaacagaatcggcagaagaaactacagcagcccccccccctgccacctgagcagacaggtgccctacgacgagatcagcgccgtgcaccagcacagctaccaccccagcggcagcaagcccaagagccagcagaccagcttccagagcagcccctgcaacaagagccccaagagccacggcctgcagaaccagccctggcagaagctgagaaacgagaagcaccacatcagagtgaagaaggcccagagcctggccgagcagaccagcgacaccgccggcctggagagcagcaccagaagcgagagcggcaccgacctgagagagcacagccccagcgagagcgagaaggaggtggtgggcgccgaccccagaggcgccaagcccaagaaggccacccagttcgtgtacagctacggcagaggccccaaggtgaagggcaagctgaagtgcgagtggagcaacagaaccacccccaagcccgaggacgccggccccgagagcaccaagcccgtgggcgtgttccaccccgacagcagcgaggccagcagcagaaagggcgtgctggacggctacggcgccagaagaaacgagcagagaagatacccccagaagagacccccctgggaggtggagggcgccagacccagacccggcagaaacccccccaagcaggagggccacagacacaccaacgccggccacagaaacaacatgggccccatccccaaggacgacctgaacgagagacccgccaagagcacctgcgacagcgagaacctggccgtgatcaacaagagcagcagaagagtggaccaggagaagtgcaccgtgagaagacaggacccccaggtggtgagccccttcagcagaggcaagcagaaccacgtgctgaagaacgtggagacccacaccggcagcctgatcgagcagctgaccaccgagaagtacgagtgcatggtgtgctgcgagctggtgagagtgaccgcccccgtgtggagctgccagagctgctaccacgtgttccacctgaactgcatcaagaagtgggccagaagccccgccagccaggccgacggccagagcggctggagatgccccgcctgccagaacgtgagcgcccacgtgcccaacacctacacctgcttctgcggcaaggtgaagaaccccgagtggagcagaaacgagatcccccacagctgcggcgaggtgtgcagaaagaagcagcccggccaggactgcccccacagctgcaacctgctgtgccaccccggcccctgccccccctgccccgccttcatgaccaagacctgcgagtgcggcagaaccagacacaccgtgagatgcggccaggccgtgagcgtgcactgcagcaacccctgcgagaacatcctgaactgcggccagcaccagtgcgccgagctgtgccacggcggccagtgccagccctgccagatcatcctgaaccaggtgtgctactgcggcagcaccagcagagacgtgctgtgcggcaccgacgtgggcaagagcgacggcttcggcgacttcagctgcctgaagatctgcggcaaggacctgaagtgcggcaaccacacctgcagccaggtgtgccacccccagccctgccagcagtgccccagactgccccagctggtgagatgctgcccctgcggccagacccccctgagccagctgctggagctgggcagcagcagcagaaagacctgcatggaccccgtgcccagctgcggcaaggtgtgcggcaagcccctgccctgcggcagcctggacttcatccacacctgcgagaagctgtgccacgagggcgactgcggcccctgcagcagaaccagcgtgatcagctgcagatgcagcttcagaaccaaggagctgccctgcaccagcctgaagagcgaggacgccaccttcatgtgcgacaagagatgcaacaagaagagactgtgcggcagacacaagtgcaacgagatctgctgcgtggacaaggagcacaagtgccccctgatctgcggcagaaagctgagatgcggcctgcacagatgcgaggagccctgccacagaggcaactgccagacctgctggcaggccagcttcgacgagctgacctgccactgcggcgccagcgtgatctacccccccgtgccctgcggcaccagaccccccgagtgcacccagacctgcgccagagtgcacgagtgcgaccaccccgtgtaccacagctgccacagcgaggagaagtgccccccctgcaccttcctgacccagaagtggtgcatgggcaagcacgagttcagaagcaacatcccctgccacctggtggacatcagctgcggcctgccctgcagcgccaccctgccctgcggcatgcacaagtgccagagactgtgccacaagggcgagtgcctggtggacgagccctgcaagcagccctgcaccacccccagagccgactgcggccacccctgcatggccccctgccacaccagcagcccctgccccgtgaccgcctgcaaggccaaggtggagctgcagtgcgagtgcggcagaagaaaggagatggtgatctgcagcgaggccagcagcacctaccagagaatcgccgccatcagcatggccagcaagatcaccgacatgcagctgggcggcagcgtggagatcagcaagctgatcaccaagaaggaggtgcaccaggccagactggagtgcgacgaggagtgcagcgccctggagagaaagaagagactggccgaggccttccacatcagcgaggacagcgaccccttcaacatcagaagcagcggcagcaagttcagcgacagcctgaaggaggacgccagaaaggacctgaagttcgtgagcgacgtggagaaggagatggagaccctggtggaggccgtgaacaagggcaagaacagcaagaagagccacagcttcccccccatgaacagagaccacagaagaatcatccacgacctggcccaggtgtacggcctggagagcgtgagctacgacagcgagcccaagagaaacgtggtggtgaccgccatcagaggcaagagcgtgtgcccccccaccaccctgaccggcgtgctggagagagagatgcaggccagaccccccccccccatcccccaccacagacaccagagcgacaagaaccccggcagcagcaacctgcagaagatcaccaaggagcccatcatcgactacttcgacgtgcaggactag

SEQ ID NO: 8909 - DNA, 2391 bp, Artificial Sequence
  Description of Artificial Sequence: Synthetic coding sequence
atggccgaggccccccccgtgagcggcaccttcaagttcaacaccgacgccgccgagttcatcccccaggagaagaagaacagcggcctgaactgcggcacccagagaagactggacagcaacagaatcggcagaagaaactacagcagcccccccccctgccacctgagcagacaggtgccctacgacgagatcagcgccgtgcaccagcacagctaccaccccagcggcagcaagcccaagagccagcagaccagcttccagagcagcccctgcaacaagagccccaagagccacggcctgcagaaccagccctggcagaagctgagaaacgagaagcaccacatcagagtgaagaaggcccagagcctggccgagcagaccagcgacaccgccggcctggagagcagcaccagaagcgagagcggcaccgacctgagagagcacagccccagcgagagcgagaaggaggtggtgggcgccgaccccagaggcgccaagcccaagaaggccacccagttcgtgtacagctacggcagaggccccaaggtgaagggcaagctgaagtgcgagtggagcaacagaaccacccccaagcccgaggacgccggccccgagagcaccaagcccgtgggcgtgttccaccccgacagcagcgaggccagcagcagaaagggcgtgctggacggctacggcgccagaagaaacgagcagagaagatacccccagaagagacccccctgggaggtggagggcgccagacccagacccggcagaaacccccccaagcaggagggccacagacacaccaacgccggccacagaaacaacatgggccccatccccaaggacgacctgaacgagagacccgccaagagcacctgcgacagcgagaacctggccgtgatcaacaagagcagcagaagagtggaccaggagaagtgcaccgtgagaagacaggacccccaggtggtgagccccttcagcagaggcaagcagaaccacgtgctgaagaacgtggagacccacaccggcagcctgatcgagcagctgaccaccgagaagtacgagtgcatggtgtgctgcgagctggtgagagtgaccgcccccgtgtggagctgccagagctgctaccacgtgttccacctgaactgcatcaagaagtgggccagaagccccgccagccaggccgacggccagagcggctggagatgccccgcctgccagaacgtgagcgcccacgtgcccaacacctacacctgcttctgcggcaaggtgaagaaccccgagtggagcagaaacgagatcccccacagctgcggcgaggtgtgcagaaagaagcagcccggccaggactgcccccacagctgcaacctgctgtgccaccccggcccctgccccccctgccccgccttcatgaccaagacctgcgagtgcggcagaaccagacacaccgtgagatgcggccaggccgtgagcgtgcactgcagcaacccctgcgagaacatcctgaactgcggccagcaccagtgcgccgagctgtgccacggcggccagtgccagccctgccagatcatcctgaaccaggtgtgctactgcggcagcaccagcagagacgtgctgtgcggcaccgacgtgggcaagagcgacggcttcggcgacttcagctgcctgaagatctgcggcaaggacctgaagtgcggcaaccacacctgcagccaggtgtgccacccccagccctgccagcagtgccccagactgccccagctggtgagatgctgcccctgcggccagacccccctgagccagctgctggagctgggcagcagcagcagaaagacctgcatggaccccgtgcccagctgcggcaaggtgtgcggcaagcccctgccctgcggcagcctggacttcatccacacctgcgagaagctgtgccacgagggcgactgcggcccctgcagcagaaccagcgtgatcagctgcagatgcagcttcagaaccaaggagctgccctgcaccagcctgaagagcgaggacgccaccttcatgtgcgacaagagatgcaacaagaagagactgtgcggcagacacaagtgcaacgagatctgctgcgtggacaaggagcacaagtgccccctgatctgcggcagaaagctgagatgcggcctgcacagatgcgaggagccctgccacagaggcaactgccagacctgctggcaggccagcttcgacgagctgacctgccactgcggcgccagcgtgatctacccccccgtgccctgcggcaccagaccccccgagtgcacccagacctgcgccagagtgcacgagtgcgaccaccccgtgtaccacagctgccacagcagaagcgtgcccctggccctgagctag

SEQ ID NO: 8910 - DNA, 1917 bp, Artificial Sequence
  Description of Artificial Sequence: Synthetic coding sequence
atgcaggtgagcagcctgaacgaggtgaagatctacagcctgagctgcggcaagagcctgcccgagtggctgagcgacagaaagaagagagccctgcagaagaaggacgtggacgtgagaagaagaatcgagctgatccaggacttcgagatgcccaccgtgtgcaccaccatcaaggtgagcaaggacggccagtacatcctggccaccggcacctacaagcccagagtgagatgctacgacacctaccagctgagcctgaagttcgagagatgcctggacagcgaggtggtgaccttcgagatcctgagcgacgactacagcaagatcgtgttcctgcacaacgacagatacatcgagttccacagccagagcggcttctactacaagaccagaatccccaagttcggcagagacttcagctaccactaccccagctgcgacctgtacttcgtgggcgccagcagcgaggtgtacagactgaacctggagcagggcagatacctgaaccccctgcagaccgacgccgccgagaacaacgtgtgcgacatcaacagcgtgcacggcctgttcgccaccggcaccatcgagggcagagtggagtgctgggaccccagaaccagaaacagagtgggcctgctggactgcgccctgaacagcgtgaccgccgacagcgagatcaacagcctgcccaccatcagcgccctgaagttcaacggcgccctgaccatggccgtgggcaccaccaccggccagggcaagatcttcaccagcctggagcccgagcacgacctgaacgacgtgtgcctgtaccccaacagcggcatgctgctgaccgccaacgagacccccaagatgggcatctactacatccccgtgctgggccccgcccccagatggtgcagcttcctggacaacctgaccgaggagctggaggagaaccccgagagcaccgtgtacgacgactacaagttcgtgaccaagaaggacctggagaacctgggcctgacccacctgatcggcagccccttcctgagagcctacatgcacggcttcttcatggacatcagactgtaccacaaggtgaagctgatggtgaaccccttcgcctacgaggagtacagaaaggacaagatcagacagaagatcgaggagaccagagcccagagagtgcagctgaagaagctgcccaaggtgaacaaggagctggccctgaagctgatcgaggaggaggaggagaagcagaagagcacctggaagaagaaggtgaagagcctgcccaacatcctgaccgacgacagattcaaggtgatgttcgagaaccccgacttccaggtggacgaggagagcgaggagttcagactgctgaaccccctggtgagcaagatcagcgagaagagaaagaagaagctgagactgctggagcagcaggagctgagagagaaggaggaggaggaggagcccgagggcaagcccagcgacgccgagagcagcgagagcagcgacgacgagaaggcctgggtggaggaggtgagaaagcagagaagactgctgcagcaggaggagaaggtgaagagacaggagagactgaaggaggaccagcagaccgtgctgaagccccagttctacgagatcaaggccggcgaggagttcagaagcttcaaggacagcgccaccaagcagaagctgatgaacaagaccctggaggacagactgaagatcgaggccaagaacggcaccctgagcgtgagcgacaccaccgtgggcagcaagcagctgaccttcaccctgaagagaagcgagcagcagaagaagcagcaggaggccgagaagctgcacagacaggagagaaagagactgagaagaagcgccggccacctgaagagcagacacaagagaggcagaagcttccactag

SEQ ID NO: 8911 - DNA, 2067 bp, Artificial Sequence
  Description of Artificial Sequence: Synthetic coding sequence
atgcaggtgagcagcctgaacgaggtgaagatctacagcctgagctgcggcaagagcctgcccgagtggctgagcgacagaaagaagagagccctgcagaagaaggacgtggacgtgagaagaagaatcgagctgatccaggacttcgagatgcccaccgtgtgcaccaccatcaaggtgagcaaggacggccagtacatcctggccaccggcacctacaagcccagagtgagatgctacgacacctaccagctgagcctgaagttcgagagatgcctggacagcgaggtggtgaccttcgagatcctgagcgacgactacagcaagatcgtgttcctgcacaacgacagatacatcgagttccacagccagagcggcttctactacaagaccagaatccccaagttcggcagagacttcagctaccactaccccagctgcgacctgtacttcgtgggcgccagcagcgaggtgtacagactgaacctggagcagggcagatacctgaaccccctgcagaccgacgccgccgagaacaacgtgtgcgacatcaacagcgtgcacggcctgttcgccaccggcaccatcgagggcagagtggagtgctgggaccccagaaccagaaacagagtgggcctgctggactgcgccctgaacagcgtgaccgccgacagcgagatcaacagcctgcccaccatcagcgccctgaagttcaacggcgccctgaccatggccgtgggcaccaccaccggccaggtgctgctgtacgacctgagaagcgacaagcccctgctggtgaaggaccaccagtacggcctgcccatcaagagcgtgcacttccaggacagcctggacctgatcctgagcgccgacagcagaatcgtgaagatgtggaacaagaacagcggcaagatcttcaccagcctggagcccgagcacgacctgaacgacgtgtgcctgtaccccaacagcggcatgctgctgaccgccaacgagacccccaagatgggcatctactacatccccgtgctgggccccgcccccagatggtgcagcttcctggacaacctgaccgaggagctggaggagaaccccgagagcaccgtgtacgacgactacaagttcgtgaccaagaaggacctggagaacctgggcctgacccacctgatcggcagccccttcctgagagcctacatgcacggcttcttcatggacatcagactgtaccacaaggtgaagctgatggtgaaccccttcgcctacgaggagtacagaaaggacaagatcagacagaagatcgaggagaccagagcccagagagtgcagctgaagaagctgcccaaggtgaacaaggagctggccctgaagctgatcgaggaggaggaggagaagcagaagagcacctggaagaagaaggtgaagagcctgcccaacatcctgaccgacgacagattcaaggtgatgttcgagaaccccgacttccaggtggacgaggagagcgaggagttcagactgctgaaccccctggtgagcaagatcagcgagaagagaaagaagaagctgagactgctggagcagcaggagctgagagagaaggaggaggaggaggagcccgagggcaagcccagcgacgccgagagcagcgagagcagcgacgacgagaaggcctgggtggaggaggtgagaaagcagagaagactgctgcagcaggaggagaaggtgaagagacaggagagactgaaggaggaccagcagaccgtgctgaagccccagttctacgagatcaaggccggcgaggagttcagaagcttcaaggacagcgccaccaagcagaagctgatgaacaagaccctggaggacagactgaagatcgaggccaagaacggcaccctgagcgtgagcgacaccaccgtgggcagcaagcagctgaccttcaccctgaagagaagcgagcagcagaagaagcagcaggaggccgagaagctgcacagacaggagagaaagagactgagaagaagcgccggccacctgaagagcagacacaagagaggcagaagcttccactag

SEQ ID NO: 8912 - DNA, 1989 bp, Artificial Sequence
  Description of Artificial Sequence: Synthetic coding sequence
atgcaggtgagcagcctgaacgaggtgaagatctacagcctgagctgcggcaagagcctgcccgagtggctgagcgacagaaagaagagagccctgcagaagaaggacgtggacgtgagaagaagaatcgagctgatccaggacttcgagatgcccaccgtgtgcaccaccatcaaggtgagcaaggacggccagtacatcctggccaccgtggtgaccttcgagatcctgagcgacgactacagcaagatcgtgttcctgcacaacgacagatacatcgagttccacagccagagcggcttctactacaagaccagaatccccaagttcggcagagacttcagctaccactaccccagctgcgacctgtacttcgtgggcgccagcagcgaggtgtacagactgaacctggagcagggcagatacctgaaccccctgcagaccgacgccgccgagaacaacgtgtgcgacatcaacagcgtgcacggcctgttcgccaccggcaccatcgagggcagagtggagtgctgggaccccagaaccagaaacagagtgggcctgctggactgcgccctgaacagcgtgaccgccgacagcgagatcaacagcctgcccaccatcagcgccctgaagttcaacggcgccctgaccatggccgtgggcaccaccaccggccaggtgctgctgtacgacctgagaagcgacaagcccctgctggtgaaggaccaccagtacggcctgcccatcaagagcgtgcacttccaggacagcctggacctgatcctgagcgccgacagcagaatcgtgaagatgtggaacaagaacagcggcaagatcttcaccagcctggagcccgagcacgacctgaacgacgtgtgcctgtaccccaacagcggcatgctgctgaccgccaacgagacccccaagatgggcatctactacatccccgtgctgggccccgcccccagatggtgcagcttcctggacaacctgaccgaggagctggaggagaaccccgagagcaccgtgtacgacgactacaagttcgtgaccaagaaggacctggagaacctgggcctgacccacctgatcggcagccccttcctgagagcctacatgcacggcttcttcatggacatcagactgtaccacaaggtgaagctgatggtgaaccccttcgcctacgaggagtacagaaaggacaagatcagacagaagatcgaggagaccagagcccagagagtgcagctgaagaagctgcccaaggtgaacaaggagctggccctgaagctgatcgaggaggaggaggagaagcagaagagcacctggaagaagaaggtgaagagcctgcccaacatcctgaccgacgacagattcaaggtgatgttcgagaaccccgacttccaggtggacgaggagagcgaggagttcagactgctgaaccccctggtgagcaagatcagcgagaagagaaagaagaagctgagactgctggagcagcaggagctgagagagaaggaggaggaggaggagcccgagggcaagcccagcgacgccgagagcagcgagagcagcgacgacgagaaggcctgggtggaggaggtgagaaagcagagaagactgctgcagcaggaggagaaggtgaagagacaggagagactgaaggaggaccagcagaccgtgctgaagccccagttctacgagatcaaggccggcgaggagttcagaagcttcaaggacagcgccaccaagcagaagctgatgaacaagaccctggaggacagactgaagatcgaggccaagaacggcaccctgagcgtgagcgacaccaccgtgggcagcaagcagctgaccttcaccctgaagagaagcgagcagcagaagaagcagcaggaggccgagaagctgcacagacaggagagaaagagactgagaagaagcgccggccacctgaagagcagacacaagagaggcagaagcttccactag

SEQ ID NO: 8913 - DNA, 1917 bp, Artificial Sequence
  Description of Artificial Sequence: Synthetic coding sequence
atgcccaccgtgtgcaccaccatcaaggtgagcaaggacggccagtacatcctggccaccggcacctacaagcccagagtgagatgctacgacacctaccagctgagcctgaagttcgagagatgcctggacagcgaggtggtgaccttcgagatcctgagcgacgactacagcaagatcgtgttcctgcacaacgacagatacatcgagttccacagccagagcggcttctactacaagaccagaatccccaagttcggcagagacttcagctaccactaccccagctgcgacctgtacttcgtgggcgccagcagcgaggtgtacagactgaacctggagcagggcagatacctgaaccccctgcagaccgacgccgccgagaacaacgtgtgcgacatcaacagcgtgcacggcctgttcgccaccggcaccatcgagggcagagtggagtgctgggaccccagaaccagaaacagagtgggcctgctggactgcgccctgaacagcgtgaccgccgacagcgagatcaacagcctgcccaccatcagcgccctgaagttcaacggcgccctgaccatggccgtgggcaccaccaccggccaggtgctgctgtacgacctgagaagcgacaagcccctgctggtgaaggaccaccagtacggcctgcccatcaagagcgtgcacttccaggacagcctggacctgatcctgagcgccgacagcagaatcgtgaagatgtggaacaagaacagcggcaagatcttcaccagcctggagcccgagcacgacctgaacgacgtgtgcctgtaccccaacagcggcatgctgctgaccgccaacgagacccccaagatgggcatctactacatccccgtgctgggccccgcccccagatggtgcagcttcctggacaacctgaccgaggagctggaggagaaccccgagagcaccgtgtacgacgactacaagttcgtgaccaagaaggacctggagaacctgggcctgacccacctgatcggcagccccttcctgagagcctacatgcacggcttcttcatggacatcagactgtaccacaaggtgaagctgatggtgaaccccttcgcctacgaggagtacagaaaggacaagatcagacagaagatcgaggagaccagagcccagagagtgcagctgaagaagctgcccaaggtgaacaaggagctggccctgaagctgatcgaggaggaggaggagaagcagaagagcacctggaagaagaaggtgaagagcctgcccaacatcctgaccgacgacagattcaaggtgatgttcgagaaccccgacttccaggtggacgaggagagcgaggagttcagactgctgaaccccctggtgagcaagatcagcgagaagagaaagaagaagctgagactgctggagcagcaggagctgagagagaaggaggaggaggaggagcccgagggcaagcccagcgacgccgagagcagcgagagcagcgacgacgagaaggcctgggtggaggaggtgagaaagcagagaagactgctgcagcaggaggagaaggtgaagagacaggagagactgaaggaggaccagcagaccgtgctgaagccccagttctacgagatcaaggccggcgaggagttcagaagcttcaaggacagcgccaccaagcagaagctgatgaacaagaccctggaggacagactgaagatcgaggccaagaacggcaccctgagcgtgagcgacaccaccgtgggcagcaagcagctgaccttcaccctgaagagaagcgagcagcagaagaagcagcaggaggccgagaagctgcacagacaggagagaaagagactgagaagaagcgccggccacctgaagagcagacacaagagaggcagaagcttccactag

SEQ ID NO: 8914 - DNA, 2160 bp, Artificial Sequence
  Description of Artificial Sequence: Synthetic coding sequence
atggccgccctggaggaggagttcaccctgagcagcgtggtgctgagcgccggccccgagggcctgctgggcgtggagcagagcgacaagaccgaccagttcctggtgaccgacagcggcagaaccgtgatcctgtacaaggtgagcgaccagaagcccctgggcagctggagcgtgaagcagggccagatcatcacctgccccgccgtgtgcaacttccagaccggcgagtacgtggtggtgcacgacaacaaggtgctgagaatctggaacaacgaggacgtgaacctggacaaggtgttcaaggccaccctgagcgccgaggtgtacagaatcctgagcgtgcagggcaccgagcccctggtgctgttcaaggagggcgccgtgagaggcctggaggccctgctggccgacccccagcagaagatcgagaccgtgatcagcgacgaggaggtgatcaagtggaccaagttcttcgtggtgttcagacaccccgtgctgatcttcatcaccgagaagcacggcaactacttcgcctacgtgcagatgttcaacagcagaatcctgaccaagtacaccctgctgctgggccaggacgagaacagcgtgatcaagagcttcaccgccagcgtggacagaaagttcatcagcctgatgagcctgagcagcgacggctgcatctacgagaccctgatccccatcagacccgccgaccccgagaagaaccagagcctggtgaagagcctgctgctgaaggccgtggtgagcggcaacgccagaaacggcgtggccctgaccgccctggaccaggaccacgtggccgtgctgggcagccccctggccgccagcaaggagtgcctgagcgtgtggaacatcaagttccagaccctgcagaccagcaaggagctgccccagggcaccagcggccagctgtggtactacggcgagcacctgttcatgctgcacggcaagagcctgaccgtgatcccctacaagtgcgaggtgagcagcctggccggcgccctgggcaagctgaagcacagccaggaccccggcacccacgtggtgagccacttcgtgaactgggagaccccccagggctgcggcctgggcttccagaacagcgagcagagcagaagaatcctgagaagaagaaagatcgaggtgagcctgcagcccgaggtgccccccagcaagcagctgctgagcaccatcatgaaggacagcgagaagcacatcgaggtggaggtgagaaagttcctggccctgaagcagacccccgacttccacaccgtgatcggcgacaccgtgaccggcctgctggagagatgcaaggccgagcccagcttctaccccagaaactgcctgatgcagctgatccagacccacgtgctgagctacagcctgtgccccgacctgatggagatcgccctgaagaagaaggacgtgcagctgctgcagctgtgcctgcagcagttccccgacatccccgagagcgtgacctgcgcctgcctgaagatcttcctgagcatcggcgacgacagcctgcaggagaccgacgtgaacatggagagcgtgttcgactacagcatcaacagcgtgcacgacgagaagatggaggagcagaccgagatcctgcagaacggcttcaaccccgaggaggacaagtgcaacaactgcgaccaggagctgaacaagaagccccaggacgagaccaaggagagcaccagctgccccgtggtgcagaagagagccgccctgctgaacgccatcctgcacagcgcctacagcgagaccttcctgctgccccacctgaaggacatccccgcccagcacatcaccctgttcctgaagtacctgtacttcctgtacctgaagtgcagcgagaacgccaccatgaccctgcccggcatccacccccccaccctgaaccagatcatggactggatctgcctgctgctggacgccaacttcaccgtggtggtgatgatgcccgaggccaagagactgctgatcaacctgtacaagctggtgaagagccagatcagcgtgtacagcgagctgaacaagatcgaggtgagcttcagagagctgcagaagctgaaccaggagaagaacaacagaggcctgtacagcatcgaggtgctggagctgttctag

SEQ ID NO: 8915 - DNA, 1614 bp, Artificial Sequence
  Description of Artificial Sequence: Synthetic coding sequence
atgttcaacagcagaatcctgaccaagtacaccctgctgctgggccaggacgagaacagcgtgatcaagagcttcaccgccagcgtggacagaaagttcatcagcctgatgagcctgagcagcgacggctgcatctacgagaccctgatccccatcagacccgccgaccccgagaagaaccagagcctggtgaagagcctgctgctgaaggccgtggtgagcggcaacgccagaaacggcgtggccctgaccgccctggaccaggaccacgtggccgtgctgggcagccccctggccgccagcaaggagtgcctgagcgtgtggaacatcaagttccagaccctgcagaccagcaaggagctgccccagggcaccagcggccagctgtggtactacggcgagcacctgttcatgctgcacggcaagagcctgaccgtgatcccctacaagtgcgaggtgagcagcctggccggcgccctgggcaagctgaagcacagccaggaccccggcacccacgtggtgagccacttcgtgaactgggagaccccccagggctgcggcctgggcttccagaacagcgagcagagcagaagaatcctgagaagaagaaagatcgaggtgagcctgcagcccgaggtgccccccagcaagcagctgctgagcaccatcatgaaggacagcgagaagcacatcgaggtggaggtgagaaagttcctggccctgaagcagacccccgacttccacaccgtgatcggcgacaccgtgaccggcctgctggagagatgcaaggccgagcccagcttctaccccagaaactgcctgatgcagctgatccagacccacgtgctgagctacagcctgtgccccgacctgatggagatcgccctgaagaagaaggacgtgcagctgctgcagctgtgcctgcagcagttccccgacatccccgagagcgtgacctgcgcctgcctgaagatcttcctgagcatcggcgacgacagcctgcaggagaccgacgtgaacatggagagcgtgttcgactacagcatcaacagcgtgcacgacgagaagatggaggagcagaccgagatcctgcagaacggcttcaaccccgaggaggacaagtgcaacaactgcgaccaggagctgaacaagaagccccaggacgagaccaaggagagcaccagctgccccgtggtgcagaagagagccgccctgctgaacgccatcctgcacagcgcctacagcgagaccttcctgctgccccacctgaaggacatccccgcccagcacatcaccctgttcctgaagtacctgtacttcctgtacctgaagtgcagcgagaacgccaccatgaccctgcccggcatccacccccccaccctgaaccagatcatggactggatctgcctgctgctggacgccaacttcaccgtggtggtgatgatgcccgaggccaagagactgctgatcaacctgtacaagctggtgaagagccagatcagcgtgtacagcgagctgaacaagatcgaggtgagcttcagagagctgcagaagctgaaccaggagaagaacaacagaggcctgtacagcatcgaggtgctggagctgttctag

SEQ ID NO: 8916 - DNA, 642 bp, Artificial Sequence
  Description of Artificial Sequence: Synthetic coding sequence
atgggcagaaacaagaagaagaagagagacggcgacgacagaagacccagactggtgctgagcttcgacgaggagaagagaagagagtacctgaccggcttccacaagagaaaggtggagagaaagaaggccgccatcgaggagatcaagcagagactgaaggaggagcagagaaagctgagagaggagagacaccaggagtacctgaagatgctggccgagagagaggaggccctggaggaggccgacgagctggacagactggtgaccgccaagaccgagagcgtgcagtacgaccaccccaaccacaccgtgaccgtgaccaccatcagcgacctggacctgagcggcgccagactgctgggcctgaccccccccgagggcggcgccggcgacagaagcgaggaggaggccagcagcaccgagaagcccaccaaggccctgcccagaaagagcagagaccccctgctgagccagagaatcagcagcctgaccgccagcctgcacgcccacagcagaaagaaggtgaagagaaagcaccccagaagagcccaggacagcaagaagccccccagagcccccagaaccagcaaggcccagagaagaagactgaccggcaaggccagacacagcggcgagtag

SEQ ID NO: 8917 - DNA, 642 bp, Artificial Sequence; identical to SEQ ID NO: 8916
  Description of Artificial Sequence: Synthetic coding sequence

SEQ ID NO: 8918 - DNA, 1917 bp, Artificial Sequence
  Description of Artificial Sequence: Synthetic coding sequence
atggagagcgagagagacatgtacagacagttccaggactggtgcctgagaacctacggcgacagcggcaagaccaagaccgtgaccagaaagaagtacgagagaatcgtgcagctgctgaacggcagcgagagcagcagcaccgacaacgccaagttcaagttctgggtgaagagcaagggcttccagctgggccagcccgacgaggtgagaggcggcggcggcggcgccaagcaggtgctgtacgtgcccgtgaagaccaccgacggcgtgggcgtggacgagaagctgagcctgagaagagtggccgtggtggaggacttcttcgacatcatctacagcatgcacgtggagaccggccccaacggcgagcagatcagaaagcacgccggccagaagagaacctacaaggccatcagcgagagctacgccttcctgcccagagaggccgtgaccagattcctgatgagctgcagcgagtgccagaagagaatgcacctgaaccccgacggcaccgaccacaaggacaacggcaagccccccaccctggtgaccagcatgatcgactacaacatgcccatcaccatggcctacatgaagcacatgaagctgcagctgctgaacagccagcaggacgaggacgagagcagcatcgagagcgacgagttcgacatgagcgacagcaccagaatgagcgccgtgaacagcgacctgagcagcaacctggaggagagaatgcagagcccccagaacctgcacggccagcaggacgacgacagcgccgccgagagcttcaacggcaacgagaccctgggccacagcagcatcgccagcggcggcacccacagcagagagatgggcgacagcaacagcgacggcaagaccggcctggagcaggacgagcagcccctgaacctgagcgacagccccctgagcgcccagctgaccagcgagtacagaatcgacgaccacaacagcaacggcaagaacaagtacaagaacctgctgatcagcgacctgaagatggagagagaggccagagagaacggcagcaagagccccgcccacagctacagcagctacgacagcggcaagaacgagagcgtggacagaggcgccgaggacctgagcctgaacagaggcgacgaggacgaggacgaccacgaggaccacgacgacagcgagaaggtgaacgagaccgacggcgtggaggccgagagactgaaggccttcaacatgttcgtgagactgttcgtggacgagaacctggacagaatggtgcccatcagcaagcagcccaaggagaagatccaggccatcatcgacagctgcagaagacagttccccgagtaccaggagagagccagaaagagaatcagaacctacctgaagagctgcagaagaatgaagagaagcggcttcgagatgagcagacccatccccagccacctgaccagcgccgtggccgagagcatcctggccagcgcctgcgagagcgagagcagaaacgccgccaagagaatgagactggagagacagcaggacgagagcgcccccgccgacaagcagtgcaagcccgaggccacccaggccacctacagcaccagcgccgtgcccggcagccaggacgtgctgtacatcaacggcaacggcacctacagctaccacagctacagaggcctgggcggcggcctgctgaacctgaacgacgccagcagcagcggccccaccgacctgagcatgaagagacagctggccaccagcagcggcagcagcagcagcagcaacagcagaccccagctgagccccaccgagatcaacgccgtgagacagctggtggccggctacagagagagcgccgccttcctgctgagaagcgccgacgagctggagaacctgatcctgcagcagaactag

SEQ ID NO: 8919 - DNA, 1269 bp, Artificial Sequence
  Description of Artificial Sequence: Synthetic coding sequence
atgcacgtggagaccggccccaacggcgagcagatcagaaagcacgccggccagaagagaacctacaaggccatcagcgagagctacgccttcctgcccagagaggccgtgaccagattcctgatgagctgcagcgagtgccagaagagaatgcacctgaaccccgacggcaccgaccacaaggacaacggcaagccccccaccctggtgaccagcatgatcgactacaacatgcccatcaccatggcctacatgaagcacatgaagctgcagctgctgaacagccagcaggacgaggacgagagcagcatcgagagcgacgagttcgacatgagcgacagcaccagaatgagcgccgtgaacagcgacctgagcagcaacctggaggagagaatgcagagcccccagaacctgcacggccagcaggacgacgacagcgccgccgagagcttcaacggcaacgagaccctgggccacagcagcatcgccagcggcggcacccacagcagagagatgggcgacagcaacagcgacggcaagaccggcctggagcaggacgagcagcccctgaacctgagcgacagccccctgagcgcccagctgaccagcgagtacagaatcgacgaccacaacagcaacggcaagaacaagtacaagaacctgctgatcagcgacctgaagatggagagagaggccagagagaacggcagcaagagccccgcccacagctacagcagctacgacagcggcaagaacgagagcgtggacagaggcgccgaggacctgagcctgaacagaggcgacgaggacgaggacgaccacgaggaccacgacgacagcgagaaggtgaacgagaccgacggcgtggaggccgagagactgaaggccttcaacgacgagagcgcccccgccgacaagcagtgcaagcccgaggccacccaggccacctacagcaccagcgccgtgcccggcagccaggacgtgctgtacatcaacggcaacggcacctacagctaccacagctacagaggcctgggcggcggcctgctgaacctgaacgacgccagcagcagcggccccaccgacctgagcatgaagagacagctggccaccagcagcggcagcagcagcagcagcaacagcagaccccagctgagccccaccgagatcaacgccgtgagacagctggtggccggctacagagagagcgccgccttcctgctgagaagcgccgacgagctggagaacctgatcctgcagcagaactag

SEQ ID NO: 8920 - DNA, 600 bp, Artificial Sequence
  Description of Artificial Sequence: Synthetic coding sequence
atggaccagaccatgctggacgacagcgccgccgagagcttcaacggcaacgagaccctgggccacagcagcatcgccagcggcggcacccacagcagagagatgggcgacagcaacagcgacggcaagaccggcctggagcaggacgagcagcccctgaacctgagcgacagccccctgagcgcccagctgaccagcgagtacagaatcgacgaccacaacagcaacggcaagaacaagtacaagaacctgctgatcagcgacctgaagatggagagagaggccagagagaacggcagcaagagccccgcccacagctacagcagctacgacagcggcaagaacgagagcgtggacagaggcgccgaggacctgagcctgaacagaggcgacgaggacgaggacgaccacgaggaccacgacgacagcgagaaggtgaacgagaccgacggcgtggaggccgagagactgaaggccttcaacagcagacccatccccagccacctgaccagcgccgtggccgagagcatcctggccagcgcctgcgagagcgagagcagaaacgccgccaagagaatgagactggagagacagcagtag

SEQ ID NO: 8921 - DNA, 1062 bp, Artificial Sequence
  Description of Artificial Sequence: Synthetic coding sequence
atgggcgacagcaacagcgacggcaagaccggcctggagcaggacgagcagcccctgaacctgagcgacagccccctgagcgcccagctgaccagcgagtacagaatcgacgaccacaacagcaacggcaagaacaagtacaagaacctgctgatcagcgacctgaagatggagagagaggccagagagaacggcagcaagagccccgcccacagctacagcagctacgacagcggcaagaacgagagcgtggacagaggcgccgaggacctgagcctgaacagaggcgacgaggacgaggacgaccacgaggaccacgacgacagcgagaaggtgaacgagaccgacggcgtggaggccgagagactgaaggccttcaacatgttcgtgagactgttcgtggacgagaacctggacagaatggtgcccatcagcaagcagcccaaggagaagatccaggccatcatcgacagctgcagaagacagttccccgagtaccaggagagagccagaaagagaatcagaacctacctgaagagctgcagaagaatgaagagaagcggcttcgagatgagcagacccatccccagccacctgaccagcgccgtggccgagagcatcctggccagcgcctgcgagagcgagagcagaaacgccgccaagagaatgagactggagagacagcaggacgagagcgcccccgccgacaagcagtgcaagcccgaggccacccaggccacctacagcaccagcgccgtgcccggcagccaggacgtgctgtacatcaacggcaacggcacctacagctaccacagctacagaggcctgggcggcggcctgctgaacctgaacgacgccagcagcagcggccccaccgacctgagcatgaagagacagctggccaccagcagcggcagcagcagcagcagcaacagcagaccccagctgagccccaccgagatcaacgccgtgagacagctggtggccggctacagagagagcgccgccttcctgctgagaagcgccgacgagctggagaacctgatcctgcagcagaactag

SEQ ID NO: 8922 - DNA, 1260 bp, Artificial Sequence
  Description of Artificial Sequence: Synthetic coding sequence
atgagctgcagcgagtgccagaagagaatgcacctgaaccccgacggcaccgaccacaaggacaacggcaagccccccaccctggtgaccagcatgatcgactacaacatgcccatcaccatggcctacatgaagcacatgaagctgcagctgctgaacagccagcaggacgaggacgagagcagcatcgagagcgacgagttcgacatgagcgacagcaccagaatgagcgccgtgaacagcgacctgagcagcaacctggaggagagaatgcagagcccccagaacctgcacggccagcaggacgacgacagcgccgccgagagcttcaacggcaacgagaccctgggccacagcagcatcgccagcggcggcacccacagcagagagatgggcgacagcaacagcgacggcaagaccggcctggagcaggacgagcagcccctgaacctgagcgacagccccctgagcgcccagctgaccagcgagtacagaatcgacgaccacaacagcaacggcaagaacaagtacaagaacctgctgatcagcgacctgaagatggagagagaggccagagagaacggcagcaagagccccgcccacagctacagcagctacgacagcggcaagaacgagagcgtggacagaggcgccgaggacctgagcctgaacagaggcgacgaggacgaggacgaccacgaggaccacgacgacagcgagaaggtgaacgagaccgacggcgtggaggccgagagactgaaggccttcaacagcagacccatccccagccacctgaccagcgccgtggccgagagcatcctggccagcgcctgcgagagcgagagcagaaacgccgccaagagaatgagactggagagacagcaggacgagagcgcccccgccgacaagcagtgcaagcccgaggccacccaggccacctacagcaccagcgccgtgcccggcagccaggacgtgctgtacatcaacggcaacggcacctacagctaccacagctacagaggcctgggcggcggcctgctgaacctgaacgacgccagcagcagcggccccaccgacctgagcatgaagagacagctggccaccagcagcggcagcagcagcagcagcaacagcagaccccagctgagccccaccgagatcaacgccgtgagacagctggtggccggctacagagagagcgccgccttcctgctgagaagcgccgacgagctggagaacctgatcctgcagcagaactag

SEQ ID NO: 8923 - DNA, 1695 bp, Artificial Sequence
  Description of Artificial Sequence: Synthetic coding sequence
atggccgacctgatgcaggagaccttcctgcaccacgccaccgacggcgtgggcgtggacgagaagctgagcctgagaagagtggccgtggtggaggacttcttcgacatcatctacagcatgcacgtggagaccggccccaacggcgagcagatcagaaagcacgccggccagaagagaacctacaaggccatcagcgagagctacgccttcctgcccagagaggccgtgaccagattcctgatgagctgcagcgagtgccagaagagaatgcacctgaaccccgacggcaccgaccacaaggacaacggcaagccccccaccctggtgaccagcatgatcgactacaacatgcccatcaccatggcctacatgaagcacatgaagctgcagctgctgaacagccagcaggacgaggacgagagcagcatcgagagcgacgagttcgacatgagcgacagcaccagaatgagcgccgtgaacagcgacctgagcagcaacctggaggagagaatgcagagcccccagaacctgcacggccagcaggacgacgacagcgccgccgagagcttcaacggcaacgagaccctgggccacagcagcatcgccagcggcggcacccacagcagagagatgggcgacagcaacagcgacggcaagaccggcctggagcaggacgagcagcccctgaacctgagcgacagccccctgagcgcccagctgaccagcgagtacagaatcgacgaccacaacagcaacggcaagaacaagtacaagaacctgctgatcagcgacctgaagatggagagagaggccagagagaacggcagcaagagccccgcccacagctacagcagctacgacagcggcaagaacgagagcgtggacagaggcgccgaggacctgagcctgaacagaggcgacgaggacgaggacgaccacgaggaccacgacgacagcgagaaggtgaacgagaccgacggcgtggaggccgagagactgaaggccttcaacatgttcgtgagactgttcgtggacgagaacctggacagaatggtgcccatcagcaagcagcccaaggagaagatccaggccatcatcgacagctgcagaagacagttccccgagtaccaggagagagccagaaagagaatcagaacctacctgaagagctgcagaagaatgaagagaagcggcttcgagatgagcagacccatccccagccacctgaccagcgccgtggccgagagcatcctggccagcgcctgcgagagcgagagcagaaacgccgccaagagaatgagactggagagacagcaggacgagagcgcccccgccgacaagcagtgcaagcccgaggccacccaggccacctacagcaccagcgccgtgcccggcagccaggacgtgctgtacatcaacggcaacggcacctacagctaccacagctacagaggcctgggcggcggcctgctgaacctgaacgacgccagcagcagcggccccaccgacctgagcatgaagagacagctggccaccagcagcggcagcagcagcagcagcaacagcagaccccagctgagccccaccgagatcaacgccgtgagacagctggtggccggctacagagagagcgccgccttcctgctgagaagcgccgacgagctggagaacctgatcctgcagcagaactag

SEQ ID NO: 8924 - DNA, 2109 bp, Artificial Sequence
  Description of Artificial Sequence: Synthetic coding sequence
atggccgacagcggcctgctgctgaagagaggcagctgcagaagcacctggctgagagtgagaaaggccagaccccagctgatcctgagcagaagacccagaagaagactgggcagcctgagatggtgcggcagaagaagactgagatggagactgctgcaggcccaggccagcggcgtggactggagagagggcgccagacaggtgagcagagccgccgccgccagaagacccaacaccgccacccccagccccatccccagccccacccccgccagcgagcccgagagcgagcccgagctggagagcgccagcagctgccacagacccctgctgatcccccccgtgagacccgtgggccccggcagagccctgctgctgctgcccgtggagcagggcttcaccttcagcggcatctgcagagtgacctgcctgtacggccaggtgcaggtgttcggcttcaccatcagccagggccagcccgcccaggacatcttcagcgtgtacacccacagctgcctgagcatccacgccctgcactacagccagcccgagaagagcaagaaggagctgaagagagaggccagaaacctgctgaagagccacctgaacctggacgacagaagatggagcatgcagaacttcagcccccagtgcagcatcgtgctgctggagcacctgaagaccgccaccgtgaacttcatcaccagctaccccggcagcagctacatcttcgtgcaggagagccccaccccccagatcaagcccgagtacctggccctgagaagcgtgggcatcagaagagagaagaagagaaagggcctgcagctgaccgagagcaccctgagcgccctggaggagctggtgaacgtgagctgcgaggaggtggacggctgccccgtgatcctggtgtgcggcagccaggacgtgggcaagagcaccttcaacagatacctgatcaaccacctgctgaacagcctgccctgcgtggactacctggagtgcgacctgggccagaccgagttcaccccccccggctgcatcagcctgctgaacatcaccgagcccgtgctgggcccccccttcacccacctgagaaccccccagaagatggtgtactacggcaagcccagctgcaagaacaactacgagaactacatcgacatcgtgaagtacgtgttcagcgcctacaagagagagagccccctgatcgtgaacaccatgggctgggtgagcgaccagggcctgctgctgctgatcgacctgatcagactgctgagccccagccacgtggtgcagttcagaagcgaccacagcaagtacatgcccgacctgaccccccagtacgtggacgacatggacggcctgtacaccaagagcaagaccaagatgagaaacagaagattcagactggccgccttcgccgacgccctggagttcgccgacgaggagaaggagagccccgtggagttcaccggccacaagctgatcggcgtgtacaccgacttcgccttcagaatcacccccagaaacagagagagccacaacaagatcctgagagacctgagcatcctgagctacctgagccagctgcagccccccatgcccaagcccctgagccccctgcacagcctgaccccctaccaggtgcccttcaacgccgtggccctgagaatcacccacagcgacgtggcccccacccacatcctgtacgccgtgaacgccagctgggtgggcctgtgcaagatccaggacgacgtgagaggctacaccaacggccccatcctgctggcccagacccccatctgcgactgcctgggcttcggcatctgcagaggcatcgacatggagaagagactgtaccacatcctgacccccgtgccccccgaggagctgagaaccgtgaactgcctgctggtgggcgccatcgccatcccccactgcgtgctgaagtgccagagaggcatcgagggcaccgtgccctacgtgaccaccgactacaacttcaagctgcccggcgccagcgagaagatcggcgccagagagcccgaggaggcccacaaggagaagccctacagaagacccaagttctgcagaaagatgaagtag

SEQ ID NO: 8925 - DNA, 2583 bp, Artificial Sequence
  Description of Artificial Sequence: Synthetic coding sequence
atggccgccagcagaagcgccggcgaggccggccccggcggcagccagggcagagtggtgagaatgaagagaagaggcggcagaggccccagaagaggccccgccggcggcggcgagaaggccctgaagagactgaagctggccgtggaggagttcgtgcacgccaccagcgagggcgaggcccccggcggctgcgagggcagaggcgcccccgtgagcttcagacccggcggcagaaagagcagaaaggagctgagaaaggagaagagacacctgagaaaggccagaagactgcagagaaccgccggccccgagcagggccccggcctgggcggcagaagcggcgccgaggaggccagcggccacagacaggacaccgaggagagagccagacccgcccccagcagagaccccagcccccccagaaagcccagacccagcagagtgaaggccaaggccaccgccgccaccgccaagaccagacccagcgccgccgccaccgccgccgccagaaagagagccctgctggccgccaacgaggaggaggacagagagatcagaaagctggagagatgcctgggcctgaacaagagaaagaagaaggacggcagcagcagcgtgcccctgagcttcgccagagacggcctggactacatcctgggcgccctggagagcggcaagaacagcggcctgtacgacagcagcggcgaggaggaggaggacgccggccagaccctgcccgagagcgacctggagagcgacagccaggacgagagcgaggaggaggaggagggcgacgtggagaaggagaagaaggcccaggaggccgaggcccagagcgaggacgacgacgaggacaccgaggaggagcagggcgaggagaaggagaagggcgcccaggagaagagaagaggcaagagagtgagattcgccgaggacgaggagaagagcgagaacagcagcgaggacggcgacatcaccgacaagagcctgtgcggcagcggcgagaagtacatccccccccacgtgagacaggccgaggagaccgtggacttcaagaagaaggaggagctggagagactgaagaagcacgtgaagggcctgctgaacagactgagcgagcccaacatggccagcatcagcggccagctggaggagctgtacatggcccacagcagaaaggacatgaacgacaccctgaccagcgccctgatgggcgcctgcgtgaccgccagcgccatgcccagcagactgatgatggagcacgtgctgctggtgagcatcctgcaccacaccgtgggcatcgaggtgggcgcccacttcctggaggccgtggtgagaaagttcgacgccatctacaagtacggcagcgagggcaaggagtgcgacaacctgttcaccgtgatcgcccacctgtacaacttccacgtggtgcagagcctgctgatcttcgacatcctgaagaagctgatcggcaccttcaccgagaaggacatcgagctgatcctgctgatgctgaagaacgtgggcttcagcctgagaaaggacgacgccctgagcctgaaggagctgatcaccgaggcccagaccaaggccagcggcgccggcagcgagttccaggaccagaccagaatcagattcatgctggagaccatgctggccctgaagaacaacgacatgagaaagatccccggctacgaccccgagcccgtggagaagctgagaaagctgcagagagccctggtgagaaacgccggcagcggcagcgagacccagctgagagtgagctgggacagcgtgctgagcgccgagcagaccggcagatggtggatcgtgggcagcgcctggagcggcgcccccatgatcgacaacagccaccacacccacctgcagaagcagctggtgggcaccgtgagcagcaagatcctggagctggccagaaagcagagaatgaacaccgacatcagaagaaacatcttctgcaccatcatgaccagcgaggacttcctggacgccttcgagaagctgctgaagctgggcctgaaggaccagcaggagagagagatcatccacgtgctgatggactgctgcctgcaggagaagacctacaaccccttctacgccttcctggccagcaagttctgcgagtacgagagaagattccagatgaccttccagttcagcatctgggacaagttcagagacctggagaacctgcccgccaccaacttcagcaacctggtgcacctggtggcccacctgctgaagaccaagagcctgagcctgagcatcctgaaggtggtggagttcagcgagctggacaagcccagagtgagattcctgagaaaggtgctgagcatcctgctgatggagaccgaggtggaggacctgagcctgatcttcaccagagtgagcgacaaccccaagctgggcgtgctgagagagggcctgaagctgttcatcagccacttcctgctgaagaacgcccaggcccacagaagcgccgacgaggccaacgtgctgagagagaaggccgacctggccaccaagtgcctgcagggcaaggccagcctgagaatgtag

SEQ ID NO: 8926 - DNA, 4917 bp, Artificial Sequence
  Description of Artificial Sequence: Synthetic coding sequence
atggccgccgccgccggcggcccctgcgtgagaagcagcagagagctgtggaccatcctgctgggcagaagcgccctgagagagctgagccagatcgaggccgagctgaacaagcactggagaagactgctggagggcctgagctactacaagccccccagccccagcagcgccgagaaggtgaaggccaacaaggacgtggccagccccctgaaggagctgggcctgagaatcagcaagttcctgggcctggacgaggagcagagcgtgcagctgctgcagtgctacctgcaggaggactacagaggcaccagagacagcgtgaagaccgtgctgtacttcgagatggcccccagcgacctgctggtgctgaccaagatgttcaaggagcagggcttcggcagcagacagaccaacagacacctggtggacgagaccatggaccccttcgtggacagaatcggctacttcagcgccctgatcctggtggagggcatggacatcgagagcctgcacaagtgcgccctggacgacagaagagagctgcaccagttcgcccaggacggcctgatctgccaggacatggactgcctgatgctgaccttcggcgacatcccccaccacgcccccgtgctgctggcctgggccctgctgagacacaccctgaaccccgaggagaccagcagcgtggtgagaaagatcggcggcaccgccatccagctgaacgtgttccagtacctgaccagactgctgcagagcctggccagcggcggcaacgactgcaccaccagcaccgcctgcatgtgcgtgtacggcctgctgagcttcgtgctgaccagcctggagctgcacaccctgggcaaccagcaggacatcatcgacaccgcctgcgaggtgctggccgaccccagcctgcccgagctgttctggggcaccgagcccaccagcggcctgggcatcatcctggacagcgtgtgcggcatgttcccccacctgctgagccccctgctgcagctgctgagagccctggtgagcggcaagagcaccgccaagaaggtgtacagcttcctggacaagatgagcttctacaacgagctgtacaagcacaagccccacgacgtgatcagccacgaggacggcaccctgtggagaagacagacccccaagctgctgtaccccctgggcggccagaccaacctgagaatcccccagggcaccgtgggccaggtgatgctggacgacagagcctacctggtgagatgggagtacagctacagcagctggaccctgttcacctgcgagatcgagatgctgctgcacgtggtgagcaccgccgacgtgatccagcactgccagagagtgaagcccatcatcgacctggtgcacaaggtgatcagcaccgacctgagcatcgccgactgcctgctgcccatcaccagcagaatctacatgctgctgcagagactgaccaccgtgatcagcccccccgtggacgtgatcgccagctgcgtgaactgcctgaccgtgctggccgccagaaaccccgccaaggtgtggaccgacctgagacacaccggcttcctgcccttcgtggcccaccccgtgagcagcctgagccagatgatcagcgccgagggcatgaacgccggcggctacggcaacctgctgatgaacagcgagcagccccagggcgagtacggcgtgaccatcgccttcctgagactgatcaccaccctggtgaagggccagctgggcagcacccagagccagggcctggtgccctgcgtgatgttcgtgctgaaggagatgctgcccagctaccacaagtggagatacaacagccacggcgtgagagagcagatcggctgcctgatcctggagctgatccacgccatcctgaacctgtgccacgagaccgacctgcacagcagccacacccccagcctgcagttcctgtgcatctgcagcctggcctacaccgaggccggccagaccgtgatcaacatcatgggcatcggcgtggacaccatcgacatggtgatggccgcccagcccagaagcgacggcgccgagggccagggccagggccagctgctgatcaagaccgtgaagctggccttcagcgtgaccaacaacgtgatcagactgaagccccccagcaacgtggtgagccccctggagcaggccctgagccagcacggcgcccacggcaacaacctgatcgccgtgctggccaagtacatctaccacaagcacgaccccgccctgcccagactggccatccagctgctgaagagactggccaccgtggcccccatgagcgtgtacgcctgcctgggcaacgacgccgccgccatcagagacgccttcctgaccagactgcagagcaagatcgaggacatgagaatcaaggtgatgatcctggagttcctgaccgtggccgtggagacccagcccggcctgatcgagctgttcctgaacctggaggtgaaggacggcagcgacggcagcaaggagttcagcctgggcatgtggagctgcctgcacgccgtgctggagctgatcgacagccagcagcaggacagatactggtgcccccccctgctgcacagagccgccatcgccttcctgcacgccctgtggcaggacagaagagacagcgccatgctggtgctgagaaccaagcccaagttctgggagaacctgaccagccccctgttcggcaccctgagcccccccagcgagaccagcgagcccagcatcctggagacctgcgccctgatcatgaagatcatctgcctggagatctactacgtggtgaagggcagcctggaccagagcctgaaggacaccctgaagaagttcagcatcgagaagagattcgcctactggagcggctacgtgaagagcctggccgtgcacgtggccgagaccgagggcagcagctgcaccagcctgctggagtaccagatgctggtgagcgcctggagaatgctgctgatcatcgccaccacccacgccgacatcatgcacctgaccgacagcgtggtgagaagacagctgttcctggacgtgctggacggcaccaaggccctgctgctggtgcccgccagcgtgaactgcctgagactgggcagcatgaagtgcaccctgctgctgatcctgctgagacagtggaagagagagctgggcagcgtggacgagatcctgggccccctgaccgagatcctggagggcgtgctgcaggccgaccagcagctgatggagaagaccaaggccaaggtgttcagcgccttcatcaccgtgctgcagatgaaggagatgaaggtgagcgacatcccccagtacagccagctggtgctgaacgtgtgcgagaccctgcaggaggaggtgatcgccctgttcgaccagaccagacacagcctggccctgggcagcgccaccgaggacaaggacagcatggagaccgacgactgcagcagaagcagacacagagaccagagagacggcgtgtgcgtgctgggcctgcacctggccaaggagctgtgcgaggtggacgaggacggcgacagctggctgcaggtgaccagaagactgcccatcctgcccaccctgctgaccaccctggaggtgagcctgagaatgaagcagaacctgcacttcaccgaggccaccctgcacctgctgctgaccctggccagaacccagcagggcgccaccgccgtggccggcgccggcatcacccagagcatctgcctgcccctgctgagcgtgtaccagctgagcaccaacggcaccgcccagacccccagcgccagcagaaagagcctggacgcccccagctggcccggcgtgtacagactgagcatgagcctgatggagcagctgctgaagaccctgagatacaacttcctgcccgaggccctggacttcgtgggcgtgcaccaggagagaaccctgcagtgcctgaacgccgtgagaaccgtgcagagcctggcctgcctggaggaggccgaccacaccgtgggcttcatcctgcagctgagcaacttcatgaaggagtggcacttccacctgccccagctgatgagagacatccaggtgaacctgggctacctgtgccaggcctgcaccagcctgctgcacagcagaaagatgctgcagcactacctgcagaacaagaacggcgacggcctgcccagcgccgtggcccagagagtgcagagaccccccagcgccgccagcgccgcccccagcagcagcaagcagcccgccgccgacaccgaggccagcgagcagcaggccctgcacaccgtgcagtacggcctgctgaagatcctgagcaagaccctggccgccctgagacacttcacccccgacgtgtgccagatcctgctggaccagagcctggacctggccgagtacaacttcctgttcgccctgagcttcaccacccccaccttcgacagcgaggtggcccccagcttcggcaccctgctggccaccgtgaacgtggccctgaacatgctgggcgagctggacaagaagaaggagcccctgacccaggccgtgggcctgagcacccaggccgagggcaccagaaccctgaagagcctgctgatgttcaccatggagaactgcttctacctgctgatcagccaggccatgagatacctgagagaccccgccgtgcaccccagagacaagcagagaatgaagcaggagctgagcagcgagctgagcaccctgctgagcagcctgagcagatacttcagaagaggcgcccccagcagccccgccaccggcgtgctgcccagcccccagggcaagagcaccagcctgagcaaggccagccccgagagccaggagcccctgatccagctggtgcaggccttcgtgagacacatgcagagatag

SEQ ID NO: 8927 - DNA, 5250 bp, Artificial Sequence
  Description of Artificial Sequence: Synthetic coding sequence
atggccgccgccgccggcggcccctgcgtgagaagcagcagagagctgtggaccatcctgctgggcagaagcgccctgagagagctgagccagatcgaggccgagctgaacaagcactggagaagactgctggagggcctgagctactacaagccccccagccccagcagcgccgagaaggtgaaggccaacaaggacgtggccagccccctgaaggagctgggcctgagaatcagcaagttcctgggcctggacgaggagcagagcgtgcagctgctgcagtgctacctgcaggaggactacagaggcaccagagacagcgtgaagaccgtgctgcaggacgagagacagagccaggccctgatcctgaagatcgccgactactactacgaggagagaacctgcatcctgagatgcgtgctgcacctgctgacctacttccaggacgagagacacccctacagagtggagtacgccgactgcgtggacaagctggagaaggagctggtgagcaagtacagacagcagttcgaggagctgtacaagaccgaggcccccacctgggagacccacggcaacctgatgaccgagagacaggtgagcagatggttcgtgcagtgcctgagagagcagagcatgctgctggagatcatcttcctgtactacgcctacttcgagatggcccccagcgacctgctggtgctgaccaagatgttcaaggagcagggcttcggcagcagacagaccaacagacacctggtggacgagaccatggaccccttcgtggacagaatcggctacttcagcgccctgatcctggtggagggcatggacatcgagagcctgcacaagtgcgccctggacgacagaagagagctgcaccagttcgcccaggacggcctgatctgccaggacatggactgcctgatgctgaccttcggcgacatcccccaccacgcccccgtgctgctggcctgggccctgctgagacacaccctgaaccccgaggagaccagcagcgtggtgagaaagatcggcggcaccgccatccagctgaacgtgttccagtacctgaccagactgctgcagagcctggccagcggcggcaacgactgcaccaccagcaccgcctgcatgtgcgtgtacggcctgctgagcttcgtgctgaccagcctggagctgcacaccctgggcaaccagcaggacatcatcgacaccgcctgcgaggtgctggccgaccccagcctgcccgagctgttctggggcaccgagcccaccagcggcctgggcatcatcctggacagcgtgtgcggcatgttcccccacctgctgagccccctgctgcagctgctgagagccctggtgagcggcaagagcaccgccaagaaggtgtacagcttcctggacaagatgagcttctacaacgagctgtacaagcacaagccccacgacgtgatcagccacgaggacggcaccctgtggagaagacagacccccaagctgctgtaccccctgggcggccagaccaacctgagaatcccccagggcaccgtgggccaggtgatgctggacgacagagcctacctggtgagatgggagtacagctacagcagctggaccctgttcacctgcgagatcgagatgctgctgcacgtggtgagcaccgccgacgtgatccagcactgccagagagtgaagcccatcatcgacctggtgcacaaggtgatcagcaccgacctgagcatcgccgactgcctgctgcccatcaccagcagaatctacatgctgctgcagagactgaccaccgtgatcagcccccccgtggacgtgatcgccagctgcgtgaactgcctgaccgtgctggccgccagaaaccccgccaaggtgtggaccgacctgagacacaccggcttcctgcccttcgtggcccaccccgtgagcagcctgagccagatgatcagcgccgagggcatgaacgccggcggctacggcaacctgctgatgaacagcgagcagccccagggcgagtacggcgtgaccatcgccttcctgagactgatcaccaccctggtgaagggccagctgggcagcacccagagccagggcctggtgccctgcgtgatgttcgtgctgaaggagatgctgcccagctaccacaagtggagatacaacagccacggcgtgagagagcagatcggctgcctgatcctggagctgatccacgccatcctgaacctgtgccacgagaccgacctgcacagcagccacacccccagcctgcagttcctgtgcatctgcagcctggcctacaccgaggccggccagaccgtgatcaacatcatgggcatcggcgtggacaccatcgacatggtgatggccgcccagcccagaagcgacggcgccgagggccagggccagggccagctgctgatcaagaccgtgaagctggccttcagcgtgaccaacaacgtgatcagactgaagccccccagcaacgtggtgagccccctggagcaggccctgagccagcacggcgcccacggcaacaacctgatcgccgtgctggccaagtacatctaccacaagcacgaccccgccctgcccagactggccatccagctgctgaagagactggccaccgtggcccccatgagcgtgtacgcctgcctgggcaacgacgccgccgccatcagagacgccttcctgaccagactgcagagcaagatcgaggacatgagaatcaaggtgatgatcctggagttcctgaccgtggccgtggagacccagcccggcctgatcgagctgttcctgaacctggaggtgaaggacggcagcgacggcagcaaggagttcagcctgggcatgtggagctgcctgcacgccgtgctggagctgatcgacagccagcagcaggacagatactggtgcccccccctgctgcacagagccgccatcgccttcctgcacgccctgtggcaggacagaagagacagcgccatgctggtgctgagaaccaagcccaagttctgggagaacctgaccagccccctgttcggcaccctgagcccccccagcgagaccagcgagcccagcatcctggagacctgcgccctgatcatgaagatcatctgcctggagatctactacgtggtgaagggcagcctggaccagagcctgaaggacaccctgaagaagttcagcatcgagaagagattcgcctactggagcggctacgtgaagagcctggccgtgcacgtggccgagaccgagggcagcagctgcaccagcctgctggagtaccagatgctggtgagcgcctggagaatgctgctgatcatcgccaccacccacgccgacatcatgcacctgaccgacagcgtggtgagaagacagctgttcctggacgtgctggacggcaccaaggccctgctgctggtgcccgccagcgtgaactgcctgagactgggcagcatgaagtgcaccctgctgctgatcctgctgagacagtggaagagagagctgggcagcgtggacgagatcctgggccccctgaccgagatcctggagggcgtgctgcaggccgaccagcagctgatggagaagaccaaggccaaggtgttcagcgccttcatcaccgtgctgcagatgaaggagatgaaggtgagcgacatcccccagtacagccagctggtgctgaacgtgtgcgagaccctgcaggaggaggtgatcgccctgttcgaccagaccagacacagcctggccctgggcagcgccaccgaggacaaggacagcatggagaccgacgactgcagcagaagcagacacagagaccagagagacggcgtgtgcgtgctgggcctgcacctggccaaggagctgtgcgaggtggacgaggacggcgacagctggctgcaggtgaccagaagactgcccatcctgcccaccctgctgaccaccctggaggtgagcctgagaatgaagcagaacctgcacttcaccgaggccaccctgcacctgctgctgaccctggccagaacccagcagggcgccaccgccgtggccggcgccggcatcacccagagcatctgcctgcccctgctgagcgtgtaccagctgagcaccaacggcaccgcccagacccccagcgccagcagaaagagcctggacgcccccagctggcccggcgtgtacagactgagcatgagcctgatggagcagctgctgaagaccctgagatacaacttcctgcccgaggccctggacttcgtgggcgtgcaccaggagagaaccctgcagtgcctgaacgccgtgagaaccgtgcagagcctggcctgcctggaggaggccgaccacaccgtgggcttcatcctgcagctgagcaacttcatgaaggagtggcacttccacctgccccagctgatgagagacatccaggtgaacctgggctacctgtgccaggcctgcaccagcctgctgcacagcagaaagatgctgcagcactacctgcagaacaagaacggcgacggcctgcccagcgccgtggcccagagagtgcagagaccccccagcgccgccagcgccgcccccagcagcagcaagcagcccgccgccgacaccgaggccagcgagcagcaggccctgcacaccgtgcagtacggcctgctgaagatcctgagcaagaccctggccgccctgagacacttcacccccgacgtgtgccagatcctgctggaccagagcctggacctggccgagtacaacttcctgttcgccctgagcttcaccacccccaccttcgacagcgaggtggcccccagcttcggcaccctgctggccaccgtgaacgtggccctgaacatgctgggcgagctggacaagaagaaggagcccctgacccaggccgtgggcctgagcacccaggccgagggcaccagaaccctgaagagcctgctgatgttcaccatggagaactgcttctacctgctgatcagccaggccatgagatacctgagagaccccgccgtgcaccccagagacaagcagagaatgaagcaggagctgagcagcgagctgagcaccctgctgagcagcctgagcagatacttcagaagaggcgcccccagcagccccgccaccggcgtgctgcccagcccccagggcaagagcaccagcctgagcaaggccagccccgagagccaggagcccctgatccagctggtgcaggccttcgtgagacacatgcagagatag

SEQ ID NO: 8928 - DNA, 219 bp, Artificial Sequence
  Description of Artificial Sequence: Synthetic coding sequence
atgcagttcaccagcatcagcaacagcctgaccagcaccgccgccatcggcctgagcttcaccaccagcaccaccaccaccgccaccttcaccaccaacaccaccaccaccatcaccagcggcttcaccgtgaaccagaaccagctgctgagcagaggcttcgagaacctggtgccctacaccagcaccgtgagattcgtgttctacatggagaagtag

SEQ ID NO: 8929 - DNA, 801 bp, Artificial Sequence
  Description of Artificial Sequence: Synthetic coding sequence
atgcagttcaccagcatcagcaacagcctgaccagcaccgccgccatcggcctgagcttcaccaccagcaccaccaccaccgccaccttcaccaccaacaccaccaccaccatcaccagcggcttcaccgtgaaccagaaccagctgctgagcagaggcttcgagaacctggtgccctacaccagcaccgtgagcgtggtggccacccccgtgatgacctacggccacctggagggcctgatcaacgagtggaacctggagctggaggaccaggagaagtacttcctgctgcaggccacccaggtgaacgcctgggaccacaccctgatcgagaacggcgagatgatcagaatcctgcacggcgaggtgaacaaggtgaagctggaccagaagagactggagcaggagctggacttcatcctgagccagcagcaggagctggagttcctgctgacctacctggaggagagcaccagagaccagagcggcctgcactacctgcaggacgccgacgaggagcacgtggagatctacagactggccgagagcatcgacgcccagctgaagcagatggcccaggacctgaaggacgtggtgaaccacctgaacaccttcgagagcagcagcgacaccaccgaccccctgcaccagatctgcagaatcctgaacgcccacatggacagcctgcagtggatcgacagaaacagcggcatgctgagaagaaaggtggaggtggtgaccagagtgttcgaggactacagacacgaggagcacgcccacaacgtgaacaccgccttctag

SEQ ID NO: 8930 - DNA, 555 bp, Artificial Sequence
  Description of Artificial Sequence: Synthetic coding sequence
atgcagttcaccagcatcagcaacagcctgaccagcaccgccgccatcggcctgagcttcaccaccagcaccaccaccaccgccaccttcaccaccaacaccaccaccaccatcaccagcggcttcaccgtgaaccagaaccagctgctgagcagaggcttcgagaacctggtgccctacaccagcaccgtgagcgtggtggccacccccgtgatgacctacggccacctggagggcctgatcaacgagtggaacctggagctggaggaccaggagaagtacttcctgctgcaggccacccaggtgaacgcctgggaccacaccctgatcgagaacggcgagatgatcagaatcctgcacggcgaggtgaacaaggtgaagctggaccagaagagactggagcaggagctggacttcatcctgagccagcagcaggagctggagttcctgctgacctacctggaggagagcaccagagaccagagcggcctgcactacctgcaggacgccgacgaggagcacgtggagatcagcaccagaagcgccgagttctag

SEQ ID NO: 8931 - DNA, 411 bp, Artificial Sequence
  Description of Artificial Sequence: Synthetic coding sequence
atgcagttcaccagcatcagcaacagcctgaccagcaccgccgccatcggcctgagcttcaccaccagcaccaccaccaccgccaccttcaccaccaacaccaccaccaccatcaccagcggcttcaccgtgaaccagaaccagctgctgagcagaggcttcgagaacctggtgccctacaccagcaccgtgagcgtggtggccacccccgtgatgacctacggccacctggagggcctgatcaacgagtggaacctggagctggaggaccaggagaagtacttcctgctgcaggccacccaggtgaacgcctgggaccacaccctgatcgagaacggcgagatgatcagaatcctgcacggcgaggtgaacaaggtgaagctggaccagaagagactggagcaggagtag

SEQ ID NO: 8932 - DNA, 597 bp, Artificial Sequence
  Description of Artificial Sequence: Synthetic coding sequence
tgacccgtgatgacctacggccacctggagggcctgatcaacgagtggaacctggagctggaggaccaggagaagtacttcctgctgcaggccacccaggtgaacgcctgggaccacaccctgatcgagaacggcgagatgatcagaatcctgcacggcgaggtgaacaaggtgaagctggaccagaagagactggagcaggagctggacttcatcctgagccagcagcaggagctggagttcctgctgacctacctggaggagagcaccagagaccagagcggcctgcactacctgcaggacgccgacgaggagcacgtggagatctacagactggccgagagcatcgacgcccagctgaagcagatggcccaggacctgaaggacgtggtgaaccacctgaacaccttcgagagcagcagcgacaccaccgaccccctgcaccagatctgcagaatcctgaacgcccacatggacagcctgcagtggatcgacagaaacagcggcatgctgagaagaaaggtggaggtggtgaccagagtgttcgaggactacagacacgaggagcacgcccacaacgtgaacaccgccttctag

SEQ ID NO: 8933 - DNA, 1383 bp, Artificial Sequence
  Description of Artificial Sequence: Synthetic coding sequence
atggccgagagcgagaacagaaaggagctgagcgagagcagccaggaggaggccggcaaccagatcatggtggagggcctgggcgagcacctggagagaggcgaggacgccgccgccggcctgggcgacgacggcaagtgcggcgaggaggccgccgccggcctgggcgaggagggcgagaacggcgaggacaccgccgccggcagcggcgaggacggcaagaagggcggcgacaccgacgaggacagcgaggccgacagacccaagggcctgatcggctacgtgctggacaccgacttcgtggagagcctgcccgtgaaggtgaagtacagagtgctggccctgaagaagctgcagaccagagccgccaacctggagagcaagttcctgagagagttccacgacatcgagagaaagttcgccgagatgtaccagcccctgctggagaagagaagacagatcatcaacgccatctacgagcccaccgaggaggagtgcgagtacaagagcgacagcgaggactgcgacgacgaggagatgtgccacgaggagatgtacggcaacgaggagggcatggtgcacgagtacgtggacgaggacgacggctacgaggactactactacgactacgccgtggaggaggaggaggaggaggaggaggaggacgacatcgaggccaccggcgaggagaacaaggaggaggaggaccccaagggcatccccgacttctggctgaccgtgctgaagaacgtggacaccctgacccccctgatcaagaagtacgacgagcccatcctgaagctgctgaccgacatcaaggtgaagctgagcgaccccggcgagcccctgagcttcaccctggagttccacttcaagcccaacgagtacttcaagaacgagctgctgaccaagacctacgtgctgaagagcaagctggcctactacgacccccacccctacagaggcaccgccatcgagtacagcaccggctgcgagatcgactggaacgagggcaagaacgtgaccctgaagaccatcaagaagaagcagaagcacagaatctggggcaccatcagaaccgtgaccgaggacttccccaaggacagcttcttcaacttcttcagcccccacggcatcaccagcaacggcagagacggcaacgacgacttcctgctgggccacaacctgagaacctacatcatccccagaagcgtgctgttcttcagcggcgacgccctggagagccagcaggagggcgtggtgagagaggtgaacgacgccatctacgacaagatcatctacgacaactggatggccgccatcgaggaggtgaaggcctgctgcaagaacctggaggccctggtggaggacatcgacagatag

SEQ ID NO: 8934 - DNA, 957 bp, Artificial Sequence
  Description of Artificial Sequence: Synthetic coding sequence
atgtaccagcccctgctggagaagagaagacagatcatcaacgccatctacgagcccaccgaggaggagtgcgagtacaagagcgacagcgaggactgcgacgacgaggagatgtgccacgaggagatgtacggcaacgaggagggcatggtgcacgagtacgtggacgaggacgacggctacgaggactactactacgactacgccgtggaggaggaggaggaggaggaggaggaggacgacatcgaggccaccggcgaggagaacaaggaggaggaggaccccaagggcatccccgacttctggctgaccgtgctgaagaacgtggacaccctgacccccctgatcaagaagtacgacgagcccatcctgaagctgctgaccgacatcaaggtgaagctgagcgaccccggcgagcccctgagcttcaccctggagttccacttcaagcccaacgagtacttcaagaacgagctgctgaccaagacctacgtgctgaagagcaagctggcctactacgacccccacccctacagaggcaccgccatcgagtacagcaccggctgcgagatcgactggaacgagggcaagaacgtgaccctgaagaccatcaagaagaagcagaagcacagaatctggggcaccatcagaaccgtgaccgaggacttccccaaggacagcttcttcaacttcttcagcccccacggcatcaccagcaacggcagagacggcaacgacgacttcctgctgggccacaacctgagaacctacatcatccccagaagcgtgctgttcttcagcggcgacgccctggagagccagcaggagggcgtggtgagagaggtgaacgacgccatctacgacaagatcatctacgacaactggatggccgccatcgaggaggtgaaggcctgctgcaagaacctggaggccctggtggaggacatcgacagatag

SEQ ID NO: 8935 - DNA, 489 bp, Artificial Sequence
  Description of Artificial Sequence: Synthetic coding sequence
atgctgttcggcagaatccccctgagatacgccatcctgatgcagatgagattcgacggcagactgggcttccccggcggcttcgtggacacccaggacagaagcctggaggacggcctgaacagagagctgagagaggagctgggcgaggccgccgccgccttcagagtggagagaaccgactacagaagcagccacgtgggcagcggccccagagtggtggcccacttctacgccaagagactgaccctggaggagctgctggccgtggaggccggcgccaccagagccaaggaccacggcctggaggtgctgggcctggtgagagtgcccctgtacaccctgagagacggcgtgggcggcctgcccaccttcctggagaacagcttcatcggcagcgccagagagcagctgctggaggccctgcaggacctgggcctgctgcagagcggcagcatcagcggcctgaagatccccgcccaccactag

SEQ ID NO: 8936 - DNA, 588 bp, Artificial Sequence
  Description of Artificial Sequence: Synthetic coding sequence
atggccggcgccagaagactggagctgggcgaggccctggccctgggcagcggctggagacacgcctgccacgccctgctgtacgcccccgaccccggcatgctgttcggcagaatccccctgagatacgccatcctgatgcagatgagattcgacggcagactgggcttccccggcggcttcgtggacacccaggacagaagcctggaggacggcctgaacagagagctgagagaggagctgggcgaggccgccgccgccttcagagtggagagaaccgactacagaagcagccacgtgggcagcggccccagagtggtggcccacttctacgccaagagactgaccctggaggagctgctggccgtggaggccggcgccaccagagccaaggaccacggcctggaggtgctgggcctggtgagagtgcccctgtacaccctgagagacggcgtgggcggcctgcccaccttcctggagaacagcttcatcggcagcgccagagagcagctgctggaggccctgcaggacctgggcctgctgcagagcggcagcatcagcggcctgaagatccccgcccaccactag

SEQ ID NO: 8937 - DNA, 480 bp, Artificial Sequence
  Description of Artificial Sequence: Synthetic coding sequence
atgcagatgagattcgacggcagactgggcttccccggcggcttcgtggacacccaggacagaagcctggaggacggcctgaacagagagctgagagaggagctgggcgaggccgccgccgccttcagagtggagagaaccgactacagaagcagccacgtgggcagcggccccagagtggtggcccacttctacgccaagagactgaccctggaggagctgctggccgtggaggccggcgccaccagagccaaggaccacggcctggaggtgctgggcctggtgagagtgcccctgtacaccctgagagacggcgtgggcggcctgcccaccttcctggagaacagcttcatcggcagcgccagagagcagctgctggaggccgccctgcacggccccatgaagaccgagatgagaaccctggtgctgggcagagagggcagaacctgggagtgcttcctgatcggcagcgagagatag

SEQ ID NO: 8938 - DNA, 684 bp, Artificial Sequence
  Description of Artificial Sequence: Synthetic coding sequence
atggccggcgccagaagactggagctgggcgaggccctggccctgggcagcggctggagacacgcctgccacgccctgctgtacgcccccgaccccggcatgctgttcggcagaatccccctgagatacgccatcctgatgcagatgagattcgacggcagactgggcttccccggcggcttcgtggacacccaggacagaagcctggaggacggcctgaacagagagctgagagaggagctgggcgaggccgccgccgccttcagagtggagagaaccgactacagaagcagccacgtgggcagcggccccagagtggtggcccacttctacgccaagagactgaccctggaggagctgctggccgtggaggccggcgccaccagagccaaggaccacggcctggaggtgggccccgcctgggacagcgtgcccttccccatcagcagcagccccaaggccttcagcccccccagaaagcacccctggagaaaggtgttcgcccccctgaccctgcccagcccccagctgagctggtggagctgggacagagaccacctgtacagcgagctggtgctgcccacctgggccttctgcaagggcctgagccaccccctgcccggcgagatcctgagcagaacccacagcagcatgagcctgtgctgcagcctgctgaccgtgtag

SEQ ID NO: 8939 - DNA, 768 bp, Artificial Sequence
  Description of Artificial Sequence: Synthetic coding sequence
atgctgagaccccagagacccggcgacctgcagctgggcgccagcctgtacgagctggtgggctacagacagccccccagcagcagcagcagcagcaccagcagcaccagcagcaccagcagcagcagcaccaccgcccccctgctgcccaaggccgccagagagaagcccgaggcccccgccgagccccccggccccggccccggcagcggcgcccaccccggcggcagcgccagacccgacgccaaggaggagcagcagcagcagctgagaagaaagatcaacagcagagagagaaagagaatgcaggacctgaacctggccatggacgccctgagagaggtgatcctgccctacagcgccgcccactgccagggcgcccccggcagaaagctgagcaagatcgccaccctgctgctggccagaaactacatcctgctgctgggcagcagcctgcaggagctgagaagagccctgggcgagggcgccggccccgccgcccccagactgctgctggccggcctgcccctgctggccgccgcccccggcagcgtgctgctggcccccggcgccgtgggcccccccgacgccctgagacccgccaagtacctgagcctggccctggacgagcccccctgcggccagttcgccctgcccggcggcggcgccggcggccccggcctgtgcacctgcgccgtgtgcaagttcccccacctggtgcccgccagcctgggcctggccgccgtgcaggcccagttcagcaagtag

SEQ ID NO: 8940 - DNA, 816 bp, Artificial Sequence
  Description of Artificial Sequence: Synthetic coding sequence
atgtactacgccgtgagccaggccagagtgaacgccgtgcccggcaccatgctgagaccccagagacccggcgacctgcagctgggcgccagcctgtacgagctggtgggctacagacagccccccagcagcagcagcagcagcaccagcagcaccagcagcaccagcagcagcagcaccaccgcccccctgctgcccaaggccgccagagagaagcccgaggcccccgccgagccccccggccccggccccggcagcggcgcccaccccggcggcagcgccagacccgacgccaaggaggagcagcagcagcagctgagaagaaagatcaacagcagagagagaaagagaatgcaggacctgaacctggccatggacgccctgagagaggtgatcctgccctacagcgccgcccactgccagggcgcccccggcagaaagctgagcaagatcgccaccctgctgctggccagaaactacatcctgctgctgggcagcagcctgcaggagctgagaagagccctgggcgagggcgccggccccgccgcccccagactgctgctggccggcctgcccctgctggccgccgcccccggcagcgtgctgctggcccccggcgccgtgggcccccccgacgccctgagacccgccaagtacctgagcctggccctggacgagcccccctgcggccagttcgccctgcccggcggcggcgccggcggccccggcctgtgcacctgcgccgtgtgcaagttcccccacctggtgcccgccagcctgggcctggccgccgtgcaggcccagttcagcaagtag

SEQ ID NO: 8941 - DNA, 99 bp, Artificial Sequence
  Description of Artificial Sequence: Synthetic coding sequence
tgaggccccggcctgtgcacctgcgccgtgtgcaagttcccccacctggtgcccgccagcctgggcctggccgccgtgcaggcccagttcagcaagtag

SEQ ID NO: 8942 - DNA, 1485 bp, Artificial Sequence
  Description of Artificial Sequence: Synthetic coding sequence
atggagctgagcctggagagcctgggcggcctgcacagcgtggcccacgcccaggccggcgagctgctgagccccggccacgccagaagcgccgccgcccagcacagaggcctggtggcccccggcagacccggcctggtggccggcatggccagcctgctggacggcggcggcggcggcggcggcggcggcgccggcggcgccggcggcgccggcagcgccggcggcggcgccgacttcagaggcgagctggccggccccctgcaccccgccatgggcatggcctgcgaggcccccggcctgggcggcacctacaccaccctgacccccctgcagcacctgccccccctggccgccgtggccgacaagttccaccagcacgccgccgccgccgccgtggccggcgcccacggcggccacccccacgcccacccccaccccgccgccgccccccccccccccccccccccccagagactggccgccagcgtgagcggcagcttcaccctgatgagagacgagagagccgccctggccagcgtgggccacctgtacggcccctacggcaaggagctgcccgccatgggcagccccctgagccccctgcccaacgccctgccccccgccctgcacggcgccccccagcccccccccccccccccccccccccccctggccgcctacggcccccccggccacctggccggcgacaagctgctgccccccgccgccttcgagccccacgccgccctgctgggcagagccgaggacgccctggccagaggcctgcccggcggcggcggcggcaccggcagcggcggcgccggcagcggcagcgccgccggcctgctggcccccctgggcggcctggccgccgccggcgcccacggcccccacggcggcggcggcggccccggcggcagcggcggcggccccagcgccggcgccgccgccgaggagatcaacaccaaggaggtggcccagagaatcaccgccgagctgaagagatacagcatcccccaggccatcttcgcccagagaatcctgtgcagaagccagggcaccctgagcgacctgctgagaaaccccaagccctggagcaagctgaagagcggcagagagaccttcagaagaatgtggaagtggctgcaggagcccgagttccagagaatgagcgccctgagactggccgcctgcaagagaaaggagcaggagcagcagaaggagagagccctgcagcccaagaagcagagactggtgttcaccgacctgcagagaagaaccctgatcgccatcttcaaggagaacaagagacccagcaaggagatgcaggtgaccatcagccagcagctgggcctggagctgaacaccgtgagcaacttcttcatgaacgccagaagaagatgcatgaacagatgggccgaggagcccagcaccgcccccggcggccccgccggcgccaccgccaccttcagcaaggcctag

SEQ ID NO: 8943 - DNA, 2922 bp, Artificial Sequence
  Description of Artificial Sequence: Synthetic coding sequence
atggccagcatcctggacgagtacgagaacagcctgagcagaagcgccgtgctgcagcccggctgccccagcgtgggcatcccccacagcggctacgtgaacgcccagctggagaaggaggtgcccatcttcaccaagcagagaatcgacttcacccccagcgagagaatcaccagcctggtggtgagcagcaaccagctgtgcatgagcctgggcaaggacaccctgctgagaatcgacctgggcaaggccaacgagcccaaccacgtggagctgggcagaaaggacgacgccaaggtgcacaagatgttcctggaccacaccggcagccacctgctgatcgccctgagcagcaccgaggtgctgtacgtgaacagaaacggccagaaggtgagacccctggccagatggaagggccagctggtggagagcgtgggctggaacaaggccctgggcaccgagagcagcaccggccccatcctggtgggcaccgcccagggccacatcttcgaggccgagctgagcgccagcgagggcggcctgttcggccccgcccccgacctgtacttcagacccctgtacgtgctgaacgaggagggcggccccgcccccgtgtgcagcctggaggccgagagaggccccgacggcagaagcttcgtgatcgccaccaccagacagagactgttccagttcatcggcagagccgccgagggcgccgaggcccagggcttcagcggcctgttcgccgcctacaccgaccaccccccccccttcagagagttccccagcaacctgggctacagcgagctggccttctacacccccaagctgagaagcgcccccagagccttcgcctggatgatgggcgacggcgtgctgtacggcgccctggactgcggcagacccgacagcctgctgagcgaggagagagtgtgggagtaccccgagggcgtgggccccggcgccagcccccccctggccatcgtgctgacccagttccacttcctgctgctgctggccgacagagtggaggccgtgtgcaccctgaccggccaggtggtgctgagagaccacttcctggagaagttcggccccctgaagcacatggtgaaggacagcagcaccggccagctgtgggcctacaccgagagagccgtgttcagataccacgtgcagagagaggccagagacgtgtggagaacctacctggacatgaacagattcgacctggccaaggagtactgcagagagagacccgactgcctggacaccgtgctggccagagaggccgacttctgcttcagacagagaagatacctggagagcgccagatgctacgccctgacccagagctacttcgaggagatcgccctgaagttcctggaggccagacaggaggaggccctggccgagttcctgcagagaaagctggccagcctgaagcccgccgagagaacccaggccaccctgctgaccacctggctgaccgagctgtacctgagcagactgggcgccctgcagggcgaccccgaggccctgaccctgtacagagagaccaaggagtgcttcagaaccttcctgagcagccccagacacaaggagtggctgttcgccagcagagccagcatccacgagctgctggccagccacggcgacaccgagcacatggtgtacttcgccgtgatcatgcaggactacgagagagtggtggcctaccactgccagcacgaggcctacgaggaggccctggccgtgctggccagacacagagacccccagctgttctacaagttcagccccatcctgatcagacacatccccagacagctggtggacgcctggatcgagatgggcagcagactggacgccagacagctgatccccgccctggtgaactacagccagggcggcgaggtgcagcaggtgagccaggccatcagatacatggagttctgcgtgaacgtgctgggcgagaccgagcaggccatccacaactacctgctgagcctgtacgccagaggcagacccgacagcctgctggcctacctggagcaggccggcgccagcccccacagagtgcactacgacctgaagtacgccctgagactgtgcgccgagcacggccaccacagagcctgcgtgcacgtgtacaaggtgctggagctgtacgaggaggccgtggacctggccctgcaggtggacgtggacctggccaagcagtgcgccgacctgcccgaggaggacgaggagctgagaaagaagctgtggctgaagatcgccagacacgtggtgcaggaggaggaggacgtgcagaccgccatggcctgcctggccagctgccccctgctgaagatcgaggacgtgctgcccttcttccccgacttcgtgaccatcgaccacttcaaggaggccatctgcagcagcctgaaggcctacaaccaccacatccaggagctgcagagagagatggaggaggccaccgccagcgcccagagaatcagaagagacctgcaggagctgagaggcagatacggcaccgtggagccccaggacaagtgcgccacctgcgacttccccctgctgaacagacccttctacctgttcctgtgcggccacatgttccacgccgactgcctgctgcaggccgtgagacccggcctgcccgcctacaagcaggccagactggaggagctgcagagaaagctgggcgccgcccccccccccgccaagggcagcgccagagccaaggaggccgagggcggcgccgccaccgccggccccagcagagagcagctgaaggccgacctggacgagctggtggccgccgagtgcgtgtactgcggcgagctgatgatcagaagcatcgacagacccttcatcgacccccagagatacgaggaggagcagctgagctggctgtag

SEQ ID NO: 8944 - DNA, 828 bp, Artificial Sequence
  Description of Artificial Sequence: Synthetic coding sequence
atgcccaaggtgttcctggtgaagagaagaagcctgggcgtgagcgtgagaagctgggacgagctgcccgacgagaagagagccgacacctacatccccgtgggcctgggcagactgctgcacgacccccccgaggactgcagaagcgacggcggcagcagcagcggcagcggcagcagcagcgccggcgagcccggcggcgccgagagcagcagcagcccccacgcccccgagagcgagacccccgagcccggcgacgccgagggccccgacggccacctggccaccaagcagagacccgtggccagaagcaagatcaagttcaccaccggcacctgcagcgacagcgtggtgcacagctgcgacctgtgcggcaagggcttcagactgcagagaatgctgaacagacacctgaagtgccacaaccaggtgaagagacacctgtgcaccttctgcggcaagggcttcaacgacaccttcgacctgaagagacacgtgagaacccacaccggcatcagaccctacaagtgcaacgtgtgcaacaaggccttcacccagagatgcagcctggagagccacctgaagaagatccacggcgtgcagcagcagtacgcctacaagcagagaagagacaagctgtacgtgtgcgaggactgcggctacaccggccccacccaggaggacctgtacctgcacgtgaacagcgcccaccccggcagcagcttcctgaagaagaccagcaagaagctggccgccctgctgcagggcaagctgaccagcgcccaccaggagaacaccagcctgagcgaggaggaggagagaaagtag

SEQ ID NO: 8945 - DNA, 1269 bp, Artificial Sequence
  Description of Artificial Sequence: Synthetic coding sequence
atgcagaacagccacagcggcgtgaaccagctgggcggcgtgttcgtgaacggcagacccctgcccgacagcaccagacagaagatcgtggagctggcccacagcggcgccagaccctgcgacatcagcagaatcctgcaggtgagcaacggctgcgtgagcaagatcctgggcagatactacgagaccggcagcatcagacccagagccatcggcggcagcaagcccagagtggccacccccgaggtggtgagcaagatcgcccagtacaagagagagtgccccagcatcttcgcctgggagatcagagacagactgctgagcgagggcgtgtgcaccaacgacaacatccccagcgtgagcagcatcaacagagtgctgagaaacctggccagcgagaagcagcagatgggcgccgacggcatgtacgacaagctgagaatgctgaacggccagaccggcagctggggcaccagacccggctggtaccccggcaccagcgtgcccggccagcccacccaggacggctgccagcagcaggagggcggcggcgagaacaccaacagcatcagcagcaacggcgaggacagcgacgaggcccagatgagactgcagctgaagagaaagctgcagagaaacagaaccagcttcacccaggagcagatcgaggccctggagaaggagttcgagagaacccactaccccgacgtgttcgccagagagagactggccgccaagatcgacctgcccgaggccagaatccaggtgtggttcagcaacagaagagccaagtggagaagagaggagaagctgagaaaccagagaagacaggccagcaacacccccagccacatccccatcagcagcagcttcagcaccagcgtgtaccagcccatcccccagcccaccacccccgtgagcagcttcaccagcggcagcatgctgggcagaaccgacaccgccctgaccaacacctacagcgccctgccccccatgcccagcttcaccatggccaacaacctgcccatgcagccccccgtgcccagccagaccagcagctacagctgcatgctgcccaccagccccagcgtgaacggcagaagctacgacacctacacccccccccacatgcagacccacatgaacagccagcccatgggcaccagcggcaccaccagcaccggcctgatcagccccggcgtgagcgtgcccgtgcaggtgcccggcagcgagcccgacatgagccagtactggcccagactgcagtag

SEQ ID NO: 8946 - DNA, 1311 bp, Artificial Sequence
  Description of Artificial Sequence: Synthetic coding sequence
atgcagaacagccacagcggcgtgaaccagctgggcggcgtgttcgtgaacggcagacccctgcccgacagcaccagacagaagatcgtggagctggcccacagcggcgccagaccctgcgacatcagcagaatcctgcagacccacgccgacgccaaggtgcaggtgctggacaaccagaacgtgagcaacggctgcgtgagcaagatcctgggcagatactacgagaccggcagcatcagacccagagccatcggcggcagcaagcccagagtggccacccccgaggtggtgagcaagatcgcccagtacaagagagagtgccccagcatcttcgcctgggagatcagagacagactgctgagcgagggcgtgtgcaccaacgacaacatccccagcgtgagcagcatcaacagagtgctgagaaacctggccagcgagaagcagcagatgggcgccgacggcatgtacgacaagctgagaatgctgaacggccagaccggcagctggggcaccagacccggctggtaccccggcaccagcgtgcccggccagcccacccaggacggctgccagcagcaggagggcggcggcgagaacaccaacagcatcagcagcaacggcgaggacagcgacgaggcccagatgagactgcagctgaagagaaagctgcagagaaacagaaccagcttcacccaggagcagatcgaggccctggagaaggagttcgagagaacccactaccccgacgtgttcgccagagagagactggccgccaagatcgacctgcccgaggccagaatccaggtgtggttcagcaacagaagagccaagtggagaagagaggagaagctgagaaaccagagaagacaggccagcaacacccccagccacatccccatcagcagcagcttcagcaccagcgtgtaccagcccatcccccagcccaccacccccgtgagcagcttcaccagcggcagcatgctgggcagaaccgacaccgccctgaccaacacctacagcgccctgccccccatgcccagcttcaccatggccaacaacctgcccatgcagccccccgtgcccagccagaccagcagctacagctgcatgctgcccaccagccccagcgtgaacggcagaagctacgacacctacacccccccccacatgcagacccacatgaacagccagcccatgggcaccagcggcaccaccagcaccggcctgatcagccccggcgtgagcgtgcccgtgcaggtgcccggcagcgagcccgacatgagccagtactggcccagactgcagtag

SEQ ID NO: 8947 - DNA, 1269 bp, Artificial Sequence; identical to SEQ ID NO: 8945
  Description of Artificial Sequence: Synthetic coding sequence

SEQ ID NO: 8948 - DNA, 1269 bp, Artificial Sequence; identical to SEQ ID NO: 8945
  Description of Artificial Sequence: Synthetic coding sequence

SEQ ID NO: 8949 - DNA, 1311 bp, Artificial Sequence; identical to SEQ ID NO: 8946
  Description of Artificial Sequence: Synthetic coding sequence

SEQ ID NO: 8950 - DNA, 1269 bp, Artificial Sequence; identical to SEQ ID NO: 8945
  Description of Artificial Sequence: Synthetic coding sequence

SEQ ID NO: 8951 - DNA, 1311 bp, Artificial Sequence; identical to SEQ ID NO: 8946
  Description of Artificial Sequence: Synthetic coding sequence

SEQ ID NO: 8952 - DNA, 1269 bp, Artificial Sequence; identical to SEQ ID NO: 8945
  Description of Artificial Sequence: Synthetic coding sequence

SEQ ID NO: 8953 - DNA, 1311 bp, Artificial Sequence; identical to SEQ ID NO: 8946
  Description of Artificial Sequence: Synthetic coding sequence

SEQ ID NO: 8954 - DNA, 201 bp, Artificial Sequence
  Description of Artificial Sequence: Synthetic coding sequence
atgcagaacagccacagcggcgtgaaccagctgggcggcgtgttcgtgaacggcagacccctgcccgacagcaccagacagaagatcgtggagctggcccacagcggcgccagaccctgcgacatcagcagaatcctgcagacccacgccgacgccaaggtgcaggtgctggacaaccagaacgtgagcaacggctgctag

SEQ ID NO: 8955 - DNA, 120 bp, Artificial Sequence
  Description of Artificial Sequence: Synthetic coding sequence
atgcagaacagccacagcggcgtgaaccagctgggcggcgtgttcgtgaacggcagacccctgcccgacagcaccagacagaagatcgtggagctggcccacagcggcgccagaccctag

SEQ ID NO: 8956 - DNA, 375 bp, Artificial Sequence
  Description of Artificial Sequence: Synthetic coding sequence
atgcagaacagccacagcggcgtgaaccagctgggcggcgtgttcgtgaacggcagacccctgcccgacagcaccagacagaagatcgtggagctggcccacagcggcgccagaccctgcgacatcagcagaatcctgcagacccacgccgacgccaaggtgcaggtgctggacaaccagaacgtgagcaacggctgcgtgagcagcatcaacagagtgctgagaaacctggccagcgagaagcagcagatgggcgccgacggcatgtacgacaagctgagaatgctgaacggccagaccggcagctggggcaccagacccggctggtaccccggcaccagcgtgcccggccagcccacccaggacggctgctag

SEQ ID NO: 8957 - DNA, 177 bp, Artificial Sequence
  Description of Artificial Sequence: Synthetic coding sequence
atgcagaacagccacagcggcgtgaaccagctgggcggcgtgttcgtgaacggcagacccctgcccgacagcaccagacagaagatcgtggagctggcccacagcggcgccagaccctgcgacatcagcagaatcctgcaggtgagcaacggctgcgtgagcaagatcctgggctag

SEQ ID NO: 8958 - DNA, 9 bp, Artificial Sequence
  Description of Artificial Sequence: Synthetic coding sequence
atgcagtag

SEQ ID NO: 8959 - DNA, 1134 bp, Artificial Sequence
  Description of Artificial Sequence: Synthetic coding sequence
atgcaggtgagcaacggctgcgtgagcaagatcctgggcagatactacgagaccggcagcatcagacccagagccatcggcggcagcaagcccagagtggccacccccgaggtggtgagcaagatcgcccagtacaagagagagtgccccagcatcttcgcctgggagatcagagacagactgctgagcgagggcgtgtgcaccaacgacaacatccccagcgtgagcagcatcaacagagtgctgagaaacctggccagcgagaagcagcagatgggcgccgacggcatgtacgacaagctgagaatgctgaacggccagaccggcagctggggcaccagacccggctggtaccccggcaccagcgtgcccggccagcccacccaggacggctgccagcagcaggagggcggcggcgagaacaccaacagcatcagcagcaacggcgaggacagcgacgaggcccagatgagactgcagctgaagagaaagctgcagagaaacagaaccagcttcacccaggagcagatcgaggccctggagaaggagttcgagagaacccactaccccgacgtgttcgccagagagagactggccgccaagatcgacctgcccgaggccagaatccaggtgtggttcagcaacagaagagccaagtggagaagagaggagaagctgagaaaccagagaagacaggccagcaacacccccagccacatccccatcagcagcagcttcagcaccagcgtgtaccagcccatcccccagcccaccacccccgtgagcagcttcaccagcggcagcatgctgggcagaaccgacaccgccctgaccaacacctacagcgccctgccccccatgcccagcttcaccatggccaacaacctgcccatgcagccccccgtgcccagccagaccagcagctacagctgcatgctgcccaccagccccagcgtgaacggcagaagctacgacacctacacccccccccacatgcagacccacatgaacagccagcccatgggcaccagcggcaccaccagcaccggcctgatcagccccggcgtgagcgtgcccgtgcaggtgcccggcagcgagcccgacatgagccagtactggcccagactgcagtag

SEQ ID NO: 8960 - DNA, 1389 bp, Artificial Sequence
  Description of Artificial Sequence: Synthetic coding sequence
atgagcagcgtgaagagaagcctgaagcaggagatcgtgacccagttccactgcagcgccgccgagggcgacatcgccaagctgaccggcatcctgagccacagccccagcctgctgaacgagaccagcgagaacggctggaccgccctgatgtacgccgccagaaacggccaccccgagatcgtgcagttcctgctggagaagggctgcgacagaagcatcgtgaacaagagcagacagaccgccctggacatcgccgtgttctggggctacaagcacatcgccaacctgctggccaccgccaagggcggcaagaagccctggttcctgaccaacgaggtggaggagtgcgagaactacttcagcaagaccctgctggacagaaagagcgagaagagaaacaacagcgactggctgctggccaaggagagccaccccgccaccgtgttcatcctgttcagcgacctgaaccccctggtgaccctgggcggcaacaaggagagcttccagcagcccgaggtgagactgtgccagctgaactacaccgacatcaaggactacctggcccagcccgagaagatcaccctgatcttcctgggcgtggagctggagatcaaggacaagctgctgaactacgccggcgaggtgcccagagaggaggaggacggcctggtggcctggttcgccctgggcatcgaccccatcgccgccgaggagttcaagcagagacacgagaactgctacttcctgcacccccccatgcccgccctgctgcagctgaaggagaaggaggccggcgtggtggcccaggccagaagcgtgctggcctggcacagcagatacaagttctgccccacctgcggcaacgccaccaagatcgaggagggcggctacaagagactgtgcctgaaggaggactgccccagcctgaacggcgtgcacaacaccagctaccccagagtggaccccgtggtgatcatgcaggtgatccaccccgacggcaccaagtgcctgctgggcagacagaagagattcccccccggcatgttcacctgcctggccggcttcatcgagcccggcgagaccatcgaggacgccgtgagaagagaggtggaggaggagagcggcgtgaaggtgggccacgtgcagtacgtggcctgccagccctggcccatgcccagcagcctgatgatcggctgcctggccctggccgtgagcaccgagatcaaggtggacaagaacgagatcgaggacgccagatggttcaccagagagcaggtgctggacgtgctgaccaagggcaagcagcaggccttcttcgtgccccccagcagagccatcgcccaccagctgatcaagcactggatcagaatcaaccccaacctgtag

SEQ ID NO: 8961 - DNA, 84 bp, Artificial Sequence
  Description of Artificial Sequence: Synthetic coding sequence
atgagcccctgccccgaggaggccgccatgagaagagaggtggtgaagagaatcgagaccgtggtgaaggacctgtggccctag

SEQ ID NO: 8962 - DNA, 1095 bp, Artificial Sequence
  Description of Artificial Sequence: Synthetic coding sequence
atggccctggccctgctggaggactggtgcagaatcatgagcgtggacgagcagaagagcctgatggtgaccggcatccccgccgacttcgaggaggccgagatccaggaggtgctgcaggagaccctgaagagcctgggcagatacagactgctgggcaagatcttcagaaagcaggagaacgccaacgccgtgctgctggagctgctggaggacaccgacgtgagcgccatccccagcgaggtgcagggcaagggcggcgtgtggaaggtgatcttcaagacccccaaccaggacaccgagttcctggagagactgaacctgttcctggagaaggagggccagaccgtgagcggcatgttcagagccctgggccaggagggcgtgagccccgccaccgtgccctgcatcagccccgagctgctggcccacctgctgggccaggccatggcccacgccccccagcccctgctgcccatgagatacagaaagctgagagtgttcagcggcagcgccgtgcccgcccccgaggaggagagcttcgaggtgtggctggagcaggccaccgagatcgtgaaggagtggcccgtgaccgaggccgagaagaagagatggctggccgagagcctgagaggccccgccctggacctgatgcacatcgtgcaggccgacaaccccagcatcagcgtggaggagtgcctggaggccttcaagcaggtgttcggcagcctggagagcagaagaaccgcccaggtgagatacctgaagacctaccaggaggagggcgagaaggtgagcgcctacgtgctgagactggagaccctgctgagaagagccgtggagaagagagccatccccagaagaatcgccgaccaggtgagactggagcaggtgatggccggcgccaccctgaaccagatgctgtggtgcagactgagagagctgaaggaccagggccccccccccagcttcctggagctgatgaaggtgatcagagaggaggaggaggaggaggccagcttcgagaacgagagcatcgaggagcccgaggagagagacggctacggcagatggaaccacgagggcgacgactag

SEQ ID NO: 8963 - DNA, 1392 bp, Artificial Sequence
  Description of Artificial Sequence: Synthetic coding sequence
atgcccctgaccctgctgcaggactggtgcagaggcgagcacctgaacaccagaagatgcatgctgatcctgggcatccccgaggactgcggcgaggacgagttcgaggagaccctgcaggaggcctgcagacacctgggcagatacagagtgatcggcagaatgttcagaagagaggagaacgcccaggccatcctgctggagctggcccaggacatcgactacgccctgctgcccagagagatccccggcaagggcggcccctgggaggtgatcgtgaagcccagaaacagcgacggcgagttcctgaacagactgaacagattcctggaggaggagagaagaaccgtgagcgacatgaacagagtgctgggcagcgacaccaactgcagcgcccccagagtgaccatcagccccgagttctggacctgggcccagaccctgggcgccgccgtgcagcccctgctggagcagatgctgtacagagagctgagagtgttcagcggcaacaccatcagcatccccggcgccctggccttcgacgcctggctggagcacaccaccgagatgctgcagatgtggcaggtgcccgagggcgagaagagaagaagactgatggagtgcctgagaggccccgccctgcaggtggtgagcggcctgagagccagcaacgccagcatcaccgtggaggagtgcctggccgccctgcagcaggtgttcggccccgtggagagccacaagatcgcccaggtgaagctgtgcaaggcctaccaggaggccggcgagaaggtgagcagcttcgtgctgagactggagcccctgctgcagagagccgtggagaacaacgtggtgagcagaagaaacgtgaaccagaccagactgaagagagtgctgagcggcgccaccctgcccgacaagctgagagacaagctgaagctgatgaagcagagaagaaagccccccggcttcctggccctggtgaagctgctgagagaggaggaggagtgggaggccaccctgggccccgacagagagagcctggagggcctggaggtggcccccagaccccccgccagaatcaccggcgtgggcgccgtgcccctgcccgccagcggcaacagcttcgacgtgagacccagccagggctacagaagaagaagaggcagaggccagcacagaagaggcggcgtggccagagccggcagcagaggcagcagaaagagaaagagacacaccttctgctacagctgcggcgaggacggccacatcagagtgcagtgcatcaaccccagcaacctgctgctggtgaagcagaagaagcaggccgccgtggagagcggcaacggcaactgggcctgggacaagagccaccccaagagcaaggccaagtag

SEQ ID NO: 8964 - DNA, 1392 bp, Artificial Sequence; identical to SEQ ID NO: 8963
  Description of Artificial Sequence: Synthetic coding sequence

SEQ ID NO: 8965 - DNA, 1392 bp, Artificial Sequence; identical to SEQ ID NO: 8963
  Description of Artificial Sequence: Synthetic coding sequence

SEQ ID NO: 8966 - DNA, 759 bp, Artificial Sequence
  Description of Artificial Sequence: Synthetic coding sequence
atggagagcgagatggagacccagagcgccagagccgaggagggcttcacccaggtgaccagaaagggcggcagaagagccaagaagagacaggccgagcagctgagcgccgccggcgagggcggcgacgccggcagaatggacaccgaggaggccagacccgccaagagacccgtgttcccccccctgtgcggcgacggcctgctgagcggcaaggaggagaccagaaagatccccgtgcccgccaacagatacacccccctgaaggagaactggatgaagatcttcacccccatcgtggagcacctgggcctgcagatcagattcaacctgaagagcagaaacgtggagatcagaacctgcaaggagaccaaggacgtgagcgccctgaccaaggccgccgacttcgtgaaggccttcatcctgggcttccaggtggaggacgccctggccctgatcagactggacgacctgttcctggagagcttcgagatcaccgacgtgaagcccctgaagggcgaccacctgagcagagccatcggcagaatcgccggcaagggcggcaagaccaagttcaccatcgagaacgtgaccagaaccagaatcgtgctggccgacgtgaaggtgcacatcctgggcagcttccagaacatcaagatggccagaaccgccatctgcaacctgatcctgggcaacccccccagcaaggtgtacggcaacatcagagccgtggccagcagaagcgccgacagattctag

SEQ ID NO: 8967 - DNA, 2322 bp, Artificial Sequence
  Description of Artificial Sequence: Synthetic coding sequence
atgaagatgagaggcgagaagagaagagacaaggtgaaccccaagagcagccagagaaagctgaactggatccccagcttccccacctacgactacttcaaccaggtgaccctgcagctgctggacggcttcatgatcaccctgagcaccgacggcgtgatcatctgcgtggccgagaacatcagcagcctgctgggccacctgcccgccgagatcgtgggcaagaagctgctgagcctgctgcccgacgaggagaaggacgaggtgtaccagaagatcatcctgaagttccccctgctgaacagcgagacccacatcgagttctgctgccacctgaagagaggcaacgtggagcacggcgacagcagcgcctacgagaacgtgaagttcatcgtgaacgtgagagacatctgcaacgagttccccgtggtgttcagcggcctgttcagcagccacctgtgcgccgacttcgccgcctgcgtgccccaggaggacagactgtacctggtgggcaacgtgtgcatcctgagaacccagctgctgcagcagctgtacaccagcaaggccgtgagcgacgaggccgtgctgacccaggacagcgacgaggagcccttcgtgggcgagctgagcagcagccagggccagagaggccacaccagcatgaaggccgtgtacgtggagcccgccgccgccgccgccgccgccgccatcagcgacgaccagatcgacatcgccgaggtggagcagtacggcccccaggagaacgtgcacatgttcgtggacagcgacagcacctactgcagcagcaccgtgttcctggacaccatgcccgagagccccgccctgagcctgcaggacttcagaggcgagcccgaggtgaaccccctgtacagagccgaccccgtggacctggagttcagcgtggaccaggtggacagcgtggaccaggagggccccatggaccagcaggaccccgagaaccccgtggcccccctggaccaggccggcctgatggaccccgtggaccccgaggacagcgtggacctgggcgccgccggcgccagcgcccagcccctgcagcccagcagccccgtggcctacgacatcatcagccaggagctggagctgatgaagaagctgaaggagcagctggaggagagaacctggctgctgcacgacgccatccagaaccagcagaacgccctggagctgatgatggaccacctgcagaagcagcccaacaccctgagacacgtggtgatccccgacctgcagagcagcgaggccgtgcccaagaagcagcagaagcagcacgccggccaggtgaagagacccctgccccaccccaaggacgtgaagtgcttctgcggcctgagcctgagcaacagcctgaagaacaccggcgagctgcaggagccctgcgtggccttcaaccagcagcagctggtgcagcaggagcagcacctgaaggagcagcagagacagctgagagagcagctgcagcagctgagagagcagagaaaggtgcagaagcagaagaagatgcaggagaagaagaagctgcaggagcagaagatgcaggagaagaagaagctgcaggagcagagaagacagaagaagaagaagctgcaggagagaaagaagtggcagggccagatgctgcagaaggagcccgaggaggagcagcagaagcagcagctgcaggagcagcccctgaagcacaacgtgatcgtgggcaacgagagagtgcagatctgcctgcagaaccccagagacgtgagcgtgcccctgtgcaaccaccccgtgagattcctgcaggcccagcccatcgtgcccgtgcagagagccgccgagcagcagcccagcggcttctaccaggacgagaactgcggccagcaggaggacgagagccagagcttctaccccgaggcctaccagggcccccccgtgaaccagctgcccctgatcgacaccagcaacagcgaggccatcagcagcagcagcatcccccagttccccatcaccagcgacagcaccatcagcaccctggagaccccccaggactacatcagactgtggcaggagctgagcgacagcctgggccccgtggtgcaggtgaacacctggagctgcgacgagcagggcaccctgcacggccagcccacctaccaccaggtgcaggtgagcgaggtgggcgtggagggcccccccgacccccaggccttccagggccccgccgcctaccagcccgaccagatgagaagcgccgagcagaccagactgatgcccgccgagcagagagacagcaacaagccctgctag

SEQ ID NO: 8968 - DNA, 3069 bp, Artificial Sequence
  Description of Artificial Sequence: Synthetic coding sequence
atgttcagagaggtgaagtactacgccgtgggcgacatcgacccccaggtgatccagctgctgaaggccggcaaggccaaggaggtgagctacaacgccctggccagccacatcatcagcgaggacggcgacaaccccgaggtgggcgaggccagagaggtgttcgacctgcccgtggtgaaggtgagcagcgaggacagaagcgccctgtgggccctggtgaccttctacggcggcgactgccagctgaccctgaacaagaagtgcacccacctgatcgtgcccgagcccaagggcgagaagtacgagtgcgccctgaagagagccagcatcaagatcgtgacccccgactgggtgctggactgcgtgagcgagaagaccaagaaggacgaggccttctaccaccccagactgatcatctacgaggaggaggaggaggaggaggaggaggaggaggaggtggagaacgaggagcaggacagccagaacgagggcagcaccgacgagaagagcagccccgccagcagccaggagggcagccccagcggcgaccagcagttcagccccaagagcaacaccgagaagagcaagggcgagctgatgttcgacgacagcagcgacagcagccccgagaagcaggagagaaacctgaactggacccccgccgaggtgccccagctggccgccgccaagagaagactgccccagggcaaggagcccggcctgatcaacctgtgcgccaacgtgccccccgtgcccggcaacatcctgccccccgaggtgagaggcaacctgatggccgccggccagaacctgcagagcagcgagagaagcgagatgatcgccacctggagccccgccgtgagaaccctgagaaacatcaccaacaacgccgacatccagcagatgaacagacccagcaacgtggcccacatcctgcagaccctgagcgcccccaccaagaacctggagcagcaggtgaaccacagccagcagggccacaccaacgccaacgccgtgctgttcagccaggtgaaggtgacccccgagacccacatgctgcagcagcagcagcaggcccagcagcagcagcagcagcaccccgtgctgcacctgcagccccagcagatcatgcagctgcagcagcagcagcagcagcagatcagccagcagccctacccccagcagcccccccaccccttcagccagcagcagcagcagcagcagcaggcccacccccaccagttcagccagcagcagctgcagttcccccagcagcagctgcaccccccccagcagctgcacagaccccagcagcagctgcagcccttccagcagcagcacgccctgcagcagcagttccaccagctgcagcagcaccagctgcagcagcagcagctggcccagctgcagcagcagcacagcctgctgcagcagcagcagcagcagcagatccagcagcagcagctgcagagaatgcaccagcagcagcagcagcagcagatgcagagccagaccgccccccacctgagccagaccagccaggccctgcagcaccaggtgcccccccagcagcccccccagcagcagcagcagcagcagcccccccccagcccccagcagcaccagctgttcggccacgaccccgccgtggagatccccgaggagggcttcctgctgggctgcgtgttcgccatcgccgactaccccgagcagatgagcgacaagcagctgctggccacctggaagagaatcatccaggcccacggcggcaccgtggaccccaccttcaccagcagatgcacccacctgctgtgcgagagccaggtgagcagcgcctacgcccaggccatcagagagagaaagagatgcgtgaccgcccactggctgaacaccgtgctgaagaagaagaagatggtgcccccccacagagccctgcacttccccgtggccttcccccccggcggcaagccctgcagccagcacatcatcagcgtgaccggcttcgtggacagcgacagagacgacctgaagctgatggcctacctggccggcgccaagtacaccggctacctgtgcagaagcaacaccgtgctgatctgcaaggagcccaccggcctgaagtacgagaaggccaaggagtggagaatcccctgcgtgaacgcccagtggctgggcgacatcctgctgggcaacttcgaggccctgagacagatccagtacagcagatacaccgccttcagcctgcaggaccccttcgcccccacccagcacctggtgctgaacctgctggacgcctggagagtgcccctgaaggtgagcgccgagctgctgatgagcatcagactgccccccaagctgaagcagaacgaggtggccaacgtgcagcccagcagcaagagagccagaatcgaggacgtgcccccccccaccaagaagctgacccccgagctgacccccttcgtgctgttcaccggcttcgagcccgtgcaggtgcagcagtacatcaagaagctgtacatcctgggcggcgaggtggccgagagcgcccagaagtgcacccacctgatcgccagcaaggtgaccagaaccgtgaagttcctgaccgccatcagcgtggtgaagcacatcgtgacccccgagtggctggaggagtgcttcagatgccagaagttcatcgacgagcagaactacatcctgagagacgccgaggccgaggtgctgttcagcttcagcctggaggagagcctgaagagagcccacgtgagccccctgttcaaggccaagtacttctacatcacccccggcatctgccccagcctgagcaccatgaaggccatcgtggagtgcgccggcggcaaggtgctgagcaagcagcccagcttcagaaagctgatggagcacaagcagaacagcagcctgagcgagatcatcctgatcagctgcgagaacgacctgcacctgtgcagagagtacttcgccagaggcatcgacgtgcacaacgccgagttcgtgctgaccggcgtgctgacccagaccctggactacgagagctacaagttcaactag

SEQ ID NO: 8969 - DNA, 2682 bp, Artificial Sequence
  Description of Artificial Sequence: Synthetic coding sequence
gtgagagtgctgatccaggccggcgccctgtgctggagcctgcccgagctgagccagggcgaggtgggcaagggcgcctgccccgccgaggtgggcaagcacagagaccacctgcccagcagcgaccccgtgctgatgcaggccgaggccagcgtggtgatgtgctgggtgagcagcgaggacagaagcgccctgtgggccctggtgaccttctacggcggcgactgccagctgaccctgaacaagaagtgcacccacctgatcgtgcccgagcccaagggcgagaagtacgagtgcgccctgaagagagccagcatcaagatcgtgacccccgactgggtgctggactgcgtgagcgagaagaccaagaaggacgaggccttctaccaccccagactgatcatctacgaggaggaggaggaggaggaggaggaggaggaggaggtggagaacgaggagcaggacagccagaacgagggcagcaccgacgagaagagcagccccgccagcagccaggagggcagccccagcggcgaccagcagttcagccccaagagcaacaccgagaagagcaagggcgagctgatgttcgacgacagcagcgacagcagccccgagaagcaggagagaaacctgaactggacccccgccgaggtgccccagctggccgccgccaagagaagactgccccagggcaaggagcccggcctgatcaacctgtgcgccaacgtgccccccgtgcccggcaacatcctgccccccgaggtgagaggcaacctgatggccgccggccagaacctgcagagcagcgagagaagcgagatgatcgccacctggagccccgccgtgagaaccctgagaaacatcaccaacaacgccgacatccagcagatgaacagacccagcaacgtggcccacatcctgcagaccctgagcgcccccaccaagaacctggagcagcaggtgaaccacagccagcagggccacaccaacgccaacgccgtgctgttcagccaggtgaaggtgacccccgagacccacatgctgcagcagcagcagcaggcccagcagcagcagcagcagcaccccgtgctgcacctgcagccccagcagatcatgcagctgcagcagcagcagcagcagcagatcagccagcagccctacccccagcagcccccccaccccttcagccagcagcagcagcagcagcagcagcccccccccagcccccagcagcaccagctgttcggccacgaccccgccgtggagatccccgaggagggcttcctgctgggctgcgtgttcgccatcgccgactaccccgagcagatgagcgacaagcagctgctggccacctggaagagaatcatccaggcccacggcggcaccgtggaccccaccttcaccagcagatgcacccacctgctgtgcgagagccaggtgagcagcgcctacgcccaggccatcagagagagaaagagatgcgtgaccgcccactggctgaacaccgtgctgaagaagaagaagatggtgcccccccacagagccctgcacttccccgtggccttcccccccggcggcaagccctgcagccagcacatcatcagcgtgaccggcttcgtggacagcgacagagacgacctgaagctgatggcctacctggccggcgccaagtacaccggctacctgtgcagaagcaacaccgtgctgatctgcaaggagcccaccggcctgaagtacgagaaggccaaggagtggagaatcccctgcgtgaacgcccagtggctgggcgacatcctgctgggcaacttcgaggccctgagacagatccagtacagcagatacaccgccttcagcctgcaggaccccttcgcccccacccagcacctggtgctgaacctgctggacgcctggagagtgcccctgaaggtgagcgccgagctgctgatgagcatcagactgccccccaagctgaagcagaacgaggtggccaacgtgcagcccagcagcaagagagccagaatcgaggacgtgcccccccccaccaagaagctgacccccgagctgacccccttcgtgctgttcaccggcttcgagcccgtgcaggtgcagcagtacatcaagaagctgtacatcctgggcggcgaggtggccgagagcgcccagaagtgcacccacctgatcgccagcaaggtgaccagaaccgtgaagttcctgaccgccatcagcgtggtgaagcacatcgtgacccccgagtggctggaggagtgcttcagatgccagaagttcatcgacgagcagaactacatcctgagagacgccgaggccgaggtgctgttcagcttcagcctggaggagagcctgaagagagcccacgtgagccccctgttcaaggccaagtacttctacatcacccccggcatctgccccagcctgagcaccatgaaggccatcgtggagtgcgccggcggcaaggtgctgagcaagcagcccagcttcagaaagctgatggagcacaagcagaacagcagcctgagcgagatcatcctgatcagctgcgagaacgacctgcacctgtgcagagagtacttcgccagaggcatcgacgtgcacaacgccgagttcgtgctgaccggcgtgctgacccagaccctggactacgagagctacaagttcaactag

SEQ ID NO: 8970 - DNA, 3210 bp, Artificial Sequence
  Description of Artificial Sequence: Synthetic coding sequence
atgagcgaccaggcccccaaggtgcccgaggagatgttcagagaggtgaagtactacgccgtgggcgacatcgacccccaggtgatccagctgctgaaggccggcaaggccaaggaggtgagctacaacgccctggccagccacatcatcagcgaggacggcgacaaccccgaggtgggcgaggccagagaggtgttcgacctgcccgtggtgaagcccagctgggtgatcctgagcgtgcagtgcggcaccctgctgcccgtgaacggcttcagccccgagagctgccagatcttcttcggcatcaccgcctgcctgagccaggtgagcagcgaggacagaagcgccctgtgggccctggtgaccttctacggcggcgactgccagctgaccctgaacaagaagtgcacccacctgatcgtgcccgagcccaagggcgagaagtacgagtgcgccctgaagagagccagcatcaagatcgtgacccccgactgggtgctggactgcgtgagcgagaagaccaagaaggacgaggccttctaccaccccagactgatcatctacgaggaggaggaggaggaggaggaggaggaggaggaggtggagaacgaggagcaggacagccagaacgagggcagcaccgacgagaagagcagccccgccagcagccaggagggcagccccagcggcgaccagcagttcagccccaagagcaacaccgagaagagcaagggcgagctgatgttcgacgacagcagcgacagcagccccgagaagcaggagagaaacctgaactggacccccgccgaggtgccccagctggccgccgccaagagaagactgccccagggcaaggagcccggcctgatcaacctgtgcgccaacgtgccccccgtgcccggcaacatcctgccccccgaggtgagaggcaacctgatggccgccggccagaacctgcagagcagcgagagaagcgagatgatcgccacctggagccccgccgtgagaaccctgagaaacatcaccaacaacgccgacatccagcagatgaacagacccagcaacgtggcccacatcctgcagaccctgagcgcccccaccaagaacctggagcagcaggtgaaccacagccagcagggccacaccaacgccaacgccgtgctgttcagccaggtgaaggtgacccccgagacccacatgctgcagcagcagcagcaggcccagcagcagcagcagcagcaccccgtgctgcacctgcagccccagcagatcatgcagctgcagcagcagcagcagcagcagatcagccagcagccctacccccagcagcccccccaccccttcagccagcagcagcagcagcagcagcaggcccacccccaccagttcagccagcagcagctgcagttcccccagcagcagctgcaccccccccagcagctgcacagaccccagcagcagctgcagcccttccagcagcagcacgccctgcagcagcagttccaccagctgcagcagcaccagctgcagcagcagcagctggcccagctgcagcagcagcacagcctgctgcagcagcagcagcagcagcagatccagcagcagcagctgcagagaatgcaccagcagcagcagcagcagcagatgcagagccagaccgccccccacctgagccagaccagccaggccctgcagcaccaggtgcccccccagcagcccccccagcagcagcagcagcagcagcccccccccagcccccagcagcaccagctgttcggccacgaccccgccgtggagatccccgaggagggcttcctgctgggctgcgtgttcgccatcgccgactaccccgagcagatgagcgacaagcagctgctggccacctggaagagaatcatccaggcccacggcggcaccgtggaccccaccttcaccagcagatgcacccacctgctgtgcgagagccaggtgagcagcgcctacgcccaggccatcagagagagaaagagatgcgtgaccgcccactggctgaacaccgtgctgaagaagaagaagatggtgcccccccacagagccctgcacttccccgtggccttcccccccggcggcaagccctgcagccagcacatcatcagcgtgaccggcttcgtggacagcgacagagacgacctgaagctgatggcctacctggccggcgccaagtacaccggctacctgtgcagaagcaacaccgtgctgatctgcaaggagcccaccggcctgaagtacgagaaggccaaggagtggagaatcccctgcgtgaacgcccagtggctgggcgacatcctgctgggcaacttcgaggccctgagacagatccagtacagcagatacaccgccttcagcctgcaggaccccttcgcccccacccagcacctggtgctgaacctgctggacgcctggagagtgcccctgaaggtgagcgccgagctgctgatgagcatcagactgccccccaagctgaagcagaacgaggtggccaacgtgcagcccagcagcaagagagccagaatcgaggacgtgcccccccccaccaagaagctgacccccgagctgacccccttcgtgctgttcaccggcttcgagcccgtgcaggtgcagcagtacatcaagaagctgtacatcctgggcggcgaggtggccgagagcgcccagaagtgcacccacctgatcgccagcaaggtgaccagaaccgtgaagttcctgaccgccatcagcgtggtgaagcacatcgtgacccccgagtggctggaggagtgcttcagatgccagaagttcatcgacgagcagaactacatcctgagagacgccgaggccgaggtgctgttcagcttcagcctggaggagagcctgaagagagcccacgtgagccccctgttcaaggccaagtacttctacatcacccccggcatctgccccagcctgagcaccatgaaggccatcgtggagtgcgccggcggcaaggtgctgagcaagcagcccagcttcagaaagctgatggagcacaagcagaacagcagcctgagcgagatcatcctgatcagctgcgagaacgacctgcacctgtgcagagagtacttcgccagaggcatcgacgtgcacaacgccgagttcgtgctgaccggcgtgctgacccagaccctggactacgagagctacaagttcaactag

SEQ ID NO: 8971 - DNA, 3210 bp, Artificial Sequence; identical to SEQ ID NO: 8970
  Description of Artificial Sequence: Synthetic coding sequence

SEQ ID NO: 8972 - DNA, 4668 bp, Artificial Sequence
  Description of Artificial Sequence: Synthetic coding sequence
atgagcgagcagacccccgccgaggccggcgccgccggcgccagagaggacgcctgcagagactaccagagcagcctggaggacctgaccttcaacagcaagccccacatcaacatgctgaccatcctggccgaggagaacctgcccttcgccaaggagatcgtgagcctgatcgaggcccagaccgccaaggcccccagcagcgagaagctgcccgtgatgtacctgatggacagcatcgtgaagaacgtgggcagagagtacctgaccgccttcaccaagaacctggtggccaccttcatctgcgtgttcgagaaggtggacgagaacaccagaaagagcctgttcaagctgagaagcacctgggacgagatcttccccctgaagaagctgtacgccctggacgtgagagtgaacagcctggaccccgcctggcccatcaagcccctgccccccaacgtgaacaccagcagcatccacgtgaaccccaagttcctgaacaagagccccgaggagcccagcacccccggcaccgtggtgagcagccccagcatcagcaccccccccatcgtgcccgacatccagaagaacctgacccaggagcagctgatcagacagcagctgctggccaagcagaagcagctgctggagctgcagcagaagaagctggagctggagctggagcaggccaaggcccagctggccgtgagcctgagcgtgcagcaggagaccagcaacctgggccccggcagcgcccccagcaagctgcacgtgagccagatcccccccatggccgtgaaggccccccaccaggtgcccgtgcagagcgagaagagcagacccggccccagcctgcagatccaggacctgaagggcaccaacagagaccccagactgaacagaatcagccagcacagccacggcaaggaccagagccacagaaaggagttcctgatgaacaccctgaaccagagcgacaccaagaccagcaagaccatccccagcgagaagctgaacagcagcaagcaggagaagagcaagagcggcgagaagatcaccaagaaggagctggaccagctggacagcaagagcaagagcaagagcaagagccccagccccctgaagaacaagctgagccacaccaaggacctgaagaaccaggagagcgagagcatgagactgagcgacatgaacaagagagaccccagactgaagaagcacctgcaggacaagaccgacggcaaggacgacgacgtgaaggagaagagaaagaccgccgagaagaaggacaaggacgagcacatgaagagcagcgagcacagactggccggcagcagaaacaagatcatcaacggcatcgtgcagaagcaggacaccatcaccgaggagagcgagaagcagggcaccaagcccggcagaagcagcaccagaaagagaagcagaagcagaagccccaagagcagaagccccatcatccacagccccaagagaagagacagaagaagccccaagagaagacagagaagcatgagccccaccagcacccccaaggccggcaagatcagacagagcggcgccaagcagagccacatggaggagttcaccccccccagcagagaggacagaaacgccaagagaagcaccaagcaggacatcagagaccccagaagaatgaagaagaccgaggaggagagaccccaggagaccaccaaccagcacagcaccaagagcggcaccgagcccaaggagaacgtggagaactggcagagcagcaagagcgccaagagatggaagagcggctgggaggagaacaagagcctgcagcaggtggacgagcacagcaagcccccccacctgagacacagagagagctggagcagcaccaagggcatcctgagccccagagcccccaagcagcagcagcacagactgagcgtggacgccaacctgcagatccccaaggagctgaccctggccagcaagagagagctgctgcagaagaccagcgagagactggccagcggcgagatcacccaggacgacttcctggtggtggtgcaccagatcagacagctgttccagtaccaggagggcgtgagagaggagcagagaagccccttcaacgacagattccccctgaagagacccagatacgaggacagcgacaagcccttcgtggacagccccgccagcagattcgccggcctggacaccaaccagagactgaccgccctggccgaggacagacccctgttcgacggccccagcagacccagcgtggccagagacggccccaccaagatgatcttcgagggccccaacaagctgagccccagaatcgacggcccccccacccccgccagcctgagattcgacggcagccccggccagatgggcggcggcggccccctgagattcgagggcccccagggccagctgggcggcggctgccccctgagattcgagggcccccccggccccgtgggcacccccctgagattcgagggccccatcggccaggccggcggcggcggcttcagattcgagggcagccccggcctgagattcgagggcagccccggcggcctgagattcgagggccccggcggccagcccgtgggcggcctgagattcgagggccacagaggccagcccgtgggcggcctgagattcgagggcccccacggccagcccgtgggcggcctgagattcgacaaccccagaggccagcccgtgggcggcctgagattcgagggcggccacggccccagcggcgccgccatcagattcgacggcccccacggccagcccggcggcggcatcagattcgagggccccctgctgcagcagggcgtgggcatgagattcgagggcccccacggccagagcgtggccggcctgagattcgagggccagcacaaccagctgggcggcaacctgagattcgagggcccccacggccagcccggcgtgggcatcagattcgagggccccctggtgcagcagggcggcggcatgagattcgagggccccagcgtgcccggcggcggcctgagaatcgagggccccctgggccagggcggccccagattcgagggctgccacgccctgagattcgacggccagcccggccagcccagcctgctgcccagattcgacggcctgcacggccagcccggccccagattcgagagaacccccggccagcccggcccccagagattcgacggcccccccggccagcaggtgcagcccagattcgacggcgtgccccagagattcgacggcccccagcaccagcaggccagcagattcgacatccccctgggcctgcagggcaccagattcgacaaccaccccagccagagactggagagcgtgagcttcaaccagaccggcccctacaacgacccccccggcaacgccttcaacgcccccagccagggcctgcagttccagagacacgagcagatcttcgacagcccccagggccccaacttcaacggcccccacggccccggcaaccagagcttcagcaaccccctgaacagagccagcggccactacttcgacgagaagaacctgcagagcagccagttcggcaacttcggcaacatccccgcccccatgaccgtgggcaacatccaggccagccagcaggtgctgagcggcgtggcccagcccgtggccttcggccagggccagcagttcctgcccgtgcacccccagaaccccggcttcgtgcagaaccccagcggcgccctgcccaaggcctaccccgacaaccacctgagccaggtggacgtgaacgagctgttcagcaagctgctgaagaccggcatcctgaagctgagccagaccgacagcgccaccacccaggtgagcgaggtgaccgcccagcccccccccgaggaggaggaggaccagaacgaggaccaggacgtgcccgacctgaccaacttcaccgtggaggagctgaagcagagatacgacagcgtgatcaacagactgtacaccggcatccagtgctacagctgcggcatgagattcaccaccagccagaccgacgtgtacgccgaccacctggactggcactacagacagaacagaaccgagaaggacgtgagcagaaaggtgacccacagaagatggtactacagcctgaccgactggatcgagttcgaggagatcgccgacctggaggagagagccaagagccagttcttcgagaaggtgcacgaggaggtggtgctgaagacccaggaggccgccaaggagaaggagttccagagcgtgcccgccggccccgccggcgccgtggagagctgcgagatctgccaggagcagttcgagcagtactgggacgaggaggaggaggagtggcacctgaagaacgccatcagagtggacggcaagatctaccaccccagctgctacgaggactaccagaacaccagcagcttcgactgcacccccagccccagcaagacccccgtggagaaccccctgaacatcatgctgaacatcgtgaagaacgagctgcaggagccctgcgacagccccaaggtgaaggaggagagaatcgacaccccccccgcctgcaccgaggagagcatcgccacccccagcgagatcaagaccgagaacgacaccgtggagagcgtgtag

SEQ ID NO: 8973 - DNA, 2355 bp, Artificial Sequence
  Description of Artificial Sequence: Synthetic coding sequence
atgagcgagcagacccccgccgaggccggcgccgccggcgccagagaggacgcctgcagagactaccagagcagcctggaggacctgaccttcaacagcaagccccacatcaacatgctgaccatcctggccgaggagaacctgcccttcgccaaggagatcgtgagcctgatcgaggcccagaccgccaaggcccccagcagcgagaagctgcccgtgatgtacctgatggacagcatcgtgaagaacgtgggcagagagtacctgaccgccttcaccaagaacctggtggccaccttcatctgcgtgttcgagaaggtggacgagaacaccagaaagagcctgttcaagctgagaagcacctgggacgagatcttccccctgaagaagctgtacgccctggacgtgagagtgaacagcctggaccccgcctggcccatcaagcccctgccccccaacgtgaacaccagcagcatccacgtgaaccccaagttcctgaacaagagccccgaggagcccagcacccccggcaccgtggtgagcagccccagcatcagcaccccccccatcgtgcccgacatccagaagaacctgacccaggagcagctgatcagacagcagctgctggccaagcagaagcagctgctggagctgcagcagaagaagctggagctggagctggagcaggccaaggcccagctggccgtgagcctgagcgtgcagcaggagaccagcaacctgggccccggcagcgcccccagcaagctgcacgtgagccagatcccccccatggccgtgaaggccccccaccaggtgcccgtgcagagcgagaagagcagacccggccccagcctgcagatccaggacctgaagggcaccaacagagaccccagactgaacagaatcagccagcacagccacggcaaggaccagagccacagaaaggagttcctgatgaacaccctgaaccagagcgacaccaagaccagcaagaccatccccagcgagaagctgaacagcagcaagcaggagaagagcaagagcggcgagaagatcaccaagaaggagctggaccagctggacagcaagagcaagagcaagagcaagagccccagccccctgaagaacaagctgagccacaccaaggacctgaagaaccaggagagcgagagcatgagactgagcgacatgaacaagagagaccccagactgaagaagcacctgcaggacaagaccgacggcaaggacgacgacgtgaaggagaagagaaagaccgccgagaagaaggacaaggacgagcacatgaagagcagcgagcacagactggccggcagcagaaacaagatcatcaacggcatcgtgcagaagcaggacaccatcaccgaggagagcgagaagcagggcaccaagcccggcagaagcagcaccagaaagagaagcagaagcagaagccccaagagcagaagccccatcatccacagccccaagagaagagacagaagaagccccaagagaagacagagaagcatgagccccaccagcacccccaaggccggcaagatcagacagagcggcgccaagcagagccacatggaggagttcaccccccccagcagagaggacagaaacgccaagagaagcaccaagcaggacatcagagaccccagaagaatgaagaagaccgaggaggagagaccccaggagaccaccaaccagcacagcaccaagagcggcaccgagcccaaggagaacgtggagaactggcagagcagcaagagcgccaagagatggaagagcggctgggaggagaacaagagcctgcagcaggtggacgagcacagcaagcccccccacctgagacacagagagagctggagcagcaccaagggcatcctgagccccagagcccccaagcagcagcagcacagactgagcgtggacgccaacctgcagatccccaaggagctgaccctggccagcaagagagagctgctgcagaagaccagcgagagactggccagcggcgagatcacccaggacgacttcctggtggtggtgcaccagatcagacagctgttccagtaccaggagggcgtgagagaggagcagagaagccccttcaacgacagattccccctgaagagacccagatacgaggacagcgacaagcccttcgtggacagccccgccagcagattcgccggcctggacaccaaccagagactgaccgccctggccgaggacagacccctgttcgacggccccagcagacccagcgtggccagagacggccccaccaagatgatcttcgagggccccaacaagctgagccccagaatcgacggccccccctag

SEQ ID NO: 8974 - DNA, 4344 bp, Artificial Sequence
  Description of Artificial Sequence: Synthetic coding sequence
atggcccacagcaagaccagaaccaacgacggcaagatcacctacccccccggcgtgaaggagatcagcgacaagatcagcaaggaggagatggtgagaagactgaagatggtggtgaagaccttcatggacatggaccaggacagcgaggaggagaaggagctgtacctgaacctggccctgcacctggccagcgacttcttcctgaagcaccccgacaaggacgtgagactgctggtggcctgctgcctggccgacatcttcagaatctacgcccccgaggccccctacaccagccccgacaagctgaaggacatcttcatgttcatcaccagacagctgaagggcctggaggacaccaagagcccccagttcaacagatacttctacctgctggagaacatcgcctgggtgaagagctacaacatctgcttcgagctggaggacagcaacgagatcttcacccagctgtacagaaccctgttcagcgtgatcaacaacggccacaaccagaaggtgcacatgcacatggtggacctgatgagcagcatcatctgcgagggcgacaccgtgagccaggagctgctggacaccgtgctggtgaacctggtgcccgcccacaagaacctgaacaagcaggcctacgacctggccaaggccctgctgaagagaaccgcccaggccatcgagccctacatcaccaacttcttcaaccaggtgctgatgctgggcaagaccagcatcagcgacctgagcgagcacgtgttcgacctgatcctggagctgtacaacatcgacagccacctgctgctgagcgtgctgccccagctggagttcaagctgaagagcaacgacaacgaggagagactgcaggtggtgaagctgctggccaagatgttcggcgccaaggacagcgagctggccagccagaacaagcccctgtggcagtgctacctgggcagattcaacgacatccacgtgcccatcagactggagtgcgtgaagttcgccagccactgcctgatgaaccaccccgacctggccaaggacctgaccgagtacctgaaggtgagaagccacgaccccgaggaggccatcagacacgacgtgatcgtgagcatcgtgaccgccgccaagaaggacatcctgctggtgaacgaccacctgctgaacttcgtgagagagagaaccctggacaagagatggagagtgagaaaggaggccatgatgggcctggcccagatctacaagaagtacgccctgcagagcgccgccggcaaggacgccgccaagcagatcgcctggatcaaggacaagctgctgcacatctactaccagaacagcatcgacgacagactgctggtggagagaatcttcgcccagtacatggtgccccacaacctggagaccaccgagagaatgaagtgcctgtactacctgtacgccaccctggacctgaacgccgtgaaggccctgaacgagatgtggaagtgccagaacctgctgagacaccaggtgaaggacctgctggacctgatcaagcagcccaagaccgacgccagcgtgaaggccatcttcagcaaggtgatggtgatcaccagaaacctgcccgaccccggcaaggcccaggacttcatgaagaagttcacccaggtgctggaggacgacgagaagatcagaaagcagctggaggtgctggtgagccccacctgcagctgcaagcaggccgagggctgcgtgagagagatcaccaagaagctgggcaaccccaagcagcccaccaaccccttcctggagatgatcaagttcctgctggagagaatcgcccccgtgcacatcgacaccgagagcatcagcgccctgatcaagcaggtgaacaagagcatcgacggcaccgccgacgacgaggacgagggcgtgcccaccgaccaggccatcagagccggcctggagctgctgaaggtgctgagcttcacccaccccatcagcttccacagcgccgagaccttcgagagcctgctggcctgcctgaagatggacgacgagaaggtggccgaggccgccctgcagatcttcaagaacaccggcagcaagatcgaggaggacttcccccacatcagaagcgccctgctgcccgtgctgcaccacaagagcaagaagggcccccccagacaggccaagtacgccatccactgcatccacgccatcttcagcagcaaggagacccagttcgcccagatcttcgagcccctgcacaagagcctggaccccagcaacctggagcacctgatcacccccctggtgaccatcggccacatcgccctgctggcccccgaccagttcgccgcccccctgaagagcctggtggccaccttcatcgtgaaggacctgctgatgaacgacagactgcccggcaagaagaccaccaagctgtgggtgcccgacgaggaggtgagccccgagaccatggtgaagatccaggccatcaagatgatggtgagatggctgctgggcatgaagaacaaccacagcaagagcggcaccagcaccctgagactgctgaccaccatcctgcacagcgacggcgacctgaccgagcagggcaagatcagcaagcccgacatgagcagactgagactggccgccggcagcgccatcgtgaagctggcccaggagccctgctaccacgagatcatcaccctggagcagtaccagctgtgcgccctggccatcaacgacgagtgctaccaggtgagacaggtgttcgcccagaagctgcacaagggcctgagcagactgagactgcccctggagtacatggccatctgcgccctgtgcgccaaggaccccgtgaaggagagaagagcccacgccagacagtgcctggtgaagaacatcaacgtgagaagagagtacctgaagcagcacgccgccgtgagcgagaagctgctgagcctgctgcccgagtacgtggtgccctacaccatccacctgctggcccacgaccccgactacgtgaaggtgcaggacatcgagcagctgaaggacgtgaaggagtgcctgtggttcgtgctggagatcctgatggccaagaacgagaacaacagccacgccttcatcagaaagatggtggagaacatcaagcagaccaaggacgcccagggccccgacgacgccaagatgaacgagaagctgtacaccgtgtgcgacgtggccatgaacatcatcatgagcaagagcaccacctacagcctggagagccccaaggaccccgtgctgcccgccagattcttcacccagcccgacaagaacttcagcaacaccaagaactacctgccccccgagatgaagagcttcttcacccccggcaagcccaagaccaccaacgtgctgggcgccgtgaacaagcccctgagcagcgccggcaagcagagccagaccaagagcagcagaatggagaccgtgagcaacgccagcagcagcagcaaccccagcagccccggcagaatcaagggcagactggacagcagcgagatggaccacagcgagaacgaggactacaccatgagcagccccctgcccggcaagaagagcgacaagagagacgacagcgacctggtgagaagcgagctggagaagcccagaggcagaaagaagacccccgtgaccgagcaggaggagaagctgggcatggacgacctgaccaagctggtgcaggagcagaagcccaagggcagccagagaagcagaaagagaggccacaccgccagcgagagcgacgagcagcagtggcccgaggagaagagactgaaggaggacatcctggagaacgaggacgagcagaacagcccccccaagaagggcaagagaggcagaccccccaagcccctgggcggcggcacccccaaggaggagcccaccatgaagaccagcaagaagggcagcaagaagaagagcggcccccccgcccccgaggaggaggaggaggaggagagacagagcggcaacaccgagcagaagagcaagagcaagcagcacagagtgagcagaagagcccagcagagagccgagagccccgagagcagcgccatcgagagcacccagagcaccccccagaagggcagaggcagacccagcaagacccccagccccagccagcccaagaagaacgtgagagtgggcagaagcaagcaggccgccaccaaggagaacgacagcagcgaggaggtggacgtgttccagggcagcagccccgtggacgacatcccccaggaggagaccgaggaggaggaggtgagcaccgtgaacgtgagaagaagaagcgccaagagagagagaagatag

SEQ ID NO: 8975 - DNA, 3909 bp, Artificial Sequence
  Description of Artificial Sequence: Synthetic coding sequence
atggcccacagcaagaccagaaccaacgacggcaagatcacctacccccccggcgtgaaggagatcagcgacaagatcagcaaggaggagatggtgagaagactgaagatggtggtgaagaccttcatggacatggaccaggacagcgaggaggagaaggagctgtacctgaacctggccctgcacctggccagcgacttcttcctgaagcaccccgacaaggacgtgagactgctggtggcctgctgcctggccgacatcttcagaatctacgcccccgaggccccctacaccagccccgacaagctgaaggacatcttcatgttcatcaccagacagctgaagggcctggaggacaccaagagcccccagttcaacagatacttctacctgctggagaacatcgcctgggtgaagagctacaacatctgcttcgagctggaggacagcaacgagatcttcacccagctgtacagaaccctgttcagcgtgatcaacaacggccacaaccagaaggtgcacatgcacatggtggacctgatgagcagcatcatctgcgagggcgacaccgtgagccaggagctgctggacaccgtgctggtgaacctggtgcccgcccacaagaacctgaacaagcaggcctacgacctggccaaggccctgctgaagagaaccgcccaggccatcgagccctacatcaccaacttcttcaaccaggtgctgatgctgggcaagaccagcatcagcgacctgagcgagcacgtgttcgacctgatcctggagctgtacaacatcgacagccacctgctgctgagcgtgctgccccagctggagttcaagctgaagagcaacgacaacgaggagagactgcaggtggtgaagctgctggccaagatgttcggcgccaaggacagcgagctggccagccagaacaagcccctgtggcagtgctacctgggcagattcaacgacatccacgtgcccatcagactggagtgcgtgaagttcgccagccactgcctgatgaaccaccccgacctggccaaggacctgaccgagtacctgaaggtgagaagccacgaccccgaggaggccatcagacacgacgtgatcgtgagcatcgtgaccgccgccaagaaggacatcctgctggtgaacgaccacctgctgaacttcgtgagagagagaaccctggacaagagatggagagtgagaaaggaggccatgatgggcctggcccagatctacaagaagtacgccctgcagagcgccgccggcaaggacgccgccaagcagatcgcctggatcaaggacaagctgctgcacatctactaccagaacagcatcgacgacagactgctggtggagagaatcttcgcccagtacatggtgccccacaacctggagaccaccgagagaatgaagtgcctgtactacctgtacgccaccctggacctgaacgccgtgaaggccctgaacgagatgtggaagtgccagaacctgctgagacaccaggtgaaggacctgctggacctgatcaagcagcccaagaccgacgccagcgtgaaggccatcttcagcaaggtgatggtgatcaccagaaacctgcccgaccccggcaaggcccaggacttcatgaagaagttcacccaggtgctggaggacgacgagaagatcagaaagcagctggaggtgctggtgagccccacctgcagctgcaagcaggccgagggctgcgtgagagagatcaccaagaagctgggcaaccccaagcagcccaccaaccccttcctggagatgatcaagttcctgctggagagaatcgcccccgtgcacatcgacaccgagagcatcagcgccctgatcaagcaggtgaacaagagcatcgacggcaccgccgacgacgaggacgagggcgtgcccaccgaccaggccatcagagccggcctggagctgctgaaggtgctgagcttcacccaccccatcagcttccacagcgccgagaccttcgagagcctgctggcctgcctgaagatggacgacgagaaggtggccgaggccgccctgcagatcttcaagaacaccggcagcaagatcgaggaggacttcccccacatcagaagcgccctgctgcccgtgctgcaccacaagagcaagaagggcccccccagacaggccaagtacgccatccactgcatccacgccatcttcagcagcaaggagacccagttcgcccagatcttcgagcccctgcacaagagcctggaccccagcaacctggagcacctgatcacccccctggtgaccatcggccacatcgccctgctggcccccgaccagttcgccgcccccctgaagagcctggtggccaccttcatcgtgaaggacctgctgatgaacgacagactgcccggcaagaagaccaccaagctgtgggtgcccgacgaggaggtgagccccgagaccatggtgaagatccaggccatcaagatgatggtgagatggctgctgggcatgaagaacaaccacagcaagagcggcaccagcaccctgagactgctgaccaccatcctgcacagcgacggcgacctgaccgagcagggcaagatcagcaagcccgacatgagcagactgagactggccgccggcagcgccatcgtgaagctggcccaggagccctgctaccacgagatcatcaccctggagcagtaccagctgtgcgccctggccatcaacgacgagtgctaccaggtgagacaggtgttcgcccagaagctgcacaagggcctgagcagactgagactgcccctggagtacatggccatctgcgccctgtgcgccaaggaccccgtgaaggagagaagagcccacgccagacagtgcctggtgaagaacatcaacgtgagaagagagtacctgaagcagcacgccgccgtgagcgagaagctgctgagcctgctgcccgagtacgtggtgccctacaccatccacctgctggcccacgaccccgactacgtgaaggtgcaggacatcgagcagctgaaggacgtgaaggagtgcctgtggttcgtgctggagatcctgatggccaagaacgagaacaacagccacgccttcatcagaaagatggtggagaacatcaagcagaccaaggacgcccagggccccgacgacgccaagatgaacgagaagctgtacaccgtgtgcgacgtggccatgaacatcatcatgagcaagagcaccacctacagcctggagagccccaaggaccccgtgctgcccgccagattcttcacccagcccgacaagaacttcagcaacaccaagaactacctgccccccgagatgaagagcttcttcacccccggcaagcccaagaccaccaacgtgctgggcgccgtgaacaagcccctgagcagcgccggcaagcagagccagaccaagagcagcagaatggagaccgtgagcaacgccagcagcagcagcaaccccagcagccccggcagaatcaagggcagactggacagcagcgagatggaccacagcgagaacgaggactacaccatgagcagccccctgcccggcaagaagagcgacaagagagacgacagcgacctggtgagaagcgagctggagaagcccagaggcagaaagaagacccccgtgaccgagcaggaggagaagctgggcatggacgacctgaccaagctggtgcaggagcagaagcccaagggcagccagagaagcagaaagagaggccacaccgccagcgagagcgacgagcagcagtggcccgaggagaagagactgaaggaggacatcctggagaacgaggacgagcagaacagcctgcccctgcaccagaaggacgccagcgacagaagaaccaccatgcagatcgtgaagtag

SEQ ID NO: 8976 - DNA, 2115 bp, Artificial Sequence
  Description of Artificial Sequence: Synthetic coding sequence
atggccaacgagaaccacggcagccccagagaggaggccagcctgctgagccacagccccggcaccagcaaccagagccagccctgcagccccaagcccatcagactggtgcaggacctgcccgaggagctggtgcacgccggctgggagaagtgctggagcagaagagagaacagaccctactacttcaacagattcaccaaccagagcctgtgggagatgcccgtgctgggccagcacgacgtgatcagcgaccccctgggcctgaacgccacccccctgccccaggacagcagcctggtggagaccccccccgccgagaacaagcccagaaagagacagctgagcgaggagcagcccagcggcaacggcgtgaagaagcccaagatcgagatccccgtgacccccaccggccagagcgtgcccagcagccccagcatccccggcacccccaccctgaagatgtggggcaccagccccgaggacaagcagcaggccgccctgctgagacccaccgaggtgtactgggacctggacatccagaccaacgccgtgatcaagcacagaggccccagcgaggtgctgcccccccaccccgaggtggagctgctgagaagccagctgatcctgaagctgagacagcactacagagagctgtgccagcagagagagggcatcgagccccccagagagagcttcaacagatggatgctggagagaaaggtggtggacaagggcagcgaccccctgctgcccagcaactgcgagcccgtggtgagccccagcatgttcagagagatcatgaacgacatccccatcagactgagcagaatcaagttcagagaggaggccaagagactgctgttcaagtacgccgaggccgccagaagactgatcgagagcagaagcgccagccccgacagcagaaaggtggtgaagtggaacgtggaggacaccttcagctggctgagaaaggaccacagcgccagcaaggaggactacatggacagactggagcacctgagaagacagtgcggcccccacgtgagcgccgccgccaaggacagcgtggagggcatctgcagcaagatctaccacatcagcctggagtacgtgaagagaatcagagagaagcacctggccatcctgaaggagaacaacatcagcgaggaggtggaggcccccgaggtggagcccagactggtgtactgctaccccgtgagactggccgtgagcgccccccccatgcccagcgtggagatgcacatggagaacaacgtggtgtgcatcagatacaagggcgagatggtgaaggtgagcagaaactacttcagcaagctgtggctgctgtacagatacagctgcatcgacgacagcgccttcgagagattcctgcccagagtgtggtgcctgctgagaagataccagatgatgttcggcgtgggcctgtacgagggcaccggcctgcagggcagcctgcccgtgcacgtgttcgaggccctgcacagactgttcggcgtgagcttcgagtgcttcgccagccccctgaactgctacttcagacagtactgcagcgccttccccgacaccgacggctacttcggcagcagaggcccctgcctggacttcgcccccctgagcggcagcttcgaggccaacccccccttctgcgaggagctgatggacgccatggtgagccacttcgagagactgctggagagcagccccgagcccctgagcttcatcgtgttcatccccgagtggagagagccccccacccccgccctgaccagaatggagcagagcagattcaagagacaccagctgatcctgcccgccttcgagcacgagtacagaagcggcagccagcacatctgcaagaaggaggagatgcactacaaggccgtgcacaacaccgccgtgctgttcctgcagaacgaccccggcttcgccaagtgggcccccacccccgagagactgcaggagctgagcgccgcctacagacagagcggcagaagccacagcagcggcagcagcagcagcagcagcagcgaggccaaggacagagacagcggcagagagcagggccccagcagagagccccaccccacctag

SEQ ID NO: 8977 - DNA, 2133 bp, Artificial Sequence
  Description of Artificial Sequence: Synthetic coding sequence
atggccaacgagaaccacggcagccccagagaggaggccagcctgctgagccacagccccggcaccagcaaccagagccagccctgcagccccaagcccatcagactggtgcaggacctgcccgaggagctggtgcacgccggctgggagaagtgctggagcagaagagagaacagaccctactacttcaacagattcaccaaccagagcctgtgggagatgcccgtgctgggccagcacgacgtgatcagcgaccccctgggcctgaacgccacccccctgccccaggacagcagcctggtggagaccccccccgccgagaacaagcccagaaagagacagctgagcgaggagcagcccagcggcaacggcgtgaagaagcccaagatcgagatccccgtgacccccaccggccagagcgtgcccagcagccccagcatccccggcacccccaccctgaagatgtggggcaccagccccgaggacaagcagcaggccgccctgctgagacccaccgaggtgtactgggacctggacatccagaccaacgccgtgatcaagcacagaggccccagcgaggtgctgcccccccaccccgaggtggagctgctgagaagccagctgatcctgaagctgagacagcactacagagagctgtgccagcagagagagggcatcgagccccccagagagagcttcaacagatggatgctggagagaaaggtggtggacaagggcagcgaccccctgctgcccagcaactgcgagcccgtggtgagccccagcatgttcagagagatcatgaacgacatccccatcagactgagcagaatcaagttcagagaggaggccaagagactgctgttcaagtacgccgaggccgccagaagactgatcgagagcagaagcgccagccccgacagcagaaaggtggtgaagtggaacgtggaggacaccttcagctggctgagaaaggaccacagcgccagcaaggaggactacatggacagactggagcacctgagaagacagtgcggcccccacgtgagcgccgccgccaaggacagcgtggagggcatctgcagcaagatctaccacatcagcctggagtacgtgaagagaatcagagagaagcacctggccatcctgaaggagaacaacatcagcgaggaggtggaggcccccgaggtggagcccagactggtgtactgctaccccgtgagactggccgtgagcgccccccccatgcccagcgtggagatgcacatggagaacaacgtggtgtgcatcagatacaagggcgagatggtgaaggtgagcagaaactacttcagcaagctgtggctgctgtacagatacagctgcatcgacgacagcgccttcgagagattcctgcccagagtgtggtgcctgctgagaagataccagatgatgttcggcgtgggcctgtacgagggcaccggcctgcagggcagcctgcccgtgcacgtgttcgaggccctgcacagactgttcggcgtgagcttcgagtgcttcgccagccccctgaactgctacttcagacagtactgcagcgccttccccgacaccgacggctacttcggcagcagaggcccctgcctggacttcgcccccctgagcggcagcttcgaggccaacccccccttctgcgaggagctgatggacgccatggtgagccacttcgagagactgctggagagcagccccgagcccctgagcttcatcgtgttcatccccgagtggagagagccccccacccccgccctgaccagaatggagcagagcagattcaagagacaccagctgatcctgcccgccttcgagcacgagtacagaagcggcagccagcacatctgcaagaaggaggagatgcactacaaggccgtgcacaacaccgccgtgctgttcctgcagaacgaccccggcttcgccaagtgggcccccacccccgagagactgcaggagctgagcgccgcctacagacagagcggcagaagccacagcagcggcagcagcagcagcagcagcagcgaggccaaggacagagacagcggcagagagcagggccccagcagagagccccaccccgtggccaccctgttccacctgtag

SEQ ID NO: 8978 - DNA, 498 bp, Artificial Sequence
  Description of Artificial Sequence: Synthetic coding sequence
atgagcgtgaccctgcacaccgacgtgggcgacatcaagatcgaggtgttctgcgagagaacccccaagacctgcgagatggagagcagatgcgtgccccaggccggcgtgcagtggagagacctgggcagcctgcagccccccccccccggcttcaagcaggtgttctgcctgagcctgcccagaaccggcagaggcggcaacagcatctggggcaagaagttcgaggacgagtacagcgagtacctgaagcacaacgtgagaggcgtggtgagcatggccaacaacggccccaacaccaacggcagccagttcttcatcacctacggcaagcagccccacctggacatgaagtacaccgtgttcggcaaggtgatcgacggcctggagaccctggacgagctggagaagctgcccgtgaacgagaagacctacagacccctgaacgacgtgcacatcaaggacatcaccatccacgccaaccccttcgcccagtag

SEQ ID NO: 8979 - DNA, 486 bp, Artificial Sequence
  Description of Artificial Sequence: Synthetic coding sequence
atgagcgtgaccctgcacaccgacgtgggcgacatcaagatcgaggtgttctgcgagagaacccccaagacctgcgagaacttcctggccctgtgcgccagcaactactacaacggctgcatcttccacagaaacatcaagggcttcatggtgcagaccggcgaccccaccggcaccggcagaggcggcaacagcatctggggcaagaagttcgaggacgagtacagcgagtacctgaagcacaacgtgagaggcgtggtgagcatggccaacaacggccccaacaccaacggcagccagttcttcatcacctacggcaagcagccccacctggacatgaagtacaccgtgttcggcaaggtgatcgacggcctggagaccctggacgagctggagaagctgcccgtgaacgagaagacctacagacccctgaacgacgtgcacatcaaggacatcaccatccacgccaaccccttcgcccagtag

SEQ ID NO: 8980 - DNA, 498 bp, Artificial Sequence; identical to SEQ ID NO: 8978
  Description of Artificial Sequence: Synthetic coding sequence

SEQ ID NO: 8981 - DNA, 243 bp, Artificial Sequence
  Description of Artificial Sequence: Synthetic coding sequence
atgagcgtgaccctgcacaccgacgtgggcgacatcaagatcgaggtgttctgcgagagaacccccaagacctgcgagaacttcctggccctgtgcgccagcaactactacaacggctgcatcttccacagaaacatcaagggcttcatggtgcagaccggcgaccccaccggcaccggcagaggcggcaacagcatctggggcaagaagttcgaggacgagtacagcgagtacctgaagtag

SEQ ID NO: 8982 - DNA, 1941 bp, Artificial Sequence
  Description of Artificial Sequence: Synthetic coding sequence
atggccgccgagagcggcagcgacttccagcagagaagaagaagaagaagagaccccgaggagcccgagaagaccgagctgagcgagagagagctggccgtggccgtggccgtgagccaggagaacgacgaggagaacgaggagagatgggtgggccccctgcccgtggaggccaccctggccaagaagagaaaggtgctggagttcgagagagtgtacctggacaacctgcccagcgccagcatgtacgagagaagctacatgcacagagacgtgatcacccacgtggtgtgcaccaagaccgacttcatcatcaccgccagccacgacggccacgtgaagttctggaagaagatcgaggagggcatcgagttcgtgaagcacttcagaagccacctgggcgtgatcgagagcatcgccgtgagcagcgagggcgccctgttctgcagcgtgggcgacgacaaggccatgaaggtgttcgacgtggtgaacttcgacatgatcaacatgctgaagctgggctacttccccggccagtgcgagtggatctactgccccggcgacgccatcagcagcgtggccgccagcgagaagagcaccggcaagatcttcatctacgacggcagaggcgacaaccagcccctgcacatcttcgacaagctgcacaccagccccctgacccagatcagactgaaccccgtgtacaaggccgtggtgagcagcgacaagagcggcatgatcgagtactggaccggccccccccacgagtacaagttccccaagaacgtgaactgggagtacaagaccgacaccgacctgtacgagttcgccaagtgcaaggcctaccccaccagcgtgtgcttcagccccgacggcaagaagatcgccaccatcggcagcgacagaaaggtgagaatcttcagattcgtgaccggcaagctgatgagagtgttcgacgagagcctgagcatgttcaccgagctgcagcagatgagacagcagctgcccgacatggagttcggcagaagaatggccgtggagagagagctggagaaggtggacgccgtgagactgatcaacatcgtgttcgacgagaccggccacttcgtgctgtacggcaccatgctgggcatcaaggtgatcaacgtggagaccaacagatgcgtgagaatcctgggcaagcaggagaacatcagagtgatgcagctggccctgttccagggcatcgccaagaagcacagagccgccaccaccatcgagatgaaggccagcgagaaccccgtgctgcagaacatccaggccgaccccaccatcgtgtgcaccagcttcaagaagaacagattctacatgttcaccaagagagagcccgaggacaccaagagcgccgacagcgacagagacgtgttcaacgagaagcccagcaaggaggaggtgatggccgccacccaggccgagggccccaagagagtgagcgacagcgccatcatccacaccagcatgggcgacatccacaccaagctgttccccgtggagtgccccaagaccgtggagaacttctgcgtgcacagcagaaacggctactacaacggccacaccttccacagaatcatcaagggcttcatgatccagaccggcgaccccaccggcaccggcatgggcggcgagagcatctggggcggcgagttcgaggacgagttccacagcaccctgagacacgacagaccctacaccctgagcatggccaacgccggcagcaacaccaacggcagccagttcttcatcaccgtggtgcccaccccctggctggacaacaagcacaccgtgttcggcagagtgaccaagggcatggaggtggtgcagagaatcagcaacgtgaaggtgaaccccaagaccgacaagccctacgaggacgtgagcatcatcaacatcaccgtgaagtag

SEQ ID NO: 8983 - DNA, 1851 bp, Artificial Sequence
  Description of Artificial Sequence: Synthetic coding sequence
atgagaagaaccaagagcgccggcctggacctgtacctgtggagacagcactggcccagaagaggcaagcagccccacgaggtgggcatcagcaacagctacctggtgctggagttcgagagagtgtacctggacaacctgcccagcgccagcatgtacgagagaagctacatgcacagagacgtgatcacccacgtggtgtgcaccaagaccgacttcatcatcaccgccagccacgacggccacgtgaagttctggaagaagatcgaggagggcatcgagttcgtgaagcacttcagaagccacctgggcgtgatcgagagcatcgccgtgagcagcgagggcgccctgttctgcagcgtgggcgacgacaaggccatgaaggtgttcgacgtggtgaacttcgacatgatcaacatgctgaagctgggctacttccccggccagtgcgagtggatctactgccccggcgacgccatcagcagcgtggccgccagcgagaagagcaccggcaagatcttcatctacgacggcagaggcgacaaccagcccctgcacatcttcgacaagctgcacaccagccccctgacccagatcagactgaaccccgtgtacaaggccgtggtgagcagcgacaagagcggcatgatcgagtactggaccggccccccccacgagtacaagttccccaagaacgtgaactgggagtacaagaccgacaccgacctgtacgagttcgccaagtgcaaggcctaccccaccagcgtgtgcttcagccccgacggcaagaagatcgccaccatcggcagcgacagaaaggtgagaatcttcagattcgtgaccggcaagctgatgagagtgttcgacgagagcctgagcatgttcaccgagctgcagcagatgagacagcagctgcccgacatggagttcggcagaagaatggccgtggagagagagctggagaaggtggacgccgtgagactgatcaacatcgtgttcgacgagaccggccacttcgtgctgtacggcaccatgctgggcatcaaggtgatcaacgtggagaccaacagatgcgtgagaatcctgggcaagcaggagaacatcagagtgatgcagctggccctgttccagggcatcgccaagaagcacagagccgccaccaccatcgagatgaaggccagcgagaaccccgtgctgcagaacatccaggccgaccccaccatcgtgtgcaccagcttcaagaagaacagattctacatgttcaccaagagagagcccgaggacaccaagagcgccgacagcgacagagacgtgttcaacgagaagcccagcaaggaggaggtgatggccgccacccaggccgagggccccaagagagtgagcgacagcgccatcatccacaccagcatgggcgacatccacaccaagctgttccccgtggagtgccccaagaccgtggagaacttctgcgtgcacagcagaaacggctactacaacggccacaccttccacagaatcatcaagggcttcatgatccagaccggcgaccccaccggcaccggcatgggcggcgagagcatctggggcggcgagttcgaggacgagttccacagcaccctgagacacgacagaccctacaccctgagcatggccaacgccggcagcaacaccaacggcagccagttcttcatcaccgtggtgcccaccccctggctggacaacaagcacaccgtgttcggcagagtgaccaagggcatggaggtggtgcagagaatcagcaacgtgaaggtgaaccccaagaccgacaagccctacgaggacgtgagcatcatcaacatcaccgtgaagtag

SEQ ID NO: 8984 - DNA, 1473 bp, Artificial Sequence
  Description of Artificial Sequence: Synthetic coding sequence
atgaaggtgttcgacgtggtgaacttcgacatgatcaacatgctgaagctgggctacttccccggccagtgcgagtggatctactgccccggcgacgccatcagcagcgtggccgccagcgagaagagcaccggcaagatcttcatctacgacggcagaggcgacaaccagcccctgcacatcttcgacaagctgcacaccagccccctgacccagatcagactgaaccccgtgtacaaggccgtggtgagcagcgacaagagcggcatgatcgagtactggaccggccccccccacgagtacaagttccccaagaacgtgaactgggagtacaagaccgacaccgacctgtacgagttcgccaagtgcaaggcctaccccaccagcgtgtgcttcagccccgacggcaagaagatcgccaccatcggcagcgacagaaaggtgagaatcttcagattcgtgaccggcaagctgatgagagtgttcgacgagagcctgagcatgttcaccgagctgcagcagatgagacagcagctgcccgacatggagttcggcagaagaatggccgtggagagagagctggagaaggtggacgccgtgagactgatcaacatcgtgttcgacgagaccggccacttcgtgctgtacggcaccatgctgggcatcaaggtgatcaacgtggagaccaacagatgcgtgagaatcctgggcaagcaggagaacatcagagtgatgcagctggccctgttccagggcatcgccaagaagcacagagccgccaccaccatcgagatgaaggccagcgagaaccccgtgctgcagaacatccaggccgaccccaccatcgtgtgcaccagcttcaagaagaacagattctacatgttcaccaagagagagcccgaggacaccaagagcgccgacagcgacagagacgtgttcaacgagaagcccagcaaggaggaggtgatggccgccacccaggccgagggccccaagagagtgagcgacagcgccatcatccacaccagcatgggcgacatccacaccaagctgttccccgtggagtgccccaagaccgtggagaacttctgcgtgcacagcagaaacggctactacaacggccacaccttccacagaatcatcaagggcttcatgatccagaccggcgaccccaccggcaccggcatgggcggcgagagcatctggggcggcgagttcgaggacgagttccacagcaccctgagacacgacagaccctacaccctgagcatggccaacgccggcagcaacaccaacggcagccagttcttcatcaccgtggtgcccaccccctggctggacaacaagcacaccgtgttcggcagagtgaccaagggcatggaggtggtgcagagaatcagcaacgtgaaggtgaaccccaagaccgacaagccctacgaggacgtgagcatcatcaacatcaccgtgaagtag

SEQ ID NO: 8985 - DNA, 906 bp, Artificial Sequence
  Description of Artificial Sequence: Synthetic coding sequence
atggccaccaccaagagagtgctgtacgtgggcggcctggccgaggaggtggacgacaaggtgctgcacgccgccttcatccccttcggcgacatcaccgacatccagatccccctggactacgagaccgagaagcacagaggcttcgccttcgtggagttcgagctggccgaggacgccgccgccgccatcgacaacatgaacgagagcgagctgttcggcagaaccatcagagtgaacctggccaagcccatgagaatcaaggagggcagcagcagacccgtgtggagcgacgacgactggctgaagaagttcagcggcaagaccctggaggagaacaaggaggaggagggcagcgagccccccaaggccgagacccaggagggcgagcccatcgccaagaaggccagaagcaacccccaggtgtacatggacatcaagatcggcaacaagcccgccggcagaatccagatgctgctgagaagcgacgtggtgcccatgaccgccgagaacttcagatgcctgtgcacccacgagaagggcttcggcttcaagggcagcagcttccacagaatcatcccccagttcatgtgccagggcggcgacttcaccaaccacaacggcaccggcggcaagagcatctacggcaagaagttcgacgacgagaacttcatcctgaagcacaccggccccggcctgctgagcatggccaacagcggccccaacaccaacggcagccagttcttcctgacctgcgacaagaccgactggctggacggcaagcacgtggtgttcggcgaggtgaccgagggcctggacgtgctgagacagatcgaggcccagggcagcaaggacggcaagcccaagcagaaggtgatcatcgccgactgcggcgagtacgtgtag

SEQ ID NO: 8986 - DNA, 891 bp, Artificial Sequence
  Description of Artificial Sequence: Synthetic coding sequence
atggccaccaccaagagagtgctgtacgtgggcggcctggccgaggaggtggacgacaaggtgctgcacgccgccttcatccccttcggcgacatcaccgacatccagatccccctggactacgagaccgagaagcacagaggcttcgccttcgtggagttcgagctggccgaggacgccgccgccgccatcgacaacatgaacgagagcgagctgttcggcagaaccatcagagtgaacctggccaagcccatgagaatcaaggagggcagcagcagacccgtgtggagcgacgacgactggctgaagaagttcagcggcaagaccctggaggagaacaaggaggaggagggcagcgagccccccaaggccgagacccaggagggcgagcccatcgccaagaaggccagaagcaacccccaggtgtacatggacatcaagatcggcaacaagcccgccggcagaatccagatgctgctgagaagcgacgtggtgcccatgaccgccgagaacttcagatgcctgtgcacccacgagaagggcttcggcttcaagggcagcagcttccacagaatcatcccccagttcatgtgccagggcggcgacttcaccaaccacaacggcaccggcggcaagagcatctacggcaagaagttcgacgacgagaacttcatcctgaagcacaccggccccggcctgctgagcatggccaacagcggccccaacaccaacggcagccagttcttcctgacctgcgacaagaccgactggctggacggcaagcacgtggtgttcggcgaggtgaccgagggcctggacgtgctgagacagatcgagaagcaggaggagagcgccatcaccagccagcccagaagctggaagctgacctag

SEQ ID NO: 8987 - DNA, 945 bp, Artificial Sequence
  Description of Artificial Sequence: Synthetic coding sequence
atggccaccaccaagagagtgctgtacgtgggcggcctggccgaggaggtggacgacaaggtgctgcacgccgccttcatccccttcggcgacatcaccgacatccagatccccctggactacgagaccgagaagcacagaggcttcgccttcgtggagttcgagctggccgaggacgccgccgccgccatcgacaacatgaacgagagcgagctgttcggcagaaccatcagagtgaacctggccaagcccatgagaatcaaggagggcagcagcagacccgtgtggagcgacgacgactggctgaagaagttcagcggcaagaccctggaggagaacaaggaggaggagggcagcgagccccccaaggccgagacccaggagggcgagcccatcgccaagaaggccagaagcaacccccaggtgtacatggacatcaagatcggcaacaagcccgccggcagaatccagatgctgctgagaagcgacgtggtgcccatgaccgccgagaacttcagatgcctgtgcacccacgagaagggcttcggcttcaagggcagcagcttccacagaatcatcccccagttcatgtgccagggcggcgacttcaccaaccacaacggcaccggcggcaagagcatctacggcaagaagttcgacgacgagaacttcatcctgaagcacaccggccccggcctgctgagcatggccaacagcggccccaacaccaacggcagccagttcttcctgacctgcgacaagaccgactggctggacggcaagcacgtggtgttcggcgaggtgaccgagggcctggacgtgctgagacagatcgaggtggcccccgacaccaaggccagcaaggccagaggcagcagaaagaacaaggacggccaggagagaaactggggcaagagccagaaggtggagagccacaccatctag

SEQ ID NO: 8988 - DNA, 6243 bp, Artificial Sequence
  Description of Artificial Sequence: Synthetic coding sequence
atgagcagcagccccagcagaagcgccgccgacatctacatcagagagtacttccacagccacgtgagcggcggccaccccgaggccacccccctgagagtgatgtacaccgacagacccctgagccagaccgaccccgtgaccctgcagtactgctgcctgaccgacgacagacaggccttcagaccccccaccagagccgagctggccagacacagagtggtggtgaccaccaccagccaggccagagagctgagagtgcccgtgggcttcttcagccacatcctgatcgacgaggccgcccagatgctggagtgcgaggccctgacccccctggcctacgccagccacggcaccagactggtgctggccggcgaccacatgcaggtgacccccagactgttcagcgtggccagagccagagccgccgagcacaccctgctgcacagactgttcctgtgctaccagcaggagacccacgaggtggccagacagagcagactggtgttccacgagaactacagatgcaccgacgccatcgtgagcttcatcagcagacacttctacgtggccaagggcaaccccatccacgccagaggcaaggtgcccccccaccccagacactaccccctgatgttctgccacgtggccggcagccccgacagagacatgagcatggccagctggctgaacctggccgagatcgcccaggtggtggagaaggtgcaggaggcctacaacacctggcccagctgctggggcggcagagagcagagatgcatctgcgtggtgagccacggcgcccaggtgagcgccctgagacaggagctgagaagaagagacctgggccaggtgagcgtgggcagcttcgagatcctgcccggcagacagttcagagtggtggtgctgagcaccgtgcacacctgccagagcctgctgagccccggcgccctggcccccgagttcttcaccgacgccagagtgctgaacaccgtgctgaccagagcccagagccagctggtggtggtgggcgacgccgtggccctgtgcagcttcggcgcctgcggcaagctgtgggagagcttcatcagagagtgcgtggagagacacagcgtgtgccccgagggcctgagcatggagcaggtggagcagggcgtggcccagagaagaagatggccccccagaggcacccaggccggcgccgccggcaactgggaggccgcccccgagcccgtgggcgacctggccgaggagcaggccgccgtggtgaccgccatggtgaaggccgagcccggcgacgaggccctgagccccgccagcagagacatcaccgccaccaccgcccagaccgaggccgccgccgcccccgccggcgacgccgtgaaggaggacgtggtgcccggcgcctgcgccgccggcgccgccgccgccgccggcgtggagagcaccgaggccgaggacgccgaggccgacttctggccctgggacggcgagctgaacgccgacgacgccatcctgagagagctgctggacgagagccagaaggtgatggtgaccgtgggcgaggacggcctgctggacaccgtggccagacccgagagcctgcagcaggccagactgtacgagaacctgccccccgccgccctgagaaagctgctgcacgccgagcccgagagatacagacactgcagcttcgtgcccgagaccttcgagagagccagcgccatccccctggacgacgccagcagcggccccatccaggtgagaggcagactggactgcggcatggccttcgccggcgacgaggtgctggtgcagctgctgagcggcgacaaggcccccgagggcagactgagaggcagagtgctgggcgtgctgaagagaaagagacacgagctggccttcgtgtgcagaatggacacctgggaccccagaatcatggtgcccatcaacggcagcgtgaccaagatcttcgtggccgagctgaaggaccccagccaggtgcccatctacagcctgagaaagggcagactgcagagagtgggcctggagagactgaccgccgaggccagacacagcagactgttctgggtgcagatcgtgctgtggagacagggcttctactaccccctgggcatcgtgagagaggtgctgcccgaggccagcacctgggagcagggcctgagaatcctgggcctggagtacagcctgagagtgccccccagcgaccaggccaccatcaccaaggtgctgcagaagtaccacaccgagctgggcagagtggccggcagaagagaggactgcagagccttcctgaccttcaccgtggacccccagggcgcctgcaacctggacgacgccctgagcgtgagagacctgggccccagatgcgaggtggccgtgcacatcaccgacgtggccagcttcgtgcccagagacggcgtgctggacgtggaggccagaagacagggcgccgccttctacgcccccggcagagagcccgtgcccatgctgcccgccagcctgtgccaggacgtgctgagcctgctgcccggcagagacagactggccatcagcctgttcctgaccatggagaaggccagcggccagctgaagagcctgagattcgcccccagcgtggtgcagagcgacagacagctgagctacgaggaggccgaggaggtgatcagacagcaccccggcgccggcagagagctgcccgccagactggacagcgtggacgcctgcgtggtggccgcctgctacttcagcagactgctgagaagacacagactgagaagcgactgcttctacgagcagcccgacgaggacggcaccctgggcttcagagccgcccacatcatggtgaaggagtacatgatccagttcaacagactggtggccgagttcctggtgggcagcgagtgcaccagaaccgtgacccccctgagatggcagcccgcccccagaagccagcagctgaaggccctgtgcgagaagcacggcgacagagtgcccctgagcctgcacctgggccaccacctgcacggcggcggcggcagcccccccgacaccagactgcacctgctggccagcctgtggaagcaggtgcagttcgccgccagaacccaggactacgagcagatggtggacctggtgaccaccgacgacatgcaccccttcctggcccccgccggcagagacctgagaaaggccctggagagaagcgccttcggcagatgcgccagaggccaccagcagcagggcggccactacagcctgcaggtggactggtacacctgggccaccagccccatcagaagatacctggacgtggtgctgcagagacagatcctgctggccctgggccacggcggcagcgcctacagcgccagagacatcgacggcctgtgccaggccttcagcctgcagcacgccctggcccagagctaccagagaagagccagaagcctgcacctggccgtgcagctgaaggcccagcccctggacaagctgggcttcgtggtggacgtggaggccggcagcagatgcttcagactgctgttccccagcaacagagagaccctgcccgacccctgccccgtgccctacggcagcctgcagctggccgagcacccccacgccctggccggcagacccggcctgagactgctgtggagaagaagagtgtacagcgcccagggcagcagcccccccctgcccctgcccggcaccgtgcccgacccccacaccctggccgtggagaccgccctgtggaagcagctgctggagctggtggagctgcagagatggcccgaggccgccgccctgatccaggagaagggcgaggccagccagagaagagagctggtgcaggtgcagagaagccactgcggccacttcctggaggtggccagagagctgggcagcggcgacaccctgcaggtgcagctgggcaccagcctgcagcacggcttcctggtgcccagcccccagctgtggaccgtggcccccggcttcagcctgtgcctggagcacgtggagagacccggcgactgcttcagcggcagagtgtacagagcccccagagacagatacagagacgtggacgagtacgcctgcgtgtgggagcccttctgcgccctggagagcgccaccggcgccgtggccgagaacgacagcgtgaccctgcagcacctgagcgtgagctgggaggccagcagaaccccccagggccagctgcagggcgccttcagactggaggccgccttcctggaggagaactgcgccgacatcaacttcagctgctgctacctgtgcatcagactggagggcctgcccgcccccaccgccagccccagacccggccccagcagcctgggccccggcctgaacgtggaccccggcacctacacctgggtggcccacggccagacccaggactgggaccaggagagaagagccgacagacaggaggcccccagaagagtgcacctgttcgtgcaccacatgggcatggagaaggtgcccgaggaggtgctgagacccggcaccctgttcaccgtggagctgctgcccaagcagctgcccgacctgagaaaggaggaggccgtgagaggcctggaggaggccagccccctggtgaccagcatcgccctgggcagacccgtgccccagcccctgtgcagagtgatccccagcagattcctggagagacagacctacaacatccccggcggcagacacaagctgaaccccagccagaacgtggccgtgagagaggccctggagaagcccttcaccgtgatccagggcccccccggcaccggcaagaccatcgtgggcctgcacatcgtgttctggttccacaagagcaaccaggagcaggtgcagcccggcggcccccccagaggcgagaagagactgggcggcccctgcatcctgtactgcggccccagcaacaagagcgtggacgtgctggccggcctgctgctgagaagaatggagctgaagcccctgagagtgtacagcgagcaggccgaggccagcgagttccccgtgcccagagtgggcagcagaaagctgctgagaaagagccccagagagggcagacccaaccagagcctgagaagcatcaccctgcaccacagaatcagacaggcccccaacccctacagcagcgagatcaaggccttcgacaccagactgcagagaggcgagctgttcagcagagaggacctggtgtggtacaagaaggtgctgtgggaggccagaaagttcgagctggacagacacgaggtgatcctgtgcacctgcagctgcgccgccagcgccagcctgaagatcctggacgtgagacagatcctggtggacgaggccggcatggccaccgagcccgagaccctgatccccctggtgcagttcccccaggccgagaaggtggtgctgctgggcgaccacaagcagctgagacccgtggtgaagaacgagagactgcagaacctgggcctggacagaagcctgttcgagagataccacgaggacgcccacatgctggacacccagtacagaatgcacgagggcatctgcgccttccccagcgtggccttctacaagagcaagctgaagacctggcagggcctgagaagaccccccagcgtgctgggccacgccggcaaggagagctgccccgtgatcttcggccacgtgcagggccacgagagaagcctgctggtgagcaccgacgagggcaacgagaacagcaaggccaacctggaggaggtggccgaggtggtgagaatcaccaagcagctgaccctgggcagaaccgtggagccccaggacatcgccgtgctgaccccctacaacgcccaggccagcgagatcagcaaggccctgagaagagagggcatcgccggcgtggccgtgagcagcatcaccaagagccagggcagcgagtggagatacgtgctggtgagcaccgtgagaacctgcgccaagagcgacctggaccagagacccaccaagagctggctgaagaagttcctgggcttcgtggtggaccccaaccaggtgaacgtggccgtgaccagagcccaggagggcctgtgcctgatcggcgaccacctgctgctgagatgctgccccctgtggagaagcctgctggacttctgcgaggcccagcagaccctggtgcccgccggccaggtgagagtgtgcagaagacccaccatgcccagctag

SEQ ID NO: 8989 - DNA, 7950 bp, Artificial Sequence
  Description of Artificial Sequence: Synthetic coding sequence
atggccgtgtgggaggccgagcagctgggcggcctgcagagaggcgacctgctgaccccccccgcccccgacggcgacggcagaaccgcccccctgggccagccccccggcgcccagctgtactgccccgcctgcctggtgacctgccacagccaggaggccttcgagaaccactgcgccagcagcgagcacgcccagatggtggccttcgaccaggccctgccctgggagcacagaagccccccccccggcctgagcaagttcgagctgtgccccaagcccgacctgtgcgagtacggcgacgcctgcaccaaggcccacagcgcccaggagctgcaggagtgggtgagaagaacccaggccgtggagctgagaggccaggccgcctggcaggacggcctggtgccctaccaggagagactgctggccgagtaccagagaagcagcagcgaggtgctggtgctggccgagaccctggacggcgtgagagtgacctgcaaccagcccctgatgtaccaggcccaggagagaaagacccagtacagctggaccttcgccgtgcacagcgaggagcccctgctgcacgtggccctgctgaagcaggagcccggcgccgacttcagcctggtggcccccggcctgccccccggcagactgtacgccagaggcgagagattcagagtgcccagcagcaccgccgacttccaggtgggcgtgagagtgcaggccgccagcttcggcaccttcgagcagtgggtggtgttcgacttcggcagaagacccgtgctgctgcagaagctgggcctgcagctgggccagggcagaagacccggcccctgcagaaacctggccctgggccaccccgaggagatggagagatggcacaccggcaacagacacgtggtgcccggcgtggagagaaccgccgagcagaccgccctgatggccaagtacaagggccccgccctggccctggagttcaacagaagcagcgtggccagcggccccatcagccccaccaactacagacagagaatgcaccagttcctgtacgaggaggaggccgcccagcagcagctggtggccaagctgaccctgagaggccaggtgttcctgaagaccgccctgcagacccccgccctgaacatgctgttcgccccccccggcgccctgtacgccgaggtgcccgtgcccagcagcctgatgcccgacaccgaccagggcttcctgctgggcagagccgtgagcaccgccctggtggcccccgtgcccgcccccgacaacaccgtgttcgaggtgagactggagagaagagccagcagcgagcaggccctgtggctgctgctgcccgccagatgctgcctggccctgggcctgcagcccgaggccagactggtgctggaggtgcagttccagatcgaccccatgaccttcagactgtggcaccaggccgtggacaccctgcccgaggagcagctggtggtgcccgacctgcccacctgcgccctgcccagaccctggagcgtgccccccctgagaagaggcaacagaaagcaggagctggccgtggccctgatcgccggctggggccccggcgacggcagaagagtgccccccctgctgatctacggccccttcggcaccggcaagacctacaccctggccatggccagcctggaggtgatcagaagacccgagaccaaggtgctgatctgcacccacaccaacagcgccgccgacatctacatcagagagtacttccacagccacgtgagcggcggccaccccgaggccacccccctgagagtgatgtacaccgacagacccctgagccagaccgaccccgtgaccctgcagtactgctgcctgaccgacgacagacaggccttcagaccccccaccagagccgagctggccagacacagagtggtggtgaccaccaccagccaggccagagagctgagagtgcccgtgggcttcttcagccacatcctgatcgacgaggccgcccagatgctggagtgcgaggccctgacccccctggcctacgccagccacggcaccagactggtgctggccggcgaccacatgcaggtgacccccagactgttcagcgtggccagagccagagccgccgagcacaccctgctgcacagactgttcctgtgctaccagcaggagacccacgaggtggccagacagagcagactggtgttccacgagaactacagatgcaccgacgccatcgtgagcttcatcagcagacacttctacgtggccaagggcaaccccatccacgccagaggcaaggtgcccccccaccccagacactaccccctgatgttctgccacgtggccggcagccccgacagagacatgagcatggccagctggctgaacctggccgagatcgcccaggtggtggagaaggtgcaggaggcctacaacacctggcccagctgctggggcggcagagagcagagatgcatctgcgtggtgagccacggcgcccaggtgagcgccctgagacaggagctgagaagaagagacctgggccaggtgagcgtgggcagcttcgagatcctgcccggcagacagttcagagtggtggtgctgagcaccgtgcacacctgccagagcctgctgagccccggcgccctggcccccgagttcttcaccgacgccagagtgctgaacaccgtgctgaccagagcccagagccagctggtggtggtgggcgacgccgtggccctgtgcagcttcggcgcctgcggcaagctgtgggagagcttcatcagagagtgcgtggagagacacagcgtgtgccccgagggcctgagcatggagcaggtggagcagggcgtggcccagagaagaagatggccccccagaggcacccaggccggcgccgccggcaactgggaggccgcccccgagcccgtgggcgacctggccgaggagcaggccgccgtggtgaccgccatggtgaaggccgagcccggcgacgaggccctgagccccgccagcagagacatcaccgccaccaccgcccagaccgaggccgccgccgcccccgccggcgacgccgtgaaggaggacgtggtgcccggcgcctgcgccgccggcgccgccgccgccgccggcgtggagagcaccgaggccgaggacgccgaggccgacttctggccctgggacggcgagctgaacgccgacgacgccatcctgagagagctgctggacgagagccagaaggtgatggtgaccgtgggcgaggacggcctgctggacaccgtggccagacccgagagcctgcagcaggccagactgtacgagaacctgccccccgccgccctgagaaagctgctgcacgccgagcccgagagatacagacactgcagcttcgtgcccgagaccttcgagagagccagcgccatccccctggacgacgccagcagcggccccatccaggtgagaggcagactggactgcggcatggccttcgccggcgacgaggtgctggtgcagctgctgagcggcgacaaggcccccgagggcagactgagaggcagagtgctgggcgtgctgaagagaaagagacacgagctggccttcgtgtgcagaatggacacctgggaccccagaatcatggtgcccatcaacggcagcgtgaccaagatcttcgtggccgagctgaaggaccccagccaggtgcccatctacagcctgagaaagggcagactgcagagagtgggcctggagagactgaccgccgaggccagacacagcagactgttctgggtgcagatcgtgctgtggagacagggcttctactaccccctgggcatcgtgagagaggtgctgcccgaggccagcacctgggagcagggcctgagaatcctgggcctggagtacagcctgagagtgccccccagcgaccaggccaccatcaccaaggtgctgcagaagtaccacaccgagctgggcagagtggccggcagaagagaggactgcagagccttcctgaccttcaccgtggacccccagggcgcctgcaacctggacgacgccctgagcgtgagagacctgggccccagatgcgaggtggccgtgcacatcaccgacgtggccagcttcgtgcccagagacggcgtgctggacgtggaggccagaagacagggcgccgccttctacgcccccggcagagagcccgtgcccatgctgcccgccagcctgtgccaggacgtgctgagcctgctgcccggcagagacagactggccatcagcctgttcctgaccatggagaaggccagcggccagctgaagagcctgagattcgcccccagcgtggtgcagagcgacagacagctgagctacgaggaggccgaggaggtgatcagacagcaccccggcgccggcagagagctgcccgccagactggacagcgtggacgcctgcgtggtggccgcctgctacttcagcagactgctgagaagacacagactgagaagcgactgcttctacgagcagcccgacgaggacggcaccctgggcttcagagccgcccacatcatggtgaaggagtacatgatccagttcaacagactggtggccgagttcctggtgggcagcgagtgcaccagaaccgtgacccccctgagatggcagcccgcccccagaagccagcagctgaaggccctgtgcgagaagcacggcgacagagtgcccctgagcctgcacctgggccaccacctgcacggcggcggcggcagcccccccgacaccagactgcacctgctggccagcctgtggaagcaggtgcagttcgccgccagaacccaggactacgagcagatggtggacctggtgaccaccgacgacatgcaccccttcctggcccccgccggcagagacctgagaaaggccctggagagaagcgccttcggcagatgcgccagaggccaccagcagcagggcggccactacagcctgcaggtggactggtacacctgggccaccagccccatcagaagatacctggacgtggtgctgcagagacagatcctgctggccctgggccacggcggcagcgcctacagcgccagagacatcgacggcctgtgccaggccttcagcctgcagcacgccctggcccagagctaccagagaagagccagaagcctgcacctggccgtgcagctgaaggcccagcccctggacaagctgggcttcgtggtggacgtggaggccggcagcagatgcttcagactgctgttccccagcaacagagagaccctgcccgacccctgccccgtgccctacggcagcctgcagctggccgagcacccccacgccctggccggcagacccggcctgagactgctgtggagaagaagagtgtacagcgcccagggcagcagcccccccctgcccctgcccggcaccgtgcccgacccccacaccctggccgtggagaccgccctgtggaagcagctgctggagctggtggagctgcagagatggcccgaggccgccgccctgatccaggagaagggcgaggccagccagagaagagagctggtgcaggtgcagagaagccactgcggccacttcctggaggtggccagagagctgggcagcggcgacaccctgcaggtgcagctgggcaccagcctgcagcacggcttcctggtgcccagcccccagctgtggaccgtggcccccggcttcagcctgtgcctggagcacgtggagagacccggcgactgcttcagcggcagagtgtacagagcccccagagacagatacagagacgtggacgagtacgcctgcgtgtgggagcccttctgcgccctggagagcgccaccggcgccgtggccgagaacgacagcgtgaccctgcagcacctgagcgtgagctgggaggccagcagaaccccccagggccagctgcagggcgccttcagactggaggccgccttcctggaggagaactgcgccgacatcaacttcagctgctgctacctgtgcatcagactggagggcctgcccgcccccaccgccagccccagacccggccccagcagcctgggccccggcctgaacgtggaccccggcacctacacctgggtggcccacggccagacccaggactgggaccaggagagaagagccgacagacaggaggcccccagaagagtgcacctgttcgtgcaccacatgggcatggagaaggtgcccgaggaggtgctgagacccggcaccctgttcaccgtggagctgctgcccaagcagctgcccgacctgagaaaggaggaggccgtgagaggcctggaggaggccagccccctggtgaccagcatcgccctgggcagacccgtgccccagcccctgtgcagagtgatccccagcagattcctggagagacagacctacaacatccccggcggcagacacaagctgaaccccagccagaacgtggccgtgagagaggccctggagaagcccttcaccgtgatccagggcccccccggcaccggcaagaccatcgtgggcctgcacatcgtgttctggttccacaagagcaaccaggagcaggtgcagcccggcggcccccccagaggcgagaagagactgggcggcccctgcatcctgtactgcggccccagcaacaagagcgtggacgtgctggccggcctgctgctgagaagaatggagctgaagcccctgagagtgtacagcgagcaggccgaggccagcgagttccccgtgcccagagtgggcagcagaaagctgctgagaaagagccccagagagggcagacccaaccagagcctgagaagcatcaccctgcaccacagaatcagacaggcccccaacccctacagcagcgagatcaaggccttcgacaccagactgcagagaggcgagctgttcagcagagaggacctggtgtggtacaagaaggtgctgtgggaggccagaaagttcgagctggacagacacgaggtgatcctgtgcacctgcagctgcgccgccagcgccagcctgaagatcctggacgtgagacagatcctggtggacgaggccggcatggccaccgagcccgagaccctgatccccctggtgcagttcccccaggccgagaaggtggtgctgctgggcgaccacaagcagctgagacccgtggtgaagaacgagagactgcagaacctgggcctggacagaagcctgttcgagagataccacgaggacgcccacatgctggacacccagtacagaatgcacgagggcatctgcgccttccccagcgtggccttctacaagagcaagctgaagacctggcagggcctgagaagaccccccagcgtgctgggccacgccggcaaggagagctgccccgtgatcttcggccacgtgcagggccacgagagaagcctgctggtgagcaccgacgagggcaacgagaacagcaaggccaacctggaggaggtggccgaggtggtgagaatcaccaagcagctgaccctgggcagaaccgtggagccccaggacatcgccgtgctgaccccctacaacgcccaggccagcgagatcagcaaggccctgagaagagagggcatcgccggcgtggccgtgagcagcatcaccaagagccagggcagcgagtggagatacgtgctggtgagcaccgtgagaacctgcgccaagagcgacctggaccagagacccaccaagagctggctgaagaagttcctgggcttcgtggtggaccccaaccaggtgaacgtggccgtgaccagagcccaggagggcctgtgcctgatcggcgaccacctgctgctgagatgctgccccctgtggagaagcctgctggacttctgcgaggcccagcagaccctggtgcccgccggccaggtgagagtgtgcagaagacccaccatgcccagctag

SEQ ID NO: 8990 - DNA, 4995 bp, Artificial Sequence
  Description of Artificial Sequence: Synthetic coding sequence
atggccgccagaagaggcagaagagacggcgtggcccccccccccagcggcggccccggccccgaccccggcggcggcgccagaggcagcggctggggcagcagaagccaggccccctacggcaccctgggcgccgtgagcggcggcgagcaggtgctgctgcacgaggaggccggcgacagcggcttcgtgagcctgagcagactgggccccagcctgagagacaaggacctggagatggaggagctgatgctgcaggacgagaccctgctgggcaccatgcagagctacatggacgccagcctgatcagcctgatcgaggacttcggcagcctgggcgagagcagactgagcctggaggaccagaacgaggtgagcctgctgaccgccctgaccgagatcctggacaacgccgacagcgagaacctgagccccttcgacagcatccccgacagcgagctgctggtgagccccagagagggcagcagcctgcacaagctgctgaccctgagcagaaccccccccgagagagacctgatcacccccgtggaccccctgggccccagcaccggcagcagcagaggcagcggcgtggagatgagcctgcccgaccccagctgggacttcagcccccccagcttcctggagaccagcagccccaagctgcccagctggagaccccccagaagcagacccagatggggccagagcccccccccccagcagagaagcgacggcgaggaggaggaggaggtggccagcttcagcggccagatcctggccggcgagctggacaactgcgtgagcagcatccccgacttccccatgcacctggcctgccccgaggaggaggacaaggccaccgccgccgagatggccgtgcccgccgccggcgacgagagcatcagcagcctgagcgagctggtgagagccatgcacccctactgcctgcccaacctgacccacctggccagcctggaggacgagctgcaggagcagcccgacgacctgaccctgcccgagggctgcgtggtgctggagatcgtgggccaggccgccaccgccggcgacgacctggagatccccgtggtggtgagacaggtgagccccggccccagacccgtgctgctggacgacagcctggagaccagcagcgccctgcagctgctgatgcccaccctggagagcgagaccgaggccgccgtgcccaaggtgaccctgtgcagcgagaaggagggcctgagcctgaacagcgaggagaagctggacagcgcctgcctgctgaagcccagagaggtggtggagcccgtggtgcccaaggagccccagaacccccccgccaacgccgcccccggcagccagagagccagaaagggcagaaagaagaagagcaaggagcagcccgccgcctgcgtggagggctacgccagaagactgagaagcagcagcagaggccagagcaccgtgggcaccgaggtgaccagccaggtggacaacctgcagaagcagccccaggaggagctgcagaaggagagcggccccctgcagggcaagggcaagcccagagcctgggccagagcctgggccgccgccctggagaacagcagccccaagaacctggagagaagcgccggccagagcagccccgccaaggagggccccctggacctgtaccccaagctggccgacaccatccagaccaaccccatccccacccacctgagcctggtggacagcgcccaggccagccccatgcccgtggacagcgtggaggccgaccccaccgccgtgggccccgtgctggccggccccgtgcccgtggaccccggcctggtggacctggccagcaccagcagcgagctggtggagcccctgcccgccgagcccgtgctgatcaaccccgtgctggccgacagcgccgccgtggaccccgccgtggtgcccatcagcgacaacctgccccccgtggacgccgtgcccagcggccccgcccccgtggacctggccctggtggaccccgtgcccaacgacctgacccccgtggaccccgtgctggtgaagagcagacccaccgaccccagaagaggcgccgtgagcagcgccctgggcggcagcgccccccagctgctggtggagagcgagagcctggacccccccaagaccatcatccccgaggtgaaggaggtggtggacagcctgaagatcgagagcggcaccagcgccaccacccacgaggccagacccagacccctgagcctgagcgagtacagaagaagaagacagcagagacaggccgagaccgaggagagaagcccccagccccccaccggcaagtggcccagcctgcccgagacccccaccggcctggccgacatcccctgcctggtgatcccccccgcccccgccaagaagaccgccctgcagagaagccccgagacccccctggagatctgcctggtgcccgtgggccccagccccgccagccccagccccgagccccccgtgagcaagcccgtggccagcagccccaccgagcaggtgcccagccaggagatgcccctgctggccagacccagcccccccgtgcagagcgtgagccccgccgtgcccaccccccccagcatgagcgccgccctgcccttccccgccggcggcctgggcatgccccccagcctgccccccccccccctgcagccccccagcctgcccctgagcatgggccccgtgctgcccgaccccttcacccactacgcccccctgcccagctggccctgctacccccacgtgagccccagcggctacccctgcctgccccccccccccaccgtgcccctggtgagcggcacccccggcgcctacgccgtgccccccacctgcagcgtgccctgggcccccccccccgcccccgtgagcccctacagcagcacctgcacctacggccccctgggctggggccccggcccccagcacgcccccttctggagcaccgtgccccccccccccctgccccccgccagcatcggcagagccgtgccccagcccaagatggagagcagaggcacccccgccggcccccccgagaacgtgctgcccctgagcatggccccccccctgagcctgggcctgcccggccacggcgccccccagaccgagcccaccaaggtggaggtgaagcccgtgcccgccagcccccaccccaagcacaaggtgagcgccctggtgcagagcccccagatgaaggccctggcctgcgtgagcgccgagggcgtgaccgtggaggagcccgccagcgagagactgaagcccgagacccaggagaccagacccagagagaagccccccctgcccgccaccaaggccgtgcccacccccagacagagcaccgtgcccaagctgcccgccgtgcaccccgccagactgagaaagctgagcttcctgcccacccccagaacccagggcagcgaggacgtggtgcaggccttcatcagcgagatcggcatcgaggccagcgacctgagcagcctgctggagcagttcgagaagagcgaggccaagaaggagtgccccccccccgcccccgccgacagcctggccgtgggcaacagcggcggcgtggacatcccccaggagaagagacccctggacagactgcaggcccccgagctggccaacgtggccggcctgaccccccccgccacccccccccaccagctgtggaagcccctggccgccgtgagcctgctggccaaggccaagagccccaagagcaccgcccaggagggcaccctgaagcccgagggcgtgaccgaggccaagcaccccgccgccgtgagactgcaggagggcgtgcacggccccagcagagtgcacgtgggcagcggcgaccacgactactgcgtgagaagcagaaccccccccaagaagatgcccgccctggtgatccccgaggtgggcagcagatggaacgtgaagagacaccaggacatcaccatcaagcccgtgctgagcctgggccccgccgcccccccccccccctgcatcgccgccagcagagagcccctggaccacagaaccagcagcgagcaggccgaccccagcgccccctgcctggcccccagcagcctgctgagccccgaggccagcccctgcagaaacgacatgaacaccagaaccccccccgagcccagcgccaagcagagaagcatgagatgctacagaaaggcctgcagaagcgccagccccagcagccagggctggcagggcagaagaggcagaaacagcagaagcgtgagcagcggcagcaacagaaccagcgaggccagcagcagcagcagcagcagcagcagcagcagcagaagcagaagcagaagcctgagccccccccacaagagatggagaagaagcagctgcagcagcagcggcagaagcagaagatgcagcagcagcagcagcagcagcagcagcagcagcagcagcagcagcagcagcagcagcagcagaagcagaagcagaagccccagccccagaagaagaagcgacagaagaagaagatacagcagctacagaagccacgaccactaccagagacagagagtgctgcagaaggagagagccatcgaggagagaagagtggtgttcatcggcaagatccccggcagaatgaccagaagcgagctgaagcagagattcagcgtgttcggcgagatcgaggagtgcaccatccacttcagagtgcagggcgacaactacggcttcgtgacctacagatacgccgaggaggccttcgccgccatcgagagcggccacaagctgagacaggccgacgagcagcccttcgacctgtgcttcggcggcagaagacagttctgcaagagaagctacagcgacctggacagcaacagagaggacttcgaccccgcccccgtgaagagcaagttcgacagcctggacttcgacaccctgctgaagcaggcccagaagaacctgagaagatag

SEQ ID NO: 8991 - DNA, 4203 bp, Artificial Sequence
  Description of Artificial Sequence: Synthetic coding sequence
atggccgccagaagaggcagaagagacggcgtggcccccccccccagcggcggccccggccccgaccccggcggcggcgccagaggcagcggctggggcagcagaagccaggccccctacggcaccctgggcgccgtgagcggcggcgagcaggtgctgctgcacgaggaggccggcgacagcggcttcgtgagcctgagcagactgggccccagcctgagagacaaggacctggagatggaggagctgatgctgcaggacgagaccctgctgggcaccatgcagagctacatggacgccagcctgatcagcctgatcgaggacttcggcagcctgggcgagagcagactgagcctggaggaccagaacgaggtgagcctgctgaccgccctgaccgagatcctggacaacgccgacagcgagaacctgagccccttcgacagcatccccgacagcgagctgctggtgagccccagagagggcagcagcctgcacaagctgctgaccctgagcagaaccccccccgagagagacctgatcacccccgtggaccccctgggccccagcaccggcagcagcagaggcagcggcgtggagatgagcctgcccgaccccagctgggacttcagcccccccagcttcctggagaccagcagccccaagctgcccagctggagaccccccagaagcagacccagatggggccagagcccccccccccagcagagaagcgacggcgaggaggaggaggaggtggccagcttcagcggccagatcctggccggcgagctggacaactgcgtgagcagcatccccgacttccccatgcacctggcctgccccgaggaggaggacaaggccaccgccgccgagatggccgtgcccgccgccggcgacgagagcatcagcagcctgagcgagctggtgagagccatgcacccctactgcctgcccaacctgacccacctggccagcctggaggacgagctgcaggagcagcccgacgacctgaccctgcccgagggctgcgtggtgctggagatcgtgggccaggccgccaccgccggcgacgacctggagatccccgtggtggtgagacaggtgagccccggccccagacccgtgctgctggacgacagcctggagaccagcagcgccctgcagctgctgatgcccaccctggagagcgagaccgaggccgccgtgcccaaggtgaccctgtgcagcgagaaggagggcctgagcctgaacagcgaggagaagctggacagcgcctgcctgctgaagcccagagaggtggtggagcccgtggtgcccaaggagccccagaacccccccgccaacgccgcccccggcagccagagagccagaaagggcagaaagaagaagagcaaggagcagcccgccgcctgcgtggagggctacgccagaagactgagaagcagcagcagaggccagagcaccgtgggcaccgaggtgaccagccaggtggacaacctgcagaagcagccccaggaggagctgcagaaggagagcggccccctgcagggcaagggcaagcccagagcctgggccagagcctgggccgccgccctggagaacagcagccccaagaacctggagagaagcgccggccagagcagccccgccaaggagggccccctggacctgtaccccaagctggccgacaccatccagaccaaccccatccccacccacctgagcctggtggacagcgcccaggccagccccatgcccgtggacagcgtggaggccgaccccaccgccgtgggccccgtgctggccggccccgtgcccgtggaccccggcctggtggacctggccagcaccagcagcgagctggtggagcccctgcccgccgagcccgtgctgatcaaccccgtgctggccgacagcgccgccgtggaccccgccgtggtgcccatcagcgacaacctgccccccgtggacgccgtgcccagcggccccgcccccgtggacctggccctggtggaccccgtgcccaacgacctgacccccgtggaccccgtgctggtgaagagcagacccaccgaccccagaagaggcgccgtgagcagcgccctgggcggcagcgccccccagctgctggtggagagcgagagcctggacccccccaagaccatcatccccgaggtgaaggaggtggtggacagcctgaagatcgagagcggcaccagcgccaccacccacgaggccagacccagacccctgagcctgagcgagtacagaagaagaagacagcagagacaggccgagaccgaggagagaagcccccagccccccaccggcaagtggcccagcctgcccgagacccccaccggcctggccgacatcccctgcctggtgatcccccccgcccccgccaagaagaccgccctgcagagaagccccgagacccccctggagatctgcctggtgcccgtgggccccagccccgccagccccagccccgagccccccgtgagcaagcccgtggccagcagccccaccgagcaggtgcccagccaggagatgcccctgctggccagacccagcccccccgtgcagagcgtgagccccgccgtgcccaccccccccagcatgagcgccgccctgcccttccccgccggcggcctgggcatgccccccagcctgccccccccccccctgcagccccccagcctgcccctgagcatgggccccgtgctgcccgaccccttcacccactacgcccccctgcccagctggccctgctacccccacgtgagccccagcggctacccctgcctgccccccccccccaccgtgcccctggtgagcggcacccccggcgcctacgccgtgccccccacctgcagcgtgccctgggcccccccccccgcccccgtgagcccctacagcagcacctgcacctacggccccctgggctggggccccggcccccagcacgcccccttctggagcaccgtgccccccccccccctgccccccgccagcatcggcagagccgtgccccagcccaagatggagagcagaggcacccccgccggcccccccgagaacgtgctgcccctgagcatggccccccccctgagcctgggcctgcccggccacggcgccccccagaccgagcccaccaaggtggaggtgaagcccgtgcccgccagcccccaccccaagcacaaggtgagcgccctggtgcagagcccccagatgaaggccctggcctgcgtgagcgccgagggcgtgaccgtggaggagcccgccagcgagagactgaagcccgagacccaggagaccagacccagagagaagccccccctgcccgccaccaaggccgtgcccacccccagacagagcaccgtgcccaagctgcccgccgtgcaccccgccagactgagaaagctgagcttcctgcccacccccagaacccagggcagcgaggacgtggtgcaggccttcatcagcgagatcggcatcgaggccagcgacctgagcagcctgctggagcagttcgagaagagcgaggccaagaaggagtgccccccccccgcccccgccgacagcctggccgtgggcaacagcggcagcagctgcagcagcagcggcagaagcagaagatgcagcagcagcagcagcagcagcagcagcagcagcagcagcagcagcagcagcagcagcagcagaagcagaagcagaagccccagccccagaagaagaagcgacagaagaagaagatacagcagctacagaagccacgaccactaccagagacagagagtgctgcagaaggagagagccatcgaggagagaagagtggtgttcatcggcaagatccccggcagaatgaccagaagcgagctgaagcagagattcagcgtgttcggcgagatcgaggagtgcaccatccacttcagagtgcagggcgacaactacggcttcgtgacctacagatacgccgaggaggccttcgccgccatcgagagcggccacaagctgagacaggccgacgagcagcccttcgacctgtgcttcggcggcagaagacagttctgcaagagaagctacagcgacctggacagcaacagagaggacttcgaccccgcccccgtgaagagcaagttcgacagcctggacttcgacaccctgctgaagcaggcccagaagaacctgagaagatag

SEQ ID NO: 8992 - DNA, 537 bp, Artificial Sequence
  Description of Artificial Sequence: Synthetic coding sequence
atggccgacggcaaggccggcgacgagaagcccgagaagagccagagagccggcgccgccggcggccccgaggaggaggccgagaagcccgtgaagaccaagaccgtgagcagcagcaacggcggcgagagcagcagcagaagcgccgagaagagaagcgccgaggaggaggccgccgacctgcccaccaagcccaccaagatcagcaagttcggcttcgccatcggcagccagaccaccaagaaggccagcgccatcagcatcaagctgggcagcagcaagcccaaggagaccgtgcccaccctggcccccaagaccctgagcgtggccgccgccttcaacgaggacgaggacagcgagcccgaggagatgccccccgaggccaagatgagaatgaagaacatcggcagagacacccccaccagcgccggccccaacagcttcaacaagggcaagcacggcttcagcgacaaccagaagctgtgggagagaaacatcaagagccacctgggcaacgtgcacgaccaggacaactag

SEQ ID NO: 8993 - DNA, 4950 bp, Artificial Sequence
  Description of Artificial Sequence: Synthetic coding sequence
atggacgacgacagcctggacgagctggtggccagaagccccggccccgacggccacccccaggtgggccccgccgaccccgccggcgacttcgaggagagcagcgtgggcagcagcggcgacagcggcgacgacagcgacagcgagcacggcgacggcaccgacggcgaggacgagggcgccagcgaggaggaggacctggaggacagaagcggcagcgaggacagcgaggacgacggcgagaccctgctggaggtggccggcacccagggcaagctggaggccgccggcagcttcaacagcgacgacgacgccgagagctgccccatctgcctgaacgccttcagagaccaggccgtgggcacccccgagaactgcgcccactacttctgcctggactgcatcgtggagtggagcaagaacgccaacagctgccccgtggacagaaccctgttcaagtgcatctgcatcagagcccagttcggcggcaagatcctgagaaagatccccgtggagaacaccaaggccagcgaggaggaggaggaccccaccttctgcgaggtgtgcggcagaagcgacagagaggacagactgctgctgtgcgacggctgcgacgccggctaccacatggagtgcctggacccccccctgcaggaggtgcccgtggacgagtggttctgccccgagtgcgccgcccccggcgtggtgctggccgccgacgccggccccgtgagcgaggaggaggtgagcctgctgctggccgacgtggtgcccaccaccagcagactgagacccagagccggcagaaccagagccatcgccagaaccagacagagcgagagagtgagagccaccgtgaacagaaacagaatcagcaccgccagaagagtgcagcacacccccggcagactgggcagcagcctgctggacgaggccatcgaggccgtggccaccggcctgagcaccgccgtgtaccagagacccctgacccccagaacccccgccagaagaaagagaaagaccagaagaagaaagaaggtgcccggcagaaagaagacccccagcggccccagcgccaagagcaagagcagcgccaccagaagcaagaagagacagcacagagtgaagaagagaagaggcaagaaggtgaagagcgaggccaccaccagaagcagaatcgccagaaccctgggcctgagaagacccgtgcacagcagctgcatccccagcgtgctgaagcccgtggagcccagcctgggcctgctgagagccgacatcggcgccgccagcctgagcctgttcggcgacccctacgagctggaccccttcgacagcagcgaggagctgagcgccaaccccctgagccccctgagcgccaagagaagagccctgagcagaagcgccctgcagagccaccagcccgtggccagacccgtgagcgtgggcctgagcagaagaagactgcccgccgccgtgcccgagcccgacctggaggaggagcccgtgcccgacctgctgggcagcatcctgagcggccagagcctgctgatgctgggcagcagcgacgtgatcatccacagagacggcagcctgagcgccaagagagccgcccccgtgagcttccagagaaacagcggcagcctgagcagaggcgaggagggcttcaagggctgcctgcagcccagagccctgcccagcggcagccccgcccagggccccagcggcaacagaccccagagcaccggcctgagctgccagggcagaagcagaacccccgccagaaccgccggcgcccccgtgagactggacctgcccgccgcccccggcgccgtgcaggccagaaacctgagcaacggcagcgtgcccggcttcagacagagccacagcccctggttcaacggcaccaacaagcacaccctgcccctggccagcgccgccagcaagatcagcagcagagacagcaagcccccctgcagaagcgtggtgcccggcccccccctgaagcccgcccccagaagaaccgacatcagcgagctgcccagaatccccaagatcagaagagacgacggcggcggcagaagagacgccgcccccgcccacggccagagcatcgagatccccagcgcctgcatcagcagactgaccggcagagagggcaccggccagcccggcagaggcaccagagccgagagcgaggccagcagcagagtgcccagagagcccggcgtgcacaccggcagcagcagaccccccgcccccagcagccacggcagcctggcccccctgggccccagcagaggcaagggcgtgggcagcaccttcgagagcttcagaatcaacatccccggcaacatggcccacagcagccagctgagcagccccggcttctgcaacaccttcagacccgtggacgacaaggagcagagaaaggagaaccccagccccctgttcagcatcaagaagaccaagcagctgagaagcgaggtgtacgaccccagcgaccccaccggcagcgacagcagcgcccccggcagcagccccgagagaagcggccccggcctgctgcccagcgagatcaccagaaccatcagcatcaacagccccaaggcccagaccgtgcaggccgtgagatgcgtgaccagctacaccgtggagagcatcttcggcaccgagcccgagccccccctgggccccagcagcgccatgagcaagctgagaggcgccgtggccgccgagggcgccagcgacaccgagagagaggagcccaccgagagccagggcctggccgccagactgagaagacccagcccccccgagccctgggacgaggaggacggcgccagctgcagcaccttcttcggcagcgaggagagaaccgtgacctgcgtgaccgtggtggagcccgaggccccccccagccccgacgtgctgcaggccgccacccacagagtggtggagctgagaccccccagcagaagcagaagcaccagcagcagcagaagcagaaagaaggccaagagaaagagagtgagcagagagcacggcagaaccagaagcggcaccagaagcgagagcagagacagaagcagcagaagcgccagccccagcgtgggcgaggagagacccagaagacagagaagcaaggccaagagcagaagaagcagcagcgacagaagcagcagcagagagagagccaagagaaagaaggccaaggacaagagcagagagcacagaagaggcccctggggccacagcagaagaaccagcagaagcagaagcggcagccccggcagcagcagctacgagcactacgagagcagaaagaagaagaagagaagaagcgccagcagacccagaggcagagagtgcagccccaccagcagcctggagagactgtgcagacacaagcaccagagagagagaagccacgagagacccgacagaaaggagagcgtggcctggcccagagacagaagaaagagaagaagcagaagccccagcagcgagcacagagccagagagcacagaagacccagaagcagagagaagtggccccagaccagaagccacagccccgagagaaagggcgccgtgagagaggccagccccgcccccctggcccagggcgagcccggcagagaggacctgcccaccagactgcccgccctgggcgaggcccacgtgagccccgaggtggccaccgccgacaaggcccccctgcaggccccccccgtgctggaggtggccgccgagtgcgagcccgacgacctggacctggactacggcgacagcgtggaggccggccacgtgttcgacgacttcagcagcgacgccgtgttcatccagctggacgacatgagcagcccccccagccccgagagcaccgacagcagccccgagagagacttccccctgaagcccgccctgccccccgccagcctggccgtggccgccatccagagagaggtgagcctgatgcacgacgaggaccccagccagcccccccccctgcccgagggcacccaggagccccacctgctgagacccgacgccgccgagaaggccgaggcccccagcagccccgacgtggcccccgccggcaaggaggacagccccagcgccagcggcagagtgcaggaggccgccagacccgaggaggtggtgagccagacccccctgctgagaagcagagccctggtgaagagagtgacctggaacctgcaggagagcgagagcagcgcccccgccgaggacagagcccccagagcccccctgcacagaccccagaagcccagagagggcgcctgggacatggaggacgtggcccccaccggcgtgagacaggtgttcagcgagctgcccttccccagccacgtgctgcccgagcccggcttccccgacaccgaccccagccaggtgtacagccccggcctgccccccgcccccgcccagcccagcagcatccccccctgcgccctggtgagccagcccaccgtgcagttcatcctgcagggcagcctgcccctggtgggctgcggcgccgcccagaccctggcccccgtgcccgccgccctgacccccgccagcgagcccgccagccaggccaccgccgccagcaacagcgaggagaagacccccgcccccagactggccgccgagaagaccaagaaggaggagtacatgaagaagctgcacatgcaggagagagccgtggaggaggtgaagctggccatcaagcccttctaccagaagagagaggtgaccaaggaggagtacaaggacatcctgagaaaggccgtgcagaagatctgccacagcaagagcggcgagatcaaccccgtgaaggtggccaacctggtgaaggcctacgtggacaagtacagacacatgagaagacacaagaagcccgaggccggcgaggagccccccacccagggcgccgagggctag

SEQ ID NO: 8994 - DNA, 4947 bp, Artificial Sequence
  Description of Artificial Sequence: Synthetic coding sequence
atggacgacgacagcctggacgagctggtggccagaagccccggccccgacggccacccccaggtgggccccgccgaccccgccggcgacttcgaggagagcagcgtgggcagcagcggcgacagcggcgacgacagcgacagcgagcacggcgacggcaccgacggcgaggacgagggcgccagcgaggaggaggacctggaggacagaagcggcagcgaggacagcgaggacgacggcgagaccctgctggaggtggccggcacccagggcaagctggaggccgccggcagcttcaacagcgacgacgacgccgagagctgccccatctgcctgaacgccttcagagaccaggccgtgggcacccccgagaactgcgcccactacttctgcctggactgcatcgtggagtggagcaagaacgccaacagctgccccgtggacagaaccctgttcaagtgcatctgcatcagagcccagttcggcggcaagatcctgagaaagatccccgtggagaacaccaaggccagcgaggaggaggaggaccccaccttctgcgaggtgtgcggcagaagcgacagagaggacagactgctgctgtgcgacggctgcgacgccggctaccacatggagtgcctggacccccccctgcaggaggtgcccgtggacgagtggttctgccccgagtgcgccgcccccggcgtggtgctggccgccgacgccggccccgtgagcgaggaggaggtgagcctgctgctggccgacgtggtgcccaccaccagcagactgagacccagagccggcagaaccagagccatcgccagaaccagacagagcgagagagtgagagccaccgtgaacagaaacagaatcagcaccgccagaagagtgcagcacacccccggcagactgggcagcagcctgctggacgaggccatcgaggccgtggccaccggcctgagcaccgccgtgtaccagagacccctgacccccagaacccccgccagaagaaagagaaagaccagaagaagaaagaaggtgcccggcagaaagaagacccccagcggccccagcgccaagagcaagagcagcgccaccagaagcaagaagagacagcacagagtgaagaagagaagaggcaagaaggtgaagagcgaggccaccaccagaagcagaatcgccagaaccctgggcctgagaagacccgtgcacagcagctgcatccccagcgtgctgaagcccgtggagcccagcctgggcctgctgagagccgacatcggcgccgccagcctgagcctgttcggcgacccctacgagctggaccccttcgacagcgaggagctgagcgccaaccccctgagccccctgagcgccaagagaagagccctgagcagaagcgccctgcagagccaccagcccgtggccagacccgtgagcgtgggcctgagcagaagaagactgcccgccgccgtgcccgagcccgacctggaggaggagcccgtgcccgacctgctgggcagcatcctgagcggccagagcctgctgatgctgggcagcagcgacgtgatcatccacagagacggcagcctgagcgccaagagagccgcccccgtgagcttccagagaaacagcggcagcctgagcagaggcgaggagggcttcaagggctgcctgcagcccagagccctgcccagcggcagccccgcccagggccccagcggcaacagaccccagagcaccggcctgagctgccagggcagaagcagaacccccgccagaaccgccggcgcccccgtgagactggacctgcccgccgcccccggcgccgtgcaggccagaaacctgagcaacggcagcgtgcccggcttcagacagagccacagcccctggttcaacggcaccaacaagcacaccctgcccctggccagcgccgccagcaagatcagcagcagagacagcaagcccccctgcagaagcgtggtgcccggcccccccctgaagcccgcccccagaagaaccgacatcagcgagctgcccagaatccccaagatcagaagagacgacggcggcggcagaagagacgccgcccccgcccacggccagagcatcgagatccccagcgcctgcatcagcagactgaccggcagagagggcaccggccagcccggcagaggcaccagagccgagagcgaggccagcagcagagtgcccagagagcccggcgtgcacaccggcagcagcagaccccccgcccccagcagccacggcagcctggcccccctgggccccagcagaggcaagggcgtgggcagcaccttcgagagcttcagaatcaacatccccggcaacatggcccacagcagccagctgagcagccccggcttctgcaacaccttcagacccgtggacgacaaggagcagagaaaggagaaccccagccccctgttcagcatcaagaagaccaagcagctgagaagcgaggtgtacgaccccagcgaccccaccggcagcgacagcagcgcccccggcagcagccccgagagaagcggccccggcctgctgcccagcgagatcaccagaaccatcagcatcaacagccccaaggcccagaccgtgcaggccgtgagatgcgtgaccagctacaccgtggagagcatcttcggcaccgagcccgagccccccctgggccccagcagcgccatgagcaagctgagaggcgccgtggccgccgagggcgccagcgacaccgagagagaggagcccaccgagagccagggcctggccgccagactgagaagacccagcccccccgagccctgggacgaggaggacggcgccagctgcagcaccttcttcggcagcgaggagagaaccgtgacctgcgtgaccgtggtggagcccgaggccccccccagccccgacgtgctgcaggccgccacccacagagtggtggagctgagaccccccagcagaagcagaagcaccagcagcagcagaagcagaaagaaggccaagagaaagagagtgagcagagagcacggcagaaccagaagcggcaccagaagcgagagcagagacagaagcagcagaagcgccagccccagcgtgggcgaggagagacccagaagacagagaagcaaggccaagagcagaagaagcagcagcgacagaagcagcagcagagagagagccaagagaaagaaggccaaggacaagagcagagagcacagaagaggcccctggggccacagcagaagaaccagcagaagcagaagcggcagccccggcagcagcagctacgagcactacgagagcagaaagaagaagaagagaagaagcgccagcagacccagaggcagagagtgcagccccaccagcagcctggagagactgtgcagacacaagcaccagagagagagaagccacgagagacccgacagaaaggagagcgtggcctggcccagagacagaagaaagagaagaagcagaagccccagcagcgagcacagagccagagagcacagaagacccagaagcagagagaagtggccccagaccagaagccacagccccgagagaaagggcgccgtgagagaggccagccccgcccccctggcccagggcgagcccggcagagaggacctgcccaccagactgcccgccctgggcgaggcccacgtgagccccgaggtggccaccgccgacaaggcccccctgcaggccccccccgtgctggaggtggccgccgagtgcgagcccgacgacctggacctggactacggcgacagcgtggaggccggccacgtgttcgacgacttcagcagcgacgccgtgttcatccagctggacgacatgagcagcccccccagccccgagagcaccgacagcagccccgagagagacttccccctgaagcccgccctgccccccgccagcctggccgtggccgccatccagagagaggtgagcctgatgcacgacgaggaccccagccagcccccccccctgcccgagggcacccaggagccccacctgctgagacccgacgccgccgagaaggccgaggcccccagcagccccgacgtggcccccgccggcaaggaggacagccccagcgccagcggcagagtgcaggaggccgccagacccgaggaggtggtgagccagacccccctgctgagaagcagagccctggtgaagagagtgacctggaacctgcaggagagcgagagcagcgcccccgccgaggacagagcccccagagcccccctgcacagaccccagaagcccagagagggcgcctgggacatggaggacgtggcccccaccggcgtgagacaggtgttcagcgagctgcccttccccagccacgtgctgcccgagcccggcttccccgacaccgaccccagccaggtgtacagccccggcctgccccccgcccccgcccagcccagcagcatccccccctgcgccctggtgagccagcccaccgtgcagttcatcctgcagggcagcctgcccctggtgggctgcggcgccgcccagaccctggcccccgtgcccgccgccctgacccccgccagcgagcccgccagccaggccaccgccgccagcaacagcgaggagaagacccccgcccccagactggccgccgagaagaccaagaaggaggagtacatgaagaagctgcacatgcaggagagagccgtggaggaggtgaagctggccatcaagcccttctaccagaagagagaggtgaccaaggaggagtacaaggacatcctgagaaaggccgtgcagaagatctgccacagcaagagcggcgagatcaaccccgtgaaggtggccaacctggtgaaggcctacgtggacaagtacagacacatgagaagacacaagaagcccgaggccggcgaggagccccccacccagggcgccgagggctag

SEQ ID NO: 8995 - DNA, 2115 bp, Artificial Sequence
  Description of Artificial Sequence: Synthetic coding sequence
atgtgggagaagatggagaccaagaccatcgtgtacgacctggacaccagcggcggcctgatggagcagatccaggccctgctggccccccccaagaccgacgaggccgagaagagaagcagaaagcccgagaaggagcccagaagaagcggcagagccaccaaccacgacagctgcgacagctgcaaggagggcggcgacctgctgtgctgcgaccactgccccgccgccttccacctgcagtgctgcaacccccccctgagcgaggagatgctgccccccggcgagtggatgtgccacagatgcaccgtgagaagaaagaagagagagcagaagaaggagctgggccacgtgaacggcctggtggacaagagcggcaagagaaccaccagccccagcagcgacaccgacctgctggacagaagcgccagcaagaccgagctgaaggccatcgcccacgccagaatcctggagagaagagccagcagacccggcacccccaccagcagcgccagcaccgagacccccaccagcgagcagaacgacgtggacgaggacatcatcgacgtggacgaggagcccgtggccgccgagcccgactacgtgcagccccagctgagaagacccttcgagctgctgatcgccgccgccatggagagaaaccccacccagttccagctgcccaacgagctgacctgcaccaccgccctgcccggcagcagcaagagaagaagaaaggaggagaccaccggcaagaacgtgaagaagacccagcacgagctggaccacaacggcctggtgcccctgcccgtgaaggtgtgcttcacctgcaacagaagctgcagagtggcccccctgatccagtgcgactactgccccctgctgttccacatggactgcctggagccccccctgaccgccatgcccctgggcagatggatgtgccccaaccacatcgagcacgtggtgctgaaccagaagaacatgaccctgagcaacagatgccaggtgttcgacagattccaggacaccgtgagccagcacgtggtgaaggtggacttcctgaacagaatccacaagaagcacccccccaacagaagagtgctgcagagcgtgaagagaagaagcctgaaggtgcccgacgccatcaagagccagtaccagttccccccccccctgatcgcccccgccgccatcagagacggcgagctgatctgcaacggcatccccgaggagagccagatgcacctgctgaacagcgagcacctggccacccaggccgagcagcaggagtggctgtgcagcgtggtggccctgcagtgcagcatcctgaagcacctgagcgccaagcagatgcccagccactgggacagcgagcagaccgagaaggccgacatcaagcccgtgatcgtgaccgacagcagcgtgaccaccagcctgcagaccgccgacaagacccccacccccagccactaccccctgagctgccccagcggcatcagcacccagaacagcctgagctgcagccccccccaccagagccccgccctggaggacatcggctgcagcagctgcgccgagaagagcaagaagaccccctgcggcaccgccaacggccccgtgaacaccgaggtgaaggccaacggcccccacctgtacagcagccccaccgacagcaccgaccccagaagactgcccggcgccaacacccccctgcccggcctgagccacagacagggctggcccagacccctgaccccccccgccgccggcggcctgcagaaccacaccgtgggcatcatcgtgaagaccgagaacgccaccggccccagcagctgcccccagagaagcctggtgcccgtgcccagcctgccccccagcatccccagcagctgcgccagcatcgagaacaccagcaccctgcagagaaagaccgtgcagagccagatcggcccccccctgaccgacagcagacccctgggcagcccccccaacgccaccagagtgctgacccccccccaggccgccggcgacggcatcctggccaccaccgccaaccagagattcagcagccccgcccccagcagcggcgagtgctgcagcgccctgggctag

SEQ ID NO: 8996 - DNA, 3015 bp, Artificial Sequence
  Description of Artificial Sequence: Synthetic coding sequence
atgtgggagaagatggagaccaagaccatcgtgtacgacctggacaccagcggcggcctgatggagcagatccaggccctgctggccccccccaagaccgacgaggccgagaagagaagcagaaagcccgagaaggagcccagaagaagcggcagagccaccaaccacgacagctgcgacagctgcaaggagggcggcgacctgctgtgctgcgaccactgccccgccgccttccacctgcagtgctgcaacccccccctgagcgaggagatgctgccccccggcgagtggatgtgccacagatgcaccgtgagaagaaagaagagagagcagaagaaggagctgggccacgtgaacggcctggtggacaagagcggcaagagaaccaccagccccagcagcgacaccgacctgctggacagaagcgccagcaagaccgagctgaaggccatcgcccacgccagaatcctggagagaagagccagcagacccggcacccccaccagcagcgccagcaccgagacccccaccagcgagcagaacgacgtggacgaggacatcatcgacgtggacgaggagcccgtggccgccgagcccgactacgtgcagccccagctgagaagacccttcgagctgctgatcgccgccgccatggagagaaaccccacccagttccagctgcccaacgagctgacctgcaccaccgccctgcccggcagcagcaagagaagaagaaaggaggagaccaccggcaagaacgtgaagaagacccagcacgagctggaccacaacggcctggtgcccctgcccgtgaaggtgtgcttcacctgcaacagaagctgcagagtggcccccctgatccagtgcgactactgccccctgctgttccacatggactgcctggagccccccctgaccgccatgcccctgggcagatggatgtgccccaaccacatcgagcacgtggtgctgaaccagaagaacatgaccctgagcaacagatgccaggtgttcgacagattccaggacaccgtgagccagcacgtggtgaaggtggacttcctgaacagaatccacaagaagcacccccccaacagaagagtgctgcagagcgtgaagagaagaagcctgaaggtgcccgacgccatcaagagccagtaccagttccccccccccctgatcgcccccgccgccatcagagacggcgagctgatctgcaacggcatccccgaggagagccagatgcacctgctgaacagcgagcacctggccacccaggccgagcagcaggagtggctgtgcagcgtggtggccctgcagtgcagcatcctgaagcacctgagcgccaagcagatgcccagccactgggacagcgagcagaccgagaaggccgacatcaagcccgtgatcgtgaccgacagcagcgtgaccaccagcctgcagaccgccgacaagacccccacccccagccactaccccctgagctgccccagcggcatcagcacccagaacagcctgagctgcagccccccccaccagagccccgccctggaggacatcggctgcagcagctgcgccgagaagagcaagaagaccccctgcggcaccgccaacggccccgtgaacaccgaggtgaaggccaacggcccccacctgtacagcagccccaccgacagcaccgaccccagaagactgcccggcgccaacacccccctgcccggcctgagccacagacagggctggcccagacccctgaccccccccgccgccggcggcctgcagaaccacaccgtgggcatcatcgtgaagaccgagaacgccaccggccccagcagctgcccccagagaagcctggtgcccgtgcccagcctgccccccagcatccccagcagctgcgccagcatcgagaacaccagcaccctgcagagaaagaccgtgcagagccagatcggcccccccctgaccgacagcagacccctgggcagcccccccaacgccaccagagtgctgacccccccccaggccgccggcgacggcatcctggccaccaccgccaaccagagattcagcagccccgcccccagcagcgacggcaaggtgagccccggcaccctgagcatcggcagcgccctgaccgtgcccagcttccccgccaacagcaccgccatggtggacctgaccaacagcctgagagccttcatggacgtgaacggcgagatcgagatcaacatgctggacgagaagctgatcaagttcctggccctgcagagaatccaccagctgttccccagcagagtgcagcccagccccggcagcgtgggcacccaccagctggccagcggcggccaccacatcgaggtgcagagaaaggaggtgcaggccagagccgtgttctaccccctgctgggcctgggcggcgccgtgaacatgtgctacagaaccctgtacatcggcaccggcgccgacatggacgtgtgcctgaccaactacggccactgcaactacgtgagcggcaagcacgcctgcatcttctacgacgagaacaccaagcactacgagctgctgaactacagcgagcacggcaccaccgtggacaacgtgctgtacagctgcgacttcagcgagaagaccccccccaccccccccagcagcatcgtggccaaggtgcagagcgtgatcagaagaagaagacaccagaagcaggacgaggagcccagcgaggaggccgccatgatgagcagccaggcccagggcccccagagaagaccctgcaactgcaaggccagcagcagcagcctgatcggcggcagcggcgccggctgggagggcaccgccctgctgcaccacggcagctacatcaagctgggctgcctgcagttcgtgttcagcatcaccgagttcgccaccaagcagcccaagggcgacgccagcctgctgcaggacggcgtgctggccgagaagctgagcctgaagccccaccagggccccgtgctgagaagcaacagcgtgccctag

SEQ ID NO: 8997 - DNA, 2550 bp, Artificial Sequence
  Description of Artificial Sequence: Synthetic coding sequence
atgtgggagaagatggagaccaagaccatcgtgtacgacctggacaccagcggcggcctgatggagcagatccaggccctgctggccccccccaagaccgacgaggccgagaagagaagcagaaagcccgagaaggagcccagaagaagcggcagagccaccaaccacgacagctgcgacagctgcaaggagggcggcgacctgctgtgctgcgaccactgccccgccgccttccacctgctggtgtaccaggacttcgtggcccccatcagcctgttccacggcaccttccacgacggccccacctgcagcttcgcccagaagagagagcagaagaaggagctgggccacgtgaacggcctggtggacaagagcggcaagagaaccaccagccccagcagcgacaccgacctgctggacagaagcgccagcaagaccgagctgaaggccatcgcccacgccagaatcctggagagaagagccagcagacccggcacccccaccagcagcgccagcaccgagacccccaccagcgagcagaacgacgtggacgaggacatcatcgacgtggacgaggagcccgtggccgccgagcccgactacgtgcagccccagctgagaagacccttcgagctgctgatcgccgccgccatggagagaaaccccacccagttccagctgcccaacgagctgacctgcaccaccgccctgcccggcagcagcaagagaagaagaaaggaggagaccaccggcaagaacgtgaagaagacccagcacgagctggaccacaacggcctggtgcccctgcccgtgaaggtgtgcttcacctgcaacagaagctgcagagtggcccccctgatccagtgcgactactgccccctgctgttccacatggactgcctggagccccccctgaccgccatgcccctgggcagatggatgtgccccaaccacatcgagcacgtggtgctgaaccagaagaacatgaccctgagcaacagatgccaggtgttcgacagattccaggacaccgtgagccagcacgtggtgaaggtggacttcctgaacagaatccacaagaagcacccccccaacagaagagtgctgcagagcgtgaagagaagaagcctgaaggtgcccgacgccatcaagagccagtaccagttccccccccccctgatcgcccccgccgccatcagagacggcgagctgatctgcaacggcatccccgaggagagccagatgcacctgctgaacagcgagcacctggccacccaggccgagcagcaggagtggctgtgcagcgtggtggccctgcagtgcagcatcctgaagcacctgagcgccaagcagatgcccagccactgggacagcgagcagaccgagaaggccgacatcaagcccgtgatcgtgaccgacagcagcgtgaccaccagcctgcagaccgccgacaagacccccacccccagccactaccccctgagctgccccagcggcatcagcacccagaacagcctgagctgcagccccccccaccagagccccgccctggaggacatcggctgcagcagctgcgccgagaagagcaagaagaccccctgcggcaccgccaacggccccgtgaacaccgaggtgaaggccaacggcccccacctgtacagcagccccaccgacagcaccgaccccagaagactgcccggcgccaacacccccctgcccggcctgagccacagacagggctggcccagacccctgaccccccccgccgccggcggcctgcagaaccacaccgtgggcatcatcgtgaagaccgagaacgccaccggccccagcagctgcccccagagaagcctggtgcccgtgcccagcctgccccccagcatccccagcagctgcgccagcatcgagaacaccagcaccctgcagagaaagaccgtgcagagccagatcggcccccccctgaccgacagcagacccctgggcagcccccccaacgccaccagagtgctgacccccccccaggccgccggcgacggcatcctggccaccaccgccaaccagagattcagcagccccgcccccagcagcgacggcaaggtgagccccggcaccctgagcatcggcagcgccctgaccgtgcccagcttccccgccaacagcaccgccatggtggacctgaccaacagcctgagagccttcatggacgtgaacggcgagatcgagatcaacatgctggacgagaagctgatcaagttcctggccctgcagagaatccaccagctgttccccagcagagtgcagcccagccccggcagcgtgggcacccaccagctggccagcggcggccaccacatcgagggcgcccacgtgcacacctgccaccacatcatcagaagccccctgtacgtgtgcgagtggagcccctgcctgcacggcgagagcgagctgcccgtgagccagaccagcctgtgcgccttccacggcctgaacaaggccccctggttcttcagcgaggagagcagaaacaagatggccaccaccgccttctag

SEQ ID NO: 8998 - DNA, 903 bp, Artificial Sequence
  Description of Artificial Sequence: Synthetic coding sequence
atggacagcgacagctgcgccgccgccttccaccccgaggagtacagccccagctgcaagagaagaagaaccgtggaggacttcaacaagttctgcaccttcgtgctggcctacgccggctacatcccctaccccaaggaggagctgcccctgagaagcagccccagccccgccaacagcaccgccggcaccatcgacagcgacggctgggacgccggcttcagcgacatcgccagcagcgtgcccctgcccgtgagcgacagatgcttcagccacctgcagcccaccctgctgcagagagccaagcccagcaacttcctgctggacagaaagaagaccgacaagctgaagaagaagaagaagagaaagagaagagacagcgacgcccccggcaaggagggctacagaggcggcctgctgaagctggaggccgccgacccctacgtggagacccccaccagccccaccctgcaggacatcccccaggcccccagcgacccctgcagcggctgggacagcgacacccccagcagcggcagctgcgccaccgtgagccccgaccaggtgaaggagatcaagaccgagggcaagagaaccatcgtgagacagggcaagcaggtggtgttcagagacgaggacagcaccggcaacgacgaggacatcatggtggacagcgacgacgacagctgggacctggtgacctgcttctgcatgaagcccttcgccggcagacccatgatcgagtgcaacgagtgccacacctggatccacctgagctgcgccaagatcagaaagagcaacgtgcccgaggtgttcgtgtgccagaagtgcagagacagcaagttcgacatcagaagaagcaacagaagcagaaccggcagcagaaagctgttcctggactag

SEQ ID NO: 8999 - DNA, 2373 bp, Artificial Sequence
  Description of Artificial Sequence: Synthetic coding sequence
atggaggagaagagaagaaagtacagcatcagcagcgacaacagcgacaccaccgacagccacgccaccagcaccagcgccagcagatgcagcaagctgcccagcagcaccaagagcggctggcccagacagaacgagaagaagcccagcgaggtgttcagaaccgacctgatcaccgccatgaagatccccgacagctaccagctgagccccgacgactactacatcctggccgacccctggagacaggagtgggagaagggcgtgcaggtgcccgccggcgccgaggccatccccgagcccgtggtgagaatcctgccccccctggagggcccccccgcccaggccagccccagcagcaccatgctgggcgagggcagccagcccgactggcccggcggcagcagatacgacctggacgagatcgacgcctactggctggagctgatcaacagcgagctgaaggagatggagagacccgagctggacgagctgaccctggagagagtgctggaggagctggagaccctgtgccaccagaacatggccagagccatcgagacccaggagggcctgggcatcgagtacgacgaggacgtggtgtgcgacgtgtgcagaagccccgagggcgaggacggcaacgagatggtgttctgcgacaagtgcaacgtgtgcgtgcaccaggcctgctacggcatcctgaaggtgcccaccggcagctggctgtgcagaacctgcgccctgggcgtgcagcccaagtgcctgctgtgccccaagagaggcggcgccctgaagcccaccagaagcggcaccaagtgggtgcacgtgagctgcgccctgtggatccccgaggtgagcatcggctgccccgagaagatggagcccatcaccaagatcagccacatccccgccagcagatgggccctgagctgcagcctgtgcaaggagtgcaccggcacctgcatccagtgcagcatgcccagctgcgtgaccgccttccacgtgacctgcgccttcgaccacggcctggagatgagaaccatcctggccgacaacgacgaggtgaagttcaagagcttctgccaggagcacagcgacggcggccccagaaacgagcccaccagcgagcccaccgagcccagccaggccggcgaggacctggagaaggtgaccctgagaaagcagagactgcagcagctggaggaggacttctacgagctggtggagcccgccgaggtggccgagagactggacctggccgaggccctggtggacttcatctaccagtactggaagctgaagagaaaggccaacgccaaccagcccctgctgacccccaagaccgacgaggtggacaacctggcccagcaggagcaggacgtgctgtacagaagactgaagctgttcacccacctgagacaggacctggagagagtgagaaacctgtgctacatggtgaccagaagagagagaaccaagcacgccatctgcaagctgcaggagcagatcttccacctgcagatgaagctgatcgagcaggacctgtgcagaggcctgagcaccagcttccccatcgacggcaccttcttcaacagctggctggcccagagcgtgcagatcaccgccgagaacatggccatgagcgagtggcccctgaacaacggccacagagaggaccccgcccccggcctgctgagcgaggagctgctgcaggacgaggagaccctgctgagcttcatgagagaccccagcctgagacccggcgaccccgccagaaaggccagaggcagaaccagactgcccgccaagaagaagcccccccccccccccccccaggacggccccggcagcagaaccacccccgacaaggcccccaagaagacctggggccaggacgccggcagcggcaagggcggccagggcccccccaccagaaagccccccagaagaaccagcagccacctgcccagcagccccgccgccggcgactgccccatcctggccacccccgagagccccccccccctggcccccgagacccccgacgaggccgccagcgtggccgccgacagcgacgtgcaggtgcccggccccgccgccagccccaagcccctgggcagactgagaccccccagagagagcaaggtgaccagaagactgcccggcgccagacccgacgccggcatgggcccccccagcgccgtggccgagagacccaaggtgagcctgcacttcgacaccgagaccgacggctacttcagcgacggcgagatgagcgacagcgacgtggaggccgaggacggcggcgtgcagagaggccccagagaggccggcgccgaggaggtggtgagaatgggcgtgctggccagctag

SEQ ID NO: 9000 - DNA, 2382 bp, Artificial Sequence
  Description of Artificial Sequence: Synthetic coding sequence
atggaggagaagagaagaaagtacagcatcagcagcgacaacagcgacaccaccgacagccacgccaccagcaccagcgccagcagatgcagcaagctgcccagcagcaccaagagcggctggcccagacagaacgagaagaagcccagcgaggtgttcagaaccgacctgatcaccgccatgaagatccccgacagctaccagctgagccccgacgactactacatcctggccgacccctggagacaggagtgggagaagggcgtgcaggtgcccgccggcgccgaggccatccccgagcccgtggtgagaatcctgccccccctggagggcccccccgcccaggccagccccagcagcaccatgctgggcgagggcagccagcccgactggcccggcggcagcagatacgacctggacgagatcgacgcctactggctggagctgatcaacagcgagctgaaggagatggagagacccgagctggacgagctgaccctggagagagtgctggaggagctggagaccctgtgccaccagaacatggccagagccatcgagacccaggagggcctgggcatcgagtacgacgaggacgtggtgtgcgacgtgtgcagaagccccgagggcgaggacggcaacgagatggtgttctgcgacaagtgcaacgtgtgcgtgcaccaggcctgctacggcatcctgaaggtgcccaccggcagctggctgtgcagaacctgcgccctgggcgtgcagcccaagtgcctgctgtgccccaagagaggcggcgccctgaagcccaccagaagcggcaccaagtgggtgcacgtgagctgcgccctgtggatccccgaggtgagcatcggctgccccgagaagatggagcccatcaccaagatcagccacatccccgccagcagatgggccctgagctgcagcctgtgcaaggagtgcaccggcacctgcatccagtgcagcatgcccagctgcgtgaccgccttccacgtgacctgcgccttcgaccacggcctggagatgagaaccatcctggccgacaacgacgaggtgaagttcaagagcttctgccaggagcacagcgacggcggccccagaaacgagcccaccagcgagcccaccgagcccagccaggccggcgaggacctggagaaggtgaccctgagaaagcagagactgcagcagctggaggaggacttctacgagctggtggagcccgccgaggtggccgagagactggacctggccgaggccctggtggacttcatctaccagtactggaagctgaagagaaaggccaacgccaaccagcccctgctgacccccaagaccgacgaggtggacaacctggcccagcaggagcaggacgtgctgtacagaagactgaagctgttcacccacctgagacaggacctggagagagtgagaaacctgtgctacatggtgaccagaagagagagaaccaagcacgccatctgcaagctgcaggagcagatcttccacctgcagatgaagctgatcgagcaggacctgtgcagagagagaagcggcagaagagccaagggcaagaagagcgacagcaagagaaagggctgcgagggcagcaagggcagcaccgagaagaaggagaaggtgaaggccggccccgacagcgtgctgggccagctggccggcctgagcaccagcttccccatcgacggcaccttcttcaacagctggctggcccagagcgtgcagatcaccgccgagaacatggccatgagcgagtggcccctgaacaacggccacagagaggaccccgcccccggcctgctgagcgaggagctgctgcaggacgaggagaccctgctgagcttcatgagagaccccagcctgagacccggcgaccccgccagaaaggccagaggcagaaccagactgcccgccaagaagaagccccccagaagaaccagcagccacctgcccagcagccccgccgccggcgactgccccatcctggccacccccgagagccccccccccctggcccccgagacccccgacgaggccgccagcgtggccgccgacagcgacgtgcaggtgcccggccccgccgccagccccaagcccctgggcagactgagaccccccagagagagcaaggtgaccagaagactgcccggcgccagacccgacgccggcatgggcccccccagcgccgtggccgagagacccaaggtgagcctgcacttcgacaccgagaccgacggctacttcagcgacggcgagatgagcgacagcgacgtggaggccgaggacggcggcgtgcagagaggccccagagaggccggcgccgaggaggtggtgagaatgggcgtgctggccagctag

SEQ ID NO: 9001 - DNA, 768 bp, Artificial Sequence
  Description of Artificial Sequence: Synthetic coding sequence
atggaggagaagagaagaaagtacagcatcagcagcgacaacagcgacaccaccgacagccacgccaccagcaccagcgccagcagatgcagcaagctgcccagcagcaccaagagcggctggcccagacagaacgagaagaagcccagcgaggtgttcagaaccgacctgatcaccgccatgaagatccccgacagctaccagctgagccccgacgactactacatcctggccgacccctggagacaggagtgggagaagggcgtgcaggtgcccgccggcgccgaggccatccccgagcccgtggtgagaatcctgccccccctggagggcccccccgcccaggccagccccagcagcaccatgctgggcgagggcagccagcccgactggcccggcggcagcagatacgacctggacgagatcgacgcctactggctggagctgatcaacagcgagctgaaggagatggagagacccgagctggacgagctgaccctggagagagtgctggaggagctggagaccctgtgccaccagaacatggccagagccatcgagacccaggagggcctgggcatcgagtacgacgaggacgtggtgtgcgacgtgtgcagaagccccgagggcgaggacggcaacgagatggtgttctgcgacaagtgcaacgtgtgcgtgcaccaggcctgctacggcatcctgaaggtgcccaccggcagctggctgtgcagaacctgcgccctgggcgtgcagcccaagtgcctgtag

SEQ ID NO: 9002 - DNA, 2376 bp, Artificial Sequence
  Description of Artificial Sequence: Synthetic coding sequence
atggaggagaagagaagaaagtacagcatcagcagcgacaacagcgacaccaccgacagccacgccaccagcaccagcgccagcagatgcagcaagctgcccagcagcaccaagagcggctggcccagacagaacgagaagaagcccagcgaggtgttcagaaccgacctgatcaccgccatgaagatccccgacagctaccagctgagccccgacgactactacatcctggccgacccctggagacaggagtgggagaagggcgtgcaggtgcccgccggcgccgaggccatccccgagcccgtggtgagaatcctgccccccctggagggcccccccgcccaggccagccccagcagcaccatgctgggcgagggcagccagcccgactggcccggcggcagcagatacgacctggacgagatcgacgcctactggctggagctgatcaacagcgagctgaaggagatggagagacccgagctggacgagctgaccctggagagagtgctggaggagctggagaccctgtgccaccagaacatggccagagccatcgagacccaggagggcctgggcatcgagtacgacgaggacgtggtgtgcgacgtgtgcagaagccccgagggcgaggacggcaacgagatggtgttctgcgacaagtgcaacgtgtgcgtgcaccaggcctgctacggcatcctgaaggtgcccaccggcagctggctgtgcagaacctgcgccctgggcgtgcagcccaagtgcctgctgtgccccaagagaggcggcgccctgaagcccaccagaagcggcaccaagtgggtgcacgtgagctgcgccctgtggatccccgaggtgagcatcggctgccccgagaagatggagcccatcaccaagatcagccacatccccgccagcagatgggccctgagctgcagcctgtgcaaggagtgcaccggcacctgcatccagtgcagcatgcccagctgcgtgaccgccttccacgtgacctgcgccttcgaccacggcctggagatgagaaccatcctggccgacaacgacgaggtgaagttcaagagcttctgccaggagcacagcgacggcggccccagaaacgagcccaccagcgagcccaccgagcccagccaggccggcgaggacctggagaaggtgaccctgagaaagcagagactgcagcagctggaggaggacttctacgagctggtggagcccgccgaggtggccgagagactggacctggccgaggccctggtggacttcatctaccagtactggaagctgaagagaaaggccaacgccaaccagcccctgctgacccccaagaccgacgaggtggacaacctggcccagcaggagcaggacgtgctgtacagaagactgaagctgttcacccacctgagacaggacctggagagagtgagaaacctgtgctacatggtgaccagaagagagagaaccaagcacgccatctgcaagctgcaggagcagatcttccacctgcagatgaagctgatcgagcaggacctgtgcagagccggcctgagcaccagcttccccatcgacggcaccttcttcaacagctggctggcccagagcgtgcagatcaccgccgagaacatggccatgagcgagtggcccctgaacaacggccacagagaggaccccgcccccggcctgctgagcgaggagctgctgcaggacgaggagaccctgctgagcttcatgagagaccccagcctgagacccggcgaccccgccagaaaggccagaggcagaaccagactgcccgccaagaagaagcccccccccccccccccccaggacggccccggcagcagaaccacccccgacaaggcccccaagaagacctggggccaggacgccggcagcggcaagggcggccagggcccccccaccagaaagccccccagaagaaccagcagccacctgcccagcagccccgccgccggcgactgccccatcctggccacccccgagagccccccccccctggcccccgagacccccgacgaggccgccagcgtggccgccgacagcgacgtgcaggtgcccggccccgccgccagccccaagcccctgggcagactgagaccccccagagagagcaaggtgaccagaagactgcccggcgccagacccgacgccggcatgggcccccccagcgccgtggccgagagacccaaggtgagcctgcacttcgacaccgagaccgacggctacttcagcgacggcgagatgagcgacagcgacgtggaggccgaggacggcggcgtgcagagaggccccagagaggccggcgccgaggaggtggtgagaatgggcgtgctggccagctag

SEQ ID NO: 9003 - DNA, 2553 bp, Artificial Sequence
  Description of Artificial Sequence: Synthetic coding sequence
atggtgcccaccgccgccatcgccgtgggcggctacttcctgggcggcatggaggagaagagaagaaagtacagcatcagcagcgacaacagcgacaccaccgacagccacgccaccagcaccagcgccagcagatgcagcaagctgcccagcagcaccaagagcggctggcccagacagaacgagaagaagcccagcgaggtgttcagaaccgacctgatcaccgccatgaagatccccgacagctaccagctgagccccgacgactactacatcctggccgacccctggagacaggagtgggagaagggcgtgcaggtgcccgccggcgccgaggccatccccgagcccgtggtgagaatcctgccccccctggagggcccccccgcccaggccagccccagcagcaccatgctgggcgagggcagccagcccgactggcccggcggcagcagatacgacctggacgagatcgacgcctactggctggagctgatcaacagcgagctgaaggagatggagagacccgagctggacgagctgaccctggagagagtgctggaggagctggagaccctgtgccaccagaacatggccagagccatcgagacccaggagggcctgggcatcgagtacgacgaggacgtggtgtgcgacgtgtgcagaagccccgagggcgaggacggcaacgagatggtgttctgcgacaagtgcaacgtgtgcgtgcaccaggcctgctacggcatcctgaaggtgcccaccggcagctggctgtgcagaacctgcgccctgggcgtgcagcccaagtgcctgctgtgccccaagagaggcggcgccctgaagcccaccagaagcggcaccaagtgggtgcacgtgagctgcgccctgtggatccccgaggtgagcatcggctgccccgagaagatggagcccatcaccaagatcagccacatccccgccagcagatgggccctgagctgcagcctgtgcaaggagtgcaccggcacctgcatccagtgcagcatgcccagctgcgtgaccgccttccacgtgacctgcgccttcgaccacggcctggagatgagaaccatcctggccgacaacgacgaggtgaagttcaagagcttctgccaggagcacagcgacggcggccccagaaacgagcccaccagcgagcccaccgagcccagccaggccggcgaggacctggagaaggtgaccctgagaaagcagagactgcagcagctggaggaggacttctacgagctggtggagcccgccgaggtggccgagagactggacctggccgaggccctggtggacttcatctaccagtactggaagctgaagagaaaggccaacgccaaccagcccctgctgacccccaagaccgacgaggtggacaacctggcccagcaggagcaggacgtgctgtacagaagactgaagctgttcacccacctgagacaggacctggagagagtgagaaacctgtgctacatggtgaccagaagagagagaaccaagcacgccatctgcaagctgcaggagcagatcttccacctgcagatgaagctgatcgagcaggacctgtgcagagagagaagcggcagaagagccaagggcaagaagagcgacagcaagagaaagggctgcgagggcagcaagggcagcaccgagaagaaggagaaggtgaaggccggccccgacagcgtgctgggccagctggccggcctgagcaccagcttccccatcgacggcaccttcttcaacagctggctggcccagagcgtgcagatcaccgccgagaacatggccatgagcgagtggcccctgaacaacggccacagagaggaccccgcccccggcctgctgagcgaggagctgctgcaggacgaggagaccctgctgagcttcatgagagaccccagcctgagacccggcgaccccgccagaaaggccagaggcagaaccagactgcccgccaagaagaagcccccccccccccccccccaggacggccccggcagcagaaccacccccgacaaggcccccaagaagacctggggccaggacgccggcagcggcaagggcggccagggcccccccaccagaaagccccccagaagaaccagcagccacctgcccagcagccccgccgccggcgactgccccatcctggccacccccgagagccccccccccctggcccccgagacccccgacgaggccgccagcgtggccgccgacagcgacgtgcaggtgcccggccccgccgccagccccaagcccctgggcagactgagaccccccagagagagcaaggtgaccagaagactgcccggcgccagacccgacgccggcatgggcccccccagcgccgtggccgagagacccaaggtgagcctgcacttcgacaccgagaccgacggctacttcagcgacggcgagatgagcgacagcgacgtggaggccgaggacggcggcgtgcagagaggccccagagaggccggcgccgaggaggtggtgagaatgggcgtgctggccagctag

SEQ ID NO: 9004 - DNA, 450 bp, Artificial Sequence
  Description of Artificial Sequence: Synthetic coding sequence
atggaggagaagagaagaaagtacagcatcagcagcgacaacagcgacaccaccgacagccacgccaccagcaccagcgccagcagatgcagcaagctgcccagcagcaccaagagcggctggcccagacagaacgagaagaagcccagcgaggtgttcagaaccgacctgatcaccgccatgaagatccccgacagctaccagctgagccccgacgactactacatcctggccgacccctggagacaggagtgggagaagggcgtgcaggtgcccgccggcgccgaggccatccccgagcccgtggtgagaatcctgccccccctggagggcccccccgcccaggccagccccagcagcaccatgctgggcgagggcagccagcccgactggcccggcggcagcagatacgacctggacgagatcgacgcctactggctggagctgtag

SEQ ID NO: 9005 - DNA, 1053 bp, Artificial Sequence
  Description of Artificial Sequence: Synthetic coding sequence
atgggctgcttcttcagcaagagaagaaaggccgacaaggagagcagacccgagaacgaggaggagagacccaagcagtacagctgggaccagagagagaaggtggaccccaaggactacatgttcagcggcctgaaggacgagaccgtgggcagactgcccggcaccgtggccggccagcagttcctgatccaggactgcgagaactgcaacatctacatcttcgaccacagcgccaccgtgaccatcgacgactgcaccaactgcatcatcttcctgggccccgtgaagggcagcgtgttcttcagaaactgcagagactgcaagtgcaccctggcctgccagcagttcagagtgagagactgcagaaagctggaggtgttcctgtgctgcgccacccagcccatcatcgagagcagcagcaacatcaagttcggctgcttccagtggtactaccccgagctggccttccagttcaaggacgccggcctgagcatcttcaacaacacctggagcaacatccacgacttcacccccgtgagcggcgagctgaactggagcctgctgcccgaggacgccgtggtgcaggactacgtgcccatccccaccaccgaggagctgaaggccgtgagagtgagcaccgaggccaacagaagcatcgtgcccatcagcagaggccagagacagaagagcagcgacgagagctgcctggtggtgctgttcgccggcgactacaccatcgccaacgccagaaagctgatcgacgagatggtgggcaagggcttcttcctggtgcagaccaaggaggtgagcatgaaggccgaggacgcccagagagtgttcagagagaaggcccccgacttcctgcccctgctgaacaagggccccgtgatcgccctggagttcaacggcgacggcgccgtggaggtgtgccagctgatcgtgaacgagatcttcaacggcaccaagatgttcgtgagcgagagcaaggagaccgccagcggcgacgtggacagcttctacaacttcgccgacatccagatgggcatctag

SEQ ID NO: 9006 - DNA, 2472 bp, Artificial Sequence
  Description of Artificial Sequence: Synthetic coding sequence
atgaagagacacagacccgtgagcagcagcgacagcagcgacgagagccccagcaccagcttcaccagcggcagcatgtacagaatcaagagcaagatccccaacgagcacaagaagcccgccgaggtgttcagaaaggacctgatcagcgccatgaagctgcccgacagccaccacatcaaccccgacagctactacctgttcgccgacacctggaaggaggagtgggagaagggcgtgcaggtgcccgccagccccgacaccgtgccccagcccagcctgagaatcatcgccgagaaggtgaaggacgtgctgttcatcagacccagaaagtacatccactgcagcagccccgacaccaccgagcccggctacatcaacatcatggagctggccgccagcgtgtgcagatacgacctggacgacatggacatcttctggctgcaggagctgaacgaggacctggccgagatgggctgcggccccgtggacgagaacctgatggagaagaccgtggaggtgctggagagacactgccacgagaacatgaaccacgccatcgagaccgaggagggcctgggcatcgagtacgacgaggacgtgatctgcgacgtgtgcagaagccccgacagcgaggagggcaacgacatggtgttctgcgacaagtgcaacgtgtgcgtgcaccaggcctgctacggcatcctgaaggtgcccgagggcagctggctgtgcagaagctgcgtgctgggcatctacccccagtgcgtgctgtgccccaagaagggcggcgccctgaagaccaccaagaccggcaccaagtgggcccacgtgagctgcgccctgtggatccccgaggtgagcatcgcctgccccgagagaatggagcccatcaccaagatcagccacatcccccccagcagatgggccctggtgtgcaacctgtgcaagctgaagaccggcgcctgcatccagtgcagcatcaagagctgcatcaccgccttccacgtgacctgcgccttcgagcacggcctggagatgaagaccatcctggacgagggcgacgaggtgaagttcaagagctactgcctgaagcacagccagaacagacagaagctgggcgaggccgagtacccccaccacagagccaaggagcagagccaggccaagagcgagaagaccagcctgagagcccagaagctgagagagctggaggaggagttctacagcctggtgagagtggaggacgtggccgccgagctgggcatgcccaccctggccgtggacttcatctacaactactggaagctgaagagaaagagcaacttcaacaagcccctgttcccccccaaggaggacgaggagaacggcctggtgcagcccaaggaggagagcatccacaccagaatgagaatgttcatgcacctgagacaggacctggagagagtgagaaacctgtgctacatgatcagcagaagagagaagctgaagctgagccacaacaagatccaggagcagatcttcggcctgcaggtgcagctgctgaaccaggagatcgacgccggcctgcccctgaccaacgccctggagaacagcctgttctaccccccccccagaatcaccctgaagctgaagatgcccaagagcacccccgaggaccacagaaacagcagcaccgagaccgaccagcagccccacagccccgacagcagcagcagcgtgcacagcatcagaaacatgcaggtgccccaggagagcctggagatgagaaccaagagctaccccagataccccctggagagcaagaacaacagactgctggccagcctgagccacagcagaagcgaggccaaggagagcagccccgcctggagaacccccagcagcgagtgctaccacggccagagcctgggcaagcccctggtgctgcaggccgccctgcacggccagagcagcatcggcaacggcaagagccagcccaacagcaagttcgccaagagcaacggcctggagggcagctggagcggcaacgtgacccagaaggacagcagcagcgagatgttctgcgaccaggagcccgtgttcagcccccacctggtgagccagggcagcttcagaaagagcaccgtggagcacttcagcagaagcttcaaggagaccaccaacagatgggtgaagaacaccgaggacctgcagtgctacgtgaagcccaccaagaacatgagccccaaggagcagttctggggcagacaggtgctgagaagaagcgccggcagagccccctaccaggagaacgacggctactgccccgacctggagctgagcgacagcgaggccgagagcgacggcaacaaggagaaggtgagagtgagaaaggacagcagcgacagagagaaccccccccacgacagcagaagagactgccacggcaagagcaagacccaccccctgagccacagcagcatgcagagatag

SEQ ID NO: 9007 - DNA, 561 bp, Artificial Sequence
  Description of Artificial Sequence: Synthetic coding sequence
atgaagagacacagacccgtgagcagcagcgacagcagcgacgagagccccagcaccagcttcaccagcggcagcatgtacagaatcaagagcaagatccccaacgagcacaagaagcccgccgaggtgttcagaaaggacctgatcagcgccatgaagctgcccgacagccaccacatcaaccccgacagctactacctgttcgccgacacctggaaggaggagtgggagaagggcgtgcaggtgcccgccagccccgacaccgtgccccagcccagcctgagaatcatcgccgagaaggtgaaggacgtgctgttcatcagacccagaaagtacatccactgcagcagccccgacaccaccgagcccggctacatcaacatcatggagctggccgccagcgtgtgcagatacgacctggacgacatggacatcttctggctgcaggagctgaacgaggacctggccgagatgggctgcggccccgtggacgagaacctgatggagaagaccgtggaggtgctggagagacactgccacgagaacatgaaccacgcctag

SEQ ID NO: 9008 - DNA, 345 bp, Artificial Sequence
  Description of Artificial Sequence: Synthetic coding sequence
atgaagagacacagacccgtgagcagcagcgacagcagcgacgagagccccagcaccagcttcaccagcggcagcatgtacagaatcaagagcaagatccccaacgagcacaagaagcccgccgaggtgttcagaaaggacctgatcagcgccatgaagctgcccgacagccaccacatcaaccccgacagctactacctgttcgccgacacctggaaggaggagtgggagaagggcgtgcaggtgcccgccagccccgacaccgtgccccagcccagcctgagaatcatcgccgagaaggtgaaggacgtgctgttcatcagacccagaaagtacatccactag

SEQ ID NO: 9009 - DNA, 1632 bp, Artificial Sequence
  Description of Artificial Sequence: Synthetic coding sequence
atgaccaagcacccccccaacagaagaggcatcagcttcgaggtgggcgcccagctggaggccagagacagactgaagaactggtaccccgcccacatcgaggacatcgactacgaggagggcaaggtgctgatccacttcaagagatggaaccacagatacgacgagtggttctgctgggacagcccctacctgagacccctggagaagatccagctgagaaaggagggcctgcacgaggaggacggcagcagcgagttccagatcaacgagcaggtgctggcctgctggagcgactgcagattctaccccgccaaggtgaccgccgtgaacaaggacggcacctacaccgtgaagttctacgacggcgtggtgcagaccgtgaagcacatccacgtgaaggccttcagcaaggaccagaacatcgtgggcaacgccagacccaaggagaccgaccacaagagcctgagcagcagccccgacaagagagagaagttcaaggagcagagaaaggccaccgtgaacgtgaagaaggacaaggaggacaagcccctgaagaccgagaagagacccaagcagcccgacaaggagggcaagctgatctgcagcgagaagggcaaggtgagcgagaagagcctgcccaagaacgagaaggaggacaaggagaacatcagcgagaacgacagagagtacagcggcgacgcccaggtggacaagaagcccgagaacgacatcgtgaagagcccccaggagaacctgagagagcccaagagaaagagaggcagaccccccagcatcgcccccaccgccgtggacagcaacagccagaccctgcagcccatcaccctggagctgagaagaagaaagatcagcaagggctgcgaggtgcccctgaagagacccagactggacaagaacagcagccaggagaagagcaagaactacagcgagaacaccgacaaggacctgagcagaagaagaagcagcagactgagcaccaacggcacccacgagatcctggaccccgacctggtggtgagcgacctggtggacaccgaccccctgcaggacaccctgagcagcaccaaggagagcgaggagggccagctgaagagcgccctggaggccggccaggtgagcagcgccctgacctgccacagcttcggcgacggcagcggcgccgccggcctggagctgaactgccccagcatgggcgagaacaccatgaagaccgagcccaccagccccctggtggagctgcaggagatcagcaccgtggaggtgaccaacaccttcaagaagaccgacgacttcggcagcagcaacgcccccgccgtggacctggaccacaagttcagatgcaaggtggtggactgcctgaagttcttcagaaaggccaagctgctgcactaccacatgaagtacttccacggcatggagaagagcctggagcccgaggagagccccggcaagagacacgtgcagaccagaggccccagcgccagcgacaagcccagccaggagaccctgaccagaaagagagtgagcgccagcagccccaccaccaaggacaaggagaagaacaaggagaagaagttcaaggagttcgtgagagtgaagcccaagaagtag

SEQ ID NO: 9010 - DNA, 1650 bp, Artificial Sequence
  Description of Artificial Sequence: Synthetic coding sequence
atgaccaagcacccccccaacagaagaggcatcagcttcgaggtgggcgcccagctggaggccagagacagactgaagaactggtaccccgcccacatcgaggacatcgactacgaggagggcaaggtgctgatccacttcaagagatggaaccacagatacgacgagtggttctgctgggacagcccctacctgagacccctggagaagatccagctgagaaaggagggcctgcacgaggaggacggcagcagcgagttccagatcaacgagcaggtgctggcctgctggagcgactgcagattctaccccgccaaggtgaccgccgtgaacaaggacggcacctacaccgtgaagttctacgacggcgtggtgcagaccgtgaagcacatccacgtgaaggccttcagcaaggaccagaacatcgtgggcaacgccagacccaaggagaccgaccacaagagcctgagcagcagccccgacaagagagagaagttcaaggagcagagaaaggccaccgtgaacgtgaagaaggacaaggaggacaagcccctgaagaccgagaagagacccaagcagcccgacaaggagggcaagctgatctgcagcgagaagggcaaggtgagcgagaagagcctgcccaagaacgagaaggaggacaaggagaacatcagcgagaacgacagagagtacagcggcgacgcccaggtggacaagaagcccgagaacgacatcgtgaagagcccccaggagaacctgagagagcccaagagaaagagaggcagaccccccagcatcgcccccaccgccgtggacagcaacagccagaccctgcagcccatcaccctggagctgagaagaagaaagatcagcaagggctgcgaggtgcccctgaagagacccagactggacaagaacagcagccaggagaagagcaagaactacagcgagaacaccgacaaggacctgagcagaagaagaagcagcagactgagcaccaacggcacccacgagatcctggaccccgacctggtggtgagcgacctggtggacaccgaccccctgcaggacaccctgagcagcaccaaggagagcgaggagggccagctgaagagcgccctggaggccggccaggtgagcagcgccctgacctgccacagcttcggcgacggcagcggcgccgccggcctggagctgaactgccccagcatgggcgagaacaccatgaagaccgagcccaccagccccctggtggagctgcaggagatcagcaccgtggaggtgaccaacaccttcaagaagaccgacgacttcggcagcagcaacgcccccgccgtggacctggaccacaagttcagatgcaaggtggtggactgcctgaagttcttcagaaaggccaagctgctgcactaccacatgaagtacttccacggcatggagaagagcctggagcccgaggagagccccggcaagagacacgtgcagaccagaggccccagcgccagcgacaagcccagccaggagaccctgaccagaaagagagtgagcgccagcagccccaccaccaaggacaaggagaagaacaaggagaagaagttcaaggagttcgtgagagtgaagcccaagaagaagaagaagaagaagaagtag

SEQ ID NO: 9011 - DNA, 3039 bp, Artificial Sequence
  Description of Artificial Sequence: Synthetic coding sequence
atgaccaagcacccccccaacagaagaggcatcagcttcgaggtgggcgcccagctggaggccagagacagactgaagaactggtaccccgcccacatcgaggacatcgactacgaggagggcaaggtgctgatccacttcaagagatggaaccacagatacgacgagtggttctgctgggacagcccctacctgagacccctggagaagatccagctgagaaaggagggcctgcacgaggaggacggcagcagcgagttccagatcaacgagcaggtgctggcctgctggagcgactgcagattctaccccgccaaggtgaccgccgtgaacaaggacggcacctacaccgtgaagttctacgacggcgtggtgcagaccgtgaagcacatccacgtgaaggccttcagcaaggaccagaacatcgtgggcaacgccagacccaaggagaccgaccacaagagcctgagcagcagccccgacaagagagagaagttcaaggagcagagaaaggccaccgtgaacgtgaagaaggacaaggaggacaagcccctgaagaccgagaagagacccaagcagcccgacaaggagggcaagctgatctgcagcgagaagggcaaggtgagcgagaagagcctgcccaagaacgagaaggaggacaaggagaacatcagcgagaacgacagagagtacagcggcgacgcccaggtggacaagaagcccgagaacgacatcgtgaagagcccccaggagaacctgagagagcccaagagaaagagaggcagaccccccagcatcgcccccaccgccgtggacagcaacagccagaccctgcagcccatcaccctggagctgagaagaagaaagatcagcaagggctgcgaggtgcccctgaagagacccagactggacaagaacagcagccaggagaagagcaagaactacagcgagaacaccgacaaggacctgagcagaagaagaagcagcagactgagcaccaacggcacccacgagatcctggaccccgacctggtggtgagcgacctggtggacaccgaccccctgcaggacaccctgagcagcaccaaggagagcgaggagggccagctgaagagcgccctggaggccggccaggtgagcagcgccctgacctgccacagcttcggcgacggcagcggcgccgccggcctggagctgaactgccccagcatgggcgagaacaccatgaagaccgagcccaccagccccctggtggagctgcaggagatcagcaccgtggaggtgaccaacaccttcaagaagaccgacgacttcggcagcagcaacgcccccgccgtggacctggaccacaagttcagatgcaaggtggtggactgcctgaagttcttcagaaaggccaagctgctgcactaccacatgaagtacttccacggcatggagaagagcctggagcccgaggagagccccggcaagagacacgtgcagaccagaggccccagcgccagcgacaagcccagccaggagaccctgaccagaaagagagtgagcgccagcagccccaccaccaaggacaaggagaagaacaaggagaagaagttcaaggagttcgtgagagtgaagcccaagaagaagaagaagaagaagaagaagaccaagcccgagtgcccctgcagcgaggagatcagcgacaccagccaggagcccagcccccccaaggccttcgccgtgaccagatgcggcagcagccacaagcccggcgtgcacatgagcccccagctgcacggccccgagagcggccaccacaagggcaaggtgaaggccctggaggaggacaacctgagcgagagcagcagcgagagcttcctgtggagcgacgacgagtacggccaggacgtggacgtgaccaccaaccccgacgaggagctggacggcgacgacagatacgacttcgaggtggtgagatgcatctgcgaggtgcaggaggagaacgacttcatgatccagtgcgaggagtgccagtgctggcagcacggcgtgtgcatgggcctgctggaggagaacgtgcccgagaagtacacctgctacgtgtgccaggacccccccggccagagacccggcttcaagtactggtacgacaaggagtggctgagcagaggccacatgcacggcctggccttcctggaggagaactacagccaccagaacgccaagaagatcgtggccacccaccagctgctgggcgacgtgcagagagtgatcgaggtgctgcacggcctgcagctgaagatgagcatcctgcagagcagagagcaccccgacctgcccctgtggtgccagccctggaagcagcacagcggcgagggcagaagccacttcagaaacatccccgtgaccgacaccagaagcaaggaggaggcccccagctacagaaccctgaacggcgccgtggagaagcccagacccctggccctgcccctgcccagaagcgtggaggagagctacatcaccagcgagcactgctaccagaagcccagagcctactaccccgccgtggagcagaagctggtggtggagaccagaggcagcgccctggacgacgccgtgaaccccctgcacgagaacggcgacgacagcctgagccccagactgggctggcccctggaccaggacagaagcaagggcgacagcgaccccaagcccggcagccccaaggtgaaggagtacgtgagcaagaaggccctgcccgaggaggcccccgccagaaagctgctggacagaggcggcgagggcctgctgagcagccagcaccagtggcagttcaacctgctgacccacgtggagagcctgcaggacgaggtgacccacagaatggacagcatcgagaaggagctggacgtgctggagagctggctggactacaccggcgagctggagccccccgagcccctggccagactgccccagctgaagcactgcatcaagcagctgctgatggacctgggcaaggtgcagcagatcgccctgtgctgcagcacctag

SEQ ID NO: 9012 - DNA, 819 bp, Artificial Sequence
  Description of Artificial Sequence: Synthetic coding sequence
atgaccaagcacccccccaacagaagaggcatcagcttcgaggtgggcgcccagctggaggccagagacagactgaagaactggtaccccgcccacatcgaggacatcgactacgaggagggcaaggtgctgatccacttcaagagatggaaccacagatacgacgagtggttctgctgggacagcccctacctgagacccctggagaagatccagctgagaaaggagggcctgcacgaggaggacggcagcagcgagttccagatcaacgagcaggtgctggcctgctggagcgactgcagattctaccccgccaaggtgaccgccgtgaacaaggacggcacctacaccgtgaagttctacgacggcgtggtgcagaccgtgaagcacatccacgtgaaggccttcagcaaggaccagaacatcgtgggcaacgccagacccaaggagaccgaccacaagagcctgagcagcagccccgacaagagagagaagttcaaggagcagagaaaggccaccgtgaacgtgaagaaggacaaggaggacaagcccctgaagaccgagaagagacccaagcagcccgacaaggagggcaagctgatctgcagcgagaagggcaaggtgagcgagaagagcctgcccaagaacgagaaggaggacaaggagaacatcagcgagaacgacagagagtacagcggcgacgcccagaagaccagacagacccccttccacagcagctactgctgcggcttcaagctgagcaacttcgccaccaacaacatcggcaccgagaagaaggagaacatcaagagaatgtag

SEQ ID NO: 9013 - DNA, 2289 bp, Artificial Sequence
  Description of Artificial Sequence: Synthetic coding sequence
atggagggccccagaagcagcacccacgtgcccctggtgctgcccctgctggtgctgctgctgctggcccccgccagacaggccgccgcccagagatgcccccaggcctgcatctgcgacaacagcagaagacacgtggcctgcagataccagaacctgaccgaggtgcccgacgccatccccgagctgacccagagactggacctgcagggcaacctgctgaaggtgatccccgccgccgccttccagggcgtgccccacctgacccacctggacctgagacactgcgaggtggagctggtggccgagggcgccttcagaggcctgggcagactgctgctgctgaacctggccagcaaccacctgagagagctgccccaggaggccctggacggcctgggcagcctgagaagactggagctggagggcaacgccctggaggagctgagacccggcaccttcggcgccctgggcgccctggccaccctgaacctggcccacaacgccctggtgtacctgcccgccatggccttccagggcctgctgagagtgagatggctgagactgagccacaacgccctgagcgtgctggcccccgaggccctggccggcctgcccgccctgagaagactgagcctgcaccacaacgagctgcaggccctgcccggccccgtgctgagccaggccagaggcctggccagactggagctgggccacaaccccctgacctacgccggcgaggaggacggcctggccctgcccggcctgagagagctgctgctggacggcggcgccctgcaggccctgggccccagagccttcgcccactgccccagactgcacaccctggacctgagaggcaaccagctggacaccctgccccccctgcagggccccggccagctgagaagactgagactgcagggcaaccccctgtggtgcggctgccaggccagacccctgctggagtggctggccagagccagagtgagaagcgacggcgcctgccagggccccagaagactgagaggcgaggccctggacgccctgagaccctgggacctgagatgccccggcgacgccgcccaggaggaggaggagctggaggagagagccgtggccggccccagagccccccccagaggcccccccagaggccccggcgaggagagagccgtggccccctgccccagagcctgcgtgtgcgtgcccgagagcagacacagcagctgcgagggctgcggcctgcaggccgtgcccagaggcttccccagcgacacccagctgctggacctgagaagaaaccacttccccagcgtgcccagagccgccttccccggcctgggccacctggtgagcctgcacctgcagcactgcggcatcgccgagctggaggccggcgccctggccggcctgggcagactgatctacctgtacctgagcgacaaccagctggccggcctgagcgccgccgccctggagggcgcccccagactgggctacctgtacctggagagaaacagattcctgcaggtgcccggcgccgccctgagagccctgcccagcctgttcagcctgcacctgcaggacaacgccgtggacagactggcccccggcgacctgggcagaaccagagccctgagatgggtgtacctgagcggcaacagaatcaccgaggtgagcctgggcgccctgggccccgccagagagctggagaagctgcacctggacagaaaccagctgagagaggtgcccaccggcgccctggagggcctgcccgccctgctggagctgcagctgagcggcaaccccctgagagccctgagagacggcgccttccagcccgtgggcagaagcctgcagcacctgttcctgaacagcagcggcctggagcagatctgccccggcgccttcagcggcctgggccccggcctgcagagcctgcacctgcagaagaaccagctgagagccctgcccgccctgcccagcctgagccagctggagctgatcgacctgagcagcaaccccttccactgcgactgccagctgctgcccctgcacagatggctgaccggcctgaacctgagagtgggcgccacctgcgccaccccccccaacgccagaggccagagagtgaaggccgccgccgccgtgttcgaggactgccccggctgggccgccagaaaggccaagagaacccccgccagcagacccagcgccagaagaacccccatcaagggcagacagtgcggcgccgacaaggtgggcaaggagaagggcagactgtag

SEQ ID NO: 9014 - DNA, 1146 bp, Artificial Sequence
  Description of Artificial Sequence: Synthetic coding sequence
atgaagaccgtgaaggagaagaaggagtgccagagactgagaaagagcgccaagaccagaagagtgacccagagaaagcccagcagcggccccgtgtgctggctgtgcctgagagagcccggcgaccccgagaagctgggcgagttcctgcagaaggacaacatcagcgtgcactacttctgcctgatcctgagcagcaagctgccccagagaggccagagcaacagaggcttccacggcttcctgcccgaggacatcaagaaggaggccgccagagccagcagaaagatctgcttcgtgtgcaagaagaagggcgccgccatcaactgccagaaggaccagtgcctgagaaacttccacctgccctgcggccaggagagaggctgcctgagccagttcttcggcgagtacaagagcttctgcgacaagcacagacccacccagaacatccagcacggccacgtgggcgaggagagctgcatcctgtgctgcgaggacctgagccagcagagcgtggagaacatccagagcccctgctgcagccaggccatctaccacagaaagtgcatccagaagtacgcccacaccagcgccaagcacttcttcaagtgcccccagtgcaacaacagaaaggagttcccccaggagatgctgagaatgggcatccacatccccgacagagacgccgcctgggagctggagcccggcgccttcagcgacctgtaccagagataccagcactgcgacgcccccatctgcctgtacgagcagggcagagacagcttcgaggacgagggcagatggtgcctgatcctgtgcgccacctgcggcagccacggcacccacagagactgcagcagcctgagaagcaacagcaagaagtgggagtgcgaggagtgcagccccgccgccgccaccgactacatccccgagaacagcggcgacatcccctgctgcagcagcaccttccaccccgaggagcacttctgcagagacaacaccctggaggagaaccccggcctgagctggaccgactggcccgagcccagcctgctggagaagcccgagagcagcagaggcagaagaagctacagctggagaagcaagggcgtgagaatcaccaacagctgcaagaagagcaagtag

SEQ ID NO: 9015 - DNA, 1029 bp, Artificial Sequence
  Description of Artificial Sequence: Synthetic coding sequence
atgaagaccgtgaaggagaagaaggagtgccagagactgagaaagagcgccaagaccagaagagtgacccagagaaagcccagcagcggccccgtgtgctggctgtgcctgagagagcccggcgaccccgagaagctgggcgagttcctgcagaaggacaacatcagcgtgcactacttctgcctgatcctgagcagcaagctgccccagagaggccagagcaacagaggcttccacggcttcctgcccgaggacatcaagaaggaggccgccagagccagcagaaagatctgcttcgtgtgcaagaagaagggcgccgccatcaactgccagaaggaccagtgcctgagaaacttccacctgccctgcggccaggagagaggctgcctgagccagttcttcggcgagtacaagagcttctgcgacaagcacagacccacccagaacatccagcacggccacgtgggcgaggagagctgcatcctgtgctgcgaggacctgagccagcagagcgtggagaacatccagagcccctgctgcagccaggccatctaccacagaaagtgcatccagaagtacgcccacaccagcgccaagcacttcttcaagtgcccccagtgcaacaacagaaaggagttcccccaggagatgctgagaatgggcatccacatccccgacagaagatggtgcctgatcctgtgcgccacctgcggcagccacggcacccacagagactgcagcagcctgagaagcaacagcaagaagtgggagtgcgaggagtgcagccccgccgccgccaccgactacatccccgagaacagcggcgacatcccctgctgcagcagcaccttccaccccgaggagcacttctgcagagacaacaccctggaggagaaccccggcctgagctggaccgactggcccgagcccagcctgctggagaagcccgagagcagcagaggcagaagaagctacagctggagaagcaagggcgtgagaatcaccaacagctgcaagaagagcaagtag

SEQ ID NO: 9016 - DNA, 873 bp, Artificial Sequence
  Description of Artificial Sequence: Synthetic coding sequence
ttcaacagaaagatctgcttcgtgtgcaagaagaagggcgccgccatcaactgccagaaggaccagtgcctgagaaacttccacctgccctgcggccaggagagaggctgcctgagccagttcttcggcgagtacaagagcttctgcgacaagcacagacccacccagaacatccagcacggccacgtgggcgaggagagctgcatcctgtgctgcgaggacctgagccagcagagcgtggagaacatccagagcccctgctgcagccaggccatctaccacagaaagtgcatccagaagtacgcccacaccagcgccaagcacttcttcaagtgcccccagtgcaacaacagaaaggagttcccccaggagatgctgagaatgggcatccacatccccgacagcagagacgccgcctgggagctggagcccggcgccttcagcgacctgtaccagagataccagcactgcgacgcccccatctgcctgtacgagcagggcagagacagcttcgaggacgagggcagatggtgcctgatcctgtgcgccacctgcggcagccacggcacccacagagactgcagcagcctgagaagcaacagcaagaagtgggagtgcgaggagtgcagccccgccgccgccaccgactacatccccgagaacagcggcgacatcccctgctgcagcagcaccttccaccccgaggagcacttctgcagagacaacaccctggaggagaaccccggcctgagctggaccgactggcccgagcccagcctgctggagaagcccgagagcagcagaggcagaagaagctacagctggagaagcaagggcgtgagaatcaccaacagctgcaagaagagcaagtag

SEQ ID NO: 9017 - DNA, 642 bp, Artificial Sequence
  Description of Artificial Sequence: Synthetic coding sequence
atgctgagagagcccggcgaccccgagaagctgggcgagttcctgcagaaggacaacatcagcgtgcactacttctgcctgatcctgagcagcaagctgccccagagaggccagagcaacagaggcagcatggacttctgcctgaagaccagcaagagaagacagcccggcctgctgggcagaagcgccctgtgcgccagaaagagagagctgctgagcaccgccagaagaatcagcgccagcgagaccagcatctgcctggtggccaagaagggcgtggccttccacaacttcctggagagcaccaaccacttcgtgaccaacatcgcccagcacagaaccagcaacatgggcatgtggggcagaaaggccgccagctacgtggtgaagacctaccccaacagagtgctgagaaccagcagagccagagtggtggtgaagcccagcaccaccgccagcgcctacagaaacatgcccacccaccagcagagcatcagcagcaacgtgcacagcgtgaccatcgagagagtgagcagcagaaacgccgagaacggcaacagctacagcagacaggaggtggtgccccacagcgtgtgctacatgagaatccccagaaacccccagggcctgctgctgagctag

SEQ ID NO: 9018 - DNA, 72 bp, Artificial Sequence
  Description of Artificial Sequence: Synthetic coding sequence
atgaagaccgtgaaggagaagaaggagtgccagagactgagaaagagcgccaagaccagaagagtgacctag

SEQ ID NO: 9019 - DNA, 1146 bp, Artificial Sequence; identical to SEQ ID NO: 9014
  Description of Artificial Sequence: Synthetic coding sequence

SEQ ID NO: 9020 - DNA, 1557 bp, Artificial Sequence
  Description of Artificial Sequence: Synthetic coding sequence
atggaccagaccccccccgccagacccgagtacctggtgagcggcatcagaaccccccccgtgagaagaaacagcaagctggccaccctgggcagaatcttcaagccctggaagtggagaaagaagaagaacgagaagctgaagcagaccaccagcgccctggagaagaagatggccggcagacagggcagagaggagctgatcaagaagggcctgctggagatgatggagcaggacgccgagagcaagacctgcaaccccgacggcggccccagaagcgtgcagagcgagccccccacccccaagagcgagaccctgaccagcgaggacgcccagcccggcagccccctggccaccggcaccgaccaggtgagcctggacaagcccctgagcagcgccgcccacctggacgacgccgccaagatgcccagcgccagcagcggcgaggaggccgacgccggcagcctgctgcccaccaccaacgagctgagccaggccctggccggcgccgacagcctggacagcccccccagacccctggagagaagcgtgggccagctgcccagcccccccctgctgcccacccccccccccaaggccagcagcaagaccaccaagaacgtgaccggccaggccaccctgttccaggccagcagcatgaagagcgccgaccccagcctgagaggccagctgagcacccccaccggcagcccccacctgaccaccgtgcacagacccctgccccccagcagagtgatcgaggagctgcacagagccctggccaccaagcacagacaggacagcttccagggcagagagagcaagggcagccccaagaagagactggacgtgagactgagcagaaccagcagcgtggagagaggcaaggagagagaggaggcctggagcttcgacggcgccctggagaacaagagaaccgccgccaaggagagcgaggagaacaaggagaacctgatcatcaacagcgagctgaaggacgacctgctgctgtaccaggacgaggaggccctgaacgacagcatcatcagcggcaccctgcccagaaagtgcaagaaggagctgctggccgtgaagctgagaaacagacccagcaagcaggagctggaggacagaaacatcttccccagaagaaccgacgaggagagacaggagatcagacagcagatcgagatgaagctgagcaagagactgagccagagacccgccgtggaggagctggagagaagaaacatcctgaagcagagaaacgaccagaccgagcaggaggagagaagagagatcaagcagagactgaccagaaagctgaaccagagacccaccgtggacgagctgagagacagaaagatcctgatcagattcagcgactacgtggaggtggccaaggcccaggactacgacagaagagccgacaagccctggaccagactgagcgccgccgacaaggccgccatcagaaaggagctgaacgagtacaagagcaacgagatggaggtgcacgccagcagcaagcacctgaccagattccacagaccctag

SEQ ID NO: 9021 - DNA, 1347 bp, Artificial Sequence
  Description of Artificial Sequence: Synthetic coding sequence
atggaccagaccccccccgccagacccgagtacctggtgagcggcatcagaaccccccccgtgagaagaaacagcaagctggccaccctgggcagaatcttcaagccctggaagtggagaaagaagaagaacgagaagctgaagcagaccaccagcgccctggagaagaagatggccggcagacagggcagagaggagctgatcaagaagggcctgctggagatgatggagcaggacgccgagagcaagacctgcaaccccgacggcggccccagaagcgtgcagagcgagccccccacccccaagagcgagaccctgaccagcgaggacgcccagcccggcagccccctggccaccggcaccgaccaggtgagcctggacaagcccctgagcagcgccgcccacctggacgacgccggccaggccaccctgttccaggccagcagcatgaagagcgccgaccccagcctgagaggccagctgagcacccccaccggcagcccccacctgaccaccgtgcacagacccctgccccccagcagagtgatcgaggagctgcacagagccctggccaccaagcacagacaggacagcttccagggcagagagagcaagggcagccccaagaagagactggacgtgagactgagcagaaccagcagcgtggagagaggcaaggagagagaggaggcctggagcttcgacggcgccctggagaacaagagaaccgccgccaaggagagcgaggagaacaaggagaacctgatcatcaacagcgagctgaaggacgacctgctgctgtaccaggacgaggaggccctgaacgacagcatcatcagcggcaccctgcccagaaagtgcaagaaggagctgctggccgtgaagctgagaaacagacccagcaagcaggagctggaggacagaaacatcttccccagaagaaccgacgaggagagacaggagatcagacagcagatcgagatgaagctgagcaagagactgagccagagacccgccgtggaggagctggagagaagaaacatcctgaagcagagaaacgaccagaccgagcaggaggagagaagagagatcaagcagagactgaccagaaagctgaaccagagacccaccgtggacgagctgagagacagaaagatcctgatcagattcagcgactacgtggaggtggccaaggcccaggactacgacagaagagccgacaagccctggaccagactgagcgccgccgacaaggccgccatcagaaaggagctgaacgagtacaagagcaacgagatggaggtgcacgccagcagcaagcacctgaccagattccacagaccctag

SEQ ID NO: 9022 - DNA, 1680 bp, Artificial Sequence
  Description of Artificial Sequence: Synthetic coding sequence
atggccgccagcgaggacggcagcggctgcctggtgagcagaggcagaagccagagcgaccccagcgtgctgaccgacagcagcgccaccagcagcgccgacgccggcgagaaccccgacgagatggaccagaccccccccgccagacccgagtacctggtgagcggcatcagaaccccccccgtgagaagaaacagcaagctggccaccctgggcagaatcttcaagccctggaagtggagaaagaagaagaacgagaagctgaagcagaccaccagcgccctggagaagaagatggccggcagacagggcagagaggagctgatcaagaagggcctgctggagatgatggagcaggacgccgagagcaagacctgcaaccccgacggcggccccagaagcgtgcagagcgagccccccacccccaagagcgagaccctgaccagcgaggacgcccagcccggcagccccctggccaccggcaccgaccaggtgagcctggacaagcccctgagcagcgccgcccacctggacgacgccgccaagatgcccagcgccagcagcggcgaggaggccgacgccggcagcctgctgcccaccaccaacgagctgagccaggccctggccggcgccgacagcctggacagcccccccagacccctggagagaagcgtgggccagctgcccagcccccccctgctgcccacccccccccccaaggccagcagcaagaccaccaagaacgtgaccggccaggccaccctgttccaggccagcagcatgaagagcgccgaccccagcctgagaggccagctgagcacccccaccggcagcccccacctgaccaccgtgcacagacccctgccccccagcagagtgatcgaggagctgcacagagccctggccaccaagcacagacaggacagcttccagggcagagagagcaagggcagccccaagaagagactggacgtgagactgagcagaaccagcagcgtggagagaggcaaggagagagaggaggcctggagcttcgacggcgccctggagaacaagagaaccgccgccaaggagagcgaggagaacaaggagaacctgatcatcaacagcgagctgaaggacgacctgctgctgtaccaggacgaggaggccctgaacgacagcatcatcagcggcaccctgcccagaaagtgcaagaaggagctgctggccgtgaagctgagaaacagacccagcaagcaggagctggaggacagaaacatcttccccagaagaaccgacgaggagagacaggagatcagacagcagatcgagatgaagctgagcaagagactgagccagagacccgccgtggaggagctggagagaagaaacatcctgaagcagagaaacgaccagaccgagcaggaggagagaagagagatcaagcagagactgaccagaaagctgaaccagagacccaccgtggacgagctgagagacagaaagatcctgatcagattcagcgactacgtggaggtggccaaggcccaggactacgacagaagagccgacaagccctggaccagactgagcgccgccgacaaggccgccatcagaaaggagctgaacgagtacaagagcaacgagatggaggtgcacgccagcagcaagcacctgaccagattccacagaccctag

SEQ ID NO: 9023 - DNA, 1557 bp, Artificial Sequence; identical to SEQ ID NO: 9020
  Description of Artificial Sequence: Synthetic coding sequence

SEQ ID NO: 9024 - DNA, 1347 bp, Artificial Sequence; identical to SEQ ID NO: 9021
  Description of Artificial Sequence: Synthetic coding sequence

SEQ ID NO: 9025 - DNA, 126 bp, Artificial Sequence
  Description of Artificial Sequence: Synthetic coding sequence
atggccgccagcgaggacggcagcggctgcctggtgagcagaggcagaagccagagcgaccccagcgtgctgaccgacagcagcgccaccagcagcgccgacgccggcgagaaccccgacgagtag

SEQ ID NO: 9026 - DNA, 1557 bp, Artificial Sequence; identical to SEQ ID NO: 9020
  Description of Artificial Sequence: Synthetic coding sequence

SEQ ID NO: 9027 - DNA, 2430 bp, Artificial Sequence
  Description of Artificial Sequence: Synthetic coding sequence
atgtacgaggccctgcccggccccgcccccgagaacgaggacggcctggtgaaggtgaaggaggaggaccccacctgggagcaggtgtgcaacagccaggagggcagcagccacacccaggagatctgcagactgagattcagacacttctgctaccaggaggcccacggcccccaggaggccctggcccagctgagagagctgtgccaccagtggctgagacccgagatgcacaccaaggagcagatcatggagctgctggtgctggagcagttcctgaccatcctgcccaaggagctgcagccctgcgtgaagacctaccccctggagagcggcgaggaggccgtgaccgtgctggagaacctggagaccggcagcggcgacaccggccagcaggccagcgtgtacatccagggccaggacatgcaccccatggtggccgagtaccagggcgtgagcctggagtgccagagcctgcagctgctgcccggcatcaccaccctgaagtgcgagcccccccagagaccccagggcaacccccaggaggtgagcggccccgtgccccacggcagcgcccacctgcaggagaagaaccccagagacaaggccgtggtgcccgtgttcaaccccgtgagaagccagaccctggtgaagaccgaggaggagaccgcccaggccgtggccgccgagaagtggagccacctgagcctgaccagaagaaacctgtgcggcaacagcgcccaggagaccgtgatgagcctgagccccatgaccgaggagatcgtgaccaaggacagactgttcaaggccaagcaggagaccagcgaggagatggagcagagcggcgaggccagcggcaagcccaacagagagtgcgccccccagatcccctgcagcacccccatcgccaccgagagaaccgtggcccacctgaacaccctgaaggacagacaccccggcgacctgtgggccagaatgcacatcagcagcctggagtacgccgccggcgacatcaccagaaagggcagaaagaaggacaaggccagagtgagcgagctgctgcagggcctgagcttcagcggcgacagcgacgtggagaaggacaacgagcccgagatccagcccgcccagaagaagctgaaggtgagctgcttccccgagaagagctggaccaagagagacatcaagcccaacttccccagctggagcgccctggacagcggcctgctgaacctgaagagcgagaagctgaaccccgtggagctgttcgagctgttcttcgacgacgagaccttcaacctgatcgtgaacgagaccaacaactacgccagccagaagaacgtgagcctggaggtgaccgtgcaggagatgagatgcgtgttcggcgtgctgctgctgagcggcttcatgagacaccccagaagagagatgtactgggaggtgagcgacaccgaccagaacctggtgagagacgccatcagaagagacagattcgagctgatcttcagcaacctgcacttcgccgacaacggccacctggaccagaaggacaagttcaccaagctgagacccctgatcaagcagatgaacaagaacttcctgctgtacgcccccctggaggagtactactgcttcgacaagagcatgtgcgagtgcttcgacagcgaccagttcctgaacggcaagcccatcagaatcggctacaagatctggtgcggcaccaccacccagggctacctggtgtggttcgagccctaccaggaggagagcaccatgaaggtggacgaggaccccgacctgggcctgggcggcaacctggtgatgaacttcgccgacgtgctgctggagagaggccagtacccctaccacctgtgcttcgacagcttcttcaccagcgtgaagctgctgagcgccctgaagaagaagggcgtgagagccaccggcaccatcagagagaacagaaccgagaagtgccccctgatgaacgtggagcacatgaagaagatgaagagaggctacttcgacttcagaatcgaggagaacaacgagatcatcctgtgcagatggtacggcgacggcatcatcagcctgtgcagcaacgccgtgggcatcgagcccgtgaacgaggtgagctgctgcgacgccgacaacgaggagatcccccagatcagccagcccagcatcgtgaaggtgtacgacgagtgcaaggagggcgtggccaagatggaccagatcatcagcaagtacagagtgagaatcagaagcaagaagtggtacagcatcctggtgagctacatgatcgacgtggccatgaacaacgcctggcagctgcacagagcctgcaaccccggcgccagcctggaccccctggacttcagaagattcgtggcccacttctacctggagcacaacgcccacctgagcgactag

SEQ ID NO: 9028 - DNA, 2430 bp, Artificial Sequence; identical to SEQ ID NO: 9027
  Description of Artificial Sequence: Synthetic coding sequence

SEQ ID NO: 9029 - DNA, 2418 bp, Artificial Sequence
  Description of Artificial Sequence: Synthetic coding sequence
atgtgggaccagggcggccagccctggcagcagtggcccctgaaccagcagcagtggatgcagagcttccagcaccagcaggaccccagccagatcgactgggccgccctggcccaggcctggatcgcccagagagaggccagcggccagcagagcatggtggagcagccccccggcatgatgcccaacggccaggacatgagcaccatggagagcggccccaacaaccacggcaacttccagggcgacagcaacttcaacagaatgtggcagcccgagtggggcatgcaccagcagcccccccaccccccccccgaccagccctggatgccccccacccccggccccatggacatcgtgccccccagcgaggacagcaacagccaggacagcggcgagttcgcccccgacaacagacacatcttcaaccagaacaaccacaacttcggcggcccccccgacaacttcgccgtgggccccgtgaaccagttcgactaccagcacggcgccgccttcggccccccccagggcggcttccaccccccctactggcagcccggcccccccggcccccccgcccccccccagaacagaagagagagacccagcagcttcagagacagacagagaagccccatcgccctgcccgtgaagcaggagcccccccagatcgacgccgtgaagagaagaaccctgcccgcctggatcagagagggcctggagaagatggagagagagaagcagaagaagctggagaaggagagaatggagcagcagagaagccagctgagcaagaaggagaagaaggccaccgaggacgccgagggcggcgacggccccagactgccccagagaagcaagttcgacagcgacgaggaggaggaggacaccgagaacgtggaggccgccagcagcggcaaggtgaccagaagccccagccccgtgccccaggaggagcacagcgaccccgagatgaccgaggaggagaaggagtaccagatgatgctgctgaccaagatgctgctgaccgagatcctgctggacgtgaccgacgaggagatctactacgtggccaaggacgcccacagaaaggccaccaaggcccccgccaagcagctggcccagagcagcgccctggccagcctgaccggcctgggcggcctgggcggctacggcagcggcgacagcgaggacgagagaagcgacagaggcagcgagagcagcgacaccgacgacgaggagctgagacacagaatcagacagaagcaggaggccttctggagaaaggagaaggagcagcagctgctgcacgacaagcagatggaggaggagaagcagcagaccgagagagtgaccaaggagatgaacgagttcatccacaaggagcagaacagcctgagcctgctggaggccagagaggccgacggcgacgtggtgaacgagaagaagagaacccccaacgagaccaccagcgtgctggagcccaagaaggagcacaaggagaaggagaagcagggcagaagcagaagcggcagcagcagcagcggcagcagcagcagcaacagcagaaccagcagcaccagcagcaccgtgagcagcagcagctacagcagcagcagcggcagcagcagaaccagcagcagaagcagcagccccaagagaaagaagagacacagcagaagcagaagccccaccatcaaggccagaagaagcagaagcagaagctacagcagaagaatcaagatcgagagcaacagagccagagtgaagatcagagacagaagaagaagcaacagaaacagcatcgagagagagagaagaagaaacagaagccccagcagagagagaagaagaagcagaagcagaagcagagacagaagaaccaacagagccagcagaagcagaagcagagacagaagaaagatcgacgaccagagaggcaacctgagcggcaacagccacaagcacaagggcgaggccaaggagcaggagagaaagaaggagagaagcagaagcatcgacaaggacagaaagaagaaggacaaggagagagagagagagcaggacaagagaaaggagaagcagaagagagaggagaaggacttcaagttcagcagccaggacgacagactgaagagaaagagagagagcgagagaaccttcagcagaagcggcagcatcagcgtgaagatcatcagacacgacagcagacaggacagcaagaagagcaccaccaaggacagcaagaagcacagcggcagcgacagcagcggcagaagcagcagcgagagccccggcagcagcaaggagaagaaggccaagaagcccaagcacagcagaagcagaagcgtggagaagagccagagaagcggcaagaaggccagcagaaagcacaagagcaagagcagaagcagatag

SEQ ID NO: 9030 - DNA, 2418 bp, Artificial Sequence; identical to SEQ ID NO: 9029
  Description of Artificial Sequence: Synthetic coding sequence

SEQ ID NO: 9031 - DNA, 1830 bp, Artificial Sequence
  Description of Artificial Sequence: Synthetic coding sequence
atggagagcaccgcctaccccctgaacctgagcctgaaggaggaggaggaggaggaggagatccagagcagagagctggaggacggccccgccgacatgcagaaggtgagaatctgcagcgagggcggctgggtgcccgccctgttcgacgaggtggccatctacttcagcgacgaggagtgggaggtgctgaccgagcagcagaaggccctgtacagagaggtgatgagaatgaactacgagaccgtgctgagcctggagttccccttccccaagcccgacatgatcaccagactggagggcgaggaggagagccagaacagcgacgagtggcagctgcagggcggcaccagcgccgagaacgaggagagcgacgtgaagccccccgactggcccaaccccatgaacgccaccagccagttcccccagccccagcacttcgacagcttcggcctgagactgcccagagacatcaccgagctgcccgagtggagcgagggctaccccttctacatggccatgggcttccccggctacgacctgagcgccgacgacatcgccggcaagttccagttcagcagaggcatgagaagaagctacgacgccggcttcaagctgatggtggtggagtacgccgagagcaccaacaactgccaggccgccaagcagttcggcgtgctggagaagaacgtgagagactggagaaaggtgaagccccagctgcagaacgcccacgccatgagaagagccttcagaggccccaagaacggcagattcgccctggtggaccagagagtggccgagtacgtgagatacatgcaggccaagggcgaccccatcaccagagaggccatgcagctgaaggccctggagatcgcccaggagatgaacatccccgagaagggcttcaaggccagcctgggctggtgcagaagaatgatgagaagatacgacctgagcctgagacacaaggtgcccgtgccccagcacctgcccgaggacctgaccgagaagctggtgacctaccagagaagcgtgctggccctgagaagagcccacgactacgaggtggcccagatgggcaacgccgacgagacccccatctgcctggaggtgcccagcagagtgaccgtggacaaccagggcgagaagcccgtgctggtgaagacccccggcagagagaagctgaagatcaccgccatgctgggcgtgctggccgacggcagaaagctgcccccctacatcatcctgagaggcacctacatcccccccggcaagttccccagcggcatggagatcagatgccacagatacggctggatgaccgaggacctgatgcaggactggctggaggtggtgtggagaagaagaaccggcgccgtgcccaagcagagaggcatgctgatcctgaacggcttcagaggccacgccaccgacagcgtgaagaacagcatggagagcatgaacaccgacatggtgatcatccccggcggcctgaccagccagctgcaggtgctggacgtggtggtgtacaagcccctgaacgacagcgtgagagcccagtacagcaactggctgctggccggcaacctggccctgagccccaccggcaacgccaagaagccccccctgggcctgttcctggagtgggtgatggtggcctggaacagcatcagcagcgagagcatcgtgcagggcttcaagaagtgccacatcagcagcaacctggaggaggaggacgacgtgctgtgggagatcgagagcgagctgcccggcggcggcgagccccccaaggactgcgacaccgagagcatggccgagagcaactag

SEQ ID NO: 9032 - DNA, 1830 bp, Artificial Sequence; identical to SEQ ID NO: 9031
  Description of Artificial Sequence: Synthetic coding sequence

SEQ ID NO: 9033 - DNA, 630 bp, Artificial Sequence
  Description of Artificial Sequence: Synthetic coding sequence
atggagagcaccgcctaccccctgaacctgagcctgaaggaggaggaggaggaggaggagatccagagcagagagctggaggacggccccgccgacatgcagaaggtgagaatctgcagcgagggcggctgggtgcccgccctgttcgacgaggtggccatctacttcagcgacgaggagtgggaggtgctgaccgagcagcagaaggccctgtacagagaggtgatgagaatgaactacgagaccgtgctgagcctggagttccccttccccaagcccgacatgatcaccagactggagggcgaggaggagagccagaacagcgacgagtggcagctgcagggcggcaccagcgccgagaacgaggagagcgacgtgaagccccccgactggcccaaccccatgaacgccaccagccagttcccccagccccagcacttcgacagcttcggcctgagactgcccagagacatcaccgagctgcccgagtggagcgagggctaccccttctacatggccatgggcttccccggctacgacctgagcgccgacgacatcgccggcaagttccagttcagcagaggcatgagaagaagctacgacgccggcttcaagctgatggtggtgtag

SEQ ID NO: 9034 - DNA, 1575 bp, Artificial Sequence
  Description of Artificial Sequence: Synthetic coding sequence
atggagttccccttccccaagcccgacatgatcaccagactggagggcgaggaggagagccagaacagcgacgagtggcagctgcagggcggcaccagcgccgagaacgaggagagcgacgtgaagccccccgactggcccaaccccatgaacgccaccagccagttcccccagccccagcacttcgacagcttcggcctgagactgcccagagacatcaccgagctgcccgagtggagcgagggctaccccttctacatggccatgggcttccccggctacgacctgagcgccgacgacatcgccggcaagttccagttcagcagaggcatgagaagaagctacgacgccggcttcaagctgatggtggtggagtacgccgagagcaccaacaactgccaggccgccaagcagttcggcgtgctggagaagaacgtgagagactggagaaaggtgaagccccagctgcagaacgcccacgccatgagaagagccttcagaggccccaagaacggcagattcgccctggtggaccagagagtggccgagtacgtgagatacatgcaggccaagggcgaccccatcaccagagaggccatgcagctgaaggccctggagatcgcccaggagatgaacatccccgagaagggcttcaaggccagcctgggctggtgcagaagaatgatgagaagatacgacctgagcctgagacacaaggtgcccgtgccccagcacctgcccgaggacctgaccgagaagctggtgacctaccagagaagcgtgctggccctgagaagagcccacgactacgaggtggcccagatgggcaacgccgacgagacccccatctgcctggaggtgcccagcagagtgaccgtggacaaccagggcgagaagcccgtgctggtgaagacccccggcagagagaagctgaagatcaccgccatgctgggcgtgctggccgacggcagaaagctgcccccctacatcatcctgagaggcacctacatcccccccggcaagttccccagcggcatggagatcagatgccacagatacggctggatgaccgaggacctgatgcaggactggctggaggtggtgtggagaagaagaaccggcgccgtgcccaagcagagaggcatgctgatcctgaacggcttcagaggccacgccaccgacagcgtgaagaacagcatggagagcatgaacaccgacatggtgatcatccccggcggcctgaccagccagctgcaggtgctggacgtggtggtgtacaagcccctgaacgacagcgtgagagcccagtacagcaactggctgctggccggcaacctggccctgagccccaccggcaacgccaagaagccccccctgggcctgttcctggagtgggtgatggtggcctggaacagcatcagcagcgagagcatcgtgcagggcttcaagaagtgccacatcagcagcaacctggaggaggaggacgacgtgctgtgggagatcgagagcgagctgcccggcggcggcgagccccccaaggactgcgacaccgagagcatggccgagagcaactag

SEQ ID NO: 9035 - DNA, 2211 bp, Artificial Sequence
  Description of Artificial Sequence: Synthetic coding sequence
atgaaggagatgagcgccaacaccgtgctggacagccagagacagcagaagcactacggcatcaccagccccatcagcctggccagccccaaggagatcgaccacatctacacccagaagctgatcgacgccatgaagcccttcggcgtgttcgaggacgaggaggagctgaaccacagactggtggtgctgggcaagctgaacaacctggtgaaggagtggatcagcgacgtgagcgagagcaagaacctgccccccagcgtggtggccaccgtgggcggcaagatcttcaccttcggcagctacagactgggcgtgcacaccaagggcgccgacatcgacgccctgtgcgtggcccccagacacgtggagagaagcgacttcttccagagcttcttcgagaagctgaagcaccaggacggcatcagaaacctgagagccgtggaggacgccttcgtgcccgtgatcaagttcgagttcgacggcatcgagatcgacctggtgttcgccagactggccatccagaccatcagcgacaacctggacctgagagacgacagcagactgagaagcctggacatcagatgcatcagaagcctgaacggctgcagagtgaccgacgagatcctgcacctggtgcccaacaaggagaccttcagactgaccctgagagccgtgaagctgtgggccaagagaagaggcatctacagcaacatgctgggcttcctgggcggcgtgagctgggccatgctggtggccagaacctgccagctgtaccccaacgccgccgccagcaccctggtgcacaagttcttcctggtgttcagcaagtgggagtggcccaaccccgtgctgctgaagcagcccgaggagagcaacctgaacctgcccgtgtgggaccccagagtgaaccccagcgacagataccacctgatgcccatcatcacccccgcctacccccagcagaacagcacctacaacgtgagcaccagcaccagaaccgtgatggtggaggagttcaagcagggcctggccgtgaccgacgagatcctgcagggcaagagcgactggagcaagctgctggagccccccaacttcttccagaagtacagacactacatcgtgctgaccgccagcgccagcaccgaggagaaccacctggagtgggtgggcctggtggagagcaagatcagagtgctggtgggcaacctggagagaaacgagttcatcaccctggcccacgtgaacccccagagcttccccggcaacaaggagcaccacaaggacaacaactacgtgagcatgtggttcctgggcatcatcttcagaagagtggagaacgccgagagcgtgaacatcgacctgacctacgacatccagagcttcaccgacaccgtgtacagacaggccaacaacatcaacatgctgaaggagggcatgaagatcgaggccacccacgtgaagaagaagcagctgcaccactacctgcccgccgagatcctgcagaagaagaagaagcagagcctgagcgacgtgaacagaagcagcggcggcctgcagagcaagagactgagcctggacagcagctgcctggacagcagcagagacaccgacaacggcacccccttcaacagccccgccagcaagagcgacagccccagcgtgggcgagaccgagagaaacagcgccgagcccgccgccgtgatcgtggagaagcccctgagcgtgccccccgcccagggcctgagcatccccgtgatcggcgccaaggtggacagcaccgtgaagaccgtgagcccccccaccgtgtgcaccatccccaccgtggtgggcagaaacgtgatccccagaatcaccaccccccacaaccccgcccagggccagccccacctgaacggcatgagcaacatcaccaagaccgtgacccccaagagaagccacagccccagcatcgacggcacccccaagagactgaaggacgtggagaagttcatcagactggagagcaccttcaaggaccccagaaccgccgaggagagaaagagaaagagcgtggacgccatcggcggcgagagcatgcccatccccaccatcgacaccagcagaaagaagagactgcccagcaaggagctgcccgacagcagcagccccgtgcccgccaacaacatcagagtgatcaagaacagcatcagactgaccctgaacagatag

SEQ ID NO: 9036 - DNA, 1212 bp, Artificial Sequence
  Description of Artificial Sequence: Synthetic coding sequence
atgcccatcatcacccccgcctacccccagcagaacagcacctacaacgtgagcaccagcaccagaaccgtgatggtggaggagttcaagcagggcctggccgtgaccgacgagatcctgcagggcaagagcgactggagcaagctgctggagccccccaacttcttccagaagtacagacactacatcgtgctgaccgccagcgccagcaccgaggagaaccacctggagtgggtgggcctggtggagagcaagatcagagtgctggtgggcaacctggagagaaacgagttcatcaccctggcccacgtgaacccccagagcttccccggcaacaaggagcaccacaaggacaacaactacgtgagcatgtggttcctgggcatcatcttcagaagagtggagaacgccgagagcgtgaacatcgacctgacctacgacatccagagcttcaccgacaccgtgtacagacaggccaacaacatcaacatgctgaaggagggcatgaagatcgaggccacccacgtgaagaagaagcagctgcaccactacctgcccgccgagatcctgcagaagaagaagaagcagagcctgagcgacgtgaacagaagcagcggcggcctgcagagcaagagactgagcctggacagcagctgcctggacagcagcagagacaccgacaacggcacccccttcaacagccccgccagcaagagcgacagccccagcgtgggcgagaccgagagaaacagcgccgagcccgccgccgtgatcgtggagaagcccctgagcgtgccccccgcccagggcctgagcatccccgtgatcggcgccaaggtggacagcaccgtgaagaccgtgagcccccccaccgtgtgcaccatccccaccgtggtgggcagaaacgtgatccccagaatcaccaccccccacaaccccgcccagggccagccccacctgaacggcatgagcaacatcaccaagaccgtgacccccaagagaagccacagccccagcatcgacggcacccccaagagactgaaggacgtggagaaggacgccatcggcggcgagagcatgcccatccccaccatcgacaccagcagaaagaagagactgcccagcaaggagctgcccgacagcagcagccccgtgcccgccaacaacatcagagtgatcaagaacagcatcagactgaccctgaacagatag

SEQ ID NO: 9037 - DNA, 1149 bp, Artificial Sequence
  Description of Artificial Sequence: Synthetic coding sequence
agaaccgtgatggtggaggagttcaagcagggcctggccgtgaccgacgagatcctgcagggcaagagcgactggagcaagctgctggagccccccaacttcttccagaagtacagacactacatcgtgctgaccgccagcgccagcaccgaggagaaccacctggagtgggtgggcctggtggagagcaagatcagagtgctggtgggcaacctggagagaaacgagttcatcaccctggcccacgtgaacccccagagcttccccggcaacaaggagcaccacaaggacaacaactacgtgagcatgtggttcctgggcatcatcttcagaagagtggagaacgccgagagcgtgaacatcgacctgacctacgacatccagagcttcaccgacaccgtgtacagacaggccaacaacatcaacatgctgaaggagggcatgaagatcgaggccacccacgtgaagaagaagcagctgcaccactacctgcccgccgagatcctgcagaagaagaagaagcagagcctgagcgacgtgaacagaagcagcggcggcctgcagagcaagagactgagcctggacagcagctgcctggacagcagcagagacaccgacaacggcacccccttcaacagccccgccagcaagagcgacagccccagcgtgggcgagaccgagagaaacagcgccgagcccgccgccgtgatcgtggagaagcccctgagcgtgccccccgcccagggcctgagcatccccgtgatcggcgccaaggtggacagcaccgtgaagaccgtgagcccccccaccgtgtgcaccatccccaccgtggtgggcagaaacgtgatccccagaatcaccaccccccacaaccccgcccagggccagccccacctgaacggcatgagcaacatcaccaagaccgtgacccccaagagaagccacagccccagcatcgacggcacccccaagagactgaaggacgtggagaaggacgccatcggcggcgagagcatgcccatccccaccatcgacaccagcagaaagaagagactgcccagcaaggagctgcccgacagcagcagccccgtgcccgccaacaacatcagagtgatcaagaacagcatcagactgaccctgaacagatag

SEQ ID NO: 9038 - DNA, 642 bp, Artificial Sequence
  Description of Artificial Sequence: Synthetic coding sequence
atggccgtgctgagcgcccccggcctgagaggcttcagaatcctgggcctgagaagcagcgtgggccccgccgtgcaggccagaggcgtgcaccagagcgtggccaccgacggccccagcagcacccagcccgccctgcccaaggccagagccgtggcccccaagcccagcagcagaggcgagtacgtggtggccaagctggacgacctggtgaactgggccagaagaagcagcctgtggcccatgaccttcggcctggcctgctgcgccgtggagatgatgcacatggccgcccccagatacgacatggacagattcggcgtggtgttcagagccagccccagacagagcgacgtgatgatcgtggccggcaccctgaccaacaagatggcccccgccctgagaaaggtgtacgaccagatgcccgagcccagatacgtggtgagcatgggcagctgcgccaacggcggcggctactaccactacagctacagcgtggtgagaggctgcgacagaatcgtgcccgtggacatctacatccccggctgcccccccaccgccgaggccctgctgtacggcatcctgcagctgcagagaaagatcaagagagagagaagactgcagatctggtacagaagatag

SEQ ID NO: 9039 - DNA, 1035 bp, Artificial Sequence
  Description of Artificial Sequence: Synthetic coding sequence
atgcacagaaccaccagaatcaagatcaccgagctgaacccccacctgatgtgcgccctgtgcggcggctacttcatcgacgccaccaccatcgtggagtgcctgcacagcttctgcaagacctgcatcgtgagatacctggagaccaacaagtactgccccatgtgcgacgtgcaggtgcacaagaccagacccctgctgagcatcagaagcgacaagaccctgcaggacatcgtgtacaagctggtgcccggcctgttcaaggacgagatgaagagaagaagagacttctacgccgcctaccccctgaccgaggtgcccaacggcagcaacgaggacagaggcgaggtgctggagcaggagaagggcgccctgagcgacgacgagatcgtgagcctgagcatcgagttctacgagggcgccagagacagagacgagaagaagggccccctggagaacggcgacggcgacaaggagaagaccggcgtgagattcctgagatgccccgccgccatgaccgtgatgcacctggccaagttcctgagaaacaagatggacgtgcccagcaagtacaaggtggaggtgctgtacgaggacgagcccctgaaggagtactacaccctgatggacatcgcctacatctacccctggagaagaaacggccccctgcccctgaagtacagagtgcagcccgcctgcaagagactgaccctggccaccgtgcccacccccagcgagggcaccaacaccagcggcgccagcgagtgcgagagcgtgagcgacaaggcccccagccccgccaccctgcccgccaccagcagcagcctgcccagccccgccacccccagccacggcagccccagcagccacggcccccccgccacccaccccaccagccccaccccccccagcaccgccagcggcgccaccaccgccgccaacggcggcagcctgaactgcctgcagacccccagcagcaccagcagaggcagaaagatgaccgtgaacggcgcccccgtgccccccctgacctag

SEQ ID NO: 9040 - DNA, 729 bp, Artificial Sequence
  Description of Artificial Sequence: Synthetic coding sequence
atgctgaccagaaagatcaagctgtgggacatcaacgcccacatcacctgcagactgtgcagcggctacctgatcgacgccaccaccgtgaccgagtgcctgcacaccttctgcagaagctgcctggtgaagtacctggaggagaacaacacctgccccacctgcagaatcgtgatccaccagagccaccccctgcagtacatcggccacgacagaaccatgcaggacatcgtgtacaagctggtgcccggcctgcaggaggccgagatgagaaagcagagagagttctaccacaagctgggcatggaggtgcccggcgacatcaagggcgagacctgcagcgccaagcagcacctggacagccacagaaacggcgagaccaaggccgacgacagcagcaacaaggaggccgccgaggagaagcccgaggaggacaacgactaccacagaagcgacgagcaggtgagcatctgcctggagtgcaacagcagcaagctgagaggcctgaagagaaagtggatcagatgcagcgcccaggccaccgtgctgcacctgaagaagttcatcgccaagaagctgaacctgagcagcttcaacgagctggacatcctgtgcaacgaggagatcctgggcaaggaccacaccctgaagttcgtggtggtgaccagatggagattcaagaaggcccccctgctgctgcactacagacccaagatggacctgctgtag

SEQ ID NO: 9041 - DNA, 123 bp, Artificial Sequence
  Description of Artificial Sequence: Synthetic coding sequence
atgctgaccagaaagatcaagctgtgggacatcaacgcccacatcacctgcagactgtgcagcggctacctgatcgacgccaccaccgtgaccgagtgcctgcacaccttctgcagaagctag

SEQ ID NO: 9042 - DNA, 189 bp, Artificial Sequence
  Description of Artificial Sequence: Synthetic coding sequence
atgctgaccagaaagatcaagctgtgggacatcaacgcccacatcacctgcagactgtgcagcggctacctgatcgacgccaccaccgtgaccgagtgcctgcacaccttctgcagaagctgcctggtgaagtacctggaggagaacaacacctgccccacctgcagaatcgtgatccaccagagctag

SEQ ID NO: 9043 - DNA, 330 bp, Artificial Sequence
  Description of Artificial Sequence: Synthetic coding sequence
atgctgaccagaaagatcaagctgtgggacatcaacgcccacatcacctgcagactgtgcagcggctacctgatcgacgccaccaccgtgaccgagtgcctgcacaccttctgcagaagctgcctggtgaagtacctggaggagaacaacacctgccccacctgcagaatcgtgatccaccagagccaccccctgcagtacatcggccacgacagaaccatgcaggacatcgtgtacaagctggtgcccggcctgcaggaggccgagatgagaaagcagagagagttctaccacaagctgggcatggaggtgcccggcgacatcaagtag

SEQ ID NO: 9044 - DNA, 729 bp, Artificial Sequence; identical to SEQ ID NO: 9040
  Description of Artificial Sequence: Synthetic coding sequence

SEQ ID NO: 9045 - DNA, 729 bp, Artificial Sequence; identical to SEQ ID NO: 9040
  Description of Artificial Sequence: Synthetic coding sequence

SEQ ID NO: 9046 - DNA, 627 bp, Artificial Sequence
  Description of Artificial Sequence: Synthetic coding sequence
atgaccgtgtgcagaagctgcctggtgaagtacctggaggagaacaacacctgccccacctgcagaatcgtgatccaccagagccaccccctgcagtacatcggccacgacagaaccatgcaggacatcgtgtacaagctggtgcccggcctgcaggaggccgagatgagaaagcagagagagttctaccacaagctgggcatggaggtgcccggcgacatcaagggcgagacctgcagcgccaagcagcacctggacagccacagaaacggcgagaccaaggccgacgacagcagcaacaaggaggccgccgaggagaagcccgaggaggacaacgactaccacagaagcgacgagcaggtgagcatctgcctggagtgcaacagcagcaagctgagaggcctgaagagaaagtggatcagatgcagcgcccaggccaccgtgctgcacctgaagaagttcatcgccaagaagctgaacctgagcagcttcaacgagctggacatcctgtgcaacgaggagatcctgggcaaggaccacaccctgaagttcgtggtggtgaccagatggagattcaagaaggcccccctgctgctgcactacagacccaagatggacctgctgtag

SEQ ID NO: 9047 - DNA, 3015 bp, Artificial Sequence
  Description of Artificial Sequence: Synthetic coding sequence
atggagaccgagagcgagcagaacagcaacagcaccaacggcagcagcagcagcggcggcagcagcagaccccagatcgcccagatgagcctgtacgagagacaggccgtgcaggccctgcaggccctgcagagacagcccaacgccgcccagtacttccaccagttcatgctgcagcagcagctgagcaacgcccagctgcacagcctggccgccgtgcagcaggccaccatcgccgccagcagacaggccagcagccccaacaccagcaccacccagcagcagaccaccaccacccaggccagcatcaacctggccaccaccagcgccgcccagctgatcagcagaagccagagcgtgagcagccccagcgccaccaccctgacccagagcgtgctgctgggcaacaccaccagcccccccctgaaccagagccaggcccagatgtacctgagaccccagctgggcaacctgctgcaggtgaacagaaccctgggcagaaacgtgcccctggccagccagctgatcctgatgcccaacggcgccgtggccgccgtgcagcaggaggtgcccagcgcccagagccccggcgtgcacgccgacgccgaccaggtgcagaacctggccgtgagaaaccagcaggccagcgcccagggcccccagatgcagggcagcacccagaaggccatcccccccggcgccagccccgtgagcagcctgagccaggccagcagccaggccctggccgtggcccaggccagcagcggcgccaccaaccagagcctgaacctgagccaggccggcggcggcagcggcaacagcatccccggcagcatgggccccggcggcggcggccaggcccacggcggcctgggccagctgcccagcagcggcatgggcggcggcagctgccccagaaagggcaccggcgtggtgcagcccctgcccgccgcccagaccgtgaccgtgagccagggcagccagaccgaggccgagagcgccgccgccaagaaggccgaggccgacggcagcggccagcagaacgtgggcatgaacctgaccagaaccgccacccccgcccccagccagaccctgatcagcagcgccacctacacccagatccagccccacagcctgatccagcagcagcagcagatccacctgcagcagaagcaggtggtgatccagcagcagatcgccatccaccaccagcagcagttccagcacagacagagccagctgctgcacaccgccacccacctgcagctggcccagcagcagcagcagcagcagcagcagcagcagcagcagcagcagccccaggccaccaccctgaccgccccccagcccccccaggtgccccccacccagcaggtgccccccagccagagccagcagcaggcccagaccctggtggtgcagcccatgctgcagagcagccccctgagcctgccccccgacgccgcccccaagccccccatccccatccagagcaagccccccgtggcccccatcaagcccccccagctgggcgccgccaagatgagcgccgcccagcagccccccccccacatccccgtgcaggtggtgggcaccagacagcccggcaccgcccaggcccaggccctgggcctggcccagctggccgccgccgtgcccaccagcagaggcatgcccggcaccgtgcagagcggccaggcccacctggccagcagcccccccagcagccaggcccccggcgccctgcaggagtgcccccccaccctggcccccggcatgaccctggcccccgtgcagggcaccgcccacgtggtgaagggcggcgccaccaccagcagccccgtggtggcccaggtgcccgccgccttctacatgcagagcgtgcacctgcccggcaagccccagaccctggccgtgaagagaaaggccgacagcgaggaggagagagacgacgtgagcaccctgggcagcatgctgcccgccaaggccagccccgtggccgagagccccaaggtgatggacgagaagagcagcctgggcgagaaggccgagagcgtggccaacgtgaacgccaacacccccagcagcgagctggtggccctgacccccgcccccagcgtgcccccccccaccctggccatggtgagcagacagatgggcgacagcaagcccccccaggccatcgtgaagccccagatcctgacccacatcatcgagggcttcgtgatccaggagggcgccgagcccttccccgtgggctgcagccagctgctgaaggagagcgagaagcccctgcagaccggcctgcccaccggcctgaccgagaaccagagcggcggccccctgggcgtggacagccccagcgccgagctggacaagaaggccaacctgctgaagtgcgagtactgcggcaagtacgcccccgccgagcagttcagaggcagcaagagattctgcagcatgacctgcgccaagagatacaacgtgagctgcagccaccagttcagactgaagagaaagaagatgaaggagttccaggaggccaactacgccagagtgagaagaagaggccccagaagaagcagcagcgacatcgccagagccaagatccagggcaagtgccacagaggccaggaggacagcagcagaggcagcgacaacagcagctacgacgaggccctgagccccaccagccccggccccctgagcgtgagagccggccacggcgagagagacctgggcaaccccaacaccgccccccccacccccgagctgcacggcatcaaccccgtgttcctgagcagcaaccccagcagatggagcgtggaggaggtgtacgagttcatcgccagcctgcagggctgccaggagatcgccgaggagttcagaagccaggagatcgacggccaggccctgctgctgctgaaggaggagcacctgatgagcgccatgaacatcaagctgggccccgccctgaagatctgcgccaagatcaacgtgctgaaggagacctag

SEQ ID NO: 9048 - DNA, 1833 bp, Artificial Sequence
  Description of Artificial Sequence: Synthetic coding sequence
atgcagggcagcacccagaaggccatcccccccggcgccagccccgtgagcagcctgagccaggccagcagccaggccctggccgtggcccaggccagcagcggcgccaccaaccagagcctgaacctgagccaggccggcggcggcagcggcaacagcatccccggcagcatgggccccggcggcggcggccaggcccacggcggcctgggccagctgcccagcagcggcatgggcggcggcagctgccccagaaagggcaccggcgtggtgcagcccctgcccgccgcccagaccgtgaccgtgagccagggcagccagaccgaggccgagagcgccgccgccaagaaggccgaggccgacggcagcggccagcagaacgtgggcatgaacctgaccagaaccgccacccccgcccccagccagaccctgatcagcagcgccacctacacccagatccagccccacagcctgatccagcagcagcagcagatccacctgcagcagaagcaggtggtgatccagcagcagatcgccatccaccaccagcagcagttccagcacagacagagccagctgctgcacaccgccacccacctgcagctggcccagcagcagcagcagcagcagcagcagcagcagcagcagcagcagccccaggccaccaccctgaccgccccccagcccccccaggtgccccccacccagcagggcaagccccagaccctggccgtgaagagaaaggccgacagcgaggaggagagagacgacgtgagcaccctgggcagcatgctgcccgccaaggccagccccgtggccgagagccccaaggtgatggacgagaagagcagcctgggcgagaaggccgagagcgtggccaacgtgaacgccaacacccccagcagcgagctggtggccctgacccccgcccccagcgtgcccccccccaccctggccatggtgagcagacagatgggcgacagcaagcccccccaggccatcgtgaagccccagatcctgacccacatcatcgagggcttcgtgatccaggagggcgccgagcccttccccgtgggctgcagccagctgctgaaggagagcgagaagcccctgcagaccggcctgcccaccggcctgaccgagaaccagagcggcggccccctgggcgtggacagccccagcgccgagctggacaagaaggccaacctgctgaagtgcgagtactgcggcaagtacgcccccgccgagcagttcagaggcagcaagagattctgcagcatgacctgcgccaagagatacaacgtgagctgcagccaccagttcagactgaagagaaagaagatgaaggagttccaggaggccaactacgccagagtgagaagaagaggccccagaagaagcagcagcgacatcgccagagccaagatccagggcaagtgccacagaggccaggaggacagcagcagaggcagcgacaacagcagctacgacgaggccctgagccccaccagccccggccccctgagcgtgagagccggccacggcgagagagacctgggcaaccccaacaccgccccccccacccccgagctgcacggcatcaaccccgtgttcctgagcagcaaccccagcagatggagcgtggaggaggtgtacgagttcatcgccagcctgcagggctgccaggagatcgccgaggagttcagaagccaggagatcgacggccaggccctgctgctgctgaaggaggagcacctgatgagcgccatgaacatcaagctgggccccgccctgaagatctgcgccaagatcaacgtgctgaaggagacctag

SEQ ID NO: 9049 - DNA, 519 bp, Artificial Sequence
  Description of Artificial Sequence: Synthetic coding sequence
atggagaccgagagcgagcagaacagcaacagcaccaacggcagcagcagcagcggcggcagcagcagaccccagatcgcccagatgagcctgtacgagagacaggccgtgcaggccctgcaggccctgcagagacagcccaacgccgcccagtacttccaccagttcatgctgcagcagcagctgagcaacgcccagctgcacagcctggccgccgtgcagcaggccaccatcgccgccagcagacaggccagcagccccaacaccagcaccacccagcagcagaccaccaccacccaggccagcatcaacctggccaccaccagcgccgcccagctgatcagcagaagccagagcgtgagcagccccagcgccaccaccctgacccagagcgtgctgctgggcaacaccaccagcccccccctgaaccagagccaggcccagatgtacctgagaccccagctgggcaacctgctgcaggtgaacagaaccctgggcagaaacgtgcccctggcctag

SEQ ID NO: 9050 - DNA, 3015 bp, Artificial Sequence; identical to SEQ ID NO: 9047
  Description of Artificial Sequence: Synthetic coding sequence

SEQ ID NO: 9051 - DNA, 3015 bp, Artificial Sequence; identical to SEQ ID NO: 9047
  Description of Artificial Sequence: Synthetic coding sequence

SEQ ID NO: 9052 - DNA, 2577 bp, Artificial Sequence
  Description of Artificial Sequence: Synthetic coding sequence
atggagaacgagctgcccgtgccccacaccagcagcagcgcctgcgccaccagcagcaccagcggcgccagcagcagcagcggctgcaacaacagcagcagcggcggcagcggcagacccaccggcccccagatcagcgtgtacagcggcatccccgacagacagaccgtgcaggtgatccagcaggccctgcacagacagcccagcaccgccgcccagtacctgcagcagatgtacgccgcccagcagcagcacctgatgctgcagaccgccgccctgcagcagcagcacctgagcagcgcccagctgcagagcctggccgccgtgcagcaggccagcctggtgagcaacagacagggcagcaccagcggcagcaacgtgagcgcccaggcccccgcccagagcagcagcatcaacctggccgccagccccgccgccgcccagctgctgaacagagcccagagcgtgaacagcgccgccgccagcggcatcgcccagcaggccgtgctgctgggcaacaccagcagccccgccctgaccgccagccaggcccagatgtacctgagagcccagatgctgatcttcacccccaccgccaccgtggccaccgtgcagcccgagctgggcaccggcagccccgccagaccccccacccccgcccaggtgcagaacctgaccctgagaacccagcagacccccgccgccgccgccagcggccccacccccacccagcccgtgctgcccagcctggccctgaagcccacccccggcggcagccagcccctgcccacccccgcccagagcagaaacaccgcccaggccagccccgccggcgccaagcccggcatcgccgacagcgtgatggagccccacaagaagggcgacggcaacagcagcgtgcccggcagcatggagggcagagccggcctgagcagaaccgtgcccgccgtggccgcccaccccctgatcgcccccgcctacgcccagctgcagccccaccagctgctgccccagcccagcagcaagcacctgcagccccagttcgtgatccagcagcagccccagccccagcagcagcagccccccccccagcagagcagacccgtgctgcaggccgagccccacccccagctggccagcgtgagccccagcgtggccctgcagcccagcagcgaggcccacgccatgcccctgggccccgtgacccccgccctgcccctgcagtgccccaccgccaacctgcacaagcccggcggcagccagcagtgccacccccccacccccgacaccggcccccagaacggccaccccgagggcgtgccccacaccccccagagaagattccagcacaccagcgccgtgatcctgcagctgcagcccgccagccccccccagcagtgcgtgcccgacgactggaaggaggtggcccccggcgagaagagcgtgcccgagaccagaagcggccccagcccccaccagcaggccatcgtgaccgccatgcccggcggcctgcccgtgcccaccagccccaacatccagcccagccccgcccacgagaccggccagggcatcgtgcacgccctgaccgacctgagcagccccggcatgaccagcggcaacggcaacagcgccagcagcatcgccggcaccgccccccagaacggcgagaacaagcccccccaggccatcgtgaagccccagatcctgacccacgtgatcgagggcttcgtgatccaggagggcgccgagcccttccccgtgggcagaagcagcctgctggtgggcaacctgaagaagaagtacgcccagggcttcctgcccgagaagctgccccagcaggaccacaccaccaccaccgacagcgagatggaggagccctacctgcaggagagcaaggaggagggcgcccccctgaagctgaagtgcgagctgtgcggcagagtggacttcgcctacaagttcaagagaagcaagagattctgcagcatggcctgcgccaagagatacaacgtgggctgcaccaagagagtgggcctgttccacagcgacagaagcaagctgcagaaggccggcgccgccacccacaacagaagaagagccagcaaggccagcctgccccccctgaccaaggacaccaagaagcagcccaccggcaccgtgcccctgagcgtgaccgccgccctgcagctgacccacagccaggaggacagcagcagatgcagcgacaacagcagctacgaggagcccctgagccccatcagcgccagcagcagcaccagcagaagaagacagggccagagagacctggagctgcccgacatgcacatgagagacctggtgggcatgggccaccacttcctgcccagcgagcccaccaagtggaacgtggaggacgtgtacgagttcatcagaagcctgcccggctgccaggagatcgccgaggagttcagagcccaggagatcgacggccaggccctgctgctgctgaaggaggaccacctgatgagcgccatgaacatcaagctgggccccgccctgaagatctacgccagaatcagcatgctgaaggacagctag

SEQ ID NO: 9053 - DNA, 1305 bp, Artificial Sequence
  Description of Artificial Sequence: Synthetic coding sequence
tgcctgagaggcggctgcagccccagagcccccgccgccagagccagacagcccagacccccccccgccctgccccccagacccagagcccccgtgcccgccagcagacccggcagacccctgctgacccccgccagaccctgcggcagaatgagaagaggcagccccggccccagactgggcggcagcagaggcgagagaagacccgccagagccagagaccccgccagagtgggccccggcgagggcctgagaagacccgccagacccggccccgccggcccctggaccgagaccggccagggcatcgtgcacgccctgaccgacctgagcagccccggcatgaccagcggcaacggcaacagcgccagcagcatcgccggcaccgccccccagaacggcgagaacaagcccccccaggccatcgtgaagccccagatcctgacccacgtgatcgagggcttcgtgatccaggagggcgccgagctgagcagatgggacgccagactgctggtgggcaacctgaagaagaagtacgcccagggcttcctgcccgagaagctgccccagcaggaccacaccaccaccaccgacagcgagatggaggagccctacctgcaggagagcaaggaggagggcgcccccctgaagctgaagtgcgagctgtgcggcagagtggacttcgcctacaagttcaagagaagcaagagattctgcagcatggcctgcgccaagagatacaacgtgggctgcaccaagagagtgggcctgttccacagcgacagaagcaagctgcagaaggccggcgccgccacccacaacagaagaagacccgccaagcccgtgtgccaccacctgcccagaatccccagaagcagccagcaggccctgtgccccttcagactgctgctgctgtgcctgacccacagccaggaggacagcagcagatgcagcgacaacagcagctacgaggagcccctgagccccatcagcgccagcagcagcaccagcgccggcgacaaggccagcggcacctggagcagccccacctgcatctgcggcacctggtgggcctgggacaccaccagctgccaggtgagccaccaggtgaacgtggaggacgtgtacgagttcatcagaagcctgcccggctgccaggagatcgccgaggagttcagagcccaggagatcgacggccaggccctgctgctgctgaaggaggaccacctgatgagcgccatgaacatcaagctgggccccgccctgaagatctacgccagaatcagcatgctgaaggacagctag

SEQ ID NO: 9054 - DNA, 954 bp, Artificial Sequence
  Description of Artificial Sequence: Synthetic coding sequence
atgaccagcggcaacggcaacagcgccagcagcatcgccggcaccgccccccagaacggcgagaacaagcccccccaggccatcgtgaagccccagatcctgacccacgtgatcgagggcttcgtgatccaggagggcgccgagcccttccccgtgggcagaagcagcctgctggtgggcaacctgaagaagaagtacgcccagggcttcctgcccgagaagctgccccagcaggaccacaccaccaccaccgacagcgagatggaggagccctacctgcaggagagcaaggaggagggcgcccccctgaagctgaagtgcgagctgtgcggcagagtggacttcgcctacaagttcaagagaagcaagagattctgcagcatggcctgcgccaagagatacaacgtgggctgcaccaagagagtgggcctgttccacagcgacagaagcaagctgcagaaggccggcgccgccacccacaacagaagaagagccagcaaggccagcctgccccccctgaccaaggacaccaagaagcagcccaccggcaccgtgcccctgagcgtgaccgccgccctgcagctgacccacagccaggaggacagcagcagatgcagcgacaacagcagctacgaggagcccctgagccccatcagcgccagcagcagcaccagcagaagaagacagggccagagagacctggagctgcccgacatgcacatgagagacctggtgggcatgggccaccacttcctgcccagcgagcccaccaagtggaacgtggaggacgtgtacgagttcatcagaagcctgcccggcctgcccagcagcttccccaagggccacgagaccagcatctacagcctgagcaagcacctgagacacagcagattcccccagagccccagcggcagctgcctgtggcccgtgctgagacccagaccccacctgtag

SEQ ID NO: 9055 - DNA, 972 bp, Artificial Sequence
  Description of Artificial Sequence: Synthetic coding sequence
atgaccagcggcaacggcaacagcgccagcagcatcgccggcaccgccccccagaacggcgagaacaagcccccccaggccatcgtgaagccccagatcctgacccacgtgatcgagggcttcgtgatccaggagggcgccgagcccttccccgtgggcagaagcagcctgctggtgggcaacctgaagaagaagtacgcccagggcttcctgcccgagaagctgccccagcaggaccacaccaccaccaccgacagcgagatggaggagccctacctgcaggagagcaaggaggagggcgcccccctgaagctgaagtgcgagctgtgcggcagagtggacttcgcctacaagttcaagagaagcaagagattctgcagcatggcctgcgccaagagatacaacgtgggctgcaccaagagagtgggcctgttccacagcgacagaagcaagctgcagaaggccggcgccgccacccacaacagaagaagagccagcaaggccagcctgccccccctgaccaaggacaccaagaagcagcccaccggcaccgtgcccctgagcgtgaccgccgccctgcagctgacccacagccaggaggacagcagcagatgcagcgacaacagcagctacgaggagcccctgagccccatcagcgccagcagcagcaccagcagaagaagacagggccagagagacctggagctgcccgacatgcacatgagagacctggtgggcatgggccaccacttcctgcccagcgagcccaccaagtggaacgtggaggacgtgtacgagttcatcagaagcctgcccggctgccaggagatcgccgaggagttcagagcccaggagatcgacggccaggccctgctgctgctgaaggaggaccacctgatgagcgccatgaacatcaagctgggccccgccctgaagatctacgccagaatcagcatgctgaaggacagctag

SEQ ID NO: 9056 - DNA, 1395 bp, Artificial Sequence
  Description of Artificial Sequence: Synthetic coding sequence
atgcccctgggccccgtgacccccgccctgcccctgcagtgccccaccgccaacctgcacaagcccggcggcagccagcagtgccacccccccacccccgacaccggcccccagaacggccaccccgagggcgtgccccacaccccccagagaagattccagcacaccagcgccgtgatcctgcagctgcagcccgccagccccgtgccccagcagtgcgtgcccgacgactggaaggaggtggcccccggcgagaagagcgtgcccgagaccagaagcggccccagcccccaccagcaggccatcgtgaccgccatgcccggcggcctgcccgtgcccaccagccccaacatccagcccagccccgcccacgagaccggccagggcatcgtgcacgccctgaccgacctgagcagccccggcatgaccagcggcaacggcaacagcgccagcagcatcgccggcaccgccccccagaacggcgagaacaagcccccccaggccatcgtgaagccccagatcctgacccacgtgatcgagggcttcgtgatccaggagggcgccgagcccttccccgtgggcagaagcagcctgctggtgggcaacctgaagaagaagtacgcccagggcttcctgcccgagaagctgccccagcaggaccacaccaccaccaccgacagcgagatggaggagccctacctgcaggagagcaaggaggagggcgcccccctgaagctgaagtgcgagctgtgcggcagagtggacttcgcctacaagttcaagagaagcaagagattctgcagcatggcctgcgccaagagatacaacgtgggctgcaccaagagagtgggcctgttccacagcgacagaagcaagctgcagaaggccggcgccgccacccacaacagaagaagagccagcaaggccagcctgccccccctgaccaaggacaccaagaagcagcccaccggcaccgtgcccctgagcgtgaccgccgccctgcagctgacccacagccaggaggacagcagcagatgcagcgacaacagcagctacgaggagcccctgagccccatcagcgccagcagcagcaccagcagaagaagacagggccagagagacctggagctgcccgacatgcacatgagagacctggtgggcatgggccaccacttcctgcccagcgagcccaccaagtggaacgtggaggacgtgtacgagttcatcagaagcctgcccggctgccaggagatcgccgaggagttcagagcccaggagatcgacggccaggccctgctgctgctgaaggaggaccacctgatgagcgccatgaacatcaagctgggccccgccctgaagatctacgccagaatcagcatgctgaaggacagctag

SEQ ID NO: 9057 - DNA, 2580 bp, Artificial Sequence
  Description of Artificial Sequence: Synthetic coding sequence
atggagaacgagctgcccgtgccccacaccagcagcagcgcctgcgccaccagcagcaccagcggcgccagcagcagcagcggctgcaacaacagcagcagcggcggcagcggcagacccaccggcccccagatcagcgtgtacagcggcatccccgacagacagaccgtgcaggtgatccagcaggccctgcacagacagcccagcaccgccgcccagtacctgcagcagatgtacgccgcccagcagcagcacctgatgctgcagaccgccgccctgcagcagcagcacctgagcagcgcccagctgcagagcctggccgccgtgcagcaggccagcctggtgagcaacagacagggcagcaccagcggcagcaacgtgagcgcccaggcccccgcccagagcagcagcatcaacctggccgccagccccgccgccgcccagctgctgaacagagcccagagcgtgaacagcgccgccgccagcggcatcgcccagcaggccgtgctgctgggcaacaccagcagccccgccctgaccgccagccaggcccagatgtacctgagagcccagatgctgatcttcacccccaccgccaccgtggccaccgtgcagcccgagctgggcaccggcagccccgccagaccccccacccccgcccaggtgcagaacctgaccctgagaacccagcagacccccgccgccgccgccagcggccccacccccacccagcccgtgctgcccagcctggccctgaagcccacccccggcggcagccagcccctgcccacccccgcccagagcagaaacaccgcccaggccagccccgccggcgccaagcccggcatcgccgacagcgtgatggagccccacaagaagggcgacggcaacagcagcgtgcccggcagcatggagggcagagccggcctgagcagaaccgtgcccgccgtggccgcccaccccctgatcgcccccgcctacgcccagctgcagccccaccagctgctgccccagcccagcagcaagcacctgcagccccagttcgtgatccagcagcagccccagccccagcagcagcagccccccccccagcagagcagacccgtgctgcaggccgagccccacccccagctggccagcgtgagccccagcgtggccctgcagcccagcagcgaggcccacgccatgcccctgggccccgtgacccccgccctgcccctgcagtgccccaccgccaacctgcacaagcccggcggcagccagcagtgccacccccccacccccgacaccggcccccagaacggccaccccgagggcgtgccccacaccccccagagaagattccagcacaccagcgccgtgatcctgcagctgcagcccgccagccccgtgccccagcagtgcgtgcccgacgactggaaggaggtggcccccggcgagaagagcgtgcccgagaccagaagcggccccagcccccaccagcaggccatcgtgaccgccatgcccggcggcctgcccgtgcccaccagccccaacatccagcccagccccgcccacgagaccggccagggcatcgtgcacgccctgaccgacctgagcagccccggcatgaccagcggcaacggcaacagcgccagcagcatcgccggcaccgccccccagaacggcgagaacaagcccccccaggccatcgtgaagccccagatcctgacccacgtgatcgagggcttcgtgatccaggagggcgccgagcccttccccgtgggcagaagcagcctgctggtgggcaacctgaagaagaagtacgcccagggcttcctgcccgagaagctgccccagcaggaccacaccaccaccaccgacagcgagatggaggagccctacctgcaggagagcaaggaggagggcgcccccctgaagctgaagtgcgagctgtgcggcagagtggacttcgcctacaagttcaagagaagcaagagattctgcagcatggcctgcgccaagagatacaacgtgggctgcaccaagagagtgggcctgttccacagcgacagaagcaagctgcagaaggccggcgccgccacccacaacagaagaagagccagcaaggccagcctgccccccctgaccaaggacaccaagaagcagcccaccggcaccgtgcccctgagcgtgaccgccgccctgcagctgacccacagccaggaggacagcagcagatgcagcgacaacagcagctacgaggagcccctgagccccatcagcgccagcagcagcaccagcagaagaagacagggccagagagacctggagctgcccgacatgcacatgagagacctggtgggcatgggccaccacttcctgcccagcgagcccaccaagtggaacgtggaggacgtgtacgagttcatcagaagcctgcccggctgccaggagatcgccgaggagttcagagcccaggagatcgacggccaggccctgctgctgctgaaggaggaccacctgatgagcgccatgaacatcaagctgggccccgccctgaagatctacgccagaatcagcatgctgaaggacagctag

SEQ ID NO: 9058 - DNA, 2490 bp, Artificial Sequence
  Description of Artificial Sequence: Synthetic coding sequence
atggagaacgagctgcccgtgccccacaccagcagcagcgcctgcgccaccagcagcaccagcggcgccagcagcagcagcggctgcaacaacagcagcagcggcggcagcggcagacccaccggcccccagatcagcgtgtacagcggcatccccgacagacagaccgtgcaggtgatccagcaggccctgcacagacagcccagcaccgccgcccagtacctgcagcagatgtacgccgcccagcagcagcacctgatgctgcagaccgccgccctgcagcagcagcacctgagcagcgcccagctgcagagcctggccgccgtgcagcaggccagcctggtgagcaacagacagggcagcaccagcggcagcaacgtgagcgcccaggcccccgcccagagcagcagcatcaacctggccgccagccccgccgccgcccagctgctgaacagagcccagagcgtgaacagcgccgccgccagcggcatcgcccagcaggccgtgctgctgggcaacaccagcagccccgccctgaccgccagccaggcccagatgtacctgagagcccagatggtgcagaacctgaccctgagaacccagcagacccccgccgccgccgccagcggccccacccccacccagcccgtgctgcccagcctggccctgaagcccacccccggcggcagccagcccctgcccacccccgcccagagcagaaacaccgcccaggccagccccgccggcgccaagcccggcatcgccgacagcgtgatggagccccacaagaagggcgacggcaacagcagcgtgcccggcagcatggagggcagagccggcctgagcagaaccgtgcccgccgtggccgcccaccccctgatcgcccccgcctacgcccagctgcagccccaccagctgctgccccagcccagcagcaagcacctgcagccccagttcgtgatccagcagcagccccagccccagcagcagcagccccccccccagcagagcagacccgtgctgcaggccgagccccacccccagctggccagcgtgagccccagcgtggccctgcagcccagcagcgaggcccacgccatgcccctgggccccgtgacccccgccctgcccctgcagtgccccaccgccaacctgcacaagcccggcggcagccagcagtgccacccccccacccccgacaccggcccccagaacggccaccccgagggcgtgccccacaccccccagagaagattccagcacaccagcgccgtgatcctgcagctgcagcccgccagccccccccagcagtgcgtgcccgacgactggaaggaggtggcccccggcgagaagagcgtgcccgagaccagaagcggccccagcccccaccagcaggccatcgtgaccgccatgcccggcggcctgcccgtgcccaccagccccaacatccagcccagccccgcccacgagaccggccagggcatcgtgcacgccctgaccgacctgagcagccccggcatgaccagcggcaacggcaacagcgccagcagcatcgccggcaccgccccccagaacggcgagaacaagcccccccaggccatcgtgaagccccagatcctgacccacgtgatcgagggcttcgtgatccaggagggcgccgagcccttccccgtgggcagaagcagcctgctggtgggcaacctgaagaagaagtacgcccagggcttcctgcccgagaagctgccccagcaggaccacaccaccaccaccgacagcgagatggaggagccctacctgcaggagagcaaggaggagggcgcccccctgaagctgaagtgcgagctgtgcggcagagtggacttcgcctacaagttcaagagaagcaagagattctgcagcatggcctgcgccaagagatacaacgtgggctgcaccaagagagtgggcctgttccacagcgacagaagcaagctgcagaaggccggcgccgccacccacaacagaagaagagccagcaaggccagcctgccccccctgaccaaggacaccaagaagcagcccaccggcaccgtgcccctgagcgtgaccgccgccctgcagctgacccacagccaggaggacagcagcagatgcagcgacaacagcagctacgaggagcccctgagccccatcagcgccagcagcagcaccagcagaagaagacagggccagagagacctggagctgcccgacatgcacatgagagacctggtgggcatgggccaccacttcctgcccagcgagcccaccaagtggaacgtggaggacgtgtacgagttcatcagaagcctgcccggctgccaggagatcgccgaggagttcagagcccaggagatcgacggccaggccctgctgctgctgaaggaggaccacctgatgagcgccatgaacatcaagctgggccccgccctgaagatctacgccagaatcagcatgctgaaggacagctag

SEQ ID NO: 9059 - DNA, 561 bp, Artificial Sequence
  Description of Artificial Sequence: Synthetic coding sequence
atggacaccgagcccaaccccggcaccagcagcgtgagcaccaccaccagcagcaccaccaccaccaccatcaccaccagcagcagcagaatgcagcagccccagatcagcgtgtacagcggcagcgacagacacgccgtgcaggccctgcacagaccccccagcagcgccgcccagtacctgcagcagatgtacgccgcccagcagcagcacctgatgctgcacaccgccgccctgcagcagcagcacctgagcagcagccagctgcagagcctggccgccgtgcaggccagcctgagcagcggcagacccagcaccagccccaccggcagcgtgacccagcagagcagcatgagccagaccagcatcaacctgagcaccagccccacccccgcccagctgatcagcagaagccaggccagcagcagcaccagcggcagcatcacccagcagaccatgctgctgggcagcaccagccccaccctgaccgccagccaggcccagatgtacctgagagcccagatggtgagatacgagctgcccaacttcttcagcgtgtag

SEQ ID NO: 9060 - DNA, 744 bp, Artificial Sequence
  Description of Artificial Sequence: Synthetic coding sequence
atggccgaggccgagttcaaggaccacagcaccgccatggacaccgagcccaaccccggcaccagcagcgtgagcaccaccaccagcagcaccaccaccaccaccatcaccaccagcagcagcagaatgcagcagccccagatcagcgtgtacagcggcagcgacagacacgccgtgcaggtgatccagcaggccctgcacagaccccccagcagcgccgcccagtacctgcagcagatgtacgccgcccagcagcagcacctgatgctgcacaccgccgccctgcagcagcagcacctgagcagcagccagctgcagagcctggccgccgtgcaggccagcctgagcagcggcagacccagcaccagccccaccggcagcgtgacccagcagagcagcatgagccagaccagcatcaacctgagcaccagccccacccccgcccagctgatcagcagaagccaggccagcagcagcaccagcggcagcatcacccagcagaccatgctgctgggcagcaccagccccaccctgaccgccagccaggcccagatgtacctgagagcccagatgctgatcttcacccccgccaccaccgtggccgccgtgcagagcgacatccccgtggtgagcagcagcagcagcagcagctgccagagcgccgccacccaggtgcagaacctgaccctgagaagccagaagctgggcgtgctgagcagcagccagaacggcccccccaagtag

SEQ ID NO: 9061 - DNA, 444 bp, Artificial Sequence
  Description of Artificial Sequence: Synthetic coding sequence
atggccgaggccgagttcaaggaccacagcaccgccatggacaccgagcccaaccccggcaccagcagcgtgagcaccaccaccagcagcaccaccaccaccaccatcaccaccagcagcagcagaatgcagcagccccagatcagcgtgtacagcggcagcgacagacacgccgtgcaggccctgcacagaccccccagcagcgccgcccagtacctgcagcagatgtacgccgcccagcagcagcacctgatgctgcacaccgccgccctgcagcagcagcacctgagcagcagccagctgcagagcctggccgccgtgcaggccagcctgagcagcggcagacccagcaccagccccaccggcagcgtgacccagcagagcagcatgagccagaccagcgtgagcagcctgaacttcttcttcctggacctgaagttctag

SEQ ID NO: 9062 - DNA, 486 bp, Artificial Sequence
  Description of Artificial Sequence: Synthetic coding sequence
tgaagatggaacagaaagcccgacaaccagagcctgggccacagaggcagaagacccagcggccccgacggcgccgccagagagcacatcctgagacagctgcccatcacctaccccagcgccgaggaggacctggccagccacgaggacagcgtgcccagcgccatgaccaccagactgagaagacagagcgagagagagagagagagagagctgagagacgtgagaatcagaaagatgcccgagaacagcgacctgctgcccgtggcccagaccgagcccagcatctggaccgtggacgacgtgtgggccttcatccacagcctgcccggctgccaggacatcgccgacgagttcagagcccaggagatcgacggccaggccctgctgctgctgaaggaggaccacctgatgagcgccatgaacatcaagctgggccccgccctgaagatctgcgccagaatcaacagcctgaaggagagctag

SEQ ID NO: 9063 - DNA, 2952 bp, Artificial Sequence
  Description of Artificial Sequence: Synthetic coding sequence
atggacaccgagcccaaccccggcaccagcagcgtgagcaccaccaccagcagcaccaccaccaccaccatcaccaccagcagcagcagaatgcagcagccccagatcagcgtgtacagcggcagcgacagacacgccgtgcaggtgatccagcaggccctgcacagaccccccagcagcgccgcccagtacctgcagcagatgtacgccgcccagcagcagcacctgatgctgcacaccgccgccctgcagcagcagcacctgagcagcagccagctgcagagcctggccgccgtgcaggccagcctgagcagcggcagacccagcaccagccccaccggcagcgtgacccagcagagcagcatgagccagaccagcatcaacctgagcaccagccccacccccgcccagctgatcagcagaagccaggccagcagcagcaccagcggcagcatcacccagcagaccatgctgctgggcagcaccagccccaccctgaccgccagccaggcccagatgtacctgagagcccagatgctgatcttcacccccgccaccaccgtggccgccgtgcagagcgacatccccgtggtgagcagcagcagcagcagcagctgccagagcgccgccacccaggtgcagaacctgaccctgagaagccagaagctgggcgtgctgagcagcagccagaacggcccccccaagagcaccagccagacccagagcctgaccatctgccacaacaagaccaccgtgaccagcagcaagatcagccagagagaccccagccccgagagcaacaagaagggcgagagccccagcctggagagcagaagcaccgccgtgaccagaaccagcagcatccaccagctgatcgcccccgccagctacagccccatccagccccacagcctgatcaagcaccagcagatccccctgcacagcccccccagcaaggtgagccaccaccagctgatcctgcagcagcagcagcagcagatccagcccatcaccctgcagaacagcacccaggaccccccccccagccagcactgcatccccctgcagaaccacggcctgccccccgcccccagcaacgcccagagccagcactgcagccccatccagagccaccccagccccctgaccgtgagccccaaccagagccagagcgcccagcagagcgtggtggtgagccccccccccccccacagccccagccagagccccaccatcatcatccacccccaggccctgatccagccccaccccctggtgagcagcgccctgcagcccggccccaacctgcagcagagcaccgccaaccaggtgcaggccaccgcccagctgaacctgcccagccacctgcccctgcccgccagccccgtggtgcacatcggccccgtgcagcagagcgccctggtgagccccggccagcagatcgtgagccccagccaccagcagtacagcagcctgcagagcagccccatccccatcgccagccccccccagatgagcaccagcccccccgcccagatcccccccctgcccctgcagagcatgcagagcctgcaggtgcagcccgagatcctgagccagggccaggtgctggtgcagaacgccctggtgagcgaggaggagctgcccgccgccgaggccctggtgcagctgcccttccagaccctgccccccccccagaccgtggccgtgaacctgcaggtgcagccccccgcccccgtggacccccccgtggtgtaccaggtggaggacgtgtgcgaggaggagatgcccgaggagagcgacgagtgcgtgagaatggacagaaccccccccccccccaccctgagccccgccgccatcaccgtgggcagaggcgaggacctgaccagcgagcaccccctgctggagcaggtggagctgcccgccgtggccagcgtgagcgccagcgtgatcaagagccccagcgaccccagccacgtgagcgtgccccccccccccctgctgctgcccgccgccaccaccagaagcaacagcaccagcatgcacagcagcatccccagcatcgagaacaagcccccccaggccatcgtgaagccccagatcctgacccacgtgatcgagggcttcgtgatccaggagggcctggagcccttccccgtgagcagaagcagcctgctgatcgagcagcccgtgaagaagagacccctgctggacaaccaggtgatcaacagcgtgtgcgtgcagcccgagctgcagaacaacaccaagcacgccgacaacagcagcgacaccgagatggaggacatgatcgccgaggagaccctggaggagatggacagcgagctgctgaagtgcgagttctgcggcaagatgggctacgccaacgagttcctgagaagcaagagattctgcaccatgagctgcgccaagagatacaacgtgagctgcagcaagaagttcgccctgagcagatggaacagaaagcccgacaaccagagcctgggccacagaggcagaagacccagcggccccgacggcgccgccagagagcacatcctgagacagctgcccatcacctaccccagcgccgaggaggacctggccagccacgaggacagcgtgcccagcgccatgaccaccagactgagaagacagagcgagagagagagagagagagagctgagagacgtgagaatcagaaagatgcccgagaacagcgacctgctgcccgtggcccagaccgagcccagcatctggaccgtggacgacgtgtgggccttcatccacagcctgcccggctgccaggacatcgccgacgagttcagagcccaggagatcgacggccaggccctgctgctgctgaaggaggaccacctgatgagcgccatgaacatcaagctgggccccgccctgaagatctgcgccagaatcaacagcctgaaggagagctag

SEQ ID NO: 9064 - DNA, 2988 bp, Artificial Sequence
  Description of Artificial Sequence: Synthetic coding sequence
atggccgaggccgagttcaaggaccacagcaccgccatggacaccgagcccaaccccggcaccagcagcgtgagcaccaccaccagcagcaccaccaccaccaccatcaccaccagcagcagcagaatgcagcagccccagatcagcgtgtacagcggcagcgacagacacgccgtgcaggtgatccagcaggccctgcacagaccccccagcagcgccgcccagtacctgcagcagatgtacgccgcccagcagcagcacctgatgctgcacaccgccgccctgcagcagcagcacctgagcagcagccagctgcagagcctggccgccgtgcaggccagcctgagcagcggcagacccagcaccagccccaccggcagcgtgacccagcagagcagcatgagccagaccagcatcaacctgagcaccagccccacccccgcccagctgatcagcagaagccaggccagcagcagcaccagcggcagcatcacccagcagaccatgctgctgggcagcaccagccccaccctgaccgccagccaggcccagatgtacctgagagcccagatgctgatcttcacccccgccaccaccgtggccgccgtgcagagcgacatccccgtggtgagcagcagcagcagcagcagctgccagagcgccgccacccaggtgcagaacctgaccctgagaagccagaagctgggcgtgctgagcagcagccagaacggcccccccaagagcaccagccagacccagagcctgaccatctgccacaacaagaccaccgtgaccagcagcaagatcagccagagagaccccagccccgagagcaacaagaagggcgagagccccagcctggagagcagaagcaccgccgtgaccagaaccagcagcatccaccagctgatcgcccccgccagctacagccccatccagccccacagcctgatcaagcaccagcagatccccctgcacagcccccccagcaaggtgagccaccaccagctgatcctgcagcagcagcagcagcagatccagcccatcaccctgcagaacagcacccaggaccccccccccagccagcactgcatccccctgcagaaccacggcctgccccccgcccccagcaacgcccagagccagcactgcagccccatccagagccaccccagccccctgaccgtgagccccaaccagagccagagcgcccagcagagcgtggtggtgagccccccccccccccacagccccagccagagccccaccatcatcatccacccccaggccctgatccagccccaccccctggtgagcagcgccctgcagcccggccccaacctgcagcagagcaccgccaaccaggtgcaggccaccgcccagctgaacctgcccagccacctgcccctgcccgccagccccgtggtgcacatcggccccgtgcagcagagcgccctggtgagccccggccagcagatcgtgagccccagccaccagcagtacagcagcctgcagagcagccccatccccatcgccagccccccccagatgagcaccagcccccccgcccagatcccccccctgcccctgcagagcatgcagagcctgcaggtgcagcccgagatcctgagccagggccaggtgctggtgcagaacgccctggtgagcgaggaggagctgcccgccgccgaggccctggtgcagctgcccttccagaccctgccccccccccagaccgtggccgtgaacctgcaggtgcagccccccgcccccgtggacccccccgtggtgtaccaggtggaggacgtgtgcgaggaggagatgcccgaggagagcgacgagtgcgtgagaatggacagaaccccccccccccccaccctgagccccgccgccatcaccgtgggcagaggcgaggacctgaccagcgagcaccccctgctggagcaggtggagctgcccgccgtggccagcgtgagcgccagcgtgatcaagagccccagcgaccccagccacgtgagcgtgccccccccccccctgctgctgcccgccgccaccaccagaagcaacagcaccagcatgcacagcagcatccccagcatcgagaacaagcccccccaggccatcgtgaagccccagatcctgacccacgtgatcgagggcttcgtgatccaggagggcctggagcccttccccgtgagcagaagcagcctgctgatcgagcagcccgtgaagaagagacccctgctggacaaccaggtgatcaacagcgtgtgcgtgcagcccgagctgcagaacaacaccaagcacgccgacaacagcagcgacaccgagatggaggacatgatcgccgaggagaccctggaggagatggacagcgagctgctgaagtgcgagttctgcggcaagatgggctacgccaacgagttcctgagaagcaagagattctgcaccatgagctgcgccaagagatacaacgtgagctgcagcaagaagttcgccctgagcagatggaacagaaagcccgacaaccagagcctgggccacagaggcagaagacccagcggccccgacggcgccgccagagagcacatcctgagacagctgcccatcacctaccccagcgccgaggaggacctggccagccacgaggacagcgtgcccagcgccatgaccaccagactgagaagacagagcgagagagagagagagagagagctgagagacgtgagaatcagaaagatgcccgagaacagcgacctgctgcccgtggcccagaccgagcccagcatctggaccgtggacgacgtgtgggccttcatccacagcctgcccggctgccaggacatcgccgacgagttcagagcccaggagatcgacggccaggccctgctgctgctgaaggaggaccacctgatgagcgccatgaacatcaagctgggccccgccctgaagatctgcgccagaatcaacagcctgaaggagagctag

SEQ ID NO: 9065 - DNA, 456 bp, Artificial Sequence
  Description of Artificial Sequence: Synthetic coding sequence
atggccgaggccgagttcaaggaccacagcaccgccatggacaccgagcccaaccccggcaccagcagcgtgagcaccaccaccagcagcaccaccaccaccaccatcaccaccagcagcagcagaatgcagcagccccagatcagcgtgtacagcggcagcgacagacacgccgtgcaggtgatccagcaggccctgcacagaccccccagcagcgccgcccagtacctgcagcagatgtacgccgcccagcagcagcacctgatgctgcacaccgccgccctgcagcagcagcacctgagcagcagccagctgcagagcctggccgccgtgcaggccagcctgagcagcggcagacccagcaccagccccaccggcagcgtgacccagcagagcagcatgagccagaccagcgtgagcagcctgaacttcttcttcctggacctgaagttctag

SEQ ID NO: 9066 - DNA, 1797 bp, Artificial Sequence
  Description of Artificial Sequence: Synthetic coding sequence
atgagcgccagcgcccagcagctggccgaggagctgcagatcttcggcctggactgcgaggaggccctgatcgagaagctggtggagctgtgcgtgcagtacggccagaacgaggagggcatggtgggcgagctgatcgccttctgcaccagcacccacaaggtgggcctgaccagcgagatcctgaacagcttcgagcacgagttcctgagcaagagactgagcaaggccagacacagcacctgcaaggacagcggccacgccggcgccagagacatcgtgagcatccaggagctgatcgaggtggaggaggaggaggagatcctgctgaacagctacaccacccccagcaagggcagccagaagagagccatcagcacccccgagacccccctgaccaagagaagcgtgagcaccagaagcccccaccagctgctgagccccagcagcttcagccccagcgccacccccagccagaagtacaacagcagaagcaacagaggcgaggtggtgaccagcttcggcctggcccagggcgtgagctggagcggcagaggcggcgccggcaacatcagcctgaaggtgctgggctgccccgaggccctgaccggcagctacaagagcatgttccagaagctgcccgacatcagagaggtgctgacctgcaagatcgaggagctgggcagcgagctgaaggagcactacaagatcgaggccttcacccccctgctggcccccgcccaggagcccgtgaccctgctgggccagatcggctgcgacagcaacggcaagctgaacaacaagagcgtgatcctggagggcgacagagagcacagcagcggcgcccagatccccgtggacctgagcgagctgaaggagtacagcctgttccccggccaggtggtgatcatggagggcatcaacaccaccggcagaaagctggtggccaccaagctgtacgagggcgtgcccctgcccttctaccagcccaccgaggaggacgccgacttcgagcagagcatggtgctggtggcctgcggcccctacaccaccagcgacagcatcacctacgaccccctgctggacctgatcgccgtgatcaaccacgacagacccgacgtgtgcatcctgttcggccccttcctggacgccaagcacgagcaggtggagaactgcctgctgaccagccccttcgaggacatcttcaagcagtgcctgagaaccatcatcgagggcaccagaagcagcggcagccacctggtgttcgtgcccagcctgagagacgtgcaccacgagcccgtgtacccccagccccccttcagctacagcgacctgagcagagaggacaagaagcaggtgcagttcgtgagcgagccctgcagcctgagcatcaacggcgtgatcttcggcctgaccagcaccgacctgctgttccacctgggcgccgaggagatcagcagcagcagcggcaccagcgacagattcagcagaatcctgaagcacatcctgacccagagaagctactaccccctgtaccccccccaggaggacatggccatcgactacgagagcttctacgtgtacgcccagctgcccgtgacccccgacgtgctgatcatccccagcgagctgagatacttcgtgaaggacgtgctgggctgcgtgtgcgtgaaccccggcagactgaccaagggccaggtgggcggcaccttcgccagactgtacctgagaagacccgccgccgacggcgccgagagacagagcccctgcatcgccgtgcaggtggtgagaatctag

SEQ ID NO: 9067 - DNA, 1086 bp, Artificial Sequence
  Description of Artificial Sequence: Synthetic coding sequence
atgttccagaagctgcccgacatcagagaggtgctgacctgcaagatcgaggagctgggcagcgagctgaaggagcactacaagatcgaggccttcacccccctgctggcccccgcccaggagcccgtgaccctgctgggccagatcggctgcgacagcaacggcaagctgaacaacaagagcgtgatcctggagggcgacagagagcacagcagcggcgcccagatccccgtggacctgagcgagctgaaggagtacagcctgttccccggccaggtggtgatcatggagggcatcaacaccaccggcagaaagctggtggccaccaagctgtacgagggcgtgcccctgcccttctaccagcccaccgaggaggacgccgacttcgagcagagcatggtgctggtggcctgcggcccctacaccaccagcgacagcatcacctacgaccccctgctggacctgatcgccgtgatcaaccacgacagacccgacgtgtgcatcctgttcggccccttcctggacgccaagcacgagcaggtggagaactgcctgctgaccagccccttcgaggacatcttcaagcagtgcctgagaaccatcatcgagggcaccagaagcagcggcagccacctggtgttcgtgcccagcctgagagacgtgcaccacgagcccgtgtacccccagccccccttcagctacagcgacctgagcagagaggacaagaagcaggtgcagttcgtgagcgagccctgcagcctgagcatcaacggcgtgatcttcggcctgaccagcaccgacctgctgttccacctgggcgccgaggagatcagcagcagcagcggcaccagcgacagattcagcagaatcctgaagcacatcctgacccagagaagctactaccccctgtaccccccccaggaggacatggccatcgactacgagagcttctacgtgtacgcccagctgcccgtgacccccgacgtgctgatcatccccagcgagctgagatacttcgtgaaggtgggcctgaacagcgccttcagccagaagcaccagaaccccgtgttcgacttccccttctag

SEQ ID NO: 9068 - DNA, 1485 bp, Artificial Sequence
  Description of Artificial Sequence: Synthetic coding sequence
atgctgcccaagagaagaagagccagagtgggcagccccagcggcgacgccgccagcagcaccccccccagcaccagattccccggcgtggccatctacctggtggagcccagaatgggcagaagcagaagagccttcctgaccggcctggccagaagcaagggcttcagagtgctggacgcctgcagcagcgaggccacccacgtggtgatggaggagaccagcgccgaggaggccgtgagctggcaggagagaagaatggccgccgccccccccggctgcaccccccccgccctgctggacatcagctggctgaccgagagcctgggcgccggccagcccgtgcccgtggagtgcagacacagactggaggtggccggccccagaaagggccccctgagccccgcctggatgcccgcctacgcctgccagagacccacccccctgacccaccacaacaccggcctgagcgaggccctggagatcctggccgaggccgccggcttcgagggcagcgagggcagactgctgaccttctgcagagccgccagcgtgctgaaggccctgcccagccccgtgaccaccctgagccagctgcagggcctgccccacttcggcgagcacagcagcagagtggtgcaggagctgctggagcacggcgtgtgcgaggaggtggagagagtgagaagaagcgagagataccagaccatgaagctgttcacccagatcttcggcgtgggcgtgaagaccgccgacagatggtacagagagggcctgagaaccctggacgacctgagagagcagccccagaagctgacccagcagcagaaggccggcctgcagcaccaccaggacctgagcacccccgtgctgagaagcgacgtggacgccctgcagcaggtggtggaggaggccgtgggccaggccctgcccggcgccaccgtgaccctgaccggcggcttcagaagaggcaagctgcagggccacgacgtggacttcctgatcacccaccccaaggagggccaggaggccggcctgctgcccagagtgatgtgcagactgcaggaccagggcctgatcctgtaccaccagcaccagcacagctgctgcgagagccccaccagactggcccagcagagccacatggacgccttcgagagaagcttctgcatcttcagactgccccagccccccggcgccgccgtgggcggcagcaccagaccctgccccagctggaaggccgtgagagtggacctggtggtggcccccgtgagccagttccccttcgccctgctgggctggaccggcagcaagctgttccagagagagctgagaagattcagcagaaaggagaagggcctgtggctgaacagccacggcctgttcgaccccgagcagaagaccttcttccaggccgccagcgaggaggacatcttcagacacctgggcctggagtacctgccccccgagcagagaaacgcctag

SEQ ID NO: 9069 - DNA, 1374 bp, Artificial Sequence
  Description of Artificial Sequence: Synthetic coding sequence
atgctgcccaagagaagaagagccagagtgggcagccccagcggcgacgccgccagcagcaccccccccagcaccagattccccggcgtggccatctacctggtggagcccagaatgggcagaagcagaagagccttcctgaccggcctggccagaagcaagggcttcagagtgctggacgcctgcagcagcgaggccacccacgtggtgatggaggagaccagcgccgaggaggccgtgagctggcaggagagaagaatggccgccgccccccccggctgcaccccccccgccctgctggacatcagctggctgaccgagagcctgggcgccggccagcccgtgcccgtggagtgcagacacagactggaggtggccggccccagaaagggccccctgagccccgcctggatgcccgcctacgcctgccagagacccacccccctgacccaccacaacaccggcctgagcgaggccctggagatcctggccgaggccgccggcttcgagggcagcgagggcagactgctgaccttctgcagagccgccagcgtgctgaaggccctgcccagccccgtgaccaccctgagccagctgcagggcctgccccacttcggcgagcacagcagcagagtggtgcaggagctgctggagcacggcgtgtgcgaggaggtggagagagtgagaagaagcgagagataccagaccatgaagctgttcacccagatcttcggcgtgggcgtgaagaccgccgacagatggtacagagagggcctgagaaccctggacgacctgagagagcagccccagaagctgacccagcagcagaaggccgccccccccggccccgagcaccccagccccgccgtgagatgcagatgccccgccgccggcggcggcggcagctgcggcgccggccccgcctggggccacagacacgccgacagaagactgccccagggcctgatcctgtaccaccagcaccagcacagctgctgcgagagccccaccagactggcccagcagagccacatggacgccttcgagagaagcttctgcatcttcagactgccccagccccccggcgccgccgtgggcggcagcaccagaccctgccccagctggaaggccgtgagagtggacctggtggtggcccccgtgagccagttccccttcgccctgctgggctggaccggcagcaagctgttccagagagagctgagaagattcagcagaaaggagaagggcctgtggctgaacagccacggcctgttcgaccccgagcagaagaccttcttccaggccgccagcgaggaggacatcttcagacacctgggcctggagtacctgccccccgagcagagaaacgcctag

SEQ ID NO: 9070 - DNA, 1527 bp, Artificial Sequence
  Description of Artificial Sequence: Synthetic coding sequence
atgctgcccaagagaagaagagccagagtgggcagccccagcggcgacgccgccagcagcaccccccccagcaccagattccccggcgtggccatctacctggtggagcccagaatgggcagaagcagaagagccttcctgaccggcctggccagaagcaagggcttcagagtgctggacgcctgcagcagcgaggccacccacgtggtgatggaggagaccagcgccgaggaggccgtgagctggcaggagagaagaatggccgccgccccccccggctgcaccccccccgccctgctggacatcagctggctgaccgagagcctgggcgccggccagcccgtgcccgtggagtgcagacacagactggaggtggccggccccagaaagggccccctgagccccgcctggatgcccgcctacgcctgccagagacccacccccctgacccaccacaacaccggcctgagcgaggccctggagatcctggccgaggccgccggcttcgagggcagcgagggcagactgctgaccttctgcagagccgccagcgtgctgaaggccctgcccagccccgtgaccaccctgagccagctgcagggcctgccccacttcggcgagcacagcagcagagtggtgcaggagctgctggagcacggcgtgtgcgaggaggtggagagagtgagaagaagcgagagagcccccgccccccccggccccgagcaccccagccccgccgtgagatgcagatgccccgccgccggcggcggcggcagctgcggcgccggccccgcctggggccacagacacgccgacagaagactgccccagggcctgatcctgtaccaccagcaccagcacagctgctgcgagagccccaccagactggcccagcagagccacatggacgccttcgagagaagcttctgcatcttcagactgccccagccccccggcgccgccgtgggcggcagcaccagaccctgccccagctggaaggccgtgagagtggacctggtggtggcccccgtgagccagttccccttcgccctgctgggctggaccggcagcaagctgttccagagagagctgagaagattcagcagaaaggagaagggcctgtggctgaacagccacggcctgttcgaccccgagcagggcagcagcagcggcaagacccccagaagcagaaagagctgcttctgctgcagaagacacttcagcaagagactgcagagaaagaccagcagcgacacctgggccctgagcaccttcctgcagagcagagagacccccgagcccgcctgcgtgccccacttccacagcggcaactgggccgcccccaacctggccaccgagtgcctgcaggccgacatgctgccccccgacccccacctgcaccccagcccccccagacccggcagcagcggcggccagctgtgcctgcaggaccagctgagcccctgctggtgcgccgccggctgcgacgaggtgggcgccctgagcgccagcctgatcaccgtgtag

SEQ ID NO: 9071 - DNA, 480 bp, Artificial Sequence
  Description of Artificial Sequence: Synthetic coding sequence
atgctgcccaagagaagaagagccagagtgggcagccccagcggcgacgccgccagcagcaccccccccagcaccagattccccggcgtggccatctacctggtggagcccagaatgggcagaagcagaagagccttcctgaccggcctggccagaagcaagggcttcagagtgctggacgcctgcagcagcgaggccacccacgtggtgatggaggagaccagcgccgaggaggccgtgagctggcaggagagaagaatggccgccgccccccccggctgcaccccccccgccctgctggacatcagctggctgaccgagagcctgggcgccggccagcccgtgcccgtggagtgcagacacagactggaggaggccctggagatcctggccgaggccgccggcttcgagggcagcgagggcagactgctgaccttctgcagagccgccagcgtgctgaaggccctgcccagcccctag

SEQ ID NO: 9072 - DNA, 729 bp, Artificial Sequence
  Description of Artificial Sequence: Synthetic coding sequence
atgctgcccaagagaagaagagccagagtgggcagccccagcggcgacgccgccagcagcaccccccccagcaccagattccccggcgtggccatctacctggtggagcccagaatgggcagaagcagaagagccttcctgaccggcctggccagaagcaagggcttcagagtgctggacgcctgcagcagcgaggccacccacgtggtgatggaggagaccagcgccgaggaggccgtgagctggcaggagagaagaatggccgccgccccccccggctgcaccccccccgccctgctggacatcagctggctgaccgagagcctgggcgccggccagcccgtgcccgtggagtgcagacacagactggaggtggccggccccagaaagggccccctgagccccgcctggatgcccgcctacgcctgccagagacccacccccctgacccaccacaacaccggcctgagcgaggccctggagatcctggccgaggccgccggcttcgagggcagcgagggcagactgctgaccttctgcagagccgccagcgtgctgaaggccctgcccagccccgtgaccaccctgagccagctgcagggcctgccccacttcggcgagcacagcagcagagtggtgcaggagctgctggagcacggcgtgtgcgaggaggtggagagagtgagaagaagcgagagcagcagccccagaagcagcggcagcgtgtag

SEQ ID NO: 9073 - DNA, 813 bp, Artificial Sequence
  Description of Artificial Sequence: Synthetic coding sequence
atgctgcccaagagaagaagagccagagtgggcagccccagcggcgacgccgccagcagcaccccccccagcaccagattccccggcgtggccatctacctggtggagcccagaatgggcagaagcagaagagccttcctgaccggcctggccagaagcaagggcttcagagtgctggacgcctgcagcagcgaggccacccacgtggtgatggaggagaccagcgccgaggaggccgtgagctggcaggagagaagaatggccgccgccccccccggctgcaccccccccgccctgctggacatcagctggctgaccgagagcctgggcgccggccagcccgtgcccgtggagtgcagacacagactggaggtggccggccccagaaagggccccctgagccccgcctggatgcccgcctacgcctgccagagacccacccccctgacccaccacaacaccggcctgagcgaggccctggagatcctggccgaggccgccggcttcgagggcagcgagggcagactgctgaccttctgcagagccgccagcgtgctgaaggccctgcccagccccgtgaccaccctgagccagctgcagggcctgccccacttcggcgagcacagcagcagagtggtgcaggagctgctggagcacggcgtgtgcgaggaggtggagagagtgagaagaagcgagagataccagaccatgaaggtgagaagagccggcctgggccccacccccggcatgagctgccccggcaacgacaacaccgtgcacaccatgcacggcgaggccaacagaggcagctag

SEQ ID NO: 9074 - DNA, 5163 bp, Artificial Sequence
  Description of Artificial Sequence: Synthetic coding sequence
atgctgatcagcaagaacatgccctggagaagactgcagggcatcagcttcggcatgtacagcgccgaggagctgaagaagctgagcgtgaagagcatcaccaaccccagatacctggacagcctgggcaaccccagcgccaacggcctgtacgacctggccctgggccccgccgacagcaaggaggtgtgcagcacctgcgtgcaggacttcagcaactgcagcggccacctgggccacatcgagctgcccctgaccgtgtacaaccccctgctgttcgacaagctgtacctgctgctgagaggcagctgcctgaactgccacatgctgacctgccccagagccgtgatccacctgctgctgtgccagctgagagtgctggaggtgggcgccctgcaggccgtgtacgagctggagagaatcctgaacagattcctggaggagaaccccgaccccagcgccagcgagatcagagaggagctggagcagtacaccaccgagatcgtgcagaacaacctgctgggcagccagggcgcccacgtgaagaacgtgtgcgagagcaagagcaagctgatcgccctgttctggaaggcccacatgaacgccaagagatgcccccactgcaagaccggcagaagcgtggtgagaaaggagcacaacagcaagctgaccatcaccttccccgccatggtgcacagaaccgccggccagaaggacagcgagcccctgggcatcgaggaggcccagatcggcaagagaggctacctgacccccaccagcgccagagagcacctgagcgccctgtggaagaacgagggcttcttcctgaactacctgttcagcggcatggacgacgacggcatggagagcagattcaaccccagcgtgttcttcctggacttcctggtggtgccccccagcagatacagacccgtgagcagactgggcgaccagatgttcaccaacggccagaccgtgaacctgcaggccgtgatgaaggacgtggtgctgatcagaaagctgctggccctgatggcccaggagcagaagctgcccgaggaggtggccacccccaccaccgacgaggagaaggacagcctgatcgccatcgacagaagcttcctgagcaccctgcccggccagagcctgatcgacaagctgtacaacatctggatcagactgcagagccacgtgaacatcgtgttcgacagcgagatggacaagctgatgatggacaagtaccccggcatcagacagatcctggagaagaaggagggcctgttcagaaagcacatgatgggcaagagagtggactacgccgccagaagcgtgatctgccccgacatgtacatcaacaccaacgagatcggcatccccatggtgttcgccaccaagctgacctacccccagcccgtgaccccctggaacgtgcaggagctgagacaggccgtgatcaacggccccaacgtgcaccccggcgccagcatggtgatcaacgaggacggcagcagaaccgccctgagcgccgtggacatgacccagagagaggccgtggccaagcagctgctgacccccgccaccggcgcccccaagccccagggcaccaagatcgtgtgcagacacgtgaagaacggcgacatcctgctgctgaacagacagcccaccctgcacagacccagcatccaggcccacagagccagaatcctgcccgaggagaaggtgctgagactgcactacgccaactgcaaggcctacaacgccgacttcgacggcgacgagatgaacgcccacttcccccagagcgagctgggcagagccgaggcctacgtgctggcctgcaccgaccagcagtacctggtgcccaaggacggccagcccctggccggcctgatccaggaccacatggtgagcggcgccagcatgaccaccagaggctgcttcttcaccagagagcactacatggagctggtgtacagaggcctgaccgacaaggtgggcagagtgaagctgctgagccccagcatcctgaagcccttccccctgtggaccggcaagcaggtggtgagcaccctgctgatcaacatcatccccgaggaccacatccccctgaacctgagcggcaaggccaagatcaccggcaaggcctgggtgaaggagacccccagaagcgtgcccggcttcaaccccgacagcatgtgcgagagccaggtgatcatcagagagggcgagctgctgtgcggcgtgctggacaaggcccactacggcagcagcgcctacggcctggtgcactgctgctacgagatctacggcggcgagaccagcggcaaggtgctgacctgcctggccagactgttcaccgcctacctgcagctgtacagaggcttcaccctgggcgtggaggacatcctggtgaagcccaaggccgacgtgaagagacagagaatcatcgaggagagcacccactgcggcccccaggccgtgagagccgccctgaacctgcccgaggccgccagctacgacgaggtgagaggcaagtggcaggacgcccacctgggcaaggaccagagagacttcaacatgatcgacctgaagttcaaggaggaggtgaaccactacagcaacgagatcaacaaggcctgcatgcccttcggcctgcacagacagttccccgagaacagcctgcagatgatggtgcagagcggcgccaagggcagcaccgtgaacaccatgcagatcagctgcctgctgggccagatcgagctggagggcagaagaccccccctgatggccagcggcaagagcctgccctgcttcgagccctacgagttcacccccagagccggcggcttcgtgaccggcagattcctgaccggcatcaagccccccgagttcttcttccactgcatggccggcagagagggcctggtggacaccgccgtgaagaccagcagaagcggctacctgcagagatgcatcatcaagcacctggagggcctggtggtgcagtacgacctgaccgtgagagacagcgacggcagcgtggtgcagttcctgtacggcgaggacggcctggacatccccaagacccagttcctgcagcccaagcagttccccttcctggccagcaactacgaggtgatcatgaagagccagcacctgcacgaggtgctgagcagagccgaccccaagaaggccctgcaccacttcagagccatcaagaagtggcagagcaagcaccccaacaccctgctgagaagaggcgccttcctgagctacagccagaagatccaggaggccgtgaaggccctgaagctggagagcgagaacagaaacggcagaagccccggcacccaggagatgctgagaatgtggtacgagctggacgaggagagcagaagaaagtaccagaagaaggccgccgcctgccccgaccccagcctgagcgtgtggagacccgacatctacttcgccagcgtgagcgagaccttcgagaccaaggtggacgactacagccaggagtgggccgcccagaccgagaagagctacgagaagagcgagctgagcctggacagactgagaaccctgctgcagctgaagtggcagagaagcctgtgcgagcccggcgaggccgtgggcctgctggccgcccagagcatcggcgagcccagcacccagatgaccctgaacaccttccacttcgccggcagaggcgagatgaacgtgaccctgggcatccccagactgagagagatcctgatggtggccagcgccaacatcaagacccccatgatgagcgtgcccgtgctgaacaccaagaaggccctgaagagagtgaagagcctgaagaagcagctgaccagagtgtgcctgggcgaggtgctgcagaagatcgacgtgcaggagagcttctgcatggaggagaagcagaacaagttccaggtgtaccagctgagattccagttcctgccccacgcctactaccagcaggagaagtgcctgagacccgaggacatcctgagattcatggagaccagattcttcaagctgctgatggagagcatcaagaagaagaacaacaaggccagcgccttcagaaacgtgaacaccagaagagccacccagagagacctggacaacgccggcgagctgggcagaagcagaggcgagcaggagggcgacgaggaggaggagggccacatcgtggacgccgaggccgaggagggcgacgccgacgccagcgacgccaagagaaaggagaagcaggaggaggaggtggactacgagagcgaggaggaggaggagagagagggcgaggagaacgacgacgaggacatgcaggaggagagaaacccccacagagagggcgccagaaagacccaggagcaggacgaggaggtgggcctgggcaccgaggaggaccccagcctgcccgccctgctgacccagcccagaaagcccacccacagccaggagccccagggccccgaggccatggagagaagagtgcaggccgtgagagagatccaccccttcatcgacgactaccagtacgacaccgaggagagcctgtggtgccaggtgaccgtgaagctgcccctgatgaagatcaacttcgacatgagcagcctggtggtgagcctggcccacggcgccgtgatctacgccaccaagggcatcaccagatgcctgctgaacgagaccaccaacaacaagaacgagaaggagctggtgctgaacaccgagggcatcaacctgcccgagctgttcaagtacgccgaggtgctggacctgagaagactgtacagcaacgacatccacgccatcgccaacacctacggcatcgaggccgccctgagagtgatcgagaaggagatcaaggacgtgttcgccgtgtacggcatcgccgtggaccccagacacctgagcctggtggccgactacatgtgcttcgagggcgtgtacaagcccctgaacagattcggcatcagaagcaacagcagccccctgcagcagatgaccttcgagaccagcttccagttcctgaagcaggccaccatgctgggcagccacgacgagctgagaagccccagcgcctgcctggtggtgggcaaggtggtgagaggcggcaccggcctgttcgagctgaagcagcccctgagatag

SEQ ID NO: 9075 - DNA, 4980 bp, Artificial Sequence
  Description of Artificial Sequence: Synthetic coding sequence
atgctgatcagcaagaacatgccctggagaagactgcagggcatcagcttcggcatgtacagcgccgaggagctgaagaagctgagcgtgaagagcatcaccaaccccagatacctggacagcctgggcaaccccagcgccaacggcctgtacgacctggccctgggccccgccgacagcaaggaggtgtgcagcacctgcgtgcaggacttcagcaactgcagcggccacctgggccacatcgagctgcccctgaccgtgtacaaccccctgctgttcgacaagctgtacctgctgctgagaggcagctgcctgaactgccacatgctgacctgccccagagccgtgatccacctgctgctgtgccagctgagagtgctggaggtgggcgccctgcaggccgtgtacgagctggagagaatcctgaacagattcctggaggagaaccccgaccccagcgccagcgagatcagagaggagctggagcagtacaccaccgagatcgtgcagaacaacctgctgggcagccagggcgcccacgtgaagaacgtgtgcgagagcaagagcaagctgatcgccctgttctggaaggcccacatgaacgccaagagatgcccccactgcaagaccggcagaagcgtggtgagaaaggagcacaacagcaagctgaccatcaccttccccgccatggtgcacagaaccgccggccagaaggacagcgagcccctgggcatcgaggaggcccagatcggcaagagaggctacctgacccccaccagcgccagagagcacctgagcgccctgtggaagaacgagggcttcttcctgaactacctgttcagcggcatggacgacgacggcatggagagcagattcaaccccagcgtgttcttcctggacttcctggtggtgccccccagcagatacagacccgtgagcagactgggcgaccagatgttcaccaacggccagaccgtgaacctgcaggccgtgatgaaggacgtggtgctgatcagaaagctgctggccctgatggcccaggagcagaagctgcccgaggaggtggccacccccaccaccgacgaggagaaggacagcctgatcgccatcgacagaagcttcctgagcaccctgcccggccagagcctgatcgacaagctgtacaacatctggatcagactgcagagccacgtgaacatcgtgttcgacagcgagatggacaagctgatgatggacaagtaccccggcatcagacagatcctggagaagaaggagggcctgttcagaaagcacatgatgggcaagagagtggactacgccgccagaagcgtgatctgccccgacatgtacatcaacaccaacgagatcggcatccccatggtgttcgccaccaagctgacctacccccagcccgtgaccccctggaacgtgcaggagctgagacaggccgtgatcaacggccccaacgtgcaccccggcgccagcatggtgatcaacgaggacggcagcagaaccgccctgagcgccgtggacatgacccagagagaggccgtggccaagcagctgctgacccccgccaccggcgcccccaagccccagggcaccaagatcgtgtgcagacacgtgaagaacggcgacatcctgctgctgaacagacagcccaccctgcacagacccagcatccaggcccacagagccagaatcctgcccgaggagaaggtgctgagactgcactacgccaactgcaaggcctacaacgccgacttcgacggcgacgagatgaacgcccacttcccccagagcgagctgggcagagccgaggcctacgtgctggcctgcaccgaccagcagtacctggtgcccaaggacggccagcccctggccggcctgatccaggaccacatggtgagcggcgccagcatgaccaccagaggctgcttcttcaccagagagcactacatggagctggtgtacagaggcctgaccgacaaggtgggcagagtgaagctgctgagccccagcatcctgaagcccttccccctgtggaccggcaagcaggtggtgagcaccctgctgatcaacatcatccccgaggaccacatccccctgaacctgagcggcaaggccaagatcaccggcaaggcctgggtgaaggagacccccagaagcgtgcccggcttcaaccccgacagcatgtgcgagagccaggtgatcatcagagagggcgagctgctgtgcggcgtgctggacaaggcccactacggcagcagcgcctacggcctggtgcactgctgctacgagatctacggcggcgagaccagcggcaaggtgctgacctgcctggccagactgttcaccgcctacctgcagctgtacagaggcttcaccctgggcgtggaggacatcctggtgaagcccaaggccgacgtgaagagacagagaatcatcgaggagagcacccactgcggcccccaggccgtgagagccgccctgaacctgcccgaggccgccagctacgacgaggtgagaggcaagtggcaggacgcccacctgggcaaggaccagagagacttcaacatgatcgacctgaagttcaaggaggaggtgaaccactacagcaacgagatcaacaaggcctgcatgcccttcggcctgcacagacagttccccgagaacagcctgcagatgatggtgcagagcggcgccaagggcagcaccgtgaacaccatgcagatcagctgcctgctgggccagatcgagctggagggcagaagaccccccctgatggccagcggcaagagcctgccctgcttcgagccctacgagttcacccccagagccggcggcttcgtgaccggcagattcctgaccggcatcaagccccccgagttcttcttccactgcatggccggcagagagggcctggtggacaccgccgtgaagaccagcagaagcggctacctgcagagatgcatcatcaagcacctggagggcctggtggtgcagtacgacctgaccgtgagagacagcgacggcagcgtggtgcagttcctgtacggcgaggacggcctggacatccccaagacccagttcctgcagcccaagcagttccccttcctggccagcaactacgaggtgatcatgaagagccagcacctgcacgaggtgctgagcagagccgaccccaagaaggccctgcaccacttcagagccatcaagaagtggcagagcaagcaccccaacaccctgctgagaagaggcgccttcctgagctacagccagaagatccaggaggccgtgaaggccctgaagctggagagcgagaacagaaacggcagaagccccggcacccaggagatgctgagaatgtggtacgagctggacgaggagagcagaagaaagtaccagaagaaggccgccgcctgccccgaccccagcctgagcgtgtggagacccgacatctacttcgccagcgtgagcgagaccttcgagaccaaggtggacgactacagccaggagtgggccgcccagaccgagaagagctacgagaagagcgagctgagcctggacagactgagaaccctgctgcagctgaagtggcagagaagcctgtgcgagcccggcgaggccgtgggcctgctggccgcccagagcatcggcgagcccagcacccagatgaccctgaacaccttccacttcgccggcagaggcgagatgaacgtgaccctgggcatccccagactgagagagatcctgatggtggccagcgccaacatcaagacccccatgatgagcgtgcccgtgctgaacaccaagaaggccctgaagagagtgaagagcctgaagaagcagctgaccagagtgtgcctgggcgaggtgctgcagaagatcgacgtgcaggagagcttctgcatggaggagaagcagaacaagttccaggtgtaccagctgagattccagttcctgccccacgcctactaccagcaggagaagtgcctgagacccgaggacatcctgagattcatggagaccagattcttcaagctgctgatggagagcatcaagaagaagaacaacaaggccagcgccttcagaaacgtgaacaccagaagagccacccagagagacctggacaacgccggcgagctgggcagaagcagaggcgagcaggagggcgacgaggaggaggagggccacatcgtggacgccgaggccgaggagggcgacgccgacgccagcgacgccaagagaaaggagaagcaggaggaggaggtggactacgagagcgaggaggaggaggagagagagggcgaggagaacgacgacgaggacatgcaggaggagagaaacccccacagagagggcgccagaaagacccaggagcaggacgaggaggtgaccgtgaagctgcccctgatgaagatcaacttcgacatgagcagcctggtggtgagcctggcccacggcgccgtgatctacgccaccaagggcatcaccagatgcctgctgaacgagaccaccaacaacaagaacgagaaggagctggtgctgaacaccgagggcatcaacctgcccgagctgttcaagtacgccgaggtgctggacctgagaagactgtacagcaacgacatccacgccatcgccaacacctacggcatcgaggccgccctgagagtgatcgagaaggagatcaaggacgtgttcgccgtgtacggcatcgccgtggaccccagacacctgagcctggtggccgactacatgtgcttcgagggcgtgtacaagcccctgaacagattcggcatcagaagcaacagcagccccctgcagcagatgaccttcgagaccagcttccagttcctgaagcaggccaccatgctgggcagccacgacgagctgagaagccccagcgcctgcctggtggtgggcaaggtggtgagaggcggcaccggcctgttcgagctgaagcagcccctgagatag

SEQ ID NO: 9076 - DNA, 3408 bp, Artificial Sequence
  Description of Artificial Sequence: Synthetic coding sequence
atggaccccggcagcagatggagaaacctgcccagcggccccagcctgaagcacctgaccgaccccagctacggcatccccagagagcagcagaaggccgccctgcaggagctgaccagagcccacgtggagagcttcaactacgccgtgcacgagggcctgggcctggccgtgcaggccatcccccccttcgagttcgccttcaaggacgagagaatcagcttcaccatcctggacgccgtgatcagcccccccaccgtgcccaagggcaccatctgcaaggaggccaacgtgtaccccgccgagtgcagaggcagaagaagcacctacagaggcaagctgaccgccgacatcaactgggccgtgaacggcatcagcaagggcatcatcaagcagttcctgggctacgtgcccatcatggtgaagagcaagctgtgcaacctgagaaacctgcccccccaggccctgatcgagcaccacgaggaggccgaggagatgggcggctacttcatcatcaacggcatcgagaaggtgatcagaatgctgatcatgcccagaagaaacttccccatcgccatgatcagacccaagtggaagaccagaggccccggctacacccagtacggcgtgagcatgcactgcgtgagagaggagcacagcgccgtgaacatgaacctgcactacctggagaacggcaccgtgatgctgaacttcatctacagaaaggagctgttcttcctgcccctgggcttcgccctgaaggccctggtgagcttcagcgactaccagatcttccaggagctgatcaagggcaaggaggacgacagcttcctgagaaacagcgtgagccagatgctgagaatcgtgatggaggagggctgcagcacccagaagcaggtgctgaactacctgggcgagtgcttcagagtgaagctgaacgtgcccgactggtaccccaacgagcaggccgccgagttcctgttcaaccagtgcatctgcatccacctgaagagcaacaccgagaagttctacatgctgtgcctgatgaccagaaagctgttcgccctggccaagggcgagtgcatggaggacaaccccgacagcctggtgaaccaggaggtgctgacccccggccagctgttcctgatgttcctgaaggagaagctggagggctggctggtgagcatcaagatcgccttcgacaagaaggcccagaagaccagcgtgagcatgaacaccgacaacctgatgagaatcttcaccatgggcatcgacctgaccaagcccttcgagtacctgttcgccaccggcaacctgagaagcaagaccggcctgggcctgctgcaggacagcggcctgtgcgtggtggccgacaagctgaacttcatcagatacctgagccacttcagatgcgtgcacagaggcgccgacttcgccaagatgagaaccaccaccgtgagaagactgctgcccgagagctggggcttcctgtgccccgtgcacacccccgacggcgagccctgcggcctgatgaaccacctgaccgccgtgtgcgaggtggtgacccagttcgtgtacaccgccagcatccccgccctgctgtgcaacctgggcgtgacccccatcgacggcgccccccacagaagctacagcgagtgctaccccgtgctgctggacggcgtgatggtgggctgggtggacaaggacctggcccccggcatcgccgacagcctgagacacttcaaggtgctgagagagaagagaatccccccctggatggaggtggtgctgatccccatgaccggcaagcccagcctgtaccccggcctgttcctgttcaccaccccctgcagactggtgagacccgtgcagaacctggccctgggcaaggaggagctgatcggcaccatggagcagatcttcatgaacgtggccatcttcgaggacgaggtgttcgccggcgtgaccacccaccaggagctgttcccccacagcctgctgagcgtgatcgccaacttcatccccttcagcgaccacaaccagagccccagaaacatgtaccagtgccagatgggcaagcagaccatgggcttccccctgctgacctaccaggacagaagcgacaacaagctgtacagactgcagaccccccagagccccctggtgagacccagcatgtacgactactacgacatggacaactaccccatcggcaccaacgccatcgtggccgtgatcagctacaccggctacgacatggaggacgccatgatcgtgaacaaggccagctgggagagaggcttcgcccacggcagcgtgtacaagagcgagttcatcgacctgagcgagaagatcaagcagggcgacagcagcctggtgttcggcatcaagcccggcgaccccagagtgctgcagaagctggacgacgacggcctgcccttcatcggcgccaagctgcagtacggcgacccctactacagctacctgaacctgaacaccggcgagagcttcgtgatgtactacaagagcaaggagaactgcgtggtggacaacatcaaggtgtgcagcaacgacaccggcagcggcaagttcaagtgcgtgtgcatcaccatgagagtgcccagaaaccccaccatcggcgacaagttcgccagcagacacggccagaagggcatcctgagcagactgtggcccgccgaggacatgcccttcaccgagagcggcatggtgcccgacatcctgttcaacccccacggcttccccagcagaatgaccatcggcatgctgatcgagagcatggccggcaagagcgccgccctgcacggcctgtgccacgacgccacccccttcatcttcagcgaggagaacagcgccctggagtacttcggcgagatgctgaaggccgccggctacaacttctacggcaccgagagactgtacagcggcatcagcggcctggagctggaggccgacatcttcatcggcgtggtgtactaccagagactgagacacatggtgagcgacaagttccaggtgagaaccaccggcgccagagacagagtgaccaaccagcccatcggcggcagaaacgtgcagggcggcatcagattcggcgagatggagagagacgccctgctggcccacggcaccagcttcctgctgcacgacagactgttcaactgcagcgacagaagcgtggcccacgtgtgcgtgaagtgcggcagcctgctgagccccctgctggagaagcccccccccagctggagcgccatgagaaacagaaagtacaactgcaccctgtgcagcagaagcgacaccatcgacaccgtgagcgtgccctacgtgttcagatacttcgtggccgagctggccgccatgaacatcaaggtgaagctggacgtggtgtag

SEQ ID NO: 9077 - DNA, 3240 bp, Artificial Sequence
  Description of Artificial Sequence: Synthetic coding sequence
atggaccccggcagcagatggagaaacctgcccagcggccccagcctgaagcacctgaccgaccccagctacggcatccccagagagcagcagaaggccgccctgcaggagctgaccagagcccacgtggagagcttcaactacgccgtgcacgagggcctgggcctggccgtgcaggccgacatcaactgggccgtgaacggcatcagcaagggcatcatcaagcagttcctgggctacgtgcccatcatggtgaagagcaagctgtgcaacctgagaaacctgcccccccaggccctgatcgagcaccacgaggaggccgaggagatgggcggctacttcatcatcaacggcatcgagaaggtgatcagaatgctgatcatgcccagaagaaacttccccatcgccatgatcagacccaagtggaagaccagaggccccggctacacccagtacggcgtgagcatgcactgcgtgagagaggagcacagcgccgtgaacatgaacctgcactacctggagaacggcaccgtgatgctgaacttcatctacagaaaggagctgttcttcctgcccctgggcttcgccctgaaggccctggtgagcttcagcgactaccagatcttccaggagctgatcaagggcaaggaggacgacagcttcctgagaaacagcgtgagccagatgctgagaatcgtgatggaggagggctgcagcacccagaagcaggtgctgaactacctgggcgagtgcttcagagtgaagctgaacgtgcccgactggtaccccaacgagcaggccgccgagttcctgttcaaccagtgcatctgcatccacctgaagagcaacaccgagaagttctacatgctgtgcctgatgaccagaaagctgttcgccctggccaagggcgagtgcatggaggacaaccccgacagcctggtgaaccaggaggtgctgacccccggccagctgttcctgatgttcctgaaggagaagctggagggctggctggtgagcatcaagatcgccttcgacaagaaggcccagaagaccagcgtgagcatgaacaccgacaacctgatgagaatcttcaccatgggcatcgacctgaccaagcccttcgagtacctgttcgccaccggcaacctgagaagcaagaccggcctgggcctgctgcaggacagcggcctgtgcgtggtggccgacaagctgaacttcatcagatacctgagccacttcagatgcgtgcacagaggcgccgacttcgccaagatgagaaccaccaccgtgagaagactgctgcccgagagctggggcttcctgtgccccgtgcacacccccgacggcgagccctgcggcctgatgaaccacctgaccgccgtgtgcgaggtggtgacccagttcgtgtacaccgccagcatccccgccctgctgtgcaacctgggcgtgacccccatcgacggcgccccccacagaagctacagcgagtgctaccccgtgctgctggacggcgtgatggtgggctgggtggacaaggacctggcccccggcatcgccgacagcctgagacacttcaaggtgctgagagagaagagaatccccccctggatggaggtggtgctgatccccatgaccggcaagcccagcctgtaccccggcctgttcctgttcaccaccccctgcagactggtgagacccgtgcagaacctggccctgggcaaggaggagctgatcggcaccatggagcagatcttcatgaacgtggccatcttcgaggacgaggtgttcgccggcgtgaccacccaccaggagctgttcccccacagcctgctgagcgtgatcgccaacttcatccccttcagcgaccacaaccagagccccagaaacatgtaccagtgccagatgggcaagcagaccatgggcttccccctgctgacctaccaggacagaagcgacaacaagctgtacagactgcagaccccccagagccccctggtgagacccagcatgtacgactactacgacatggacaactaccccatcggcaccaacgccatcgtggccgtgatcagctacaccggctacgacatggaggacgccatgatcgtgaacaaggccagctgggagagaggcttcgcccacggcagcgtgtacaagagcgagttcatcgacctgagcgagaagatcaagcagggcgacagcagcctggtgttcggcatcaagcccggcgaccccagagtgctgcagaagctggacgacgacggcctgcccttcatcggcgccaagctgcagtacggcgacccctactacagctacctgaacctgaacaccggcgagagcttcgtgatgtactacaagagcaaggagaactgcgtggtggacaacatcaaggtgtgcagcaacgacaccggcagcggcaagttcaagtgcgtgtgcatcaccatgagagtgcccagaaaccccaccatcggcgacaagttcgccagcagacacggccagaagggcatcctgagcagactgtggcccgccgaggacatgcccttcaccgagagcggcatggtgcccgacatcctgttcaacccccacggcttccccagcagaatgaccatcggcatgctgatcgagagcatggccggcaagagcgccgccctgcacggcctgtgccacgacgccacccccttcatcttcagcgaggagaacagcgccctggagtacttcggcgagatgctgaaggccgccggctacaacttctacggcaccgagagactgtacagcggcatcagcggcctggagctggaggccgacatcttcatcggcgtggtgtactaccagagactgagacacatggtgagcgacaagttccaggtgagaaccaccggcgccagagacagagtgaccaaccagcccatcggcggcagaaacgtgcagggcggcatcagattcggcgagatggagagagacgccctgctggcccacggcaccagcttcctgctgcacgacagactgttcaactgcagcgacagaagcgtggcccacgtgtgcgtgaagtgcggcagcctgctgagccccctgctggagaagcccccccccagctggagcgccatgagaaacagaaagtacaactgcaccctgtgcagcagaagcgacaccatcgacaccgtgagcgtgccctacgtgttcagatacttcgtggccgagctggccgccatgaacatcaaggtgaagctggacgtggtgtag

SEQ ID NO: 9078 - DNA, 345 bp, Artificial Sequence
  Description of Artificial Sequence: Synthetic coding sequence
atggaccccggcagcagatggagaaacctgcccagcggccccagcctgaagcacctgaccgaccccagctacggcatccccagagagcagcagaaggccgccctgcaggagctgaccagagcccacgtggagagcttcaactacgccgtgcacgagggcctgggcctggccgtgcaggccatcccccccttcgagttcgccttcaaggacgagagaatcagcttcaccatcctggacgccgtgatcagcccccccaccgtgcccaagggcaccatctgcaaggaggccaacgtgtaccccgccgagtgcagaggcagaagaagcacctacagaggcaagctgtag

SEQ ID NO: 9079 - DNA, 387 bp, Artificial Sequence
  Description of Artificial Sequence: Synthetic coding sequence
atggaccccggcagcagatggagaaacctgcccagcggccccagcctgaagcacctgaccgaccccagctacggcatccccagagagcagcagaaggccgccctgcaggagctgaccagagcccacgtggagagcttcaactacgccgtgcacgagggcctgggcctggccgtgcaggccatcccccccttcgagttcgccttcaaggacgagagaatcagcttcaccatcctggacgccgtgatcagcccccccaccgtgcccaagggcaccatctgcaaggaggccaacgtgtaccccgccgagtgcagaggcagaagaagcacctacagaggcaagctgaccgccgacatcaactgggccgtgaacggcatcagcaagggctag

SEQ ID NO: 9080 - DNA, 1380 bp, Artificial Sequence
  Description of Artificial Sequence: Synthetic coding sequence
atgaacgtggccatcttcgaggacgaggtgttcgccggcgtgaccacccaccaggagctgttcccccacagcctgctgagcgtgatcgccaacttcatccccttcagcgaccacaaccagagccccagaaacatgtaccagtgccagatgggcaagcagaccatgggcttccccctgctgacctaccaggacagaagcgacaacaagctgtacagactgcagaccccccagagccccctggtgagacccagcatgtacgactactacgacatggacaactaccccatcggcaccaacgccatcgtggccgtgatcagctacaccggctacgacatggaggacgccatgatcgtgaacaaggccagctgggagagaggcttcgcccacggcagcgtgtacaagagcgagttcatcgacctgagcgagaagatcaagcagggcgacagcagcctggtgttcggcatcaagcccggcgaccccagagtgctgcagaagctggacgacgacggcctgcccttcatcggcgccaagctgcagtacggcgacccctactacagctacctgaacctgaacaccggcgagagcttcgtgatgtactacaagagcaaggagaactgcgtggtggacaacatcaaggtgtgcagcaacgacaccggcagcggcaagttcaagtgcgtgtgcatcaccatgagagtgcccagaaaccccaccatcggcgacaagttcgccagcagacacggccagaagggcatcctgagcagactgtggcccgccgaggacatgcccttcaccgagagcggcatggtgcccgacatcctgttcaacccccacggcttccccagcagaatgaccatcggcatgctgatcgagagcatggccggcaagagcgccgccctgcacggcctgtgccacgacgccacccccttcatcttcagcgaggagaacagcgccctggagtacttcggcgagatgctgaaggccgccggctacaacttctacggcaccgagagactgtacagcggcatcagcggcctggagctggaggccgacatcttcatcggcgtggtgtactaccagagactgagacacatggtgagcgacaagttccaggtgagaaccaccggcgccagagacagagtgaccaaccagcccatcggcggcagaaacgtgcagggcggcatcagattcggcgagatggagagagacgccctgctggcccacggcaccagcttcctgctgcacgacagactgttcaactgcagcgacagaagcgtggcccacgtgtgcgaggtgtggcagttcaccctgagcaccgtgggcgaggccacccccttcctggtgtgccacgcccagcagaagatccagctgtacagcgtgtag

SEQ ID NO: 9081 - DNA, 2775 bp, Artificial Sequence
  Description of Artificial Sequence: Synthetic coding sequence
atgcactgcgtgagagaggagcacagcgccgtgaacatgaacctgcactacctggagaacggcaccgtgatgctgaacttcatctacagaaaggagctgttcttcctgcccctgggcttcgccctgaaggccctggtgagcttcagcgactaccagatcttccaggagctgatcaagggcaaggaggacgacagcttcctgagaaacagcgtgagccagatgctgagaatcgtgatggaggagggctgcagcacccagaagcaggtgctgaactacctgggcgagtgcttcagagtgaagctgaacgtgcccgactggtaccccaacgagcaggccgccgagttcctgttcaaccagtgcatctgcatccacctgaagagcaacaccgagaagttctacatgctgtgcctgatgaccagaaagctgttcgccctggccaagggcgagtgcatggaggacaaccccgacagcctggtgaaccaggaggtgctgacccccggccagctgttcctgatgttcctgaaggagaagctggagggctggctggtgagcatcaagatcgccttcgacaagaaggcccagaagaccagcgtgagcatgaacaccgacaacctgatgagaatcttcaccatgggcatcgacctgaccaagcccttcgagtacctgttcgccaccggcaacctgagaagcaagaccggcctgggcctgctgcaggacagcggcctgtgcgtggtggccgacaagctgaacttcatcagatacctgagccacttcagatgcgtgcacagaggcgccgacttcgccaagatgagaaccaccaccgtgagaagactgctgcccgagagctggggcttcctgtgccccgtgcacacccccgacggcgagccctgcggcctgatgaaccacctgaccgccgtgtgcgaggtggtgacccagttcgtgtacaccgccagcatccccgccctgctgtgcaacctgggcgtgacccccatcgacggcgccccccacagaagctacagcgagtgctaccccgtgctgctggacggcgtgatggtgggctgggtggacaaggacctggcccccggcatcgccgacagcctgagacacttcaaggtgctgagagagaagagaatccccccctggatggaggtggtgctgatccccatgaccggcaagcccagcctgtaccccggcctgttcctgttcaccaccccctgcagactggtgagacccgtgcagaacctggccctgggcaaggaggagctgatcggcaccatggagcagatcttcatgaacgtggccatcttcgaggacgaggtgttcgccggcgtgaccacccaccaggagctgttcccccacagcctgctgagcgtgatcgccaacttcatccccttcagcgaccacaaccagagccccagaaacatgtaccagtgccagatgggcaagcagaccatgggcttccccctgctgacctaccaggacagaagcgacaacaagctgtacagactgcagaccccccagagccccctggtgagacccagcatgtacgactactacgacatggacaactaccccatcggcaccaacgccatcgtggccgtgatcagctacaccggctacgacatggaggacgccatgatcgtgaacaaggccagctgggagagaggcttcgcccacggcagcgtgtacaagagcgagttcatcgacctgagcgagaagatcaagcagggcgacagcagcctggtgttcggcatcaagcccggcgaccccagagtgctgcagaagctggacgacgacggcctgcccttcatcggcgccaagctgcagtacggcgacccctactacagctacctgaacctgaacaccggcgagagcttcgtgatgtactacaagagcaaggagaactgcgtggtggacaacatcaaggtgtgcagcaacgacaccggcagcggcaagttcaagtgcgtgtgcatcaccatgagagtgcccagaaaccccaccatcggcgacaagttcgccagcagacacggccagaagggcatcctgagcagactgtggcccgccgaggacatgcccttcaccgagagcggcatggtgcccgacatcctgttcaacccccacggcttccccagcagaatgaccatcggcatgctgatcgagagcatggccggcaagagcgccgccctgcacggcctgtgccacgacgccacccccttcatcttcagcgaggagaacagcgccctggagtacttcggcgagatgctgaaggccgccggctacaacttctacggcaccgagagactgtacagcggcatcagcggcctggagctggaggccgacatcttcatcggcgtggtgtactaccagagactgagacacatggtgagcgacaagttccaggtgagaaccaccggcgccagagacagagtgaccaaccagcccatcggcggcagaaacgtgcagggcggcatcagattcggcgagatggagagagacgccctgctggcccacggcaccagcttcctgctgcacgacagactgttcaactgcagcgacagaagcgtggcccacgtgtgcgtgaagtgcggcagcctgctgagccccctgctggagaagcccccccccagctggagcgccatgagaaacagaaagtacaactgcaccctgtgcagcagaagcgacaccatcgacaccgtgagcgtgccctacgtgttcagatacttcgtggccgagctggccgccatgaacatcaaggtgaagctggacgtggtgtag

SEQ ID NO: 9082 - DNA, 3522 bp, Artificial Sequence
  Description of Artificial Sequence: Synthetic coding sequence
atgagagccaaggaggccgccgagaccggcctgagacccctgctgcccgcctgcaccgagagactggccagcggcgtgtacagagagaccggcgtgagatgcgccggcggccacatggaccccggcagcagatggagaaacctgcccagcggccccagcctgaagcacctgaccgaccccagctacggcatccccagagagcagcagaaggccgccctgcaggagctgaccagagcccacgtggagagcttcaactacgccgtgcacgagggcctgggcctggccgtgcaggccatcccccccttcgagttcgccttcaaggacgagagaatcagcttcaccatcctggacgccgtgatcagcccccccaccgtgcccaagggcaccatctgcaaggaggccaacgtgtaccccgccgagtgcagaggcagaagaagcacctacagaggcaagctgaccgccgacatcaactgggccgtgaacggcatcagcaagggcatcatcaagcagttcctgggctacgtgcccatcatggtgaagagcaagctgtgcaacctgagaaacctgcccccccaggccctgatcgagcaccacgaggaggccgaggagatgggcggctacttcatcatcaacggcatcgagaaggtgatcagaatgctgatcatgcccagaagaaacttccccatcgccatgatcagacccaagtggaagaccagaggccccggctacacccagtacggcgtgagcatgcactgcgtgagagaggagcacagcgccgtgaacatgaacctgcactacctggagaacggcaccgtgatgctgaacttcatctacagaaaggagctgttcttcctgcccctgggcttcgccctgaaggccctggtgagcttcagcgactaccagatcttccaggagctgatcaagggcaaggaggacgacagcttcctgagaaacagcgtgagccagatgctgagaatcgtgatggaggagggctgcagcacccagaagcaggtgctgaactacctgggcgagtgcttcagagtgaagctgaacgtgcccgactggtaccccaacgagcaggccgccgagttcctgttcaaccagtgcatctgcatccacctgaagagcaacaccgagaagttctacatgctgtgcctgatgaccagaaagctgttcgccctggccaagggcgagtgcatggaggacaaccccgacagcctggtgaaccaggaggtgctgacccccggccagctgttcctgatgttcctgaaggagaagctggagggctggctggtgagcatcaagatcgccttcgacaagaaggcccagaagaccagcgtgagcatgaacaccgacaacctgatgagaatcttcaccatgggcatcgacctgaccaagcccttcgagtacctgttcgccaccggcaacctgagaagcaagaccggcctgggcctgctgcaggacagcggcctgtgcgtggtggccgacaagctgaacttcatcagatacctgagccacttcagatgcgtgcacagaggcgccgacttcgccaagatgagaaccaccaccgtgagaagactgctgcccgagagctggggcttcctgtgccccgtgcacacccccgacggcgagccctgcggcctgatgaaccacctgaccgccgtgtgcgaggtggtgacccagttcgtgtacaccgccagcatccccgccctgctgtgcaacctgggcgtgacccccatcgacggcgccccccacagaagctacagcgagtgctaccccgtgctgctggacggcgtgatggtgggctgggtggacaaggacctggcccccggcatcgccgacagcctgagacacttcaaggtgctgagagagaagagaatccccccctggatggaggtggtgctgatccccatgaccggcaagcccagcctgtaccccggcctgttcctgttcaccaccccctgcagactggtgagacccgtgcagaacctggccctgggcaaggaggagctgatcggcaccatggagcagatcttcatgaacgtggccatcttcgaggacgaggtgttcgccggcgtgaccacccaccaggagctgttcccccacagcctgctgagcgtgatcgccaacttcatccccttcagcgaccacaaccagagccccagaaacatgtaccagtgccagatgggcaagcagaccatgggcttccccctgctgacctaccaggacagaagcgacaacaagctgtacagactgcagaccccccagagccccctggtgagacccagcatgtacgactactacgacatggacaactaccccatcggcaccaacgccatcgtggccgtgatcagctacaccggctacgacatggaggacgccatgatcgtgaacaaggccagctgggagagaggcttcgcccacggcagcgtgtacaagagcgagttcatcgacctgagcgagaagatcaagcagggcgacagcagcctggtgttcggcatcaagcccggcgaccccagagtgctgcagaagctggacgacgacggcctgcccttcatcggcgccaagctgcagtacggcgacccctactacagctacctgaacctgaacaccggcgagagcttcgtgatgtactacaagagcaaggagaactgcgtggtggacaacatcaaggtgtgcagcaacgacaccggcagcggcaagttcaagtgcgtgtgcatcaccatgagagtgcccagaaaccccaccatcggcgacaagttcgccagcagacacggccagaagggcatcctgagcagactgtggcccgccgaggacatgcccttcaccgagagcggcatggtgcccgacatcctgttcaacccccacggcttccccagcagaatgaccatcggcatgctgatcgagagcatggccggcaagagcgccgccctgcacggcctgtgccacgacgccacccccttcatcttcagcgaggagaacagcgccctggagtacttcggcgagatgctgaaggccgccggctacaacttctacggcaccgagagactgtacagcggcatcagcggcctggagctggaggccgacatcttcatcggcgtggtgtactaccagagactgagacacatggtgagcgacaagttccaggtgagaaccaccggcgccagagacagagtgaccaaccagcccatcggcggcagaaacgtgcagggcggcatcagattcggcgagatggagagagacgccctgctggcccacggcaccagcttcctgctgcacgacagactgttcaactgcagcgacagaagcgtggcccacgtgtgcgtgaagtgcggcagcctgctgagccccctgctggagaagcccccccccagctggagcgccatgagaaacagaaagtacaactgcaccctgtgcagcagaagcgacaccatcgacaccgtgagcgtgccctacgtgttcagatacttcgtggccgagctggccgccatgaacatcaaggtgaagctggacgtggtgtag

SEQ ID NO: 9083 - DNA, 3525 bp, Artificial Sequence
  Description of Artificial Sequence: Synthetic coding sequence
atgtacgacgccgacgaggacatgcagtacgacgaggacgacgacgagatcacccccgacctgtggcaggaggcctgctggatcgtgatcagcagctacttcgacgagaagggcctggtgagacagcagctggacagcttcgacgagttcatccagatgagcgtgcagagaatcgtggaggacgccccccccatcgacctgcaggccgaggcccagcacgccagcggcgaggtggaggagccccccagatacctgctgaagttcgagcagatctacctgagcaagcccacccactgggagagagacggcgcccccagccccatgatgcccaacgaggccagactgagaaacctgacctacagcgcccccctgtacgtggacatcaccaagaccgtgatcaaggagggcgaggagcagctgcagacccagcaccagaagaccttcatcggcaagatccccatcatgctgagaagcacctactgcctgctgaacggcctgaccgacagagacctgtgcgagctgaacgagtgccccctggaccccggcggctacttcatcatcaacggcagcgagaaggtgctgatcgcccaggagaagatggccaccaacaccgtgtacgtgttcgccaagaaggacagcaagtacgcctacaccggcgagtgcagaagctgcctggagaacagcagcagacccaccagcaccatctgggtgagcatgctggccagaggcggccagggcgccaagaagagcgccatcggccagagaatcgtggccaccctgccctacatcaagcaggaggtgcccatcatcatcgtgttcagagccctgggcttcgtgagcgacagagacatcctggagcacatcatctacgacttcgaggaccccgagatgatggagatggtgaagcccagcctggacgaggccttcgtgatccaggagcagaacgtggccctgaacttcatcggcagcagaggcgccaagcccggcgtgaccaaggagaagagaatcaagtacgccaaggaggtgctgcagaaggagatgctgccccacgtgggcgtgagcgacttctgcgagaccaagaaggcctacttcctgggctacatggtgcacagactgctgctggccgccctgggcagaagagagctggacgacagagaccactacggcaacaagagactggacctggccggccccctgctggccttcctgttcagaggcatgttcaagaacctgctgaaggaggtgagaatctacgcccagaagttcatcgacagaggcaaggacttcaacctggagctggccatcaagaccagaatcatcagcgacggcctgaagtacagcctggccaccggcaactggggcgaccagaagaaggcccaccaggccagagccggcgtgagccaggtgctgaacagactgaccttcgccagcaccctgagccacctgagaagactgaacagccccatcggcagagacggcaagctggccaagcccagacagctgcacaacaccctgtggggcatggtgtgccccgccgagacccccgagggccacgccgtgggcctggtgaagaacctggccctgatggcctacatcagcgtgggcagccagcccagccccatcctggagttcctggaggagtggagcatggagaacctggaggagatcagccccgccgccatcgccgacgccaccaagatcttcgtgaacggctgctgggtgggcatccacaaggaccccgagcagctgatgaacaccctgagaaagctgagaagacagatggacatcatcgtgagcgaggtgagcatgatcagagacatcagagagagagagatcagaatctacaccgacgccggcagaatctgcagacccctgctgatcgtggagaagcagaagctgctgctgaagaagagacacatcgaccagctgaaggagagagagtacaacaactacagctggcaggacctggtggccagcggcgtggtggagtacatcgacaccctggaggaggagaccgtgatgctggccatgacccccgacgacctgcaggagaaggaggtggcctactgcagcacctacacccactgcgagatccaccccagcatgatcctgggcgtgtgcgccagcatcatccccttccccgaccacaaccagagccccagaaacacctaccagagcgccatgggcaagcaggccatgggcgtgtacatcaccaacttccacgtgagaatggacaccctggcccacgtgctgtactacccccagaagcccctggtgaccaccagaagcatggagtacctgagattcagagagctgcccgccggcatcaacagcatcgtggccatcgccagctacaccggctacaaccaggaggacagcgtgatcatgaacagaagcgccgtggacagaggcttcttcagaagcgtgttctacagaagctacaaggagcaggagagcaagaagggcttcgaccaggaggaggtgttcgagaagcccaccagagagacctgccagggcatgagacacgccatctacgacaagctggacgacgacggcctgatcgcccccggcgtgagagtgagcggcgacgacgtgatcatcggcaagaccgtgaccctgcccgagaacgaggacgagctggagagcaccaacagaagatacaccaagagagactgcagcaccttcctgagaaccagcgagaccggcatcgtggaccaggtgatggtgaccctgaaccaggagggctacaagttctgcaagatcagagtgagaagcgtgagaatcccccagatcggcgacaagttcgccagcagacacggccagaagggcacctgcggcatccagtacagacaggaggacatgcccttcacctgcgagggcatcacccccgacatcatcatcaacccccacgccatccccagcagaatgaccatcggccacctgatcgagtgcctgcagggcaaggtgagcgccaacaagggcgagatcggcgacgccacccccttcaacgacgccgtgaacgtgcagaagatcagcaacctgctgagcgactacggctaccacctgagaggcaacgaggtgctgtacaacggcttcaccggcagaaagatcaccagccagatcttcatcggccccacctactaccagagactgaagcacatggtggacgacaagatccacagcagagccagaggccccatccagatcctgaacagacagcccatggagggcagaagcagagacggcggcctgagattcggcgagatggagagagactgccagatcgcccacggcgccgcccagttcctgagagagagactgttcgaggccagcgacccctaccaggtgcacgtgtgcaacctgtgcggcatcatggccatcgccaacaccagaacccacacctacgagtgcagaggctgcagaaacaagacccagatcagcctggtgagaatgccctacgcctgcaagctgctgttccaggagctgatgagcatgagcatcgcccccagaatgatgagcgtgtag

SEQ ID NO: 9084 - DNA, 3525 bp, Artificial Sequence; identical to SEQ ID NO: 9083
  Description of Artificial Sequence: Synthetic coding sequence

SEQ ID NO: 9085 - DNA, 429 bp, Artificial Sequence
  Description of Artificial Sequence: Synthetic coding sequence
atggccgccggcggcagcgaccccagagccggcgacgtggaggaggacgccagccagctgatcttccccaaggagttcgagaccgccgagaccctgctgaacagcgaggtgcacatgctgctggagcacagaaagcagcagaacgagagcgccgaggacgagcaggagctgagcgaggtgttcatgaagaccctgaactacaccgccagattcagcagattcaagaacagagagaccatcgccagcgtgagaagcctgctgctgcagaagaagctgcacaagttcgagctggcctgcctggccaacctgtgccccgagaccgccgaggagagcaaggccctgatccccagcctggagggcagattcgaggacgaggagctgcagcagatcctggacgacatccagaccaagagaagcttccagtactag

SEQ ID NO: 9086 - DNA, 348 bp, Artificial Sequence
  Description of Artificial Sequence: Synthetic coding sequence
atgaacgccccccccgccttcgagagcttcctgctgttcgagggcgagaagatcaccatcaacaaggacaccaaggtgcccaacgcctgcctgttcaccatcaacaaggaggaccacaccctgggcaacatcatcaagagccagctgctgaaggacccccaggtgctgttcgccggctacaaggtgccccaccccctggagcacaagatcatcatcagagtgcagaccacccccgactacagcccccaggaggccttcaccaacgccatcaccgacctgatcagcgagctgagcctgctggaggagagattcagaacctgcctgctgcccctgagactgctgccctag

SEQ ID NO: 9087 - DNA, 348 bp, Artificial Sequence; identical to SEQ ID NO: 9086
  Description of Artificial Sequence: Synthetic coding sequence

SEQ ID NO: 9088 - DNA, 1107 bp, Artificial Sequence
  Description of Artificial Sequence: Synthetic coding sequence
atgtgcagcctgcccagaggcttcgagccccaggcccccgaggacctggcccagagaagcctggtggagctgagagagatgctgaagagacaggagagactgctgagaaacgagaagttcatctgcaagctgcccgacaagggcaagaagatcttcgacagcttcgccaagctgaaggccgccatcgccgagtgcgaggaggtgagaagaaagagcgagctgttcaaccccgtgagcctggactgcaagctgagacagaaggccatcgccgaggtggacgtgggcaccgacaaggcccagaacagcgaccccatcctggacaccagcagcctggtgcccggctgcagcagcgtggacaacatcaagagcagccagaccagccagaaccagggcctgggcagacccaccctggagggcgacgaggagaccagcgaggtggagtacaccgtgaacaagggccccgccagcagcaacagagacagagtgccccccagcagcgaggccagcgagcaccaccccagacacagagtgagcagccaggccgaggacaccagcagcagcttcgacaacctgttcatcgacagactgcagagaatcaccatcgccgaccagggcgagcagcagagcgaggagaacgccagcaccaagaacctgaccggcctgagcagcggcaccgagaagaagccccactacatggaggtgctggagatgagagccaagaaccccgtgccccagctgagaaagttcaagaccaacgtgctgcccttcagacagaacgacagcagcagccactgccagaagagcggcagccccatcagcagcgaggagagaagaagaagagacaagcagcacctggacgacatcaccgccgccagactgctgcccctgcaccacatgcccacccagctgctgagcatcgaggagagcctggccctgcagaagcagcagaagcagaactacgaggagatgcaggccaagctggccgcccagaagctggccgagagactgaacatcaagatgagaagctacaaccccgagggcgagagcagcggcagatacagagaggtgagagacgaggacgacgactggagcagcgacgagttctag

SEQ ID NO: 9089 - DNA, 636 bp, Artificial Sequence
  Description of Artificial Sequence: Synthetic coding sequence
atgtgcagcctgcccagaggcttcgagccccaggcccccgaggacctggcccagagaagcctggtggagctgagagagatgctgaagagacaggagagactgctgagaaacgagctgcagagaatcaccatcgccgaccagggcgagcagcagagcgaggagaacgccagcaccaagaacctgaccggcctgagcagcggcaccgagaagaagccccactacatggaggtgctggagatgagagccaagaaccccgtgccccagctgagaaagttcaagaccaacgtgctgcccttcagacagaacgacagcagcagccactgccagaagagcggcagccccatcagcagcgaggagagaagaagaagagacaagcagcacctggacgacatcaccgccgccagactgctgcccctgcaccacatgcccacccagctgctgagcatcgaggagagcctggccctgcagaagcagcagaagcagaactacgaggagatgcaggccaagctggccgcccagaagctggccgagagactgaacatcaagatgagaagctacaaccccgagggcgagagcagcggcagatacagagaggtgagagacgaggacgacgactggagcagcgacgagttctag

SEQ ID NO: 9090 - DNA, 1092 bp, Artificial Sequence
  Description of Artificial Sequence: Synthetic coding sequence
atgtgcagcctgcccagaggcttcgagccccaggcccccgaggacctggcccagagaagcctggtggagctgagagagatgctgaagagacaggagagactgctgagaaacgagaagttcatctgcaagctgcccgacaagggcaagaagatcttcgacagcttcgccaagctgaaggccgccatcgccgagtgcgaggaggtgagaagaaagagcgagctgttcaaccccgtgagcctggactgcaagctgagacagaaggccatcgccgaggtggacgtgggcaccgacaaggcccagaacagcgaccccatcctggacaccagcagcctggtgcccggctgcagcagcgtggacaacatcaagagcagccagaccagccagaaccagggcctgggcagacccaccctggagggcgacgaggagaccagcgaggtggagtacaccgtgaacaagggccccgccagcagcaacagagacagagtgccccccagcagcgaggccagcgagcaccaccccagacacagagtgagcagccaggccgaggacaccagcagcagcttcgacaacctgttcatcgacagactgcagagaatcaccatcgccgaccagggcgagcagcagagcgaggagaacgccagcaccaagaacctgaccggcctgagcagcggcaccgagaagaagccccactacatggaggtgctggagatgagagccaagaaccccgtgccccagctgagaaagttcaagaccaacgtgctgcccttcagacagaacgacagcagcagccactgccagaagagcggcagccccatcagcagcgaggagagaagaagaagagacaagcagcacctggacgacatcaccgccgccagactgctgcccctgcaccacatgcccacccagctgctgagcatcgaggagagcctggccctgcagaagcagcagaagcagaactacgaggagagacccttctacagcccccagtacagaagcagcatgaacctgctgagcctggccgccgccgccaaggacaccagaggcagcaagagcggcaagatgggcagcctggccctgctgaccaagctgtag

SEQ ID NO: 9091 - DNA, 1605 bp, Artificial Sequence
  Description of Artificial Sequence: Synthetic coding sequence
atgacccaggccgagatcaagctgtgcagcctgctgctgcaggagcacttcggcgagatcgtggagaagatcggcgtgcacctgatcagaaccggcagccagcccctgagagtgatcgcccacgacaccggcaccagcctggaccaggtgaagaaggccctgtgcgtgctggtgcagcacaacctggtgagctaccaggtgcacaagagaggcgtggtggagtacgaggcccagtgcagcagagtgctgagaatgctgagataccccagatacatctacaccaccaagaccctgtacagcgacaccggcgagctgatcgtggaggagctgctgctgaacggcaagctgaccatgagcgccgtggtgaagaaggtggccgacagactgaccgagaccatggaggacggcaagaccatggactacgccgaggtgagcaacaccttcgtgagactggccgacacccacttcgtgcagagatgccccagcgtgcccaccaccgagaacagcgaccccggcccccccccccccgcccccaccctggtgatcaacgagaaggacatgtacctggtgcccaagctgagcctgatcggcaagggcaagagaagaagaagcagcgacgaggacgccgccggcgagcccaaggccaagagacccaagtacaccaccgacaacaaggagcccatccccgacgacggcatctactggcaggccaacctggacagattccaccagcacttcagagaccaggccatcgtgagcgccgtggccaacagaatggaccagaccagcagcgagatcgtgagaaccatgctgagaatgagcgagatcaccaccagcagcagcgcccccttcacccagcccctgagcagcaacgagatcttcagaagcctgcccgtgggctacaacatcagcaagcaggtgctggaccagtacctgaccctgctggccgacgaccccctggagttcgtgggcaagagcggcgacagcggcggcggcatgtacgtgatcaacctgcacaaggccctggccagcctggccaccgccaccctggagagcgtggtgcaggagagattcggcagcagatgcgccagaatcttcagactggtgctgcagaagaagcacatcgagcagaagcaggtggaggacttcgccatgatccccgccaaggaggccaaggacatgctgtacaagatgctgagcgagaacttcatgagcctgcaggagatccccaagacccccgaccacgcccccagcagaaccttctacctgtacaccgtgaacatcctgagcgccgccagaatgctgctgcacagatgctacaagagcatcgccaacctgatcgagagaagacagttcgagaccaaggagaacaagagactgctggagaagagccagagagtggaggccatcatcgccagcatgcaggccaccggcgccgaggaggcccagctgcaggagatcgaggagatgatcaccgcccccgagagacagcagctggagaccctgaagagaaacgtgaacaagctggacgccagcgagatccaggtggacgagaccatcttcctgctggagagctacatcgagtgcaccatgaagagacagtag

SEQ ID NO: 9092 - DNA, 1236 bp, Artificial Sequence
  Description of Artificial Sequence: Synthetic coding sequence
atgacccaggccgagatcaagctgtgcagcctgctgctgcaggagcacttcggcgagatcgtggagaagatcggcgtgcacctgatcagaaccggcagccagcccctgagagtgatcgcccacgacaccggcaccagcctggaccaggtgaagaaggccctgtgcgtgctggtgcagcacaacctggtgagctaccaggtgcacaagagaggcgtggtggagtacgaggcccagtgcagcagagtgctgagaatgctgagataccccagatacatctacaccaccaagaccctgtacagcgacaccggcgagctgatcgtggaggagctgctgctgaacggcaagctgaccatgagcgccgtggtgaagaaggtggccgacagactgaccgagaccatggaggacggcaagaccatggactacgccgaggtgagcaacaccttcgtgagactggccgacacccacttcgtgcagagatgccccagcgtgcccaccaccgagaacagcgaccccggcccccccccccccgcccccaccctggtgatcaacgagaaggacatgtacctggtgcccaagctgagcctgatcggcaagggcaagagaagaagaagcagcgacgaggacgccgccggcgagcccaaggccaagagacccaagtacaccaccgacaacaaggagcccatccccgacgacggcatctactggcaggccaacctggacagattccaccagcacttcagagaccaggccatcgtgagcgccgtggccaacagaatggaccagaccagcagcgagatcgtgagaaccatgctgagaatgagcgagatcaccaccagcagcagcgcccccttcacccagcccctgagcagcaacgagatcttcagaagcctgcccgtgggctacaacatcagcaagcaggtgctggaccagtacctgaccctgctggccgacgaccccctggagttcgtgggcaagagcggcgacagcggcggcggcatgtacgtgatcaacctgcacaaggccctggccagcctggccaccgccaccctggagagcgtggtgcaggagagattcggcagcagatgcgccagaatcttcagactggtgctgcagaagaagcacatcgagcagaagcaggtggaggacttcgccatgatccccgccaaggaggccaaggacatgctgtacaagatgctgagcgagaacttcatgagcctgcaggtgggctgccagtag

SEQ ID NO: 9093 - DNA, 1197 bp, Artificial Sequence
  Description of Artificial Sequence: Synthetic coding sequence
atgagcgagggcaacgccgccggcgagcccagcacccccggcggccccagacccctgctgaccggcgccagaggcctgatcggcagaagacccgccccccccctgacccccggcagactgcccagcatcagaagcagagacctgaccctgggcggcgtgaagaagaagaccttcacccccaacatcatcagcagaaagatcaaggaggagcccaaggaggaggtgaccgtgaagaaggagaagagagagagagacagagacagacagagagagggccacggcagaggcagaggcagacccgaggtgatccagagccacagcatcttcgagcagggccccgccgagatgatgaagaagaagggcaactgggacaagaccgtggacgtgagcgacatgggccccagccacatcatcaacatcaagaaggagaagagagagaccgacgaggagaccaagcagatcctgagaatgctggagaaggacgacttcctggacgaccccggcctgagaaacgacaccagaaacatgcccgtgcagctgcccctggcccacagcggctggctgttcaaggaggagaacgacgagcccgacgtgaagccctggctggccggccccaaggaggaggacatggaggtggacatccccgccgtgaaggtgaaggaggagcccagagacgaggaggaggaggccaagatgaaggccccccccaaggccgccagaaagacccccggcctgcccaaggacgtgagcgtggccgagctgctgagagagctgagcctgaccaaggaggaggagctgctgttcctgcagctgcccgacaccctgcccggccagccccccacccaggacatcaagcccatcaagaccgaggtgcagggcgaggacggccaggtggtgctgatcaagcaggagaaggacagagaggccaagctggccgagaacgcctgcaccctggccgacctgaccgagggccaggtgggcaagctgctgatcagaaagagcggcagagtgcagctgctgctgggcaaggtgaccctggacgtgaccatgggcaccgcctgcagcttcctgcaggagctggtgagcgtgggcctgggcgacagcagaaccggcgagatgaccgtgctgggccacgtgaagcacaagctggtgtgcagccccgacttcgagagcctgctggaccacaagcacagatag

SEQ ID NO: 9094 - DNA, 1197 bp, Artificial Sequence; identical to SEQ ID NO: 9093
  Description of Artificial Sequence: Synthetic coding sequence

SEQ ID NO: 9095 - DNA, 2127 bp, Artificial Sequence
  Description of Artificial Sequence: Synthetic coding sequence
atggccaacgaggaggacgaccccgtggtgcaggagatcgacgtgtacctggccaagagcctggccgagaagctgtacctgttccagtaccccgtgagacccgccagcatgacctacgacgacatcccccacctgagcgccaagatcaagcccaagcagcagaaggtggagctggagatggccatcgacaccctgaaccccaactactgcagaagcaagggcgagcagatcgccctgaacgtggacggcgcctgcgccgacgagaccagcacctacagcagcaagctgatggacaagcagaccttctgcagcagccagaccaccagcaacaccagcagatacgccgccgccctgtacagacagggcgagctgcacctgacccccctgcacggcatcctgcagctgagacccagcttcagctacctggacaaggccgacgccaagcacagagagagagaggccgccaacgaggccggcgacagcagccaggacgaggccgaggacgacgtgaagcagatcaccgtgagattcagcagacccgagagcgagcaggccagacagagaagagtgcagagctacgagttcctgcagaagaagcacgccgaggagccctgggtgcacctgcactactacggcctgagagacagcagaagcgagcacgagagacagtacctgctgtgccccggcagcagcggcgtggagaacaccgagctggtgaagagccccagcgagtacctgatgatgctgatgccccccagccaggaggaggagaaggacaagcccgtggcccccagcaacgtgctgagcatggcccagctgagaaccctgcccctggccgaccagatcaagatcctgatgaagaacgtgaaggtgatgcccttcgccaacctgatgagcctgctgggccccagcatcgacagcgtggccgtgctgagaggcatccagaaggtggccatgctggtgcagggcaactgggtggtgaagagcgacatcctgtaccccaaggacagcagcagcccccacagcggcgtgcccgccgaggtgctgtgcagaggcagagacttcgtgatgtggaagttcacccagagcagatgggtggtgagaaaggaggtggccaccgtgaccaagctgtgcgccgaggacgtgaaggacttcctggagcacatggccgtggtgagaatcaacaagggctgggagttcatcctgccctacgacggcgagttcatcaagaagcaccccgacgtggtgcagagacagcacatgctgtggaccggcatccaggccaagctggagaaggtgtacaacctggtgaaggagaccatgcccaagaagcccgacgcccagagcggccccgccggcctggtgtgcggcgaccagagaatccaggtggccaagaccaaggcccagcagaaccacgccctgctggagagagagctgcagagaagaaaggagcagctgagagtgcccgccgtgccccccggcgtgagaatcaaggaggagcccgtgagcgaggagggcgaggaggacgaggagcaggaggccgaggaggagcccatggacaccagccccagcggcctgcacagcaagctggccaacggcctgcccctgggcagagccgccggcaccgacagcttcaacggccaccccccccagggctgcgccagcacccccgtggccagagagctgaaggccttcgtggaggccaccttccagagacagttcgtgctgaccctgagcgagctgaagagactgttcaacctgcacctggccagcctgccccccggccacaccctgttcagcggcatcagcgacagaatgctgcaggacaccgtgctggccgccggctgcaagcagatcctggtgcccttccccccccagaccgccgccagccccgacgagcagaaggtgttcgccctgtgggagagcggcgacatgagcgaccagcacagacaggtgctgctggagatcttcagcaagaactacagagtgagaagaaacatgatccagagcagactgacccaggagtgcggcgaggacctgagcaagcaggaggtggacaaggtgctgaaggactgctgcgtgagctacggcggcatgtggtacctgaagggcaccgtgcagagctag

SEQ ID NO: 9096 - DNA, 2001 bp, Artificial Sequence
  Description of Artificial Sequence: Synthetic coding sequence
atggccaacgaggaggacgaccccgtggtgcaggagatcgacgtgtacctggccaagagcctggccgagaagctgtacctgttccagtaccccgtgagacccgccagcatgacctacgacgacatcccccacctgagcgccaagatcaagcccaagcagcagaaggtggagctggagatggccatcgacaccctgaaccccaactactgcagaagcaagggcgagcagatcgccctgaacgtggacggcgcctgcgccgacgagaccagcacctacagcagcaagctgatggacaagcagaccttctgcagcagccagaccaccagcaacaccagcagatacgccgccgccctgtacagacagggcgagctgcacctgacccccctgcacggcatcctgcagctgagacccagcttcagctacctggacaaggccgacgccaagcacagagagagagaggccgccaacgaggccggcgacagcagccaggacgaggccgaggacgacgtgaagcagatcaccgtgagattcagcagacccgagagcgagcaggccagacagagaagagtgcagagctacgagttcctgcagaagaagcacgccgaggagccctgggtgcacctgcactactacggcctgagagacagcagaagcgagcacgagagacagtacctgctgtgccccggcagcagcggcgtggagaacaccgagctggtgaagagccccagcgagtacctgatgatgctgatgccccccagccaggaggaggagaaggacaagcccgtggcccccagcaacgtgctgagcatggcccagctgagaaccctgcccctggccgaccagatcaagatcctgatgaagaacgtgaaggtgatgcccttcgccaacctgatgagcctgctgggccccagcatcgacagcgtggccgtgctgagaggcatccagaaggtggccatgctggtgcagggcaactgggtggtgaagagcgacatcctgtaccccaaggacagcagcagcccccacagcggcgtgcccgccgaggtgctgtgcagaggcagagacttcgtgatgtggaagttcacccagagcagatgggtggtgagaaaggaggtggccaccgtgaccaagctgtgcgccgaggacgtgaaggacttcctggagcacatggccgtggtgagaatcaacaagggctgggagttcatcctgccctacgacggcgagttcatcaagaagcaccccgacgtggtgcagagacagcacatgctgtggaccggcatccaggccaagctggagaaggtgtacaacctggtgaaggagaccatgcccaagaagcccgacgcccagagcggccccgccggcctggtgtgcggcgaccagagaatccaggtggccaagaccaaggcccagcagaaccacgccctgctggagagagagctgcagagaagaaaggagcagctgagagtgcccgccgtgccccccggcgtgagaatcaaggaggagcccgtgagcgaggagggcgaggaggacgaggagcaggaggccgaggaggagcccatggacaccagccccagcggcctgcacagcaagctggccaacggcctgcccctgggcagagccgccggcaccgacagcttcaacggccaccccccccagggctgcgccagcacccccgtggccagagagctgaaggccttcgtggaggccaccttccagagacagttcgtgctgaccctgagcgagctgaagagactgttcaacctgcacctggccagcctgccccccggccacaccctgttcagcggcatcagcgacagaatgctgcaggacaccgtgctggccgccggctgcaagcagatcctggtgcccttccccccccagaccgccgccagccccgacgagcagaaggtgttcgccctgtgggagagcggcgacatgagcgaccaggactgctgcgtgagctacggcggcatgtggtacctgaagggcaccgtgcagagctag

SEQ ID NO: 9097 - DNA, 2019 bp, Artificial Sequence
  Description of Artificial Sequence: Synthetic coding sequence
atggccaacgaggaggacgaccccgtggtgcaggagatcaagcccaagcagcagaaggtggagctggagatggccatcgacaccctgaaccccaactactgcagaagcaagggcgagcagatcgccctgaacgtggacggcgcctgcgccgacgagaccagcacctacagcagcaagctgatggacaagcagaccttctgcagcagccagaccaccagcaacaccagcagatacgccgccgccctgtacagacagggcgagctgcacctgacccccctgcacggcatcctgcagctgagacccagcttcagctacctggacaaggccgacgccaagcacagagagagagaggccgccaacgaggccggcgacagcagccaggacgaggccgaggacgacgtgaagcagatcaccgtgagattcagcagacccgagagcgagcaggccagacagagaagagtgcagagctacgagttcctgcagaagaagcacgccgaggagccctgggtgcacctgcactactacggcctgagagacagcagaagcgagcacgagagacagtacctgctgtgccccggcagcagcggcgtggagaacaccgagctggtgaagagccccagcgagtacctgatgatgctgatgccccccagccaggaggaggagaaggacaagcccgtggcccccagcaacgtgctgagcatggcccagctgagaaccctgcccctggccgaccagatcaagatcctgatgaagaacgtgaaggtgatgcccttcgccaacctgatgagcctgctgggccccagcatcgacagcgtggccgtgctgagaggcatccagaaggtggccatgctggtgcagggcaactgggtggtgaagagcgacatcctgtaccccaaggacagcagcagcccccacagcggcgtgcccgccgaggtgctgtgcagaggcagagacttcgtgatgtggaagttcacccagagcagatgggtggtgagaaaggaggtggccaccgtgaccaagctgtgcgccgaggacgtgaaggacttcctggagcacatggccgtggtgagaatcaacaagggctgggagttcatcctgccctacgacggcgagttcatcaagaagcaccccgacgtggtgcagagacagcacatgctgtggaccggcatccaggccaagctggagaaggtgtacaacctggtgaaggagaccatgcccaagaagcccgacgcccagagcggccccgccggcctggtgtgcggcgaccagagaatccaggtggccaagaccaaggcccagcagaaccacgccctgctggagagagagctgcagagaagaaaggagcagctgagagtgcccgccgtgccccccggcgtgagaatcaaggaggagcccgtgagcgaggagggcgaggaggacgaggagcaggaggccgaggaggagcccatggacaccagccccagcggcctgcacagcaagctggccaacggcctgcccctgggcagagccgccggcaccgacagcttcaacggccaccccccccagggctgcgccagcacccccgtggccagagagctgaaggccttcgtggaggccaccttccagagacagttcgtgctgaccctgagcgagctgaagagactgttcaacctgcacctggccagcctgccccccggccacaccctgttcagcggcatcagcgacagaatgctgcaggacaccgtgctggccgccggctgcaagcagatcctggtgcccttccccccccagaccgccgccagccccgacgagcagaaggtgttcgccctgtgggagagcggcgacatgagcgaccagcacagacaggtgctgctggagatcttcagcaagaactacagagtgagaagaaacatgatccagagcagactgacccaggagtgcggcgaggacctgagcaagcaggaggtggacaaggtgctgaaggactgctgcgtgagctacggcggcatgtggtacctgaagggcaccgtgcagagctag

SEQ ID NO: 9098 - DNA, 2064 bp, Artificial Sequence
  Description of Artificial Sequence: Synthetic coding sequence
atggccaacgaggaggacgaccccgtggtgcaggagatcgacgtgtacctggccaagagcctggccgagaagctgtacctgttccagtaccccgtgagacccgccagcatgacctacgacgacatcccccacctgagcgccaagatcaagcccaagcagcagaaggtggagctggagatggccatcgacaccctgaaccccaactactgcagaagcaagggcgagcagatcgccctgaacgtggacggcgcctgcgccgacgagaccagcacctacagcagcaagctgatggacaagcagaccttctgcagcagccagaccaccagcaacaccagcagatacgccgccgccctgtacagacagggcgagctgcacctgacccccctgcacggcatcctgcagctgagacccagcttcagctacctggacaaggccgacgccaagcacagagagagagaggccgccaacgaggccggcgacagcagccaggacgaggccgaggacgacgtgaagcagatcaccgtgagattcagcagacccgagagcgagcaggccagacagagaagagtgcagagctacgagttcctgcagaagaagcacgccgaggagccctgggtgcacctgcactactacggcctgagagacagcagaagcgagcacgagagacagtacctgctgtgccccggcagcagcggcgtggagaacaccgagctggtgaagagccccagcgagtacctgatgatgctgatgccccccagccaggaggaggagaaggacaagcccgtggcccccagcaacgtgctgagcatggcccagctgagaaccctgcccctggccgaccagatcaagatcctgatgaagaacgtgaaggtgatgcccttcgccaacctgatgagcctgctgggccccagcatcgacagcgtggccgtgctgagaggcatccagaaggtggccatgctggtgcagggcaactgggtggtgaagagcgacatcctgtaccccaaggacagcagcagcccccacagcggcgtgcccgccgaggtgctgtgcagaggcagagacttcgtgatgtggaagttcacccagagcagatgggtggtgagaaaggaggtggccaccgtgaccaagctgtgcgccgaggacgtgaaggacttcctggagcacatggccgtggtgagaatcaacaagggctgggagttcatcctgccctacgacggcgagttcatcaagaagcaccccgacgtggtgcagagacagcacatgctgtggaccggcatccaggccaagctggagaaggtgtacaacctggtgaaggagaccatgcccaagaagcccgacgcccagagcggccccgccggcctggtgtgcggcgaccagagaatccaggtggccaagaccaaggcccagcagaaccacgccctgctggagagagagctgcagagaagaaaggagcagctgagagtgcccgccgtgccccccggcgtgagaatcaaggaggagcccgtgagcgaggagggcgaggaggacgaggagcaggaggccgaggaggagcccatggacaccagccccagcggcctgcacagcaagctggccaacggcctgcccctgggcagagccgccggcaccgacagcttcaacggccaccccccccagggctgcgccagcacccccgtggccagagagctgaaggccttcgtggaggccaccttccagagacagttcgtgctgaccctgagcgagctgaagagactgttcaacctgcacctggccagcctgccccccggccacaccctgttcagcggcatcagcgacagaatgctgcaggacaccgtgctggccgccggctgcaagcagatcctggtgcccttccccccccagaccgccgccagccccgacgagcagaaggtgttcgccctgtgggagagcggcgacatgagcgaccagagcagactgacccaggagtgcggcgaggacctgagcaagcaggaggtggacaaggtgctgaaggactgctgcgtgagctacggcggcatgtggtacctgaagggcaccgtgcagagctag

SEQ ID NO: 9099 - DNA, 951 bp, Artificial Sequence
  Description of Artificial Sequence: Synthetic coding sequence
atggccgaggtgaaggtgaaggtgcagccccccgacgccgaccccgtggagatcgagaacagaatcatcgagctgtgccaccagttcccccacggcatcaccgaccaggtgatccagaacgagatgccccacatcgaggcccagcagagagccgtggccatcaacagactgctgagcatgggccagctggacctgctgagaagcaacaccggcctgctgtacagaatcaaggacagccagaacgccggcaagatgaagggcagcgacaaccaggagaagctggtgtaccagatcatcgaggacgccggcaacaagggcatctggagcagagacatcagatacaagagcaacctgcccctgaccgagatcaacaagatcctgaagaacctggagagcaagaagctgatcaaggccgtgaagagcgtggccgccagcaagaagaaggtgtacatgctgtacaacctgcagcccgacagaagcgtgaccggcggcgcctggtacagcgaccaggacttcgagagcgagttcgtggaggtgctgaaccagcagtgcttcaagttcctgcagagcaaggccgagaccgccagagagagcaagcagaaccccatgatccagagaaacagcagcttcgccagcagccacgaggtgtggaagtacatctgcgagctgggcatcagcaaggtggagctgagcatggaggacatcgagaccatcctgaacaccctgatctacgacggcaaggtggagatgaccatcatcgccgccaaggagggcaccgtgggcagcgtggacggccacatgaagctgtacagagccgtgaaccccatcatcccccccaccggcctggtgagagccccctgcggcctgtgccccgtgttcgacgactgccacgagggcggcgagatcagccccagcaactgcatctacatgaccgagtggctggagttctag

SEQ ID NO: 9100 - DNA, 672 bp, Artificial Sequence
  Description of Artificial Sequence: Synthetic coding sequence
atggccggcaacaagggcagaggcagagccgcctacaccttcaacatcgaggccgtgggcttcagcaagggcgagaagctgcccgacgtggtgctgaagcccccccccctgttccccgacaccgactacaagcccgtgcccctgaagaccggcgagggcgaggagtacatgctggccctgaagcaggagctgagagagaccatgaagagaatgccctacttcatcgagacccccgaggagagacaggacatcgagagatacagcaagagatacatgaaggtgtacaaggaggagtggatccccgactggagaagactgcccagagagatgatgcccagaaacaagtgcaagaaggccggccccaagcccaagaaggccaaggacgccggcaagggcacccccctgaccaacaccgaggacgtgctgaagaagatggaggagctggagaagagaggcgacggcgagaagagcgacgaggagaacgaggagaaggagggcagcaaggagaagagcaaggagggcgacgacgacgacgacgacgacgccgccgagcaggaggagtacgacgaggaggagcaggaggaggagaacgactacatcaacagctacttcgaggacggcgacgacttcggcgccgacagcgacgacaacatggacgaggccacctactag

SEQ ID NO: 9101 - DNA, 672 bp, Artificial Sequence; identical to SEQ ID NO: 9100
  Description of Artificial Sequence: Synthetic coding sequence

SEQ ID NO: 9102 - DNA, 528 bp, Artificial Sequence
  Description of Artificial Sequence: Synthetic coding sequence
atgttcgtgctggtggagatggtggacaccgtgagaatccccccctggcagttcgagagaaagctgaacgacagcatcgccgaggagctgaacaagaagctggccaacaaggtggtgtacaacgtgggcctgtgcatctgcctgttcgacatcaccaagctggaggacgcctacgtgttccccggcgacggcgccagccacaccaaggtgagcctgggcttcttcgacgacatcctgatcccccccgagagcctgcagcagcccgccaagttcgacgaggccgagcaggtgtgggtgtgggagtacgagaccgaggagggcgcccacgacctgtacatggacaccggcgaggagatcagattcagagtggtggacgagagcttcgtggacaccagccccaccggccccagcagcgccgacgccaccaccagcagcgaggagctgcccaagaaggaggccccctacaccctggtgggcagcatcagcgagcccggcctgggcctgctgagctggtggaccagcaactag

SEQ ID NO: 9103 - DNA, 615 bp, Artificial Sequence
  Description of Artificial Sequence: Synthetic coding sequence
atgttcgtgctggtggagatggtggacaccgtgagaatccccccctggcagttcgagagaaagctgaacgacagcatcgccgaggagctgaacaagaagctggccaacaaggtggtgtacaacgtgggcctgtgcatctgcctgttcgacatcaccaagctggaggacgcctacgtgttccccggcgacggcgccagccacaccaaggtgcacttcagatgcgtggtgttccaccccttcctggacgagatcctgatcggcaagatcaagggctgcagccccgagggcgtgcacgtgagcctgggcttcttcgacgacatcctgatcccccccgagagcctgcagcagcccgccaagttcgacgaggccgagcaggtgtgggtgtgggagtacgagaccgaggagggcgcccacgacctgtacatggacaccggcgaggagatcagattcagagtggtggacgagagcttcgtggacaccagccccaccggccccagcagcgccgacgccaccaccagcagcgaggagctgcccaagaaggaggccccctacaccctggtgggcagcatcagcgagcccggcctgggcctgctgagctggtggaccagcaactag

SEQ ID NO: 9104 - DNA, 615 bp, Artificial Sequence; identical to SEQ ID NO: 9103
  Description of Artificial Sequence: Synthetic coding sequence

SEQ ID NO: 9105 - DNA, 615 bp, Artificial Sequence; identical to SEQ ID NO: 9103
  Description of Artificial Sequence: Synthetic coding sequence

SEQ ID NO: 9106 - DNA, 327 bp, Artificial Sequence
  Description of Artificial Sequence: Synthetic coding sequence
atgctgctgttctgccccggctgcggcaacggcctgatcgtggaggagggccagagatgccacagattcagctgcaacacctgcccctacgtgcacaacatcaccagaaaggtgaccaacagaaagtaccccaagctgaaggaggtggacgacgtgctgggcggcgccgccgcctgggagaacgtggacagcaccgccgagagctgccccaagtgcgagcaccccagagcctacttcatgcagctgcagaccagaagcgccgacgagcccatgaccaccttctacaagtgctgcaacgcccagtgcggccacagatggagagactag

SEQ ID NO: 9107 - DNA, 771 bp, Artificial Sequence
  Description of Artificial Sequence: Synthetic coding sequence
atgagcagaaagaagacccccaagagcaagggcgccagcacccccgccgccagcaccctgcccaccgccaacggcgccagacccgccagaagcggcaccgccctgagcggccccgacgccccccccaacggccccctgcagcccggcagacccagcctgggcggcggcgtggacttctacgacgtggccttcaaggtgatgctggtgggcgacagcggcgtgggcaagacctgcctgctggtgagattcaaggacggcgccttcctggccggcaccttcatcagcaccgtgggcatcgacttcagaaacaaggtgctggacgtggacggcgtgaaggtgaagctgcagatgtgggacaccgccggccaggagagattcagaagcgtgacccacgcctactacagagacgcccacgccctgctgctgctgtacgacgtgaccaacaaggccagcttcgacaacatccaggcctggctgaccgagatccacgagtacgcccagcacgacgtggccctgatgctgctgggcaacaaggtggacagcgcccacgagagagtggtgaagagagaggacggcgagaagctggccaaggagtacggcctgcccttcatggagaccagcgccaagaccggcctgaacgtggacctggccttcaccgccatcgccaaggagctgaagcagagaagcatgaaggcccccagcgagcccagattcagactgcacgactacgtgaagagagagggcagaggcgccagctgctgcagaccctag

SEQ ID NO: 9108 - DNA, 1668 bp, Artificial Sequence
  Description of Artificial Sequence: Synthetic coding sequence
atggacggcgtggtgaccgacctgatcaccgtgggcctgaagagaggcagcgacgagctgctgagcagcggcatcatcaacggccccttcaccatgaacagcagcacccccagcaccggcgtgtacgccaacggcaacgacagcaagaagttcaagagagacagacccccctgcagccccagcagagtgctgcacctgagaaagatcccctgcgacgtgaccgaggccgagatcatcagcctgggcctgcccttcggcaaggtgaccaacctgctgatgctgaagggcaagagccaggccttcctggagatggccagcgaggaggccgccgtgaccatggtgaactactacacccccatcaccccccacctgagaagccagcccgtgtacatccagtacagcaaccacagagagctgaagaccgacaacctgcccaaccaggccagagcccaggccgccctgcaggccgtgagcgccgtgcagagcggcagcctggccctgagcggcggccccagcaacgagggcaccgtgctgcccggccagagccccgtgctgagaatcatcatcgagaacctgttctaccccgtgaccctggaggtgctgcaccagatcttcagcaagttcggcaccgtgctgaagatcatcaccttcaccaagaacaaccagttccaggccctgctgcagtacgccgaccccgtgaacgcccactacgccaagatggccctggacggccagaacatctacaacgcctgctgcaccctgagaatcgacttcagcaagctgaccagcctgaacgtgaagtacaacaacgacaagagcagagacttcaccagactggacctgcccaccggcgacggccagcccagcctggagccccccatggccgccgccttcggcgcccccggcatcatcagcagcccctacgccggcgccgccggcttcgcccccgccatcggcttcccccaggccaccggcctgagcgtgcccgccgtgcccggcgccctgggccccctgaccatcaccagcagcgccgtgaccggcagaatggccatccccggcgccagcggcatccccggcaacagcgtgctgctggtgaccaacctgaaccccgacctgatcaccccccacggcctgttcatcctgttcggcgtgtacggcgacgtgcacagagtgaagatcatgttcaacaagaaggagaacgccctggtgcagatggccgacgccaaccaggcccagctggccatgaaccacctgagcggccagagactgtacggcaaggtgctgagagccaccctgagcaagcaccaggccgtgcagctgcccagagagggccaggaggaccagggcctgaccaaggacttcagcaacagccccctgcacagattcaagaagcccggcagcaagaacttccagaacatcttcccccccagcgccaccctgcacctgagcaacatcccccccagcgtgaccgtggacgacctgaagaacctgttcatcgaggccggctgcagcgtgaaggccttcaagttcttccagaaggacagaaagatggccctgatccagctgggcagcgtggaggaggccatccaggccctgatcgagctgcacaaccacgacctgggcgagaaccaccacctgagagtgagcttcagcaagagcaccatctag

SEQ ID NO: 9109 - DNA, 1374 bp, Artificial Sequence
  Description of Artificial Sequence: Synthetic coding sequence
atggccttcctggagatggccagcgaggaggccgccgtgaccatggtgaactactacacccccatcaccccccacctgagaagccagcccgtgtacatccagtacagcaaccacagagagctgaagaccgacaacctgcccaaccaggccagagcccaggccgccctgcaggccgtgagcgccgtgcagagcggcagcctggccctgagcggcggccccagcaacgagggcaccgtgctgcccggccagagccccgtgctgagaatcatcatcgagaacctgttctaccccgtgaccctggaggtgctgcaccagatcttcagcaagttcggcaccgtgctgaagatcatcaccttcaccaagaacaaccagttccaggccctgctgcagtacgccgaccccgtgaacgcccactacgccaagatggccctggacggccagaacatctacaacgcctgctgcaccctgagaatcgacttcagcaagctgaccagcctgaacgtgaagtacaacaacgacaagagcagagacttcaccagactggacctgcccaccggcgacggccagcccagcctggagccccccatggccgccgccttcggcgcccccggcatcatcagcagcccctacgccggcgccgccggcttcgcccccgccatcggcttcccccaggccaccggcctgagcgtgcccgccgtgcccggcgccctgggccccctgaccatcaccagcagcgccgtgaccggcagaatggccatccccggcgccagcggcatccccggcaacagcgtgctgctggtgaccaacctgaaccccgacctgatcaccccccacggcctgttcatcctgttcggcgtgtacggcgacgtgcacagagtgaagatcatgttcaacaagaaggagaacgccctggtgcagatggccgacgccaaccaggcccagctggccatgaaccacctgagcggccagagactgtacggcaaggtgctgagagccaccctgagcaagcaccaggccgtgcagctgcccagagagggccaggaggaccagggcctgaccaaggacttcagcaacagccccctgcacagattcaagaagcccggcagcaagaacttccagaacatcttcccccccagcgccaccctgcacctgagcaacatcccccccagcgtgaccgtggacgacctgaagaacctgttcatcgaggccggctgcagcgtgaaggccttcaagttcttccagaaggacagaaagatggccctgatccagctgggcagcgtggaggaggccatccaggccctgatcgagctgcacaaccacgacctgggcgagaaccaccacctgagagtgagcttcagcaagagcaccatctag

SEQ ID NO: 9110 - DNA, 1659 bp, Artificial Sequence
  Description of Artificial Sequence: Synthetic coding sequence
atggacggcgtggtgaccgacctgatcaccgtgggcctgaagagaggcagcgacgagctgctgagcagcggcatcatcaacggccccttcaccatgaacagcagcacccccagcaccgccaacggcaacgacagcaagaagttcaagagagacagacccccctgcagccccagcagagtgctgcacctgagaaagatcccctgcgacgtgaccgaggccgagatcatcagcctgggcctgcccttcggcaaggtgaccaacctgctgatgctgaagggcaagagccaggccttcctggagatggccagcgaggaggccgccgtgaccatggtgaactactacacccccatcaccccccacctgagaagccagcccgtgtacatccagtacagcaaccacagagagctgaagaccgacaacctgcccaaccaggccagagcccaggccgccctgcaggccgtgagcgccgtgcagagcggcagcctggccctgagcggcggccccagcaacgagggcaccgtgctgcccggccagagccccgtgctgagaatcatcatcgagaacctgttctaccccgtgaccctggaggtgctgcaccagatcttcagcaagttcggcaccgtgctgaagatcatcaccttcaccaagaacaaccagttccaggccctgctgcagtacgccgaccccgtgaacgcccactacgccaagatggccctggacggccagaacatctacaacgcctgctgcaccctgagaatcgacttcagcaagctgaccagcctgaacgtgaagtacaacaacgacaagagcagagacttcaccagactggacctgcccaccggcgacggccagcccagcctggagccccccatggccgccgccttcggcgcccccggcatcatcagcagcccctacgccggcgccgccggcttcgcccccgccatcggcttcccccaggccaccggcctgagcgtgcccgccgtgcccggcgccctgggccccctgaccatcaccagcagcgccgtgaccggcagaatggccatccccggcgccagcggcatccccggcaacagcgtgctgctggtgaccaacctgaaccccgacctgatcaccccccacggcctgttcatcctgttcggcgtgtacggcgacgtgcacagagtgaagatcatgttcaacaagaaggagaacgccctggtgcagatggccgacgccaaccaggcccagctggccatgaaccacctgagcggccagagactgtacggcaaggtgctgagagccaccctgagcaagcaccaggccgtgcagctgcccagagagggccaggaggaccagggcctgaccaaggacttcagcaacagccccctgcacagattcaagaagcccggcagcaagaacttccagaacatcttcccccccagcgccaccctgcacctgagcaacatcccccccagcgtgaccgtggacgacctgaagaacctgttcatcgaggccggctgcagcgtgaaggccttcaagttcttccagaaggacagaaagatggccctgatccagctgggcagcgtggaggaggccatccaggccctgatcgagctgcacaaccacgacctgggcgagaaccaccacctgagagtgagcttcagcaagagcaccatctag

SEQ ID NO: 9111 - DNA, 1575 bp, Artificial Sequence
  Description of Artificial Sequence: Synthetic coding sequence
atgaacagcagcacccccagcaccggcgtgtacgccaacggcaacgacagcaagaagttcaagagagacagacccccctgcagccccagcagagtgctgcacctgagaaagatcccctgcgacgtgaccgaggccgagatcatcagcctgggcctgcccttcggcaaggtgaccaacctgctgatgctgaagggcaagagccaggccttcctggagatggccagcgaggaggccgccgtgaccatggtgaactactacacccccatcaccccccacctgagaagccagcccgtgtacatccagtacagcaaccacagagagctgaagaccgacaacctgcccaaccaggccagagcccaggccgccctgcaggccgtgagcgccgtgcagagcggcagcctggccctgagcggcggccccagcaacgagggcaccgtgctgcccggccagagccccgtgctgagaatcatcatcgagaacctgttctaccccgtgaccctggaggtgctgcaccagatcttcagcaagttcggcaccgtgctgaagatcatcaccttcaccaagaacaaccagttccaggccctgctgcagtacgccgaccccgtgaacgcccactacgccaagatggccctggacggccagaacatctacaacgcctgctgcaccctgagaatcgacttcagcaagctgaccagcctgaacgtgaagtacaacaacgacaagagcagagacttcaccagactggacctgcccaccggcgacggccagcccagcctggagccccccatggccgccgccttcggcgcccccggcatcatcagcagcccctacgccggcgccgccggcttcgcccccgccatcggcttcccccaggccaccggcctgagcgtgcccgccgtgcccggcgccctgggccccctgaccatcaccagcagcgccgtgaccggcagaatggccatccccggcgccagcggcatccccggcaacagcgtgctgctggtgaccaacctgaaccccgacctgatcaccccccacggcctgttcatcctgttcggcgtgtacggcgacgtgcacagagtgaagatcatgttcaacaagaaggagaacgccctggtgcagatggccgacgccaaccaggcccagctggccatgaaccacctgagcggccagagactgtacggcaaggtgctgagagccaccctgagcaagcaccaggccgtgcagctgcccagagagggccaggaggaccagggcctgaccaaggacttcagcaacagccccctgcacagattcaagaagcccggcagcaagaacttccagaacatcttcccccccagcgccaccctgcacctgagcaacatcccccccagcgtgaccgtggacgacctgaagaacctgttcatcgaggccggctgcagcgtgaaggccttcaagttcttccagaaggacagaaagatggccctgatccagctgggcagcgtggaggaggccatccaggccctgatcgagctgcacaaccacgacctgggcgagaaccaccacctgagagtgagcttcagcaagagcaccatctag

SEQ ID NO: 9112 - DNA, 234 bp, Artificial Sequence
  Description of Artificial Sequence: Synthetic coding sequence
atggacggcgtggtgaccgacctgatcaccgtgggcctgaagagaggcagcgacgagctgctgagcagcggcatcatcaacggccccttcaccatgaacagcagcacccccagcaccggcgtgtacgccaacggcaacgacagcaagaagttcaagagagacagacccccctgcagccccagcagagtgctgcacctgagaaagatcccctgcgacgtgaccgaggccgagtag

SEQ ID NO: 9113 - DNA, 1677 bp, Artificial Sequence
  Description of Artificial Sequence: Synthetic coding sequence
atggacgccagccccagccccttcagcctgcccaagaagctgaacgagctgagcgccagaagaggcagcgacgagctgctgagcagcggcatcatcaacggccccttcaccatgaacagcagcacccccagcaccgccaacggcaacgacagcaagaagttcaagagagacagacccccctgcagccccagcagagtgctgcacctgagaaagatcccctgcgacgtgaccgaggccgagatcatcagcctgggcctgcccttcggcaaggtgaccaacctgctgatgctgaagggcaagagccaggccttcctggagatggccagcgaggaggccgccgtgaccatggtgaactactacacccccatcaccccccacctgagaagccagcccgtgtacatccagtacagcaaccacagagagctgaagaccgacaacctgcccaaccaggccagagcccaggccgccctgcaggccgtgagcgccgtgcagagcggcagcctggccctgagcggcggccccagcaacgagggcaccgtgctgcccggccagagccccgtgctgagaatcatcatcgagaacctgttctaccccgtgaccctggaggtgctgcaccagatcttcagcaagttcggcaccgtgctgaagatcatcaccttcaccaagaacaaccagttccaggccctgctgcagtacgccgaccccgtgaacgcccactacgccaagatggccctggacggccagaacatctacaacgcctgctgcaccctgagaatcgacttcagcaagctgaccagcctgaacgtgaagtacaacaacgacaagagcagagacttcaccagactggacctgcccaccggcgacggccagcccagcctggagccccccatggccgccgccttcggcgcccccggcatcatcagcagcccctacgccggcgccgccggcttcgcccccgccatcggcttcccccaggccaccggcctgagcgtgcccgccgtgcccggcgccctgggccccctgaccatcaccagcagcgccgtgaccggcagaatggccatccccggcgccagcggcatccccggcaacagcgtgctgctggtgaccaacctgaaccccgacctgatcaccccccacggcctgttcatcctgttcggcgtgtacggcgacgtgcacagagtgaagatcatgttcaacaagaaggagaacgccctggtgcagatggccgacgccaaccaggcccagctggccatgaaccacctgagcggccagagactgtacggcaaggtgctgagagccaccctgagcaagcaccaggccgtgcagctgcccagagagggccaggaggaccagggcctgaccaaggacttcagcaacagccccctgcacagattcaagaagcccggcagcaagaacttccagaacatcttcccccccagcgccaccctgcacctgagcaacatcccccccagcgtgaccgtggacgacctgaagaacctgttcatcgaggccggctgcagcgtgaaggccttcaagttcttccagaaggacagaaagatggccctgatccagctgggcagcgtggaggaggccatccaggccctgatcgagctgcacaaccacgacctgggcgagaaccaccacctgagagtgagcttcagcaagagcaccatctag

SEQ ID NO: 9114 - DNA, 1500 bp, Artificial Sequence
  Description of Artificial Sequence: Synthetic coding sequence
atggagaacggccagagcaccgccgccaagctgggcctgccccccctgacccccgagcagcaggaggccctgcagaaggccaagaagtacgccatggagcagagcatcaagagcgtgctggtgaagcagaccatcgcccaccagcagcagcagctgaccaacctgcagatggccgcccagagacagagagccctggccatcatgtgcagagtgtacgtgggcagcatctactacgagctgggcgaggacaccatcagacaggccttcgcccccttcggccccatcaagagcatcgacatgagctgggacagcgtgaccatgaagcacaagggcttcgccttcgtggagtacgaggtgcccgaggccgcccagctggccctggagcagatgaacagcgtgatgctgggcggcagaaacatcaaggtgggcagacccagcaacatcggccaggcccagcccatcatcgaccagctggccgaggaggccagagccttcaacagaatctacgtggccagcgtgcaccaggacctgagcgacgacgacatcaagagcgtgttcgaggccttcggcaagatcaagagctgcaccctggccagagaccccaccaccggcaagcacaagggctacggcttcatcgagtacgagaaggcccagagcagccaggacgccgtgagcagcatgaacctgttcgacctgggcggccagtacctgagagtgggcaaggccgtgaccccccccatgcccctgctgacccccgccacccccggcggcctgccccccgccgccgccgtggccgccgccgccgccaccgccaagatcaccgcccaggaggccgtggccggcgccgccgtgctgggcaccctgggcacccccggcctggtgagccccgccctgaccctggcccagcccctgggcaccctgccccaggccgtgatggccgcccaggcccccggcgtgatcaccggcgtgacccccgccagaccccccatccccgtgaccatccccagcgtgggcgtggtgaaccccatcctggccagcccccccaccctgggcctgctggagcccaagaaggagaaggaggaggaggagctgttccccgagagcgagagacccgagatgctgagcgagcaggagcacatgagcatcagcggcagcagcgccagacacatggtgatgcagaagctgctgagaaagcaggagagcaccgtgatggtgctgagaaacatggtggaccccaaggacatcgacgacgacctggagggcgaggtgaccgaggagtgcggcaagttcggcgccgtgaacagagtgatcatctaccaggagaagcagggcgaggaggaggacgccgagatcatcgtgaagatcttcgtggagttcagcatcgccagcgagacccacaaggccatccaggccctgaacggcagatggttcgccggcagaaaggtggtggccgaggtgtacgaccaggagagattcgacaacagcgacctgagcgcctag

SEQ ID NO: 9115 - DNA, 1629 bp, Artificial Sequence
  Description of Artificial Sequence: Synthetic coding sequence
atggccaccgccaccatcgccctgcaggtgaacggccagcagggcggcggcagcgagcccgccgccgccgccgccgtggtggccgccggcgacaagtggaagcccccccagggcaccgacagcatcaagatggagaacggccagagcaccgccgccaagctgggcctgccccccctgacccccgagcagcaggaggccctgcagaaggccaagaagtacgccatggagcagagcatcaagagcgtgctggtgaagcagaccatcgcccaccagcagcagcagctgaccaacctgcagatggccgcccagagacagagagccctggccatcatgtgcagagtgtacgtgggcagcatctactacgagctgggcgaggacaccatcagacaggccttcgcccccttcggccccatcaagagcatcgacatgagctgggacagcgtgaccatgaagcacaagggcttcgccttcgtggagtacgaggtgcccgaggccgcccagctggccctggagcagatgaacagcgtgatgctgggcggcagaaacatcaaggtgggcagacccagcaacatcggccaggcccagcccatcatcgaccagctggccgaggaggccagagccttcaacagaatctacgtggccagcgtgcaccaggacctgagcgacgacgacatcaagagcgtgttcgaggccttcggcaagatcaagagctgcaccctggccagagaccccaccaccggcaagcacaagggctacggcttcatcgagtacgagaaggcccagagcagccaggacgccgtgagcagcatgaacctgttcgacctgggcggccagtacctgagagtgggcaaggccgtgaccccccccatgcccctgctgacccccgccacccccggcggcctgccccccgccgccgccgtggccgccgccgccgccaccgccaagatcaccgcccaggaggccgtggccggcgccgccgtgctgggcaccctgggcacccccggcctggtgagccccgccctgaccctggcccagcccctgggcaccctgccccaggccgtgatggccgcccaggcccccggcgtgatcaccggcgtgacccccgccagaccccccatccccgtgaccatccccagcgtgggcgtggtgaaccccatcctggccagcccccccaccctgggcctgctggagcccaagaaggagaaggaggaggaggagctgttccccgagagcgagagacccgagatgctgagcgagcaggagcacatgagcatcagcggcagcagcgccagacacatggtgatgcagaagctgctgagaaagcaggagagcaccgtgatggtgctgagaaacatggtggaccccaaggacatcgacgacgacctggagggcgaggtgaccgaggagtgcggcaagttcggcgccgtgaacagagtgatcatctaccaggagaagcagggcgaggaggaggacgccgagatcatcgtgaagatcttcgtggagttcagcatcgccagcgagacccacaaggccatccaggccctgaacggcagatggttcgccggcagaaaggtggtggccgaggtgtacgaccaggagagattcgacaacagcgacctgagcgcctag

SEQ ID NO: 9116 - DNA, 1551 bp, Artificial Sequence
  Description of Artificial Sequence: Synthetic coding sequence
atggagaacggccagagcaccgccgccaagctgggcctgccccccctgacccccgagcagcaggaggccctgcagaaggccaagaagtacgccatggagcagagcatcaagagcgtgctggtgaagcagaccatcgcccaccagcagcagcagctgaccaacctgcagatggccgccgtgaccatgggcttcggcgaccccctgagccccctgcagagcatggccgcccagagacagagagccctggccatcatgtgcagagtgtacgtgggcagcatctactacgagctgggcgaggacaccatcagacaggccttcgcccccttcggccccatcaagagcatcgacatgagctgggacagcgtgaccatgaagcacaagggcttcgccttcgtggagtacgaggtgcccgaggccgcccagctggccctggagcagatgaacagcgtgatgctgggcggcagaaacatcaaggtgggcagacccagcaacatcggccaggcccagcccatcatcgaccagctggccgaggaggccagagccttcaacagaatctacgtggccagcgtgcaccaggacctgagcgacgacgacatcaagagcgtgttcgaggccttcggcaagatcaagagctgcaccctggccagagaccccaccaccggcaagcacaagggctacggcttcatcgagtacgagaaggcccagagcagccaggacgccgtgagcagcatgaacctgttcgacctgggcggccagtacctgagagtgggcaaggccgtgaccccccccatgcccctgctgacccccgccacccccggcggcctgccccccgccgccgccgtggccgccgccgccgccaccgccaagatcaccgcccaggaggccgtggccggcgccgccgtgctgggcaccctgggcacccccggcctggtgagccccgccctgaccctggcccagcccctgggcaccctgccccaggccgtgatggccgcccaggcccccggcgtgatcaccggcgtgacccccgccagaccccccatccccgtgaccatccccagcgtgggcgtggtgaaccccatcctggccagcccccccaccctgggcctgctggagcccaagaaggagaaggaggaggaggagctgttccccgagagcgagagacccgagatgctgagcgagcaggagcacatgagcatcagcggcagcagcgccagacacatggtgatgcagaagctgctgagaaagcaggagagcaccgtgatggtgctgagaaacatggtggaccccaaggacatcgacgacgacctggagggcgaggtgaccgaggagtgcggcaagttcggcgccgtgaacagagtgatcatctaccaggagaagcagggcgaggaggaggacgccgagatcatcgtgaagatcttcgtggagttcagcatcgccagcgagacccacaaggccatccaggccctgaacggcagatggttcgccggcagaaaggtggtggccgaggtgtacgaccaggagagattcgacaacagcgacctgagcgcctag

SEQ ID NO: 9117 - DNA, 1680 bp, Artificial Sequence
  Description of Artificial Sequence: Synthetic coding sequence
atggccaccgccaccatcgccctgcaggtgaacggccagcagggcggcggcagcgagcccgccgccgccgccgccgtggtggccgccggcgacaagtggaagcccccccagggcaccgacagcatcaagatggagaacggccagagcaccgccgccaagctgggcctgccccccctgacccccgagcagcaggaggccctgcagaaggccaagaagtacgccatggagcagagcatcaagagcgtgctggtgaagcagaccatcgcccaccagcagcagcagctgaccaacctgcagatggccgccgtgaccatgggcttcggcgaccccctgagccccctgcagagcatggccgcccagagacagagagccctggccatcatgtgcagagtgtacgtgggcagcatctactacgagctgggcgaggacaccatcagacaggccttcgcccccttcggccccatcaagagcatcgacatgagctgggacagcgtgaccatgaagcacaagggcttcgccttcgtggagtacgaggtgcccgaggccgcccagctggccctggagcagatgaacagcgtgatgctgggcggcagaaacatcaaggtgggcagacccagcaacatcggccaggcccagcccatcatcgaccagctggccgaggaggccagagccttcaacagaatctacgtggccagcgtgcaccaggacctgagcgacgacgacatcaagagcgtgttcgaggccttcggcaagatcaagagctgcaccctggccagagaccccaccaccggcaagcacaagggctacggcttcatcgagtacgagaaggcccagagcagccaggacgccgtgagcagcatgaacctgttcgacctgggcggccagtacctgagagtgggcaaggccgtgaccccccccatgcccctgctgacccccgccacccccggcggcctgccccccgccgccgccgtggccgccgccgccgccaccgccaagatcaccgcccaggaggccgtggccggcgccgccgtgctgggcaccctgggcacccccggcctggtgagccccgccctgaccctggcccagcccctgggcaccctgccccaggccgtgatggccgcccaggcccccggcgtgatcaccggcgtgacccccgccagaccccccatccccgtgaccatccccagcgtgggcgtggtgaaccccatcctggccagcccccccaccctgggcctgctggagcccaagaaggagaaggaggaggaggagctgttccccgagagcgagagacccgagatgctgagcgagcaggagcacatgagcatcagcggcagcagcgccagacacatggtgatgcagaagctgctgagaaagcaggagagcaccgtgatggtgctgagaaacatggtggaccccaaggacatcgacgacgacctggagggcgaggtgaccgaggagtgcggcaagttcggcgccgtgaacagagtgatcatctaccaggagaagcagggcgaggaggaggacgccgagatcatcgtgaagatcttcgtggagttcagcatcgccagcgagacccacaaggccatccaggccctgaacggcagatggttcgccggcagaaaggtggtggccgaggtgtacgaccaggagagattcgacaacagcgacctgagcgcctag

SEQ ID NO: 9118 - DNA, 2232 bp, Artificial Sequence
  Description of Artificial Sequence: Synthetic coding sequence
atgaacaaccccagcgagaccagcaagcccagcatggagagcggcgacggcaacaccggcacccagaccaacggcctggacttccagaagcagcccgtgcccgtgggcggcgccatcagcaccgcccaggcccaggccttcctgggccacctgcaccaggtgcagctggccggcaccagcctgcaggccgccgcccagagcctgaacgtgcagagcaagagcaacgaggagagcggcgacagccagcagcccagccagcccagccagcagcccagcgtgcaggccgccatcccccagacccagctgatgctggccggcggccagatcaccggcctgaccctgacccccgcccagcagcagctgctgctgcagcaggcccaggcccaggcccagctgctggccgccgccgtgcagcagcacagcgccagccagcagcacagcgccgccggcgccaccatcagcgccagcgccgccacccccatgacccagatccccctgagccagcccatccagatcgcccaggacctgcagcagctgcagcagctgcagcagcagaacctgaacctgcagcagttcgtgctggtgcaccccaccaccaacctgcagcccgcccagttcatcatcagccagaccccccagggccagcagggcctgctgcaggcccagaacctgctgacccagctgccccagcagagccaggccaacctgctgcagagccagcccagcatcaccctgaccagccagcccgccacccccaccagaaccatcgccgccacccccatccagaccctgccccagagccagagcacccccaagagaatcgacacccccagcctggaggagcccagcgacctggaggagctggagcagttcgccaagaccttcaagcagagaagaatcaagctgggcttcacccagggcgacgtgggcctggccatgggcaagctgtacggcaacgacttcagccagaccaccatcagcagattcgaggccctgaacctgagcttcaagaacatgtgcaagctgaagcccctgctggagaagtggctgaacgacgccgagaacctgagcagcgacagcagcctgagcagccccagcgccctgaacagccccggcatcgagggcctgagcagaagaagaaagaagagaaccagcatcgagaccaacatcagagtggccctggagaagagcttcctggagaaccagaagcccaccagcgaggagatcaccatgatcgccgaccagctgaacatggagaaggaggtgatcagagtgtggttctgcaacagaagacagaaggagaagagaatcaacccccccagcagcggcggcaccagcagcagccccatcaaggccatcttccccagccccaccagcctggtggccaccacccccagcctggtgaccagcagcgccgccaccaccctgaccgtgagccccgtgctgcccctgaccagcgccgccgtgaccaacctgagcgtgaccggcaccagcgacaccaccagcaacaacaccgccaccgtgatcagcaccgccccccccgccagcagcgccgtgaccagccccagcctgagccccagccccagcgccagcgccagcaccagcgaggccagcagcgccagcgagaccagcaccacccagaccaccagcacccccctgagcagccccctgggcaccagccaggtgatggtgaccgccagcggcctgcagaccgccgccgccgccgccctgcagggcgccgcccagctgcccgccaacgccagcctggccgccatggccgccgccgccggcctgaaccccagcctgatggcccccagccagttcgccgccggcggcgccctgctgagcctgaaccccggcaccctgagcggcgccctgagccccgccctgatgagcaacagcaccctggccaccatccaggccctggccagcggcggcagcctgcccatcaccagcctggacgccaccggcaacctggtgttcgccaacgccggcggcgcccccaacatcgtgaccgcccccctgttcctgaacccccagaacctgagcctgctgaccagcaaccccgtgagcctggtgagcgccgccgccgccagcgccggcaacagcgcccccgtggccagcctgcacgccaccagcaccagcgccgagagcatccagaacagcctgttcaccgtggccagcgccagcggcgccgccagcaccaccaccaccgccagcaaggcccagtag

SEQ ID NO: 9119 - DNA, 2268 bp, Artificial Sequence
  Description of Artificial Sequence: Synthetic coding sequence
atgctggactgcagcgactacgtgctggacagcagaatgaacaaccccagcgagaccagcaagcccagcatggagagcggcgacggcaacaccggcacccagaccaacggcctggacttccagaagcagcccgtgcccgtgggcggcgccatcagcaccgcccaggcccaggccttcctgggccacctgcaccaggtgcagctggccggcaccagcctgcaggccgccgcccagagcctgaacgtgcagagcaagagcaacgaggagagcggcgacagccagcagcccagccagcccagccagcagcccagcgtgcaggccgccatcccccagacccagctgatgctggccggcggccagatcaccggcctgaccctgacccccgcccagcagcagctgctgctgcagcaggcccaggcccaggcccagctgctggccgccgccgtgcagcagcacagcgccagccagcagcacagcgccgccggcgccaccatcagcgccagcgccgccacccccatgacccagatccccctgagccagcccatccagatcgcccaggacctgcagcagctgcagcagctgcagcagcagaacctgaacctgcagcagttcgtgctggtgcaccccaccaccaacctgcagcccgcccagttcatcatcagccagaccccccagggccagcagggcctgctgcaggcccagaacctgctgacccagctgccccagcagagccaggccaacctgctgcagagccagcccagcatcaccctgaccagccagcccgccacccccaccagaaccatcgccgccacccccatccagaccctgccccagagccagagcacccccaagagaatcgacacccccagcctggaggagcccagcgacctggaggagctggagcagttcgccaagaccttcaagcagagaagaatcaagctgggcttcacccagggcgacgtgggcctggccatgggcaagctgtacggcaacgacttcagccagaccaccatcagcagattcgaggccctgaacctgagcttcaagaacatgtgcaagctgaagcccctgctggagaagtggctgaacgacgccgagaacctgagcagcgacagcagcctgagcagccccagcgccctgaacagccccggcatcgagggcctgagcagaagaagaaagaagagaaccagcatcgagaccaacatcagagtggccctggagaagagcttcctggagaaccagaagcccaccagcgaggagatcaccatgatcgccgaccagctgaacatggagaaggaggtgatcagagtgtggttctgcaacagaagacagaaggagaagagaatcaacccccccagcagcggcggcaccagcagcagccccatcaaggccatcttccccagccccaccagcctggtggccaccacccccagcctggtgaccagcagcgccgccaccaccctgaccgtgagccccgtgctgcccctgaccagcgccgccgtgaccaacctgagcgtgaccggcaccagcgacaccaccagcaacaacaccgccaccgtgatcagcaccgccccccccgccagcagcgccgtgaccagccccagcctgagccccagccccagcgccagcgccagcaccagcgaggccagcagcgccagcgagaccagcaccacccagaccaccagcacccccctgagcagccccctgggcaccagccaggtgatggtgaccgccagcggcctgcagaccgccgccgccgccgccctgcagggcgccgcccagctgcccgccaacgccagcctggccgccatggccgccgccgccggcctgaaccccagcctgatggcccccagccagttcgccgccggcggcgccctgctgagcctgaaccccggcaccctgagcggcgccctgagccccgccctgatgagcaacagcaccctggccaccatccaggccctggccagcggcggcagcctgcccatcaccagcctggacgccaccggcaacctggtgttcgccaacgccggcggcgcccccaacatcgtgaccgcccccctgttcctgaacccccagaacctgagcctgctgaccagcaaccccgtgagcctggtgagcgccgccgccgccagcgccggcaacagcgcccccgtggccagcctgcacgccaccagcaccagcgccgagagcatccagaacagcctgttcaccgtggccagcgccagcggcgccgccagcaccaccaccaccgccagcaaggcccagtag

SEQ ID NO: 9120 - DNA, 2226 bp, Artificial Sequence
  Description of Artificial Sequence: Synthetic coding sequence
atgaagaccagaatgaagatcttcgtgatgatccacttccacctgatgaacagcacccagaccaacggcctggacttccagaagcagcccgtgcccgtgggcggcgccatcagcaccgcccaggcccaggccttcctgggccacctgcaccaggtgcagctggccggcaccagcctgcaggccgccgcccagagcctgaacgtgcagagcaagagcaacgaggagagcggcgacagccagcagcccagccagcccagccagcagcccagcgtgcaggccgccatcccccagacccagctgatgctggccggcggccagatcaccggcctgaccctgacccccgcccagcagcagctgctgctgcagcaggcccaggcccaggcccagctgctggccgccgccgtgcagcagcacagcgccagccagcagcacagcgccgccggcgccaccatcagcgccagcgccgccacccccatgacccagatccccctgagccagcccatccagatcgcccaggacctgcagcagctgcagcagctgcagcagcagaacctgaacctgcagcagttcgtgctggtgcaccccaccaccaacctgcagcccgcccagttcatcatcagccagaccccccagggccagcagggcctgctgcaggcccagaacctgctgacccagctgccccagcagagccaggccaacctgctgcagagccagcccagcatcaccctgaccagccagcccgccacccccaccagaaccatcgccgccacccccatccagaccctgccccagagccagagcacccccaagagaatcgacacccccagcctggaggagcccagcgacctggaggagctggagcagttcgccaagaccttcaagcagagaagaatcaagctgggcttcacccagggcgacgtgggcctggccatgggcaagctgtacggcaacgacttcagccagaccaccatcagcagattcgaggccctgaacctgagcttcaagaacatgtgcaagctgaagcccctgctggagaagtggctgaacgacgccgagaacctgagcagcgacagcagcctgagcagccccagcgccctgaacagccccggcatcgagggcctgagcagaagaagaaagaagagaaccagcatcgagaccaacatcagagtggccctggagaagagcttcctggagaaccagaagcccaccagcgaggagatcaccatgatcgccgaccagctgaacatggagaaggaggtgatcagagtgtggttctgcaacagaagacagaaggagaagagaatcaacccccccagcagcggcggcaccagcagcagccccatcaaggccatcttccccagccccaccagcctggtggccaccacccccagcctggtgaccagcagcgccgccaccaccctgaccgtgagccccgtgctgcccctgaccagcgccgccgtgaccaacctgagcgtgaccggcaccagcgacaccaccagcaacaacaccgccaccgtgatcagcaccgccccccccgccagcagcgccgtgaccagccccagcctgagccccagccccagcgccagcgccagcaccagcgaggccagcagcgccagcgagaccagcaccacccagaccaccagcacccccctgagcagccccctgggcaccagccaggtgatggtgaccgccagcggcctgcagaccgccgccgccgccgccctgcagggcgccgcccagctgcccgccaacgccagcctggccgccatggccgccgccgccggcctgaaccccagcctgatggcccccagccagttcgccgccggcggcgccctgctgagcctgaaccccggcaccctgagcggcgccctgagccccgccctgatgagcaacagcaccctggccaccatccaggccctggccagcggcggcagcctgcccatcaccagcctggacgccaccggcaacctggtgttcgccaacgccggcggcgcccccaacatcgtgaccgcccccctgttcctgaacccccagaacctgagcctgctgaccagcaaccccgtgagcctggtgagcgccgccgccgccagcgccggcaacagcgcccccgtggccagcctgcacgccaccagcaccagcgccgagagcatccagaacagcctgttcaccgtggccagcgccagcggcgccgccagcaccaccaccaccgccagcaaggcccagtag

SEQ ID NO: 9121 - DNA, 2301 bp, Artificial Sequence
  Description of Artificial Sequence: Synthetic coding sequence
atggccgacggcggcgccgccagccaggacgagagcagcgccgccgccgccgccgccgccgacagcagaatgaacaaccccagcgagaccagcaagcccagcatggagagcggcgacggcaacaccggcacccagaccaacggcctggacttccagaagcagcccgtgcccgtgggcggcgccatcagcaccgcccaggcccaggccttcctgggccacctgcaccaggtgcagctggccggcaccagcctgcaggccgccgcccagagcctgaacgtgcagagcaagagcaacgaggagagcggcgacagccagcagcccagccagcccagccagcagcccagcgtgcaggccgccatcccccagacccagctgatgctggccggcggccagatcaccggcctgaccctgacccccgcccagcagcagctgctgctgcagcaggcccaggcccaggcccagctgctggccgccgccgtgcagcagcacagcgccagccagcagcacagcgccgccggcgccaccatcagcgccagcgccgccacccccatgacccagatccccctgagccagcccatccagatcgcccaggacctgcagcagctgcagcagctgcagcagcagaacctgaacctgcagcagttcgtgctggtgcaccccaccaccaacctgcagcccgcccagttcatcatcagccagaccccccagggccagcagggcctgctgcaggcccagaacctgctgacccagctgccccagcagagccaggccaacctgctgcagagccagcccagcatcaccctgaccagccagcccgccacccccaccagaaccatcgccgccacccccatccagaccctgccccagagccagagcacccccaagagaatcgacacccccagcctggaggagcccagcgacctggaggagctggagcagttcgccaagaccttcaagcagagaagaatcaagctgggcttcacccagggcgacgtgggcctggccatgggcaagctgtacggcaacgacttcagccagaccaccatcagcagattcgaggccctgaacctgagcttcaagaacatgtgcaagctgaagcccctgctggagaagtggctgaacgacgccgagaacctgagcagcgacagcagcctgagcagccccagcgccctgaacagccccggcatcgagggcctgagcagaagaagaaagaagagaaccagcatcgagaccaacatcagagtggccctggagaagagcttcctggagaaccagaagcccaccagcgaggagatcaccatgatcgccgaccagctgaacatggagaaggaggtgatcagagtgtggttctgcaacagaagacagaaggagaagagaatcaacccccccagcagcggcggcaccagcagcagccccatcaaggccatcttccccagccccaccagcctggtggccaccacccccagcctggtgaccagcagcgccgccaccaccctgaccgtgagccccgtgctgcccctgaccagcgccgccgtgaccaacctgagcgtgaccggcaccagcgacaccaccagcaacaacaccgccaccgtgatcagcaccgccccccccgccagcagcgccgtgaccagccccagcctgagccccagccccagcgccagcgccagcaccagcgaggccagcagcgccagcgagaccagcaccacccagaccaccagcacccccctgagcagccccctgggcaccagccaggtgatggtgaccgccagcggcctgcagaccgccgccgccgccgccctgcagggcgccgcccagctgcccgccaacgccagcctggccgccatggccgccgccgccggcctgaaccccagcctgatggcccccagccagttcgccgccggcggcgccctgctgagcctgaaccccggcaccctgagcggcgccctgagccccgccctgatgagcaacagcaccctggccaccatccaggccctggccagcggcggcagcctgcccatcaccagcctggacgccaccggcaacctggtgttcgccaacgccggcggcgcccccaacatcgtgaccgcccccctgttcctgaacccccagaacctgagcctgctgaccagcaaccccgtgagcctggtgagcgccgccgccgccagcgccggcaacagcgcccccgtggccagcctgcacgccaccagcaccagcgccgagagcatccagaacagcctgttcaccgtggccagcgccagcggcgccgccagcaccaccaccaccgccagcaaggcccagtag

SEQ ID NO: 9122 - DNA, 1962 bp, Artificial Sequence
  Description of Artificial Sequence: Synthetic coding sequence
atgaacaaccccagcgagaccagcaagcccagcatggagagcggcgacggcaacaccggcacccagaccaacggcctggacttccagaagcagcccgtgcccgtgggcggcgccatcagcaccgcccaggcccaggccttcctgggccacctgcaccaggtgcagctggccggcaccagcctgcaggccgccgcccagagcctgaacgtgcagagcaagagcaacgaggagagcggcgacagccagcagcccagccagcccagccagcagcccagcgtgcaggccgccatcccccagacccagctgatgctggccggcggccagatcaccggcctgaccctgacccccgcccagcagcagctgctgctgcagcaggcccaggcccaggcccagctgctggccgccgccgtgcagcagcacagcgccagccagcagcacagcgccgccggcgccaccatcagcgccagcgccgccacccccatgacccagatccccctgagccagcccatccagatcgcccaggacctgcagcagctgcagcagctgcagcagcagaacctgaacctgcagcagttcgtgctggtgcaccccaccaccaacctgcagcccgcccagttcatcatcagccagaccccccagggccagcagggcctgctgcaggcccagaacctgctgacccagctgccccagcagagccaggccaacctgctgcagagccagcccagcatcaccctgaccagccagcccgccacccccaccagaaccatcgccgccacccccatccagaccctgccccagagccagagcacccccaagagaatcgacacccccagcctggaggagcccagcgacctggaggagctggagcagttcgccaagaccttcaagcagagaagaatcaagctgggcttcacccagggcgacgtgggcctggccatgggcaagctgtacggcaacgacttcagccagaccaccatcagcagattcgaggccctgaacctgagcttcaagaacatgtgcaagctgaagcccctgctggagaagtggctgaacgacgccgagaacctgagcagcgacagcagcctgagcagccccagcgccctgaacagccccggcatcgagggcctgagcagaagaagaaagaagagaaccagcatcgagaccaacatcagagtggccctggagaagagcttcctggagaaccagaagcccaccagcgaggagatcaccatgatcgccgaccagctgaacatggagaaggaggtgatcagagtgtggttctgcaacagaagacagaaggagaagagaatcaacccccccagcagcggcggcaccagcagcagccccatcaaggccatcttccccagccccaccagcctggtggccaccacccccagcctggtgaccagcagcgccgccaccaccctgaccgtgagccccgtgctgcccctgaccagcgccgccgtgaccaacctgagcgtgaccggcaccagcgacaccaccagcaacaacaccgccaccgtgatcagcaccgccccccccgccagcagcgccgtgaccagccccagcctgagccccagccccagcgccagcgccagcaccagcgaggccagcagcgccagcgagaccagcaccacccagaccaccagcacccccctgagcagccccctgggcaccagccaggtgatggtgaccgccagcggcctgcagaccgccgccgccgccgccctgcagggcgccgcccagctgcccgccaacgccagcctggccgccatggccgccgccgccggcctgaaccccagcctgatggcccccagccagttcgccgccggcggcgccctgctgagcctgaaccccggcaccctgagcggcgccctgagccccgccctgatgagcaacagcaccctggccaccatccagggcctgctgcacggcctggagaacttcctgaccaagaactag

SEQ ID NO: 9123 - DNA, 2112 bp, Artificial Sequence
  Description of Artificial Sequence: Synthetic coding sequence
atggccgacggcggcgccgccagccaggacgagagcagcgccgccgccgccgccgccgccgacagcagaatgaacaaccccagcgagaccagcaagcccagcatggagagcggcgacggcaacaccggcacccagaccaacggcctggacttccagaagcagcccgtgcccgtgggcggcgccatcagcaccgcccaggcccaggccttcctgggccacctgcaccaggtgcagctggccggcaccagcctgcaggccgccgcccagagcctgaacgtgcagagcaagagcaacgaggagagcggcgacagccagcagcccagccagcccagccagcagcccagcgtgcaggccgccatcccccagacccagctgatgctggccggcggccagatcaccggcgacctgcagcagctgcagcagctgcagcagcagaacctgaacctgcagcagttcgtgctggtgcaccccaccaccaacctgcagcccgcccagttcatcatcagccagaccccccagggccagcagggcctgctgcaggcccagaacctgctgacccagctgccccagcagagccaggccaacctgctgcagagccagcccagcatcaccctgaccagccagcccgccacccccaccagaaccatcgccgccacccccatccagaccctgccccagagccagagcacccccaagagaatcgacacccccagcctggaggagcccagcgacctggaggagctggagcagttcgccaagaccttcaagcagagaagaatcaagctgggcttcacccagggcgacgtgggcctggccatgggcaagctgtacggcaacgacttcagccagaccaccatcagcagattcgaggccctgaacctgagcttcaagaacatgtgcaagctgaagcccctgctggagaagtggctgaacgacgccgagaacctgagcagcgacagcagcctgagcagccccagcgccctgaacagccccggcatcgagggcctgagcagaagaagaaagaagagaaccagcatcgagaccaacatcagagtggccctggagaagagcttcctggagaaccagaagcccaccagcgaggagatcaccatgatcgccgaccagctgaacatggagaaggaggtgatcagagtgtggttctgcaacagaagacagaaggagaagagaatcaacccccccagcagcggcggcaccagcagcagccccatcaaggccatcttccccagccccaccagcctggtggccaccacccccagcctggtgaccagcagcgccgccaccaccctgaccgtgagccccgtgctgcccctgaccagcgccgccgtgaccaacctgagcgtgaccggcaccagcgacaccaccagcaacaacaccgccaccgtgatcagcaccgccccccccgccagcagcgccgtgaccagccccagcctgagccccagccccagcgccagcgccagcaccagcgaggccagcagcgccagcgagaccagcaccacccagaccaccagcacccccctgagcagccccctgggcaccagccaggtgatggtgaccgccagcggcctgcagaccgccgccgccgccgccctgcagggcgccgcccagctgcccgccaacgccagcctggccgccatggccgccgccgccggcctgaaccccagcctgatggcccccagccagttcgccgccggcggcgccctgctgagcctgaaccccggcaccctgagcggcgccctgagccccgccctgatgagcaacagcaccctggccaccatccaggccctggccagcggcggcagcctgcccatcaccagcctggacgccaccggcaacctggtgttcgccaacgccggcggcgcccccaacatcgtgaccgcccccctgttcctgaacccccagaacctgagcctgctgaccagcaaccccgtgagcctggtgagcgccgccgccgccagcgccggcaacagcgcccccgtggccagcctgcacgccaccagcaccagcgccgagagcatccagaacagcctgttcaccgtggccagcgccagcggcgccgccagcaccaccaccaccgccagcaaggcccagtag

SEQ ID NO: 9124 - DNA, 279 bp, Artificial Sequence
  Description of Artificial Sequence: Synthetic coding sequence
atgaacaaccccagcgagaccagcaagcccagcatggagagcggcgacggcaacaccggcacccagaccaacggcctggacttccagaagcagcccgtgcccgtgggcggcgccatcagcaccgcccaggcccaggccttcctgggccacctgcaccaggtgcagctggccggcaccagcctgcaggccgccgcccagagcctgaacgtgcagagcaagagcaacgaggagagcggcgacagccagcagcccagccagcccagccagcagcccagctag

SEQ ID NO: 9125 - DNA, 765 bp, Artificial Sequence
  Description of Artificial Sequence: Synthetic coding sequence
atgaacaaccccagcgagaccagcaagcccagcatggagagcggcgacggcaacaccggcacccagaccaacggcctggacttccagaagcagcccgtgcccgtgggcggcgccatcagcaccgcccaggcccaggccttcctgggccacctgcaccaggtgcagctggccggcaccagcctgcaggccgccgcccagagcctgaacgtgcagagcaagagcaacgaggagagcggcgacagccagcagcccagccagcccagccagcagcccagcgtgcaggccgccatcccccagacccagctgatgctggccggcggccagatcaccggcctgaccctgacccccgcccagcagcagctgctgctgcagcaggcccaggcccaggcccagctgctggccgccgccgtgcagcagcacagcgccagccagcagcacagcgccgccggcgccaccatcagcgccagcgccgccacccccatgacccagatccccctgagccagcccatccagatcgcccaggacctgcagcagctgcagcagctgcagcagcagaacctgaacctgcagcagttcgtgctggtgcaccccaccaccaacctgcagcccgcccagttcatcatcagccagaccccccagggccagcagggcctgctgcaggcccagaacctgctgacccagctgccccagcagagccaggccaacctgctgcagagccagcccagcatcaccctgaccagccagatctggcccagccccgcctag

SEQ ID NO: 9126 - DNA, 342 bp, Artificial Sequence
  Description of Artificial Sequence: Synthetic coding sequence
atgaacaaccccagcgagaccagcaagcccagcatggagagcggcgacggcaacaccggcaccggcaccgccgccggctgctgcagcgccgccgccctgagacagcccgccgcccagtgctgctggagccaccacctgagactgtgctgccacgcccacgacgccgacccccccgtgagcgcccacaccgacagaaccggcagcagcaccaccgccaccgccagcaccgccgagagccagcccgccaccgtgtgcgtgggcgccagcaaccaccagttcgccgccagcgccgtgtaccacctgaccgacgcccccggccccgccggcagccccgccagctag

SEQ ID NO: 9127 - DNA, 2232 bp, Artificial Sequence; identical to SEQ ID NO: 9118
  Description of Artificial Sequence: Synthetic coding sequence

SEQ ID NO: 9128 - DNA, 411 bp, Artificial Sequence
  Description of Artificial Sequence: Synthetic coding sequence
atgaacaaccccagcgagaccagcaagcccagcatggagagcggcgacggcaacaccggcacccagaccaacggcctggacttccagaagcagcccgtgcccgtgggcggcgccatcagcaccgcccaggcccaggccttcctgggccacctgcaccaggtgcagctggccggcaccagcctgcaggccgccgcccagagcctgaacgtgcagagcaagagcaacgaggagagcggcgacagccagcagcccagccagcccagccagcagcccagcgtgcaggccgccatcccccagacccagctgatgctggccggcggccagatcaccggcctgaccctgacccccgcccagcagcagctgctgctgcagcaggcccaggcccaggcccagctgctggccgccgcctag

SEQ ID NO: 9129 - DNA, 1587 bp, Artificial Sequence
  Description of Artificial Sequence: Synthetic coding sequence
atggccgacggcggcgccgccagccaggacgagagcagcgccgccgccgccgccgccgccgacagcagaatgaacaaccccagcgagaccagcaagcccagcatggagagcggcgacggcaacaccggcacccagaccaacggcctggacttccagaagcagcccgtgcccgtgggcggcgccatcagcaccgcccaggcccaggccttcctgggccacctgcaccaggtgcagctggccggcaccagcctgcaggccgccgcccagagcctgaacgtgcagagcaagagcaacgaggagagcggcgacagccagcagcccagccagcccagccagcagcccagcgtgcaggccgccatcccccagacccagctgatgctggccggcggccagatcaccggcctgaccctgacccccgcccagcagcagctgctgctgcagcaggcccaggcccaggcccagctgctggccgccgccgtgcagcagcacagcgccagccagcagcacagcgccgccggcgccaccatcagcgccagcgccgccacccccatgacccagatccccctgagccagcccatccagatcgcccaggacctgcagcagctgcagcagctgcagcagcagaacctgaacctgcagcagttcgtgctggtgcaccccaccaccaacctgcagcccgcccagttcatcatcagccagaccccccagggccagcagggcctgctgcaggcccagaacctgctgacccagctgccccagcagagccaggccaacctgctgcagagccagcccagcatcaccctgaccagccagcccgccacccccaccagaaccatcgccgccacccccatccagaccctgccccagagccagagcacccccaagagaatcgacacccccagcctggaggagcccagcgacctggaggagctggagcagttcgccaagaccttcaagcagagaagaatcaagctgggcttcacccagggcgacgtgggcctggccatgggcaagctgtacggcaacgacttcagccagaccaccatcagcagattcgaggccctgaacctgagcttcaagaacatgtgcaagctgaagcccctgctggagaagtggctgaacgacgccgagaacctgagcagcgacagcagcctgagcagccccagcgccctgaacagccccggcatcgagggcctgagcagaagaagaaagaagagaaccagcatcgagaccaacatcagagtggccctggagaagagcttcctggagaaccagaagcccaccagcgaggagatcaccatgatcgccgaccagctgaacatggagaaggaggtgatcagagtgtggttctgcaacagaagacagaaggagaagagaatcaacccccccagcagcggcggcaccagcagcagccccatcaaggccatcttccccagccccaccagcctggtggccaccacccccagcctggtgaccagcagcgccgccaccaccctgaccgtgagccccgtgctgcccctgaccagcgccgccgtgaccaacctgagcgccctgcagacccccccccccaccacccagcagccctag

SEQ ID NO: 9130 - DNA, 165 bp, Artificial Sequence
  Description of Artificial Sequence: Synthetic coding sequence
atgaacaaccccagcgagaccagcaagcccagcatggagagcggcgacggcaacaccggcacccagaccaacggcctggacttccagaagcagcccgtgcccgtgggcggcgccatcagcaccgcccaggcccaggccttcctgggccacctgcaccaggtgtag

SEQ ID NO: 9131 - DNA, 2268 bp, Artificial Sequence; identical to SEQ ID NO: 9119
  Description of Artificial Sequence: Synthetic coding sequence

SEQ ID NO: 9132 - DNA, 1230 bp, Artificial Sequence
  Description of Artificial Sequence: Synthetic coding sequence
atgatgatgatgagcctgaacagcaagcaggccttcagcatgccccacggcggcagcctgcacgtggagcccaagtacagcgccctgcacagcaccagccccggcagcagcgcccccatcgcccccagcgccagcagccccagcagcagcagcaacgccggcggcggcggcggcggcggcggcggcggcggcggcggcggcggcagaagcagcagcagcagcagcagcggcagcagcggcggcggcggcagcgaggccatgagaagagcctgcctgcccaccccccccagcaacatcttcggcggcctggacgagagcctgctggccagagccgaggccctggccgccgtggacatcgtgagccagagcaagagccaccaccaccaccccccccaccacagccccttcaagcccgacgccacctaccacaccatgaacaccatcccctgcaccagcgccgccagcagcagcagcgtgcccatcagccaccccagcgccctggccggcacccaccaccaccaccaccaccaccaccaccaccaccaccagccccaccaggccctggagggcgagctgctggagcacctgagccccggcctggccctgggcgccatggccggccccgacggcgccgtggtgagcacccccgcccacgccccccacatggccaccatgaaccccatgcaccaggccgccctgagcatggcccacgcccacggcctgcccagccacatgggctgcatgagcgacgtggacgccgaccccagagacctggaggccttcgccgagagattcaagcagagaagaatcaagctgggcgtgacccaggccgacgtgggcagcgccctggccaacctgaagatccccggcgtgggcagcctgagccagagcaccatctgcagattcgagagcctgaccctgagccacaacaacatgatcgccctgaagcccatcctgcaggcctggctggaggaggccgagaagagccacagagagaagctgaccaagcccgagctgttcaacggcgccgagaagaagagaaagagaaccagcatcgccgcccccgagaagagaagcctggaggcctacttcgccatccagcccagacccagcagcgagaagatcgccgccatcgccgagaagctggacctgaagaagaacgtggtgagagtgtggttctgcaaccagagacagaagcagaagagaatgaagtacagcgccggcatctag

SEQ ID NO: 9133 - DNA, 906 bp, Artificial Sequence
  Description of Artificial Sequence: Synthetic coding sequence
atgcccggcatcagcagccagatcctgaccaacgcccagggccaggtgatcggcaccctgccctgggtggtgaacagcgccagcgtggccgcccccgcccccgcccagagcctgcaggtgcaggccgtgaccccccagctgctgctgaacgcccagggccaggtgatcgccaccctggccagcagccccctgcccccccccgtggccgtgagaaagcccagcacccccgagagccccgccaagagcgaggtgcagcccatccagcccacccccaccgtgccccagcccgccgtggtgatcgccagccccgcccccgccgccaagcccagcgccagcgcccccatccccatcacctgcagcgagacccccaccgtgagccagctggtgagcaagccccacacccccagcctggacgaggacggcatcaacctggaggagatcagagagttcgccaagaacttcaagatcagaagactgagcctgggcctgacccagacccaggtgggccaggccctgaccgccaccgagggccccgcctacagccagagcgccatctgcagattcgagaagctggacatcacccccaagagcgcccagaagctgaagcccgtgctggagaagtggctgaacgaggccgagctgagaaaccaggagggccagcagaacctgatggagttcgtgggcggcgagcccagcaagaagagaaagagaagaaccagcttcaccccccaggccatcgaggccctgaacgcctacttcgagaagaaccccctgcccaccggccaggagatcaccgagatcgccaaggagctgaactacgacagagaggtggtgagagtgtggttctgcaacagaagacagaccctgaagaacaccagcaagctgaacgtgttccagatcccctag

SEQ ID NO: 9134 - DNA, 906 bp, Artificial Sequence; identical to SEQ ID NO: 9133
  Description of Artificial Sequence: Synthetic coding sequence

SEQ ID NO: 9135 - DNA, 90 bp, Artificial Sequence
  Description of Artificial Sequence: Synthetic coding sequence
atgcccggcatcagcagccagatcctgaccaacgcccagggccaggtgatcggcaccctgccctgggtggtgaacagcgccagcgtgtag

SEQ ID NO: 9136 - DNA, 906 bp, Artificial Sequence; identical to SEQ ID NO: 9133
  Description of Artificial Sequence: Synthetic coding sequence

SEQ ID NO: 9137 - DNA, 1020 bp, Artificial Sequence
  Description of Artificial Sequence: Synthetic coding sequence
atggccgccgccgccgccgccgccctggagagctggcaggccgccgcccccagaaagagaagaagcgccgccagaagacccagaagaagagaggccgcccccagaggcagagaggccgcccccagaggcagagaggccgcccccagaggccccgaggccgagttcgagagcgacagcggcgtggtgctgagaagaatctgggaggccgagaaggacctgttcatcagcgacttctggagcagcgccctggagaccatcaacagatgcctgaccaagcacctggagcagctgaaggcccccgtgggcaccctgagcgacatcttcggcaacctgcacctggacagcctgcccgaggagagcgacgtggccaccgacagcatccccagagagatcctggtgaccggcacctgccacctgaagtgcgtgtgctacggcatcggcaacttcgccacctgcatcgtggccagaaaccagctgaccttcctgctgctgctgctggagaagtgccagatccccagaagccactgctgggtgtacgaccccctgttcagccagctggagatcgaggtgctgaacaccctgggcgtgaccgtgctgagcgagaacgaggagggcaagagaagcatcagaggcgagcccaccatcttctacatgctgcactgcggcaccgccctgtacaacaacctgctgtggagcaactggagcgtggacgccctgagcaagatggtgatcatcggcaacagcttcaagggcctggaggagagactgctggccagaatcctgcagaagaactacccctacatcgccaagatcctgaagggcctggaggagctggagttcccccagaccagccagtacatggacatcttcaacgacaccagcgtgcactggttccccgtgcagaagctggagcagctgagcatcgacatctgggagttcagagaggagcccgactaccaggactgcgaggacctggagatcatcagaaacaagagagaggaccccagcgccaccgactag

SEQ ID NO: 9138 - DNA, 2064 bp, Artificial Sequence
  Description of Artificial Sequence: Synthetic coding sequence
atggagagagtgaacgacgccagctgcggccccagcggctgctacacctaccaggtgagcagacacagcaccgagatgctgcacaacctgaaccagcagagaaagaacggcggcagattctgcgacgtgctgctgagagtgggcgacgagagcttccccgcccacagagccgtgctggccgcctgcagcgagtacttcgagagcgtgttcagcgcccagctgggcgacggcggcgccgccgacggcggccccgccgacgtgggcggcgccaccgccgcccccggcggcggcgccggcggcagcagagagctggagatgcacaccatcagcagcaaggtgttcggcgacatcctggacttcgcctacaccagcagaatcgtggtgagactggagagcttccccgagctgatgaccgccgccaagttcctgctgatgagaagcgtgatcgagatctgccaggaggtgatcaagcagagcaacgtgcagatcctggtgccccccgccagagccgacatcatgctgttcagaccccccggcaccagcgacctgggcttccccctggacatgaccaacggcgccgccctggccgccaacagcaacggcatcgccggcagcatgcagcccgaggaggaggccgccagagccgccggcgccgccatcgccggccaggccagcctgcccgtgctgcccggcgtggacagactgcccatggtggccggccccctgagcccccagctgctgaccagccccttccccagcgtggccagcagcgccccccccctgaccggcaagagaggcagaggcagacccagaaaggccaacctgctggacagcatgttcggcagccccggcggcctgagagaggccggcatcctgccctgcggcctgtgcggcaaggtgttcaccgacgccaacagactgagacagcacgaggcccagcacggcgtgaccagcctgcagctgggctacatcgacctgcccccccccagactgggcgagaacggcctgcccatcagcgaggaccccgacggccccagaaagagaagcagaaccagaaagcaggtggcctgcgagatctgcggcaagatcttcagagacgtgtaccacctgaacagacacaagctgagccacagcggcgagaagccctacagctgccccgtgtgcggcctgagattcaagagaaaggacagaatgagctaccacgtgagaagccacgacggcagcgtgggcaagccctacatctgccagagctgcggcaagggcttcagcagacccgaccacctgaacggccacatcaagcaggtgcacaccagcgagagaccccacaagtgccagacctgcaacgccagcttcgccaccagagacagactgagaagccacctggcctgccacgaggacaaggtgccctgccaggtgtgcggcaagtacctgagagccgcctacatggccgaccacctgaagaagcacagcgagggccccagcaacttctgcagcatctgcaacagaggcttcagcagcgccagctacctgaaggtgcacgtgaagacccaccacggcgtgcccctgccccaggtgagcagacaccaggagcccatcctgaacggcggcgccgccttccactgcgccagaacctacggcaacaaggagggccagaagtgcagccaccaggaccccatcgagagcagcgacagctacggcgacctgagcgacgccagcgacctgaagacccccgagaagcagagcgccaacggcagcttcagctgcgacatggccgtgcccaagaacaagatggagagcgacggcgagaagaagtacccctgccccgagtgcggcagcttcttcagaagcaagagctacctgaacaagcacatccagaaggtgcacgtgagagccctgggcggccccctgggcgacctgggccccgccctgggcagccccttcagcccccagcagaacatgagcctgctggagagcttcggcttccagatcgtgcagagcgccttcgccagcagcctggtggaccccgaggtggaccagcagcccatgggccccgagggcaagtag

SEQ ID NO: 9139 - DNA, 1926 bp, Artificial Sequence
  Description of Artificial Sequence: Synthetic coding sequence
atggagagagtgaacgacgccagctgcggccccagcggctgctacacctaccaggtgagcagacacagcaccgagatgctgcacaacctgaaccagcagagaaagaacggcggcagattctgcgacgtgctgctgagagtgggcgacgagagcttccccgcccacagagccgtgctggccgcctgcagcgagtacttcgagagcgtgttcagcgcccagctgggcgacggcggcgccgccgacggcggccccgccgacgtgggcggcgccaccgccgcccccggcggcggcgccggcggcagcagagagctggagatgcacaccatcagcagcaaggtgttcggcgacatcctggacttcgcctacaccagcagaatcgtggtgagactggagagcttccccgagctgatgaccgccgccaagttcctgctgatgagaagcgtgatcgagatctgccaggaggtgatcaagcagagcaacgtgcagatcctggtgccccccgccagagccgacatcatgctgttcagaccccccggcaccagcgacctgggcttccccctggacatgaccaacggcgccgccctggccgccaacagcaacggcatcgccggcagcatgcagcccgaggaggaggccgccagagccgccggcgccgccatcgccggccaggccagcctgcccgtgctgcccggcgtggacagactgcccatggtggccggccccctgagcccccagctgctgaccagccccttccccagcgtggccagcagcgccccccccctgaccggcaagagaggcagaggcagacccagaaaggccaacctgctggacagcatgttcggcagccccggcggcctgagagaggccggcatcctgccctgcggcctgtgcggcaaggtgttcaccgacgccaacagactgagacagcacgaggcccagcacggcgtgaccagcctgcagctgggctacatcgacctgcccccccccagactgggcgagaacggcctgcccatcagcgaggaccccgacggccccagaaagagaagcagaaccagaaagcaggtggcctgcgagatctgcggcaagatcttcagagacgtgtaccacctgaacagacacaagctgagccacagcggcgagaagccctacagctgccccgtgtgcggcctgagattcaagagaaaggacagaatgagctaccacgtgagaagccacgacggcagcgtgggcaagccctacatctgccagagctgcggcaagggcttcagcagacccgaccacctgaacggccacatcaagcaggtgcacaccagcgagagaccccacaagtgccagacctgcaacgccagcttcgccaccagagacagactgagaagccacctggcctgccacgaggacaaggtgccctgccaggtgtgcggcaagtacctgagagccgcctacatggccgaccacctgaagaagcacagcgagggccccagcaacttctgcagcatctgcaacagagagggccagaagtgcagccaccaggaccccatcgagagcagcgacagctacggcgacctgagcgacgccagcgacctgaagacccccgagaagcagagcgccaacggcagcttcagctgcgacatggccgtgcccaagaacaagatggagagcgacggcgagaagaagtacccctgccccgagtgcggcagcttcttcagaagcaagagctacctgaacaagcacatccagaaggtgcacgtgagagccctgggcggccccctgggcgacctgggccccgccctgggcagccccttcagcccccagcagaacatgagcctgctggagagcttcggcttccagatcgtgcagagcgccttcgccagcagcctggtggaccccgaggtggaccagcagcccatgggccccgagggcaagtag

SEQ ID NO: 9140 - DNA, 1614 bp, Artificial Sequence
  Description of Artificial Sequence: Synthetic coding sequence
atggagagagtgaacgacgccagctgcggccccagcggctgctacacctaccaggtgagcagacacagcaccgagatgctgcacaacctgaaccagcagagaaagaacggcggcagattctgcgacgtgctgctgagagtgggcgacgagagcttccccgcccacagagccgtgctggccgcctgcagcgagtacttcgagagcgtgttcagcgcccagctgggcgacggcggcgccgccgacggcggccccgccgacgtgggcggcgccaccgccgcccccggcggcggcgccggcggcagcagagagctggagatgcacaccatcagcagcaaggtgttcggcgacatcctggacttcgcctacaccagcagaatcgtggtgagactggagagcttccccgagctgatgaccgccgccaagttcctgctgatgagaagcgtgatcgagatctgccaggaggtgatcaagcagagcaacgtgcagatcctggtgccccccgccagagccgacatcatgctgttcagaccccccggcaccagcgacctgggcttccccctggacatgaccaacggcgccgccctggccgccaacagcaacggcatcgccggcagcatgcagcccgaggaggaggccgccagagccgccggcgccgccatcgccggccaggccagcctgcccgtgctgcccggcgtggacagactgcccatggtggccggccccctgagcccccagctgctgaccagccccttccccagcgtggccagcagcgccccccccctgaccggcaagagaggcagaggcagacccagaaaggccaacctgctggacagcatgttcggcagccccggcggcctgagagaggccggcatcctgccctgcggcctgtgcggcaaggtgttcaccgacgccaacagactgagacagcacgaggcccagcacggcgtgaccagcctgcagctgggctacatcgacctgcccccccccagactgggcgagaacggcctgcccatcagcgaggaccccgacggccccagaaagagaagcagaaccagaaagcaggtggcctgcgagatctgcggcaagatcttcagagacgtgtaccacctgaacagacacaagctgagccacagcggcgagaagccctacagctgccccgtgtgcggcctgagattcaagagaaaggacagaatgagctaccacgtgagaagccacgacggcagcgtgggcaagccctacatctgccagagctgcggcaagggcttcagcagacccgaccacctgaacggccacatcaagcaggtgcacaccagcgagagaccccacaagtgccagacctgcaacgccagcttcgccaccagagacagactgagaagccacctggcctgccacgaggacaaggtgccctgccaggtgtgcggcaagtacctgagagccgcctacatggccgaccacctgaagaagcacagcgagggccccagcaacttctgcagcatctgcaacagaggcctgcaggcccccggcgcccaccccgagtggggcagcagcgtgcccctgagacaggacctgtggcagcagagaagacccgagatgctgaccagcggcagcgactag

SEQ ID NO: 9141 - DNA, 1104 bp, Artificial Sequence
  Description of Artificial Sequence: Synthetic coding sequence
atgatgggcagcgtgctgcccgccgaggccctggtgctgaagaccggcctgaaggcccccggcctggccctggccgaggtgatcaccagcgacatcctgcacagcttcctgtacggcagatggagaaacgtgctgggcgagcagctgttcgaggacaagagccaccacgccagccccaagaccgccttcaccgccgaggtgctggcccagagcttcagcggcgaggtgcagaagctgagcagcctggtgctgcccgccgaggtgatcatcgcccagagcagcatccccggcgagggcctgggcatcttcagcaagacctggatcaaggccggcaccgagatgggccccttcaccggcagagtgatcgcccccgagcacgtggacatctgcaagaacaacaacctgatgtgggaggtgttcaacgaggacggcaccgtgagatacttcatcgacgccagccaggaggaccacagaagctggatgacctacatcaagtgcgccagaaacgagcaggagcagaacctggaggtggtgcagatcggcaccagcatcttctacaaggccatcgagatgatcccccccgaccaggagctgctggtgtggtacggcaacagccacaacaccttcctgggcatccccggcgtgcccggcctggaggaggaccagaagaagaacaagcacgaggacttccaccccgccgacagcgccgccggccccgccggcagaatgagatgcgtgatctgccacagaggcttcaacagcagaagcaacctgagaagccacatgagaatccacaccctggacaagcccttcgtgtgcagattctgcaacagaagattcagccagagcagcaccctgagaaaccacgtgagactgcacaccggcgagagaccctacaagtgccaggtgtgccagagcgcctacagccagctggccggcctgagagcccaccagaagagcgccagacacagaccccccagcaccgccctgcaggcccacagccccgccctgcccgccccccacgcccacgcccccgccctggccgccgccgccgccgccgccgccgccgccgccgcccaccacctgcccgccatggtgctgtag

SEQ ID NO: 9142 - DNA, 2154 bp, Artificial Sequence
  Description of Artificial Sequence: Synthetic coding sequence
atgcacggcgccgccagagcccccgccaccagcgtgagcgccgactgctgcatccccgccggcctgagactgggccccgtgcccggcaccttcaagctgggcaagtacctgagcgacagaagagagcccggccccaagaagaaggtgctgaccatccagaccagcgcccaccaggtgagaatggtgagaggcgagctggtggacgagagcggcggcagccccctggagtggatcggcctgatcagagccgccagaaacagccaggagcagaccctggaggccatcgccgacctgcccggcggccagatcttctacagagccctgagagacgtgcagcccggcgaggagctgaccgtgtggtacagcaacagcctggcccagtggttcgacatccccaccaccgccacccccacccacgacgagaagggcgaggagagatacatctgctggtactgctggagaaccttcagataccccaacagcctgaaggcccacctgagattccactgcgtgttcagcggcggcggcggcggcgccttcctgcaccacgagcacgccgccagacagggcgccgtgcccgccgccgacggcctgggcctgagccccaagccccccgcccccgacttcgccgcccccagccaggccggcaccctgagaccccaccccctgggccccccccccgtgcaggcctgcggcgccagagagggcatcaagagagaggccagcagcgcccccagcgccaccagccccacccccggcaagtggggccagcccaagaagggcaaggagcagctggacagagccctggacatgagcggcgccgccagaggccagggccacttcctgggcatcgtgggcggcagcagcgccggcgtgggcagcctggccttctaccccggcgtgagaagcgccttcaagcccgccggcctggccagagccgccgccgccgcccacggcgacccctacagagaggagagcagcagcaagcagggcgccggcctggccctgggcagactgctgggcggcggcagagcctgcggcagacccggcagcggcgagaacagcgccgccggcggcgccggccaccaccaccaccaccacgcccaccaccaccaccaccccaagtgcctgctggccggcgaccccccccccccccccccccccggcctgccctgcagcggcgccctgagaggcttccccctgctgagcgtgccccccgaggaggccagcgccttcaagcacgtggagagagccccccccgccgccgccgccctgcccggcgccagatacgcccagctgccccccgcccccggcctgcccctggagagatgcgccctgccccccctggaccccggcggcctgaaggcctaccccggcggcgagtgcagccacctgcccgccgtgatgcccgccttcaccgtgtacaacggcgagctgctgtacggcagccccgccaccaccgcctactaccccctgaagctgcacttcggcggcctgctgaagtaccccgagagcatcagctacttcagcggccccgccgccgccgccctgagccccgccgagctgggcagcctggccagcatcgacagagagatcgccatgcacaaccagcagctgagcgagatggccgccggcaagggcagaggcagactggacagcggcaccctgccccccgccgtggccgccgccggcggcaccggcggcggcggcagcggcggcagcggcgccggcaagcccaagaccggccacctgtgcctgtactgcggcaagctgtacagcagaaagtacggcctgaagatccacatgagaacccacaccggctacaagcccctgaagtgcaaggtgtgcctgagacccttcggcgaccccagcaacctgaacaagcacatcagactgcacgccgagggcaacaccccctacagatgcgagttctgcggcaaggtgctggtgagaagaagagacctggagagacacgtgaagagcagacaccccggccagagcctgctggccaaggccggcgacggccccggcgccgagcccggctacccccccgagcccggcgaccccaagagcgacgacagcgacgtggacgtgtgcttcaccgacgaccagagcgaccccgaggtgggcggcggcggcgagagagacctgtag

SEQ ID NO: 9143 - DNA, 2124 bp, Artificial Sequence
  Description of Artificial Sequence: Synthetic coding sequence
atgcacggcgccgccagagcccccgccaccagcgtgagcgccgactgctgcatccccgccggcctgagactgggccccgtgcccggcaccttcaagctgggcaagtacctgagcgacagaagagagcccggccccaagaagaaggtgagaatggtgagaggcgagctggtggacgagagcggcggcagccccctggagtggatcggcctgatcagagccgccagaaacagccaggagcagaccctggaggccatcgccgacctgcccggcggccagatcttctacagagccctgagagacgtgcagcccggcgaggagctgaccgtgtggtacagcaacagcctggcccagtggttcgacatccccaccaccgccacccccacccacgacgagaagggcgaggagagatacatctgctggtactgctggagaaccttcagataccccaacagcctgaaggcccacctgagattccactgcgtgttcagcggcggcggcggcggcgccttcctgcaccacgagcacgccgccagacagggcgccgtgcccgccgccgacggcctgggcctgagccccaagccccccgcccccgacttcgccgcccccagccaggccggcaccctgagaccccaccccctgggccccccccccgtgcaggcctgcggcgccagagagggcatcaagagagaggccagcagcgcccccagcgccaccagccccacccccggcaagtggggccagcccaagaagggcaaggagcagctggacagagccctggacatgagcggcgccgccagaggccagggccacttcctgggcatcgtgggcggcagcagcgccggcgtgggcagcctggccttctaccccggcgtgagaagcgccttcaagcccgccggcctggccagagccgccgccgccgcccacggcgacccctacagagaggagagcagcagcaagcagggcgccggcctggccctgggcagactgctgggcggcggcagagcctgcggcagacccggcagcggcgagaacagcgccgccggcggcgccggccaccaccaccaccaccacgcccaccaccaccaccaccccaagtgcctgctggccggcgaccccccccccccccccccccccggcctgccctgcagcggcgccctgagaggcttccccctgctgagcgtgccccccgaggaggccagcgccttcaagcacgtggagagagccccccccgccgccgccgccctgcccggcgccagatacgcccagctgccccccgcccccggcctgcccctggagagatgcgccctgccccccctggaccccggcggcctgaaggcctaccccggcggcgagtgcagccacctgcccgccgtgatgcccgccttcaccgtgtacaacggcgagctgctgtacggcagccccgccaccaccgcctactaccccctgaagctgcacttcggcggcctgctgaagtaccccgagagcatcagctacttcagcggccccgccgccgccgccctgagccccgccgagctgggcagcctggccagcatcgacagagagatcgccatgcacaaccagcagctgagcgagatggccgccggcaagggcagaggcagactggacagcggcaccctgccccccgccgtggccgccgccggcggcaccggcggcggcggcagcggcggcagcggcgccggcaagcccaagaccggccacctgtgcctgtactgcggcaagctgtacagcagaaagtacggcctgaagatccacatgagaacccacaccggctacaagcccctgaagtgcaaggtgtgcctgagacccttcggcgaccccagcaacctgaacaagcacatcagactgcacgccgagggcaacaccccctacagatgcgagttctgcggcaaggtgctggtgagaagaagagacctggagagacacgtgaagagcagacaccccggccagagcctgctggccaaggccggcgacggccccggcgccgagcccggctacccccccgagcccggcgaccccaagagcgacgacagcgacgtggacgtgtgcttcaccgacgaccagagcgaccccgaggtgggcggcggcggcgagagagacctgtag

SEQ ID NO: 9144 - DNA, 4524 bp, Artificial Sequence
  Description of Artificial Sequence: Synthetic coding sequence
atgcccagaagaagaccccccgccagcggcgccgcccagttccccgagagaatcgccaccagaagccccgaccccatccccctgtgcaccttccagagacagcccagagccgcccccgtgcagcccccctgcagactgttcttcgtgaccttcgccggctgcggccacagatggagaagcgagagcaagcccggctggatcagcagaagcagaagcggcatcgccctgagagccgccagaccccccggcagcagcccccccagacccgccgcccccagaccccccccccccggcggcgtggtggccgaggcccccggcgacgtggtgatccccagacccagagtgcagcccatgagagtggccagaggcggcccctggacccccaaccccgccttcagagaggccgagagctggagccagatcggcaaccagagagtgagcgagcagctgctggagaccagcctgggcaacgaggtgagcgacaccgagcccctgagccccgccagcgccggcctgagaagaaaccccgccctgccccccggccccttcgcccagaacttcagctggggcaaccaggagaacctgccccccgccctgggcaagatcgccaacggcggcggcaccggcgccggcaaggccgagtgcggctacgagaccgagagccacctgctggagccccacgagatccccctgaacgtgaacacccacaagttcagcgactgcgagttcccctacgagttctgcaccgtgtgcttcagccccttcaagctgctgggcatgagcggcgtggagggcgtgtggaaccagcacagcagaagcgccagcatgcacaccttcctgaaccacagcgccaccggcatcagagaggccggctgcagaaaggacatgcccgtgagcgagatggccgaggacggcagcgaggagatcatgttcatctggtgcgaggactgcagccagtaccacgacagcgagtgccccgagctgggccccgtggtgatggtgaaggacagcttcgtgctgagcagagccagaagctggcccgccagcggccacgtgcacacccaggccggccagggcatgagaggctacgaggacagagacagagccgacccccagcagctgcccgaggccgtgcccgccggcctggtgagaagactgagcggccagcagctgccctgcagaagcaccctgacctggggcagactgtgccacctggtggcccagggcagaagcagcctgccccccaacctggagatcagaagactggaggacggcgccgagggcgtgttcgccatcacccagctggtgaagagaacccagttcggccccttcgagagcagaagagtggccaagtgggagaaggagagcgccttccccctgaaggtgttccagaaggacggccaccccgtgtgcttcgacaccagcaacgaggacgactgcaactggatgatgctggtgagacccgccgccgaggccgagcaccagaacctgaccgcctaccagcacggcagcgacgtgtacttcaccaccagcagagacatcccccccggcaccgagctgagagtgtggtacgccgccttctacgccaagaagatggacaagcccatgctgaagcaggccggcagcggcgtgcacgccgccggcacccccgagaacagcgcccccgtggagagcgagcccagccagtgggcctgcaaggtgtgcagcgccaccttcctggagctgcagctgctgaacgagcacctgctgggccacctggagcaggccaagagcctgccccccggcagccagagcgaggccgccgcccccgagaaggagcaggacacccccagaggcgagccccccgccgtgcccgagagcgagaacgtggccaccaaggagcagaagaagaagcccagaagaggcagaaagcccaaggtgagcaaggccgagcagcccctggtgatcgtggaggacaaggagcccaccgagcaggtggccgagatcatcaccgaggtgccccccgacgagcccgtgagcgccacccccgacgagagaatcatggagctggtgctgggcaagctggccaccaccaccaccgacaccagcagcgtgcccaagttcacccaccaccagaacaacaccatcaccctgaagagaagcctgatcctgagcagcagacacggcatcagaagaaagctgatcaagcagctgggcgagcacaagagagtgtaccagtgcaacatctgcagcaagatcttccagaacagcagcaacctgagcagacacgtgagaagccacggcgacaagctgttcaagtgcgaggagtgcgccaagctgttcagcagaaaggagagcctgaagcagcacgtgagctacaagcacagcagaaacgaggtggacggcgagtacagatacagatgcggcacctgcgagaagaccttcagaatcgagagcgccctggagttccacaactgcagaaccgacgacaagaccttccagtgcgagatgtgcttcagattcttcagcaccaacagcaacctgagcaagcacaagaagaagcacggcgacaagaagttcgcctgcgaggtgtgcagcaagatgttctacagaaaggacgtgatgctggaccaccagagaagacacctggagggcgtgagaagagtgaagagagaggacctggaggccggcggcgagaacctggtgagatacaagaaggagcccagcggctgccccgtgtgcggcaaggtgttcagctgcagaagcaacatgaacaagcacctgctgacccacggcgacaagaagtacacctgcgagatctgcggcagaaagttcttcagagtggacgtgctgagagaccacatccacgtgcacttcaaggacatcgccctgatggacgaccaccagagagaggagttcatcggcaagatcggcatcagcagcgaggagaacgacgacaacagcgacgagagcgccgacagcgagccccacaagtacagctgcaagagatgccagctgaccttcggcagaggcaaggagtacctgaagcacatcatggaggtgcacaaggagaagggctacggctgcagcatctgcaacagaagattcgccctgaaggccacctaccacgcccacatggtgatccacagagagaacctgcccgaccccaacgtgcagaagtacatccacccctgcgagatctgcggcagaatcttcaacagcatcggcaacctggagagacacaagctgatccacaccggcgtgaagagccacgcctgcgagcagtgcggcaagagcttcgccagaaaggacatgctgaaggagcacatgagagtgcacgacaacgtgagagagtacctgtgcgccgagtgcggcaagggcatgaagaccaagcacgccctgagacaccacatgaagctgcacaagggcatcaaggagtacgagtgcaaggagtgccacagaagattcgcccagaaggtgaacatgctgaagcactgcaagagacacaccggcatcaaggacttcatgtgcgagctgtgcggcaagaccttcagcgagagaaacaccatggagacccacaagctgatccacaccgtgggcaagcagtggacctgcagcgtgtgcgacaagaagtacgtgaccgagtacatgctgcagaagcacgtgcagctgacccacgacaaggtggaggcccagagctgccagctgtgcggcaccaaggtgagcaccagagccagcatgagcagacacatgagaagaaagcaccccgaggtgctggccgtgagaatcgacgacctggaccacctgcccgagaccaccaccatcgacgccagcagcatcggcatcgtgcagcccgagctgaccctggagcaggaggacctggccgagggcaagcacggcaaggccgccaagagaagccacaagagaaagcagaagcccgaggaggaggccggcgcccccgtgcccgaggacgccaccttcagcgagtacagcgagaaggagaccgagttcaccggcagcgtgggcgacgagaccaacagcgccgtgcagagcatccagcaggtggtggtgaccctgggcgaccccaacgtgaccacccccagcagcagcgtgggcctgaccaacatcaccgtgacccccatcaccaccgccgccgccacccagttcaccaacctgcagcccgtggccgtgggccacctgaccacccccgagagacagctgcagctggacaacagcatcctgaccgtgaccttcgacaccgtgagcggcagcgccatgctgcacaacagacagaacgacgtgcagatccacccccagcccgaggccagcaacccccagagcgtggcccacttcatcaacctgaccaccctggtgaacagcatcacccccctgggcagccagctgagcgaccagcaccccctgacctggagagccgtgccccagaccgacgtgctgccccccagccagccccaggcccccccccagcaggccgcccagccccaggtgcaggccgagcagcagcagcagcagatgtacagctactag

SEQ ID NO: 9145 - DNA, 1557 bp, Artificial Sequence
  Description of Artificial Sequence: Synthetic coding sequence
atggccgaggacggcagcgaggagatcatgttcatctggtgcgaggactgcagccagtaccacgacagcgagtgccccgagctgggccccgtggtgatggtgaaggacagcttcgtgctgagcagagccagaagcagcctgccccccaacctggagatcagaagactggaggacggcgccgagggcgtgttcgccatcacccagctggtgaagagaacccagttcggccccttcgagagcagaagagtggccaagtgggagaaggagagcgccttccccctgaaggtgttccagaaggacggccaccccgtgtgcttcgacaccagcaacgaggacgactgcaactggatgatgctggtgagacccgccgccgaggccgagcaccagaacctgaccgcctaccagcacggcagcgacgtgtacttcaccaccagcagagacatcccccccggcaccgagctgagagtgtggtacgccgccttctacgccaagaagatggacaagcccatgctgaagcaggccggcagcggcgtgcacgccgccggcacccccgagaacagcgcccccgtggagagcgagcccagccagtgggcctgcaaggtgtgcagcgccaccttcctggagctgcagctgctgaacgagcacctgctgggccacctggagcaggccaagagcctgccccccggcagccagagcgaggccgccgcccccgagaaggagcaggacacccccagaggcgagccccccgccgtgcccgagagcgagaacgtggccaccaaggagcagaagaagaagcccagaagaggcagaaagcccaaggtgagcaaggccgagcagcccctggtgatcgtggaggacaaggagcccaccgagcaggtggccgagatcatcaccgaggtgccccccgacgagcccgtgagcgccacccccgacgagagaatcatggagctggtgctgggcaagctggccaccaccaccaccgacaccagcagcgtgcccaagttcacccaccaccagaacaacaccatcaccctgaagagaagcctgatcctgagcagcagacacggcatcagaagaaagctgatcaagcagctgggcgagcacaagagagtgtaccagtgcaacatctgcagcaagatcttccagaacagcagcaacctgagcagacacgtgagaagccacggcgacaagctgttcaagtgcgaggagtgcgccaagctgttcagcagaaaggagagcctgaagcagcacgtgagctacaagcacagcagaaacgaggtggacggcgagtacagatacagatgcggcacctgcgagaagaccttcagaatcgagagcgccctggagttccacaactgcagaaccggcctgatcgcccaccccggcgagggcggccccggcggcagcagactgagagacctgcccgccaccagccccagcaccagaagaagcaccgccaccagaagcctgcccgtgagaagcgccgccagatgcagcaccgccagaaccagctgctggaccaccagcgccggcacctggaagacctgcgccgcctag

SEQ ID NO: 9146 - DNA, 3537 bp, Artificial Sequence
  Description of Artificial Sequence: Synthetic coding sequence
atgcccagaagaagaccccccgccagcggcgccgcccagttccccgagagaatcgccaccagaagccccgaccccatccccctgtgcaccttccagagacaggtgagcgagatggccgaggacggcagcgaggagatcatgttcatctggtgcgaggactgcagccagtaccacgacagcgagtgccccgagctgggccccgtggtgatggtgaaggacagcttcgtgctgagcagagccagaagcagcctgccccccaacctggagatcagaagactggaggacggcgccgagggcgtgttcgccatcacccagctggtgaagagaacccagttcggccccttcgagagcagaagagtggccaagtgggagaaggagagcgccttccccctgaaggtgttccagaaggacggccaccccgtgtgcttcgacaccagcaacgaggacgactgcaactggatgatgctggtgagacccgccgccgaggccgagcaccagaacctgaccgcctaccagcacggcagcgacgtgtacttcaccaccagcagagacatcccccccggcaccgagctgagagtgtggtacgccgccttctacgccaagaagatggacaagcccatgctgaagcaggccggcagcggcgtgcacgccgccggcacccccgagaacagcgcccccgtggagagcgagcccagccagtgggcctgcaaggtgtgcagcgccaccttcctggagctgcagctgctgaacgagcacctgctgggccacctggagcaggccaagagcctgccccccggcagccagagcgaggccgccgcccccgagaaggagcaggacacccccagaggcgagccccccgccgtgcccgagagcgagaacgtggccaccaaggagcagaagaagaagcccagaagaggcagaaagcccaaggtgagcaaggccgagcagcccctggtgatcgtggaggacaaggagcccaccgagcaggtggccgagatcatcaccgaggtgccccccgacgagcccgtgagcgccacccccgacgagagaatcatggagctggtgctgggcaagctggccaccaccaccaccgacaccagcagcgtgcccaagttcacccaccaccagaacaacaccatcaccctgaagagaagcctgatcctgagcagcagacacggcatcagaagaaagctgatcaagcagctgggcgagcacaagagagtgtaccagtgcaacatctgcagcaagatcttccagaacagcagcaacctgagcagacacgtgagaagccacggcgacaagctgttcaagtgcgaggagtgcgccaagctgttcagcagaaaggagagcctgaagcagcacgtgagctacaagcacagcagaaacgaggtggacggcgagtacagatacagatgcggcacctgcgagaagaccttcagaatcgagagcgccctggagttccacaactgcagaaccgacgacaagaccttccagtgcgagatgtgcttcagattcttcagcaccaacagcaacctgagcaagcacaagaagaagcacggcgacaagaagttcgcctgcgaggtgtgcagcaagatgttctacagaaaggacgtgatgctggaccaccagagaagacacctggagggcgtgagaagagtgaagagagaggacctggaggccggcggcgagaacctggtgagatacaagaaggagcccagcggctgccccgtgtgcggcaaggtgttcagctgcagaagcaacatgaacaagcacctgctgacccacggcgacaagaagtacacctgcgagatctgcggcagaaagttcttcagagtggacgtgctgagagaccacatccacgtgcacttcaaggacatcgccctgatggacgaccaccagagagaggagttcatcggcaagatcggcatcagcagcgaggagaacgacgacaacagcgacgagagcgccgacagcgagccccacaagtacagctgcaagagatgccagctgaccttcggcagaggcaaggagtacctgaagcacatcatggaggtgcacaaggagaagggctacggctgcagcatctgcaacagaagattcgccctgaaggccacctaccacgcccacatggtgatccacagagagaacctgcccgaccccaacgtgcagaagtacatccacccctgcgagatctgcggcagaatcttcaacagcatcggcaacctggagagacacaagctgatccacaccggcgtgaagagccacgcctgcgagcagtgcggcaagagcttcgccagaaaggacatgctgaaggagcacatgagagtgcacgacaacgtgagagagtacctgtgcgccgagtgcggcaagggcatgaagaccaagcacgccctgagacaccacatgaagctgcacaagggcatcaaggagtacgagtgcaaggagtgccacagaagattcgcccagaaggtgaacatgctgaagcactgcaagagacacaccggcatcaaggacttcatgtgcgagctgtgcggcaagaccttcagcgagagaaacaccatggagacccacaagctgatccacaccgtgggcaagcagtggacctgcagcgtgtgcgacaagaagtacgtgaccgagtacatgctgcagaagcacgtgcagctgacccacgacaaggtggaggcccagagctgccagctgtgcggcaccaaggtgagcaccagagccagcatgagcagacacatgagaagaaagcaccccgaggtgctggccgtgagaatcgacgacctggaccacctgcccgagaccaccaccatcgacgccagcagcatcggcatcgtgcagcccgagctgaccctggagcaggaggacctggccgagggcaagcacggcaaggccgccaagagaagccacaagagaaagcagaagcccgaggaggaggccggcgcccccgtgcccgaggacgccaccttcagcgagtacagcgagaaggagaccgagttcaccggcagcgtgggcgacgagaccaacagcgccgtgcagagcatccagcaggtggtggtgaccctgggcgaccccaacgtgaccacccccagcagcagcgtgggcctgaccaacatcaccgtgacccccatcaccaccgccgccgccacccagttcaccaacctgcagcccgtggccgtgggccacctgaccacccccgagagacagctgcagctggacaacagcatcctgaccgtgaccttcgacaccgtgagcggcagcgccatgctgcacaacagacagaacgacgtgcagatccacccccagcccgaggccagcaacccccagagcgtggcccacttcatcaacctgaccaccctggtgaacagcatcacccccctgggcagccagctgagcgaccagcaccccctgacctggagagccgtgccccagaccgacgtgctgccccccagccagccccaggcccccccccagcaggccgcccagccccaggtgcaggccgagcagcagcagcagcagatgtacagctactag

SEQ ID NO: 9147 - DNA, 4524 bp, Artificial Sequence; identical to SEQ ID NO: 9144
  Description of Artificial Sequence: Synthetic coding sequence

SEQ ID NO: 9148 - DNA, 1437 bp, Artificial Sequence
  Description of Artificial Sequence: Synthetic coding sequence
atggccgaggacggcagcgaggagatcatgttcatctggtgcgaggactgcagccagtaccacgacagcgagtgccccgagctgggccccgtggtgatggtgaaggacagcttcgtgctgagcagagccagaagcagcctgccccccaacctggagatcagaagactggaggacggcgccgagggcgtgttcgccatcacccagctggtgaagagaacccagttcggccccttcgagagcagaagagtggccaagtgggagaaggagagcgccttccccctgaaggtgttccagaaggacggccaccccgtgtgcttcgacaccagcaacgaggacgactgcaactggatgatgctggtgagacccgccgccgaggccgagcaccagaacctgaccgcctaccagcacggcagcgacgtgtacttcaccaccagcagagacatcccccccggcaccgagctgagagtgtggtacgccgccttctacgccaagaagatggacaagcccatgctgaagcaggccggcagcggcgtgcacgccgccggcacccccgagaacagcgcccccgtggagagcgagcccagccagtgggcctgcaaggtgtgcagcgccaccttcctggagctgcagctgctgaacgagcacctgctgggccacctggagcaggccaagagcctgccccccggcagccagagcgaggccgccgcccccgagaaggagcaggacacccccagaggcgagccccccgccgtgcccgagagcgagaacgtggccaccaaggagcagaagaagaagcccagaagaggcagaaagcccaaggtgagcaaggccgagcagcccctggtgatcgtggaggacaaggagcccaccgagcaggtggccgagatcatcaccgaggtgccccccgacgagcccgtgagcgccacccccgacgagagaatcatggagctggtgctgggcaagctggccaccaccaccaccgacaccagcagcgtgcccaagcacggcatcagaagaaagctgatcaagcagctgggcgagcacaagagagtgtaccagtgcaacatctgcagcaagatcttccagaacagcagcaacctgagcagacacgtgagaagccacggcgacaagctgttcaagtgcgaggagtgcgccaagctgttcagcagaaaggagagcctgaagcagcacgtgagctacaagcacagcagaaacgaggtggacggcgagtacagatacagatgcggcacctgcgagaagaccttcagaatcgagagcgccctggagttccacaactgcagaaccgccaccagccccagcaccagaagaagcaccgccaccagaagcctgcccgtgagaagcgccgccagatgcagcaccgccagaaccagctgctggaccaccagcgccggcacctggaaggagtgcggcgagtag

SEQ ID NO: 9149 - DNA, 3426 bp, Artificial Sequence
  Description of Artificial Sequence: Synthetic coding sequence
atggccgaggacggcagcgaggagatcatgttcatctggtgcgaggactgcagccagtaccacgacagcgagtgccccgagctgggccccgtggtgatggtgaaggacagcttcgtgctgagcagagccagaagcagcctgccccccaacctggagatcagaagactggaggacggcgccgagggcgtgttcgccatcacccagctggtgaagagaacccagttcggccccttcgagagcagaagagtggccaagtgggagaaggagagcgccttccccctgaaggtgttccagaaggacggccaccccgtgtgcttcgacaccagcaacgaggacgactgcaactggatgatgctggtgagacccgccgccgaggccgagcaccagaacctgaccgcctaccagcacggcagcgacgtgtacttcaccaccagcagagacatcccccccggcaccgagctgagagtgtggtacgccgccttctacgccaagaagatggacaagcccatgctgaagcaggccggcagcggcgtgcacgccgccggcacccccgagaacagcgcccccgtggagagcgagcccagccagtgggcctgcaaggtgtgcagcgccaccttcctggagctgcagctgctgaacgagcacctgctgggccacctggagcaggccaagagcctgccccccggcagccagagcgaggccgccgcccccgagaaggagcaggacacccccagaggcgagccccccgccgtgcccgagagcgagaacgtggccaccaaggagcagaagaagaagcccagaagaggcagaaagcccaaggtgagcaaggccgagcagcccctggtgatcgtggaggacaaggagcccaccgagcaggtggccgagatcatcaccgaggtgccccccgacgagcccgtgagcgccacccccgacgagagaatcatggagctggtgctgggcaagctggccaccaccaccaccgacaccagcagcgtgcccaagttcacccaccaccagaacaacaccatcaccctgaagagaagcctgatcctgagcagcagacacggcatcagaagaaagctgatcaagcagctgggcgagcacaagagagtgtaccagtgcaacatctgcagcaagatcttccagaacagcagcaacctgagcagacacgtgagaagccacggcgacaagctgttcaagtgcgaggagtgcgccaagctgttcagcagaaaggagagcctgaagcagcacgtgagctacaagcacagcagaaacgaggtggacggcgagtacagatacagatgcggcacctgcgagaagaccttcagaatcgagagcgccctggagttccacaactgcagaaccgacgacaagaccttccagtgcgagatgtgcttcagattcttcagcaccaacagcaacctgagcaagcacaagaagaagcacggcgacaagaagttcgcctgcgaggtgtgcagcaagatgttctacagaaaggacgtgatgctggaccaccagagaagacacctggagggcgtgagaagagtgaagagagaggacctggaggccggcggcgagaacctggtgagatacaagaaggagcccagcggctgccccgtgtgcggcaaggtgttcagctgcagaagcaacatgaacaagcacctgctgacccacggcgacaagaagtacacctgcgagatctgcggcagaaagttcttcagagtggacgtgctgagagaccacatccacgtgcacttcaaggacatcgccctgatggacgaccaccagagagaggagttcatcggcaagatcggcatcagcagcgaggagaacgacgacaacagcgacgagagcgccgacagcgagccccacaagtacagctgcaagagatgccagctgaccttcggcagaggcaaggagtacctgaagcacatcatggaggtgcacaaggagaagggctacggctgcagcatctgcaacagaagattcgccctgaaggccacctaccacgcccacatggtgatccacagagagaacctgcccgaccccaacgtgcagaagtacatccacccctgcgagatctgcggcagaatcttcaacagcatcggcaacctggagagacacaagctgatccacaccggcgtgaagagccacgcctgcgagcagtgcggcaagagcttcgccagaaaggacatgctgaaggagcacatgagagtgcacgacaacgtgagagagtacctgtgcgccgagtgcggcaagggcatgaagaccaagcacgccctgagacaccacatgaagctgcacaagggcatcaaggagtacgagtgcaaggagtgccacagaagattcgcccagaaggtgaacatgctgaagcactgcaagagacacaccggcatcaaggacttcatgtgcgagctgtgcggcaagaccttcagcgagagaaacaccatggagacccacaagctgatccacaccgtgggcaagcagtggacctgcagcgtgtgcgacaagaagtacgtgaccgagtacatgctgcagaagcacgtgcagctgacccacgacaaggtggaggcccagagctgccagctgtgcggcaccaaggtgagcaccagagccagcatgagcagacacatgagaagaaagcaccccgaggtgctggccgtgagaatcgacgacctggaccacctgcccgagaccaccaccatcgacgccagcagcatcggcatcgtgcagcccgagctgaccctggagcaggaggacctggccgagggcaagcacggcaaggccgccaagagaagccacaagagaaagcagaagcccgaggaggaggccggcgcccccgtgcccgaggacgccaccttcagcgagtacagcgagaaggagaccgagttcaccggcagcgtgggcgacgagaccaacagcgccgtgcagagcatccagcaggtggtggtgaccctgggcgaccccaacgtgaccacccccagcagcagcgtgggcctgaccaacatcaccgtgacccccatcaccaccgccgccgccacccagttcaccaacctgcagcccgtggccgtgggccacctgaccacccccgagagacagctgcagctggacaacagcatcctgaccgtgaccttcgacaccgtgagcggcagcgccatgctgcacaacagacagaacgacgtgcagatccacccccagcccgaggccagcaacccccagagcgtggcccacttcatcaacctgaccaccctggtgaacagcatcacccccctgggcagccagctgagcgaccagcaccccctgacctggagagccgtgccccagaccgacgtgctgccccccagccagccccaggcccccccccagcaggccgcccagccccaggtgcaggccgagcagcagcagcagcagatgtacagctactag

SEQ ID NO: 9150 - DNA, 1668 bp, Artificial Sequence
  Description of Artificial Sequence: Synthetic coding sequence
atgcccagaagaagaccccccgccagcggcgccgcccagttccccgagagaatcgccaccagaagccccgaccccatccccctgtgcaccttccagagacaggtgagcgagatggccgaggacggcagcgaggagatcatgttcatctggtgcgaggactgcagccagtaccacgacagcgagtgccccgagctgggccccgtggtgatggtgaaggacagcttcgtgctgagcagagccagaagcagcctgccccccaacctggagatcagaagactggaggacggcgccgagggcgtgttcgccatcacccagctggtgaagagaacccagttcggccccttcgagagcagaagagtggccaagtgggagaaggagagcgccttccccctgaaggtgttccagaaggacggccaccccgtgtgcttcgacaccagcaacgaggacgactgcaactggatgatgctggtgagacccgccgccgaggccgagcaccagaacctgaccgcctaccagcacggcagcgacgtgtacttcaccaccagcagagacatcccccccggcaccgagctgagagtgtggtacgccgccttctacgccaagaagatggacaagcccatgctgaagcaggccggcagcggcgtgcacgccgccggcacccccgagaacagcgcccccgtggagagcgagcccagccagtgggcctgcaaggtgtgcagcgccaccttcctggagctgcagctgctgaacgagcacctgctgggccacctggagcaggccaagagcctgccccccggcagccagagcgaggccgccgcccccgagaaggagcaggacacccccagaggcgagccccccgccgtgcccgagagcgagaacgtggccaccaaggagcagaagaagaagcccagaagaggcagaaagcccaaggtgagcaaggccgagcagcccctggtgatcgtggaggacaaggagcccaccgagcaggtggccgagatcatcaccgaggtgccccccgacgagcccgtgagcgccacccccgacgagagaatcatggagctggtgctgggcaagctggccaccaccaccaccgacaccagcagcgtgcccaagttcacccaccaccagaacaacaccatcaccctgaagagaagcctgatcctgagcagcagacacggcatcagaagaaagctgatcaagcagctgggcgagcacaagagagtgtaccagtgcaacatctgcagcaagatcttccagaacagcagcaacctgagcagacacgtgagaagccacggcgacaagctgttcaagtgcgaggagtgcgccaagctgttcagcagaaaggagagcctgaagcagcacgtgagctacaagcacagcagaaacgaggtggacggcgagtacagatacagatgcggcacctgcgagaagaccttcagaatcgagagcgccctggagttccacaactgcagaaccggcctgatcgcccaccccggcgagggcggccccggcggcagcagactgagagacctgcccgccaccagccccagcaccagaagaagcaccgccaccagaagcctgcccgtgagaagcgccgccagatgcagcaccgccagaaccagctgctggaccaccagcgccggcacctggaaggagtgcggcgagtag

SEQ ID NO: 9151 - DNA, 3486 bp, Artificial Sequence
  Description of Artificial Sequence: Synthetic coding sequence
atggccgaggacggcagcgaggagatcatgttcatctggtgcgaggactgcagccagtaccacgacagcgagtgccccgagctgggccccgtggtgatggtgaaggacagcttcgtgctgagcagagccagaagcagcctgccccccaacctggagatcagaagactggaggacggcgccgagggcgtgttcgccatcacccagctggtgaagagaacccagttcggccccttcgagagcagaagagtggccaagtgggagaaggagagcgccttccccctgaaggtgttccagaaggacggccaccccgtgtgcttcgacaccagcaacgaggacgactgcaactggatgatgctggtgagacccgccgccgaggccgagcaccagaacctgaccgcctaccagcacggcagcgacgtgtacttcaccaccagcagagacatcccccccggcaccgagctgagagtgtggtacgccgccttctacgccaagaagatggacaagcccatgctgaagcaggccggcagcggcgtgcacgccgccggcacccccgagaacagcgcccccgtggagagcgagcccagccagtgggcctgcaaggtgtgcagcgccaccttcctggagctgcagctgctgaacgagcacctgctgggccacctggagcaggccaagagcctgccccccggcagccagagcgaggccgccgcccccgagaaggagcaggacacccccagaggcgagccccccgccgtgcccgagagcgagaacgtggccaccaaggagcagaagaagaagcccagaagaggcagaaagcccaaggtgagcaaggccgagcagcccctggtgatcgtggaggacaaggagcccaccgagcaggtggccgagatcatcaccgaggtgccccccgacgagcccgtgagcgccacccccgacgagagaatcatggagctggtgctgggcaagctggccaccaccaccaccgacaccagcagcgtgcccaagttcacccaccaccagaacaacaccatcaccctgaagagaagcctgatcctgagcagcagacacggcatcagaagaaagctgatcaagcagctgggcgagcacaagagagtgtaccagtgcaacatctgcagcaagatcttccagaacagcagcaacctgagcagacacgtgagaagccacggcgacaagctgttcaagtgcgaggagtgcgccaagctgttcagcagaaaggagagcctgaagcagcacgtgagctacaagcacagcagaaacgaggtggacggcgagtacagatacagatgcggcacctgcgagaagaccttcagaatcgagagcgccctggagttccacaactgcagaaccggcctgatcgcccaccccggcgagggcggccccggcggcagcagactgagagacctgcccgacgacaagaccttccagtgcgagatgtgcttcagattcttcagcaccaacagcaacctgagcaagcacaagaagaagcacggcgacaagaagttcgcctgcgaggtgtgcagcaagatgttctacagaaaggacgtgatgctggaccaccagagaagacacctggagggcgtgagaagagtgaagagagaggacctggaggccggcggcgagaacctggtgagatacaagaaggagcccagcggctgccccgtgtgcggcaaggtgttcagctgcagaagcaacatgaacaagcacctgctgacccacggcgacaagaagtacacctgcgagatctgcggcagaaagttcttcagagtggacgtgctgagagaccacatccacgtgcacttcaaggacatcgccctgatggacgaccaccagagagaggagttcatcggcaagatcggcatcagcagcgaggagaacgacgacaacagcgacgagagcgccgacagcgagccccacaagtacagctgcaagagatgccagctgaccttcggcagaggcaaggagtacctgaagcacatcatggaggtgcacaaggagaagggctacggctgcagcatctgcaacagaagattcgccctgaaggccacctaccacgcccacatggtgatccacagagagaacctgcccgaccccaacgtgcagaagtacatccacccctgcgagatctgcggcagaatcttcaacagcatcggcaacctggagagacacaagctgatccacaccggcgtgaagagccacgcctgcgagcagtgcggcaagagcttcgccagaaaggacatgctgaaggagcacatgagagtgcacgacaacgtgagagagtacctgtgcgccgagtgcggcaagggcatgaagaccaagcacgccctgagacaccacatgaagctgcacaagggcatcaaggagtacgagtgcaaggagtgccacagaagattcgcccagaaggtgaacatgctgaagcactgcaagagacacaccggcatcaaggacttcatgtgcgagctgtgcggcaagaccttcagcgagagaaacaccatggagacccacaagctgatccacaccgtgggcaagcagtggacctgcagcgtgtgcgacaagaagtacgtgaccgagtacatgctgcagaagcacgtgcagctgacccacgacaaggtggaggcccagagctgccagctgtgcggcaccaaggtgagcaccagagccagcatgagcagacacatgagaagaaagcaccccgaggtgctggccgtgagaatcgacgacctggaccacctgcccgagaccaccaccatcgacgccagcagcatcggcatcgtgcagcccgagctgaccctggagcaggaggacctggccgagggcaagcacggcaaggccgccaagagaagccacaagagaaagcagaagcccgaggaggaggccggcgcccccgtgcccgaggacgccaccttcagcgagtacagcgagaaggagaccgagttcaccggcagcgtgggcgacgagaccaacagcgccgtgcagagcatccagcaggtggtggtgaccctgggcgaccccaacgtgaccacccccagcagcagcgtgggcctgaccaacatcaccgtgacccccatcaccaccgccgccgccacccagttcaccaacctgcagcccgtggccgtgggccacctgaccacccccgagagacagctgcagctggacaacagcatcctgaccgtgaccttcgacaccgtgagcggcagcgccatgctgcacaacagacagaacgacgtgcagatccacccccagcccgaggccagcaacccccagagcgtggcccacttcatcaacctgaccaccctggtgaacagcatcacccccctgggcagccagctgagcgaccagcaccccctgacctggagagccgtgccccagaccgacgtgctgccccccagccagccccaggcccccccccagcaggccgcccagccccaggtgcaggccgagcagcagcagcagcagatgtacagctactag

SEQ ID NO: 9152 - DNA, 1788 bp, Artificial Sequence
  Description of Artificial Sequence: Synthetic coding sequence
atgctgaagcccggcgaccccggcggcagcgccttcctgaaggtggaccccgcctacctgcagcactggcagcagctgttcccccacggcggcgccggccccctgaagggcagcggcgccgccggcctgctgagcgccccccagcccctgcagccccccccccccccccccccccccgagagagccgagcccccccccgacagcctgagacccagacccgccagcctgagcagcgccagcagcacccccgccagcagcagcaccagcgccagcagcgccagcagctgcgccgccgccgccgccgccgccgccctggccggcctgagcgccctgcccgtgagccagctgcccgtgttcgcccccctggccgccgccgccgtggccgccgagcccctgccccccaaggagctgtgcctgggcgccaccagcggccccggccccgtgaagtgcggcggcggcggcggcggcggcggcgagggcagaggcgcccccagattcagatgcagcgccgaggagctggactactacctgtacggccagcagagaatggagatcatccccctgaaccagcacaccagcgaccccaacaacagatgcgacatgtgcgccgacaacagaaacggcgagtgccccatgcacggccccctgcacagcctgagaagactggtgggcaccagcagcgccgccgccgccgcccccccccccgagctgcccgagtggctgagagacctgcccagagaggtgtgcctgtgcaccagcaccgtgcccggcctggcctacggcatctgcgccgcccagagaatccagcagggcacctggatcggccccttccagggcgtgctgctgccccccgagaaggtgcaggccggcgccgtgagaaacacccagcacctgtgggagatctacgaccaggacggcaccctgcagcacttcatcgacggcggcgagcccagcaagagcagctggatgagatacatcagatgcgccagacactgcggcgagcagaacctgaccgtggtgcagtacagaagcaacatcttctacagagcctgcatcgacatccccagaggcaccgagctgctggtgtggtacaacgacagctacaccagcttcttcggcatccccctgcagtgcatcgcccaggacgagaacctgaacgtgcccagcaccgtgatggaggccatgtgcagacaggacgccctgcagcccttcaacaagagcagcaagctggcccccaccacccagcagagaagcgtggtgttcccccagaccccctgcagcagaaacttcagcctgctggacaagagcggccccatcgagagcggcttcaaccagatcaacgtgaagaaccagagagtgctggccagccccaccagcaccagccagctgcacagcgagttcagcgactggcacctgtggaagtgcggccagtgcttcaagaccttcacccagagaatcctgctgcagatgcacgtgtgcacccagaaccccgacagaccctaccagtgcggccactgcagccagagcttcagccagcccagcgagctgagaaaccacgtggtgacccacagcagcgacagacccttcaagtgcggctactgcggcagagccttcgccggcgccaccaccctgaacaaccacatcagaacccacaccggcgagaagcccttcaagtgcgagagatgcgagagaagcttcacccaggccacccagctgagcagacaccagagaatgcccaacgagtgcaagcccatcaccgagagccccgagagcatcgaggtggactag

SEQ ID NO: 9153 - DNA, 516 bp, Artificial Sequence
  Description of Artificial Sequence: Synthetic coding sequence
atgtgccagaacttcttcatcgacagctgcgccgcccacggcccccccaccttcgtgaaggacagcgccgtggacaagggccaccccaacagaagcgccctgagcctgccccccggcctgagaatcggccccagcggcatcccccaggccggcctgggcgtgtggaacgaggccagcgacctgcccctgggcctgcacttcggcccctacgagggcagaatcaccgaggacgaggaggccgccaacagcggctacagctggctgatcaccaagggcagaaactgctacgagtacgtggacggcaaggacaagagcagcgccaactggatgagaaccaaggccagagaccccagcatgagcctgatgctgagcggcctgttcaagagcaagatcagccagagcacctgcggcacccagagcctgctgagcgagctgcccagaaccatctgcaagaagaccagccccaccagagagagcctgcccagaggcagcgagagcggcgccgccatcttctag

SEQ ID NO: 9154 - DNA, 516 bp, Artificial Sequence; identical to SEQ ID NO: 9153
  Description of Artificial Sequence: Synthetic coding sequence

SEQ ID NO: 9155 - DNA, 417 bp, Artificial Sequence
  Description of Artificial Sequence: Synthetic coding sequence
atgagccccgagagaagccaggaggagagccccgagggcgacaccgagagaaccgagagaaagcccatggtgaaggacgccttcaaggacatcagcatctacttcaccaaggaggagtgggccgagatgggcgactgggagaagaccagatacagaaacgtgaagatgaactacaacgccctgatcaccgtgggcctgagagccaccagacccgccttcatgtgccacagaagacaggccatcaagctgcaggtggacgacaccgaggacagcgacgaggagtggacccccagacagcaggtgaagcccccctggatggccttcagaggcgagcagagcaagcaccagaagatcgtgagatgcgtgagaaccagcagcctgaccgccgtgctgctgatgggccccctgcacctgtag

SEQ ID NO: 9156 - DNA, 1479 bp, Artificial Sequence
  Description of Artificial Sequence: Synthetic coding sequence
atgagccccgagagaagccaggaggagagccccgagggcgacaccgagagaaccgagagaaagcccatggtgaaggacgccttcaaggacatcagcatctacttcaccaaggaggagtgggccgagatgggcgactgggagaagaccagatacagaaacgtgaagatgaactacaacgccctgatcaccgtgggcctgagagccaccagacccgccttcatgtgccacagaagacaggccatcaagctgcaggtggacgacaccgaggacagcgacgaggagtggacccccagacagcaggtgaagcccccctggatggccttcagaggcgagcagagcaagcaccagaagggcatgcccaaggccagcttcaacaacgagagcagcctgagagagctgagcggcacccccaacctgctgaacaccagcgacagcgagcaggcccagaagcccgtgagcccccccggcgaggccagcaccagcggccagcacagcagactgaagctggagctgagaagaaaggagaccgagggcaagatgtacagcctgagagagagaaagggccacgcctacaaggagatcagcgagccccaggacgacgactacctgtactgcgagatgtgccagaacttcttcatcgacagctgcgccgcccacggcccccccaccttcgtgaaggacagcgccgtggacaagggccaccccaacagaagcgccctgagcctgccccccggcctgagaatcggccccagcggcatcccccaggccggcctgggcgtgtggaacgaggccagcgacctgcccctgggcctgcacttcggcccctacgagggcagaatcaccgaggacgaggaggccgccaacagcggctacagctggctgatcaccaagggcagaaactgctacgagtacgtggacggcaaggacaagagcagcgccaactggatgagatacgtgaactgcgccagagacgacgaggagcagaacctggtggccttccagtaccacagacagatcttctacagaacctgcagagtgatcagacccggctgcgagctgctggtgtggagcggcgacgagtacggccaggagctgggcatcagaagcagcatcgagcccgccgagagcctgggccaggccgtgaactgctggagcggcatgggcatgagcatggccagaaactgggccagcagcggcgccgccagcggcagaaagagcagctggcagggcgagaaccagagccagagaagcatccacgtgccccacgccgtgtggcccttccaggtgaagaacttcagcgtgaacatgtggaacgccatcacccccctgagaaccagccaggaccacctgcaggagaacttcagcaaccagagaatccccgcccagggcatcagaatcagaagcggcaacatcctgatccacgccgccgtgatgaccaagcccaaggtgaagagaagcaagaagggccccaacagctag

SEQ ID NO: 9157 - DNA, 2070 bp, Artificial Sequence
  Description of Artificial Sequence: Synthetic coding sequence
atggaggacaccggcatccagagaggcatctgggacggcgacgccaaggccgtgcagcagtgcctgaccgacatcttcaccagcgtgtacaccacctgcgacatccccgagaacgccatcttcggcccctgcgtgctgagccacaccagcctgtacgacagcatcgccttcatcgccctgaagagcaccgacaagagaaccgtgccctacatcttcagagtggacaccagcgccgccaacggcagcagcgagggcctgatgtggctgagactggtgcagagcgccagagacaaggaggagcagaacctggaggcctacatcaagaacggccagctgttctacagaagcctgagaagaatcgccaaggacgaggagctgctggtgtggtacggcaaggagctgaccgagctgctgctgctgtgccccagcagaagccacaacaagatgaacggcagcagcccctacacctgcctggagtgcagccagagattccagttcgagttcccctacgtggcccacctgagattcagatgccccaagagactgcacagcgccgacatcagcccccaggacgagcagggcggcggcgtgggcaccaaggaccacggcggcggcggcggcggcggcaaggaccagcagcagcagcagcaggaggcccccctgggccccggccccaagttctgcaaggccggccccctgcaccactaccccagccccagccccgagagcagcaaccccagcgccgccgccggcggcagcagcgccaagcccagcaccgacttccacaacctggccagagagctggagaacagcagaggcggcagcagctgcagccccgcccagagcctgagcagcggcagcggcagcggcggcggcggcggccaccaggaggccgagctgagccccgacggcatcgccaccggcggcggcaagggcaagagaaagttccccgaggaggccgccgagggcggcggcggcgccggcctggtgggcggcagaggcagattcgtggagagacccctgcccgccagcaaggaggacctggtgtgcaccccccagcagtacagagccagcggcagctacttcggcctggaggagaacggcagactgttcgccccccccagccccgagaccggcgaggccaagagaagcgccttcgtggaggtgaagaaggccgccagagccgccagcctgcaggaggagggcaccgccgacggcgccggcgtggccagcgaggaccaggacgccggcggcggcggcggcagcagcacccccgccgccgccagccccgtgggcgccgagaagctgctggcccccagacccggcggccccctgcccagcagactggagggcggcagccccgccagaggcagcgccttcaccagcgtgccccagctgggcagcgccggcagcaccagcggcggcggcggcaccggcgccggcgccgccggcggcgccggcggcggccagggcgccgccagcgacgagagaaagagcgccttcagccagcccgccagaagcttcagccagctgagccccctggtgctgggccagaagctgggcgccctggagccctgccaccccgccgacggcgtgggccccaccagactgtaccccgccgccgccgaccccctggccgtgaagctgcagggcgccgccgacctgaacggcggctgcggcagcctgcccagcggcggcggcggcctgcccaagcagagccccttcctgtacgccaccgccttctggcccaagagcagcgccgccgccgccgccgccgccgccgccgccgccgccggccccctgcagctgcagctgcccagcgccctgaccctgctgccccccagcttcaccagcctgtgcctgcccgcccagaactggtgcgccaagtgcaacgccagcttcagaatgaccagcgacctggtgtaccacatgagaagccaccacaagaaggagtacgccatggagcccctggtgaagagaagaagagaggagaagctgaagtgccccatctgcaacgagagcttcagagagagacaccacctgagcagacacatgaccagccacaactag

SEQ ID NO: 9158 - DNA, 2070 bp, Artificial Sequence; identical to SEQ ID NO: 9157
  Description of Artificial Sequence: Synthetic coding sequence

SEQ ID NO: 9159 - DNA, 2070 bp, Artificial Sequence; identical to SEQ ID NO: 9157
  Description of Artificial Sequence: Synthetic coding sequence

SEQ ID NO: 9160 - DNA, 1287 bp, Artificial Sequence
  Description of Artificial Sequence: Synthetic coding sequence
atggaggacaccggcatccagagaggcatctgggacggcgacgccaaggccgtgcagcagtgcctgaccgacatcttcaccagcgtgtacaccacctgcgacatccccgagaacgccatcttcggcccctgcgtgctgagccacaccagcctgtacgacagcatcgccttcatcgccctgaagagcaccgacaagagaaccgtgccctacatcttcagagtggacaccagcgccgccaacggcagcagcgagggcctgatgtggctgagactggtgcagagcgccagagacaaggaggagcagaacctggaggcctacatcaagaacggccagctgttctacagaagcctgagaagaatcgccaaggacgaggagctgctggtgtggtacggcaaggagctgaccgagctgctgctgctgtgccccagcagaagccacaacaagatgaacggcagcagcccctacacctgcctggagtgcagccagagattccagttcgagttcccctacgtggcccacctgagattcagatgccccaagagactgcacagcgccgacatcagcccccaggacgagcagggcggcggcgtgggcaccaaggaccacggcggcggcggcggcggcggcaaggaccagcagcagcagcagcaggaggcccccctgggccccggccccaagttctgcaaggccggccccctgcaccactaccccagccccagccccgagagcagcaaccccagcgccgccgccggcggcagcagcgccaagcccagcaccgacttccacaacctggccagagagctggagaacagcagaggcggcagcagctgcagccccgcccagagcctgagcagcggcagcggcagcggcggcggcggcggccaccaggaggccgagctgagccccgacggcatcgccaccggcggcggcaagggcaagagaaagttccccgaggaggccgccgagggcggcggcggcgccggcctggtgggcggcagaggcagattcgtggagagacccctgcccgccagcaaggaggacctggtgtgcaccccccagcagtacagagccagcggcagctacttcggcctggaggagaacggcagactgttcgccccccccagccccgagaccggcgaggccaagagaagcgccttcgtggaggtgaagaaggccgccagagccgccagcctgcaggaggagggcaccgccgacggcgccggcgtggccagcgaggaccaggacgccggcggcggcggcggcagcagcacccccgccgccgcctag

SEQ ID NO: 9161 - DNA, 1125 bp, Artificial Sequence
  Description of Artificial Sequence: Synthetic coding sequence
atggccgccccccccagacccgcccccagcccccccgcccccagaagactggacaccagcgacgtgctgcagcagatcatggccatcaccgaccagagcctggacgaggcccaggccagaaagcacgccctgaactgccacagaatgaagcccgccctgttcagcgtgctgtgcgagatcaaggagaagaccgtggtgagcatcagaggcatccaggacgaggacccccccgacgcccagctgctgagactggacaacatgctgctggccgagggcgtgtgcagacccgagaagagaggcagaggcggcgccgtggccagagccggcaccgccacccccggcggctgccccaacgacaacagcatcgagcacagcgactacagagccaagctgagccagatcagacagatctaccacagcgagctggagaagtacgagcaggcctgcagagagttcaccacccacgtgaccaacctgctgcaggagcagagcagaatgagacccgtgagccccaaggagatcgagagaatggtgggcgccatccacggcaagttcagcgccatccagatgcagctgaagcagagcacctgcgaggccgtgatgaccctgagaagcagactgctggacgccagaagaaagagaagaaacttcagcaagcaggccaccgaggtgctgaacgagtacttctacagccacctgaacaacccctaccccagcgaggaggccaaggaggagctggccagaaagggcggcctgaccatcagccaggtgagcaactggttcggcaacaagagaatcagatacaagaagaacatgggcaagttccaggaggaggccaccatctacaccggcaagaccgccgtggacaccaccgaggtgggcgtgcccggcaaccacgccagctgcctgagcacccccagcagcggcagcagcggccccttccccctgcccagcgccggcgacgccttcctgaccctgagaaccctggccagcctgcagcccccccccggcggcggctgcctgcagagccaggcccagggcagctggcagggcgccaccccccagcccgccaccgccagccccgccggcgaccccggcagcatcaacagcagcaccagcaactag

SEQ ID NO: 9162 - DNA, 945 bp, Artificial Sequence
  Description of Artificial Sequence: Synthetic coding sequence
atgctggtgagcggcagaagaagactgctgaccgtgctgctgcaggcccagaagtggcccttccagcccagcagagacatgagactggtgcagttcagagccccccacctggtgggcccccacctgggcctggagaccggcaacggcggcggcgtgatcaacctgaacgccttcgaccccaccctgcccaagaccatgacccagttcctggagcagggcgaggccaccctgagcgtggccagaagagccctggccgcccagctgcccgtgctgcccagaagcgaggtgaccttcctggcccccgtgaccagacccgacaaggtggtgtgcgtgggcatgaactacgtggaccactgcaaggagcagaacgtgcccgtgcccaaggagcccatcatcttcagcaagttcgccagcagcatcgtgggcccctacgacgaggtggtgctgcccccccagagccaggaggtggactgggaggtggagctggccgtggtgatcggcaagaagggcaagcacatcaaggccaccgacgccatggcccacgtggccggcttcaccgtggcccacgacgtgagcgccagagactggcagatgagaagaaacggcaagcagtggctgctgggcaagaccttcgacaccttctgccccctgggccccgccctggtgaccaaggacagcgtggccgacccccacaacctgaagatctgctgcagagtgaacggcgaggtggtgcagagcggcaacaccaaccagatggtgttcaagaccgaggacctgatcgcctgggtgagccagttcgtgaccttctaccccggcgacgtgatcctgaccggcaccccccccggcgtgggcgtgttcagaaagccccccgtgttcctgaagaagggcgacgaggtgcagtgcgagatcgaggagctgggcgtgatcatcaacaaggtggtgtag

SEQ ID NO: 9163 - DNA, 1059 bp, Artificial Sequence
  Description of Artificial Sequence: Synthetic coding sequence
atgagcgtgcagaacagcggctggccccaccaggaggacagccccaagccccaggaccccggcccccccgccaacagcgacagcgacagcggccacctgcccggcgaggaccccgaggacacccacgcccagggccccgccgtgctgagcctgggcagcctgtgcctggacaccaaccaggcccccaactggaccggcctgcagaccctgctgcagcagctgcccccccaggacatcgacgagagatactgcctggccctgggcgaggaggagagagccgagctgcagctgttctgcgccagaagaaagcaggaggccctgggccagggcgtggccagactggtgctgcccaagctggagggccacacctgcgagaagtgcagagagctgctgaagcccggcgagtacggcgtgttcgccgccagagccggcgagcagagatgctggcaccagccctgcttcgcctgccaggcctgcggccaggccctgatcaacctgatctacttctaccacgacggccagctgtactgcggcagacaccacgccgagctgctgagacccagatgccccgcctgcgaccagctgatcttcagctggagatgcaccgaggccgagggccagagatggcacgagaaccacttctgctgccaggactgcgccggccccctgggcggcggcagatacgccctgcccggcggcagcccctgctgccccagctgcttcgagaacagatacagcgacgccggcagcagctgggccggcgccctggagggccaggccttcctgggcgccccccccccccacccccccgaccccagcctgggcgccagaagcagccacagagccagcctggccggcgccttccagggcccccccgagcccacccccagaagaggcagaggctgcggcgccagactgccccccagaagaggcagaagaacccccagcggcggcggcggcggcccctggagaggcctgagcgccgccgccgccgccagaaccgcccagggcctgggcggcgccggcggctgggccagcccccccctggccgccgtgtag

SEQ ID NO: 9164 - DNA, 939 bp, Artificial Sequence
  Description of Artificial Sequence: Synthetic coding sequence
atgagcccccagggccccgccgtgctgagcctgggcagcctgtgcctggacaccaaccaggcccccaactggaccggcctgcagaccctgctgcagcagctgcccccccaggacatcgacgagagatactgcctggccctgggcgaggaggagagagccgagctgcagctgttctgcgccagaagaaagcaggaggccctgggccagggcgtggccagactggtgctgcccaagctggagggccacacctgcgagaagtgcagagagctgctgaagcccggcgagtacggcgtgttcgccgccagagccggcgagcagagatgctggcaccagccctgcttcgcctgccaggcctgcggccaggccctgatcaacctgatctacttctaccacgacggccagctgtactgcggcagacaccacgccgagctgctgagacccagatgccccgcctgcgaccagctgatcttcagctggagatgcaccgaggccgagggccagagatggcacgagaaccacttctgctgccaggactgcgccggccccctgggcggcggcagatacgccctgcccggcggcagcccctgctgccccagctgcttcgagaacagatacagcgacgccggcagcagctgggccggcgccctggagggccaggccttcctgggcgccccccccccccacccccccgaccccagcctgggcgccagaagcagccacagagccagcctggccggcgccttccagggcccccccgagcccacccccagaagaggcagaggctgcggcgccagactgccccccagaagaggcagaagaacccccagcggcggcggcggcggcccctggagaggcctgagcgccgccgccgccgccagaaccgcccagggcctgggcggcgccggcggctgggccagcccccccctggccgccgtgtag

SEQ ID NO: 9165 - DNA, 1035 bp, Artificial Sequence
  Description of Artificial Sequence: Synthetic coding sequence
atgagcccccagggccccgccgtgctgagcctgggcagcctgtgcctggacaccaaccaggcccccaactggaccggcctgcagaccctgctgcagcagctgcccccccaggacatcgacgagagatactgcctggccctgggcgaggaggagagagccgagctgcagctgttctgcgccagaagaaagcaggaggccctgggccagggcgtggccagactggtgctgcccaagctggagggccacacctgcgagaagtgcagagagctgctgaagcccggcgagtacggcgtgttcgccgccagagccggcgagcagagatgctggcaccagccctgcttcgcctgccaggcctgcggccaggccctgatcaacctgatctacttctaccacgacggccagctgtactgcggcagacaccacgccgagctgctgagacccagatgccccgcctgcgaccagctgatcttcagctggagatgcaccgaggccgagggccagagatggcacgagaaccacttctgctgccaggactgcgccggccccctgggcggcggcagatacgccctgcccggcggcagcccctgctgccccagctgcttcgagaacagatacagcgacgccggcagcagctgggccggcgccctggagggccaggccttcctgggcgagaccggcctggacagaaccgagggcagagaccagaccagcgtgaacagcgccaccctgagcagaaccctgctggccgccgccggcggcagcagcctgcagacccagagaggcctgcccggcagcagcccccagcaggagaacagacccggcgacaaggccgaggcccccaagggccaggagcagtgcagactggagaccatcagagaccccaaggacacccccttcagcacctgcagcagcagcagcgacagcgagcccgagggcttcttcctgggcgagagactgccccagagctggaagacccccggcagcctgcaggccgaggacagcaacgccagcaagacccactgcaccatgtgctag

SEQ ID NO: 9166 - DNA, 1155 bp, Artificial Sequence
  Description of Artificial Sequence: Synthetic coding sequence
atgagcgtgcagaacagcggctggccccaccaggaggacagccccaagccccaggaccccggcccccccgccaacagcgacagcgacagcggccacctgcccggcgaggaccccgaggacacccacgcccagggccccgccgtgctgagcctgggcagcctgtgcctggacaccaaccaggcccccaactggaccggcctgcagaccctgctgcagcagctgcccccccaggacatcgacgagagatactgcctggccctgggcgaggaggagagagccgagctgcagctgttctgcgccagaagaaagcaggaggccctgggccagggcgtggccagactggtgctgcccaagctggagggccacacctgcgagaagtgcagagagctgctgaagcccggcgagtacggcgtgttcgccgccagagccggcgagcagagatgctggcaccagccctgcttcgcctgccaggcctgcggccaggccctgatcaacctgatctacttctaccacgacggccagctgtactgcggcagacaccacgccgagctgctgagacccagatgccccgcctgcgaccagctgatcttcagctggagatgcaccgaggccgagggccagagatggcacgagaaccacttctgctgccaggactgcgccggccccctgggcggcggcagatacgccctgcccggcggcagcccctgctgccccagctgcttcgagaacagatacagcgacgccggcagcagctgggccggcgccctggagggccaggccttcctgggcgagaccggcctggacagaaccgagggcagagaccagaccagcgtgaacagcgccaccctgagcagaaccctgctggccgccgccggcggcagcagcctgcagacccagagaggcctgcccggcagcagcccccagcaggagaacagacccggcgacaaggccgaggcccccaagggccaggagcagtgcagactggagaccatcagagaccccaaggacacccccttcagcacctgcagcagcagcagcgacagcgagcccgagggcttcttcctgggcgagagactgccccagagctggaagacccccggcagcctgcaggccgaggacagcaacgccagcaagacccactgcaccatgtgctag

SEQ ID NO: 9167 - DNA, 213 bp, Artificial Sequence
  Description of Artificial Sequence: Synthetic coding sequence
atgagcgtgcagaacagcggctggccccaccaggaggacagccccaagccccaggaccccggcccccccgccaacagcgacagcgacagcggccacctgcccggcgaggaccccgaggacacccacgcccaggagttcctgagcctgcacctgctgagaacctggggcttcgacttcaagctgatccacatgagcatccactacctgagctag

SEQ ID NO: 9168 - DNA, 474 bp, Artificial Sequence
  Description of Artificial Sequence: Synthetic coding sequence
atgaagaaccccgacaaggccgtgcccatccccgagaagatgagcgagtgggcccccagacccccccccgagttcgtgagagacgtgatgggcagcagcgccggcgccggcagcggcgagttccacgtgtacagacacctgagaagaagagagtaccagagacaggactacatggacgccatggccgagaagcagaagctggacgccgagttccagaagagactggagaagaacaagatcgccgccgaggagcagaccgccaagagaagaaagaagagaaccagaagcgcccagggcgccggcgtgcagcagctgtgcggcggcatctggaacagaggcggcggcggcagcgcccagttccaccacggcgccatgaccatgttcgccaccgccagcgcctggaacctggccagagccgtgaccagaagagagagaagactgttcggcagcttcagccccgccagaaccagatag

SEQ ID NO: 9169 - DNA, 555 bp, Artificial Sequence
  Description of Artificial Sequence: Synthetic coding sequence
atggccagccccgccgccagcagcgtgagaccccccagacccaagaaggagccccagaccctggtgatccccaagaacgccgccgaggagcagaagctgaagctggagagactgatgaagaaccccgacaaggccgtgcccatccccgagaagatgagcgagtgggcccccagacccccccccgagttcgtgagagacgtgatgggcagcagcgccggcgccggcagcggcgagttccacgtgtacagacacctgagaagaagagagtaccagagacaggactacatggacgccatggccgagaagcagaagctggacgccgagttccagaagagactggagaagaacaagatcgccgccgaggagcagaccgccaagagaagaaagaagagacagaagctgaaggagaagaagctgctggccaagaagatgaagctggagcagaagaagcaggagggccccggccagcccaaggagcagggcagcagcagcagcgccgaggccagcggcaccgaggaggaggaggaggtgcccagcttcaccatgggcagatag

SEQ ID NO: 9170 - DNA, 555 bp, Artificial Sequence; identical to SEQ ID NO: 9169
  Description of Artificial Sequence: Synthetic coding sequence

SEQ ID NO: 9171 - DNA, 3075 bp, Artificial Sequence
  Description of Artificial Sequence: Synthetic coding sequence
atgagcaacgccaaggagagaaagcacgccaagaagatgagaaaccagcccaccaacgtgaccctgagcagcggcttcgtggccgacagaggcgtgaagcaccacagcggcggcgagaagcccttccaggcccagaagcaggagccccaccccggcaccagcagacagagacagaccagagtgaacccccacagcctgcccgaccccgaggtgaacgagcagagcagcagcaagggcatgttcagaaagaagggcggctggaaggccggccccgagggcaccagccaggagatccccaagtacatcaccgccagcaccttcgcccaggccagagccgccgagatcagcgccatgctgaaggccgtgacccagaagagcagcaacagcctggtgttccagaccctgcccagacacatgagaagaagagccatgagccacaacgtgaagagactgcccagaagactgcaggagatcgcccagaaggaggccgagaaggccgtgcaccagaagaaggagcacagcaagaacaagtgccacaaggccagaagatgccacatgaacagaaccctggagttcaacagaagacagaagaagaacatctggctggagacccacatctggcacgccaagagattccacatggtgaagaagtggggctactgcctgggcgagagacccaccgtgaagagccacagagcctgctacagagccatgaccaacagatgcctgctgcaggacctgagctactactgctgcctggagctgaagggcaaggaggaggagatcctgaaggccctgagcggcatgtgcaacatcgacaccggcctgaccttcgccgccgtgcactgcctgagcggcaagagacagggcagcctggtgctgtacagagtgaacaagtaccccagagagatgctgggccccgtgaccttcatctggaagagccagagaacccccggcgaccccagcgagagcagacagctgtggatctggctgcaccccaccctgaagcaggacatcctggaggagatcaaggccgcctgccagtgcgtggagcccatcaagagcgccgtgtgcatcgccgaccccctgcccacccccagccaggagaagagccagaccgagctgcccgacgagaagatcggcaagaagagaaagagaaaggacgacggcgagaacgccaagcccatcaagaagatcatcggcgacggcaccagagacccctgcctgccctacagctggatcagccccaccaccggcatcatcatcagcgacctgaccatggagatgaacagattcagactgatcggccccctgagccacagcatcctgaccgaggccatcaaggccgccagcgtgcacaccgtgggcgaggacaccgaggagaccccccacagatggtggatcgagacctgcaagaagcccgacagcgtgagcctgcactgcagacaggaggccatcttcgagctgctgggcggcatcaccagccccgccgagatccccgccggcaccatcctgggcctgaccgtgggcgaccccagaatcaacctgccccagaagaagagcaaggccctgcccaaccccgagaagtgccaggacaacgagaaggtgagacagctgctgctggagggcgtgcccgtggagtgcacccacagcttcatctggaaccaggacatctgcaagagcgtgaccgagaacaagatcagcgaccaggacctgaacagaatgagaagcgagctgctggtgcccggcagccagctgatcctgggcccccacgagagcaagatccccatcctgctgatccagcagcccggcaaggtgaccggcgaggacagactgggctggggcagcggctgggacgtgctgctgcccaagggctggggcatggccttctggatccccttcatctacagaggcgtgagagtgggcggcctgaaggagagcgccgtgcacagccagtacaagagaagccccaacgtgcccggcgacttccccgactgccccgccggcatgctgttcgccgaggagcaggccaagaacctgctggagaagtacaagagaagaccccccgccaagagacccaactacgtgaagctgggcaccctggcccccttctgctgcccctgggagcagctgacccaggactgggagagcagagtgcaggcctacgaggagcccagcgtggccagcagccccaacggcaaggagagcgacctgagaagaagcgaggtgccctgcgcccccatgcccaagaagacccaccagcccagcgacgaggtgggcaccagcatcgagcaccccagagaggccgaggaggtgatggacgccggctgccaggagagcgccggccccgagagaatcaccgaccaggaggccagcgagaaccacgtggccgccaccggcagccacctgtgcgtgctgagaagcagaaagctgctgaagcagctgagcgcctggtgcggccccagcagcgaggacagcagaggcggcagaagagcccccggcagaggccagcagggcctgaccagagaggcctgcctgagcatcctgggccacttccccagagccctggtgtgggtgagcctgagcctgctgagcaagggcagccccgagccccacaccatgatctgcgtgcccgccaaggaggacttcctgcagctgcacgaggactggcactactgcggcccccaggagagcaagcacagcgaccccttcagaagcaagatcctgaagcagaaggagaagaagaagagagagaagagacagaagcccggcagagccagcagcgacggccccgccggcgaggagcccgtggccggccaggaggccctgaccctgggcctgtggagcggccccctgcccagagtgaccctgcactgcagcagaaccctgctgggcttcgtgacccagggcgacttcagcatggccgtgggctgcggcgaggccctgggcttcgtgagcctgaccggcctgctggacatgctgagcagccagcccgccgcccagagaggcctggtgctgctgagaccccccgccagcctgcagtacagattcgccagaatcgccatcgaggtgtag

SEQ ID NO: 9172 - DNA, 3075 bp, Artificial Sequence; identical to SEQ ID NO: 9171
  Description of Artificial Sequence: Synthetic coding sequence

SEQ ID NO: 9173 - DNA, 552 bp, Artificial Sequence
  Description of Artificial Sequence: Synthetic coding sequence
atgagcaacgccaaggagagaaagcacgccaagaagatgagaaaccagcccaccaacgtgaccctgagcagcggcttcgtggccgacagaggcgtgaagcaccacagcggcggcgagaagcccttccaggcccagaagcaggagccccaccccggcaccagcagacagagacagaccagagtgaacccccacagcctgcccgaccccgaggtgaacgagcagagcagcagcaagggcatgttcagaaagaagggcggctggaaggccggccccgagggcaccagccaggagatccccaagtacatcaccgccagcaccttcgcccaggccagagccgccgagatcagcgccatgctgaaggccgtgacccagaagagcagcaacagcctggtgttccagaccctgcccagacacatgagaagaagagccatgagccacaacgtgaagagactgcccagaagactgcaggagatcgcccagaaggaggccgagaaggccgtgcaccagaagaaggagcacagcaagaacaagtgccacaaggccagaagatag

SEQ ID NO: 9174 - DNA, 297 bp, Artificial Sequence
  Description of Artificial Sequence: Synthetic coding sequence
atgtggaaccccaacgccggcggccccccccaccccgtgccccagcccggctaccccggctgccagcccctgggcccctacccccccccctaccccccccccgcccccggcatcccccccgtgaaccccctggcccccggcatggtgggccccgccgtgatcgtggacaagaagatgcagaagaagatgaagaaggcccacaagaagatgcacaagcaccagaagcaccacaagtaccacaagcacggcaagcacagcagcagcagcagcagcagcagcagcagcgacagcgactag

SEQ ID NO: 9175 - DNA, 447 bp, Artificial Sequence
  Description of Artificial Sequence: Synthetic coding sequence
atgtggaaccccaacgccggccagcccggccccaacccctacccccccaacatcggctgccccggcggcagcaaccccgcccaccccccccccatcaacccccccttcccccccggcccctgcccccccccccccggcgccccccacggcaaccccgccttcccccccggcggccccccccaccccgtgccccagcccggctaccccggctgccagcccctgggcccctacccccccccctaccccccccccgcccccggcatcccccccgtgaaccccctggcccccggcatggtgggccccgccgtgatcgtggacaagaagatgcagaagaagatgaagaaggcccacaagaagatgcacaagcaccagaagcaccacaagtaccacaagcacggcaagcacagcagcagcagcagcagcagcagcagcagcgacagcgactag

SEQ ID NO: 9176 - DNA, 489 bp, Artificial Sequence
  Description of Artificial Sequence: Synthetic coding sequence
atgggctacctggacagcatcggctggagaacccacctgaacatgtggaaccccaacgccggccagcccggccccaacccctacccccccaacatcggctgccccggcggcagcaaccccgcccaccccccccccatcaacccccccttcccccccggcccctgcccccccccccccggcgccccccacggcaaccccgccttcccccccggcggccccccccaccccgtgccccagcccggctaccccggctgccagcccctgggcccctacccccccccctaccccccccccgcccccggcatcccccccgtgaaccccctggcccccggcatggtgggccccgccgtgatcgtggacaagaagatgcagaagaagatgaagaaggcccacaagaagatgcacaagcaccagaagcaccacaagtaccacaagcacggcaagcacagcagcagcagcagcagcagcagcagcagcgacagcgactag

SEQ ID NO: 9177 - DNA, 447 bp, Artificial Sequence; identical to SEQ ID NO: 9175
  Description of Artificial Sequence: Synthetic coding sequence

SEQ ID NO: 9178 - DNA, 447 bp, Artificial Sequence; identical to SEQ ID NO: 9175
  Description of Artificial Sequence: Synthetic coding sequence

SEQ ID NO: 9179 - DNA, 1779 bp, Artificial Sequence
  Description of Artificial Sequence: Synthetic coding sequence
atggaccccaacagcatcctgctgagcccccagccccagatctgcagccacctggccgaggcctgcaccgagggcgagagaagcagcagcccccccgagctggacagagacagccccttcccctggagccaggtgcccagcagcagccccaccgaccccgagtggttcggcgacgagcacatccaggccaagagagccagagtggagaccatcgtgagaggcatgtgcctgagccccaaccccctggtgcccggcaacgcccaggccggcgtgagccccagatgccccaagaaggccagagagagaaagagaaagcagaacctgcccaccccccagggcctgctgatgcccgcccccgcctgggaccagggcaacagaaagggcggccccagagtgagagagcagctgcacctgctgaagcagcagctgagacacctgcaggagcacatcctgcaggccgccaagcccagagacaccgcccagggccccggcggctgcggcaccggcaagggccccctgagcgccaagcagggcaacggctgcggccccagaccctgggtggtggacggcgaccaccagcagggcaccagcaaggacctgagcggcgccgagaagcaccaggagagcgagaagcccagcttcctgcccagcggcgcccccgccagcctggagatcctgagaaaggagctgaccagagccgtgagccaggccgtggacagcgtgctgcagaaggtgctgctggacccccccggccacctgacccagctgggcagaagcttccagggccaggtggccgagggcagaagcgagcccagcccccccgtgggcggcgcctgcaaggaccccctggccctggccgccctgcccagaagagtgcagctgcaggccggcgtgcccgtgggcaacctgagcctggccaagagactggacagccccagataccccatcccccccagaatgacccccaagccctgccaggacccccccgccaacttccccctgaccgcccccagccacatccaggagaaccagatcctgagccagctgctgggccacagatacaacaacggccactggagcagcagccccccccaggacagcagcagccagagacaccccagcagcgagcccgccctgagaccctggagaaccaccaagccccagcccctggtgctgagccagcagcagtgccccctgcccttcaccagcgcccacctggagagcctgcccctgctgcccagcgtgaagatggagcagagaggcctgcacgccgtgatggaggccctgcccttcagcctggtgcacatcagcgagggcctgaaccccggccacctgaagaaggccaagctgatgttcttcttcaccagataccccagcagcaacctgctgaaggtgtacttccccgacgtgcagttcaacagatgcatcaccagccagatgatcaagtggttcagcaacttcagagagttctactacatccagatggagaagagcgccagacaggccatcagcgacggcgtgaccaaccccaagatgctggtggtgctgagaaacagcgagctgttccaggccctgaacatgcactacaacaagggcaacgacttcgaggtgcccgactgcttcctggagatcgccagcctgaccctgcaggagttcttcagagccgtgagcgccggcagagacagcgaccccagctggaagaagcccatctacaagatcatcagcaagctggacagcgacatccccgagatcttcaagagcagcagctacccccagtag

SEQ ID NO: 9180 - DNA, 1779 bp, Artificial Sequence
  Description of Artificial Sequence: Synthetic coding sequence
atggaccccaacagcatcctgctgagcccccagccccagatctgcagccacctggccgaggcctgcaccgagggcgagagaagcagcagcccccccgagctggacagagacagccccttcccctggagccaggtgcccagcagcagccccaccgaccccgagtggttcggcgacgagcacatccaggccaagagagccagagtggagaccatcgtgagaggcatgtgcctgagccccaaccccctggtgcccggcaacgcccaggccggcgtgagccccagatgccccaagaaggccagagagagaaagagaaagcagaacctgcccaccccccagggcctgctgatgcccgcccccgcctgggaccagggcaacagaaagggcggccccagagtgagagagcagctgcacctgctgaagcagcagctgagacacctgcaggagcacatcctgcaggccgccaagcccagagacaccgcccagggccccggcggctgcggcaccggcaagggccccctgagcgccaagcagggcaacggctgcggccccagaccctgggtggtggacggcgaccaccagcagggcaccagcaaggacctgagcggcgccgagaagcaccaggagagcgagaagcccagcttcctgcccagcggcgcccccgccagcctggagatcctgagaaaggagctgaccagagccgtgagccaggccgtggacagcgtgctgcagaaggtgctgctggacccccccggccacctgacccagctgggcagaagcttccagggccaggtggccgagggcagaagcgagcccagcccccccgtgggcggcgcctgcaaggaccccctggccctggccgccctgcccagaagagtgcagctgcaggccggcgtgcccgtgggcaacctgagcctggccaagagactggacagccccagataccccatcccccccagaatgacccccaagccctgccaggacccccccgccaacttccccctgaccgcccccagccacatccaggagaaccagatcctgagccagctgctgggccacagatacaacaacggccactggagcagcagccccccccaggacagcagcagccagagacaccccagcagcgagcccgccctgagaccctggagaaccaccaagccccagcccctggtgctgagccagcagcagtgccccctgcccttcaccagcgcccacctggagagcctgcccctgctgcccagcgtgaagatggagcagagaggcctgcacgccgtgatggaggccctgcccttcagcctgctgcacatccaggagggcctgaaccccggccacctgaagaaggccaagctgatgttcttcttcaccagataccccagcagcaacctgctgaaggtgtacttccccgacgtgcagttcaacagatgcatcaccagccagatgatcaagtggttcagcaacttcagagagttctactacatccagatggagaagagcgccagacaggccatcagcgacggcgtgaccaaccccaagatgctggtggtgctgagaaacagcgagctgttccaggccctgaacatgcactacaacaagggcaacgacttcgaggtgcccgactgcttcctggagatcgccagcctgaccctgcaggagttcttcagagccgtgagcgccggcagagacagcgaccccagctggaagaagcccatctacaagatcatcagcaagctggacagcgacatccccgagatcttcaagagcagcagctacccccagtag

SEQ ID NO: 9181 - DNA, 1779 bp, Artificial Sequence
  Description of Artificial Sequence: Synthetic coding sequence
atggaccccaacagcatcctgctgagcccccagccccagatctgcagccacctggccgaggcctgcaccgagggcgagagaagcagcagcccccccgagctggacagagacagccccttcccctggagccaggtgcccagcagcagccccaccgaccccgagtggttcggcgacgagcacatccaggccaagagagccagagtggagaccatcgtgagaggcatgtgcctgagccccaaccccctggtgcccggcaacgcccaggccggcgtgagccccagatgccccaagaaggccagagagagaaagagaaagcagaacctgcccaccccccagggcctgctgatgcccgcccccgcctgggaccagggcaacagaaagggcggccccagagtgagagagcagctgcacctgctgaagcagcagctgagacacctgcaggagcacatcctgcaggccgccaagcccagagacaccgcccagggccccggcggctgcggcaccggcaagggccccctgagcgccaagcagggcaacggctgcggccccagaccctgggtggtggacggcgaccaccagcagggcaccagcaaggacctgagcggcgccgagaagcaccaggagagcgagaagcccagcttcctgcccagcggcgcccccgccagcctggagatcctgagaaaggagctgaccagagccgtgagccaggccgtggacagcgtgctgcagaaggtgctgctggacccccccggccacctgacccagctgggcagaagcttccagggccaggtggccgagggcagaagcgagcccagcccccccgtgggcggcgcctgcaaggaccccctggccctggccgccctgcccagaagagtgcagctgcaggccggcgtgcccgtgggcaacctgagcctggccaagagactggacagccccagataccccatcccccccagaatgacccccaagccctgccaggacccccccgccaacttccccctgaccgcccccagccacatccaggagaaccagatcctgagccagctgctgggccacagatacaacaacggccactggagcagcagccccccccaggacagcagcagccagagacaccccagcagcgagcccgccctgagaccctggagaaccaccaagccccagcccctggtgctgagccagcagcagtgccccctgcccttcaccagcgcccacctggagagcctgcccctgctgcccagcgtgaagatggagcagagaggcctgcacgccgtgatggaggccctgcccttcagcctggtgcacatccaggagggcctgaaccccggccacctgaagaaggccaagctgatgttcttcttcaccagataccccagcagcaacctgctgaaggtgtacttccccgacgtgcagttcaacagatgcatcaccagccagatgatcaagtggttcagcaacttcagagagttctactacatccagatggagaagagcgccagacaggccatcagcgacggcgtgaccaaccccaagatgctggtggtgctgagaaacagcgagctgttccaggccctgaacatgcactacaacaagggcaacgacttcgaggtgcccgactgcttcctggagatcgccagcctgaccctgcaggagttcttcagagccgtgagcgccggcagagacagcgaccccagctggaagaagcccatctacaagatcatcagcaagctggacagcgacatccccgagatcttcaagagcagcagctacccccagtag

SEQ ID NO: 9182 - DNA, 174 bp, Artificial Sequence
  Description of Artificial Sequence: Synthetic coding sequence
atgctgtgcgcccacttcagcgaccagggccccgcccacctgaccaccagcaagagcgccttcctgagcaacaagaagaccagcaccctgaagcacctgctgggcgagaccagaagcgacggcagcgcctgcaacagcggcatcagcggcggcagaggcagaaagatcccctag

SEQ ID NO: 9183 - DNA, 5439 bp, Artificial Sequence
  Description of Artificial Sequence: Synthetic coding sequence
atggccgtggacagcgccatggagctgctgttcctggacaccttcaagcaccccagcgccgagcagagcagccacatcgacgtggtgagattcccctgcgtggtgtacatcaacgaggtgagagtgatcccccccggcgtgagagcccacagcagcctgcccgacaacagagcctacggcgagaccagcccccacaccttccagctggacctgttcttcaacaacgtgagcaagcccagcgcccccgtgttcgacagactgggcagcctggagtacgacgagaacaccagcatcatcttcagacccaacagcaaggtgaacaccgacggcctggtgctgagaggctggtacaactgcctgaccctggccatctacggcagcgtggacagagtgatcagccacgacagagacagcccccccccccccccccccccccccccccccccccagccccagcccagcctgaagagaaaccccaagcacgccgacggcgagaaggaggaccagttcaacggcagcccccccagaccccagcccagaggccccagaaccccccccggcccccccccccccgacgacgacgaggacgaccccgtgcccctgcccgtgagcggcgacaaggaggaggacgccccccacagagaggactacttcgagcccatcagccccgacagaaacagcgtgccccaggagggccagtacagcgacgagggcgaggtggaggaggagcagcaggaggagggcgaggaggacgaggacgacgtggacgtggaggaggaggaggacgaggacgaggacgacagaagaaccgtggacagcatccccgaggaggaggaggaggacgaggaggaggagggcgaggaggacgaggagggcgagggcgacgacggctacgagcagatcagcagcgacgaggacggcatcgccgacctggagagagagaccttcaagtaccccaacttcgacgtggagtacaccgccgaggacctggccagcgtgccccccatgacctacgacccctacgacagagagctggtgcccctgctgtacttcagctgcccctacaagaccaccttcgagatcgagatcagcagaatgaaggaccagggccccgacaaggagaacagcggcgccatcgaggccagcgtgaagctgaccgagctgctggacctgtacagagaggacagaggcgccaagtgggtgaccgccctggaggagatccccagcctgatcatcaagggcctgagctacctgcagctgaagaacaccaagcaggacagcctgggccagctggtggactggaccatgcaggccctgaacctgcaggtggccctgagacagcccatcgccctgaacgtgagacagctgaaggccggcaccaagctggtgagcagcctggccgagtgcggcgcccagggcgtgaccggcctgctgcaggccggcgtgatcagcggcctgttcgagctgctgttcgccgaccacgtgagcagcagcctgaagctgaacgccttcaaggccctggacagcgtgatcagcatgaccgagggcatggaggccttcctgagaggcagacagaacgagaagagcggctaccagaagctgctggagctgatcctgctggaccagaccgtgagagtggtgaccgccggcagcgccatcctgcagaagtgccacttctacgaggtgctgagcgagatcaagagactgggcgaccacctggccgagaagaccagcagcctgcccaaccacagcgagcccgaccacgacaccgacgccggcctggagagaaccaaccccgagtacgagaacgaggtggaggccagcatggacatggacctgctggagagcagcaacatcagcgagggcgagatcgagagactgatcaacctgctggaggaggtgttccacctgatggagaccgccccccacaccatgatccagcagcccgtgaagagcttccccaccatggccagaatcaccggcccccccgagagagacgacccctaccccgtgctgttcagatacctgcacagccaccacttcctggagctggtgaccctgctgctgagcatccccgtgaccagcgcccaccccggcgtgctgcaggccaccaaggacgtgctgaagttcctggcccagagccagaagggcctgctgttcttcatgagcgagtacgaggccaccaacctgctgatcagagccctgtgccacttctacgaccaggacgaggaggagggcctgcagagcgacggcgtgatcgacgacgccttcgccctgtggctgcaggacagcacccagaccctgcagtgcatcaccgagctgttcagccacttccagagatgcaccgccagcgaggagaccgaccacagcgacctgctgggcaccctgcacaacctgtacctgatcaccttcaaccccgtgggcagaagcgccgtgggccacgtgttcagcctggagaagaacctgcagagcctgatcaccctgatggagtactacagcaaggaggccctgggcgacagcaagagcaagaagagcgtggcctacaactacgcctgcatcctgatcctggtggtggtgcagagcagcagcgacgtgcagatgctggagcagcacgccgccagcctgctgaagctgtgcaaggccgacgagaacaacgccaagctgcaggagctgggcaagtggctggagcccctgaagaacctgagattcgagatcaactgcatccccaacctgatcgagtacgtgaagcagaacatcgacaacctgatgacccccgagggcgtgggcctgaccaccgccctgagagtgctgtgcaacgtggcctgcccccccccccccgtggagggccagcagaaggacctgaagtggaacctggccgtgatccagctgttcagcgccgagggcatggacaccttcatcagagtgctgcagaagctgaacagcatcctgacccagccctggagactgcacgtgaacatgggcaccaccctgcacagagtgaccaccatcagcatggccagatgcaccctgaccctgctgaagaccatgctgaccgagctgctgagaggcggcagcttcgagttcaaggacatgagagtgcccagcgccctggtgaccctgcacatgctgctgtgcagcatccccctgagcggcagactggacagcgacgagcagaagatccagaacgacatcatcgacatcctgctgaccttcacccagggcgtgaacgagaagctgaccatcagcgaggagaccctggccaacaacacctggagcctgatgctgaaggaggtgctgagcagcatcctgaaggtgcccgagggcttcttcagcggcctgatcctgctgagcgagctgctgcccctgcccctgcccatgcagaccacccaggtgatcgagccccacgacatcagcgtggccctgaacaccagaaagctgtggagcatgcacctgcacgtgcaggccaagctgctgcaggagatcgtgagaagcttcagcggcaccacctgccagcccatccagcacatgctgagaagaatctgcgtgcagctgtgcgacctggccagccccaccgccctgctgatcatgagaaccgtgctggacctgatcgtggaggacctgcagagcaccagcgaggacaaggagaagcagtacaccagccagaccaccagactgctggccctgctggacgccctggccagccacaaggcctgcaagctggccatcctgcacctgatcaacggcaccatcaagggcgacgagagatacgccgagatcttccaggacctgctggccctggtgagaagccccggcgacagcgtgatcagacagcagtgcgtggagtacgtgaccagcatcctgcagagcctgtgcgaccaggacatcgccctgatcctgcccagcagcagcgagggcagcatcagcgagctggagcagctgagcaacagcctgcccaacaaggagctgatgaccagcatctgcgactgcctgctggccaccctggccaacagcgagagcagctacaactgcctgctgacctgcgtgagaaccatgatgttcctggccgagcacgactacggcctgttccacctgaagagcagcctgagaaagaacagcagcgccctgcacagcctgctgaagagagtggtgagcaccttcagcaaggacaccggcgagctggccagcagcttcctggagttcatgagacagatcctgaacagcgacaccatcggctgctgcggcgacgacaacggcctgatggaggtggagggcgcccacaccagcagaaccatgagcatcaacgccgccgagctgaagcagctgctgcagagcaaggaggagagccccgagaacctgttcctggagctggagaagctggtgctggagcacagcaaggacgacgacaacctggacagcctgctggacagcgtggtgggcctgaagcagatgctggagagcagcggcgaccccctgcccctgagcgaccaggacgtggagcccgtgctgagcgcccccgagagcctgcagaacctgttcaacaacagaaccgcctacgtgctggccgacgtgatggacgaccagctgaagagcatgtggttcacccccttccaggccgaggagatcgacaccgacctggacctggtgaaggtggacctgatcgagctgagcgagaagtgctgcagcgacttcgacctgcacagcgagctggagagaagcttcctgagcgagcccagcagccccggcagaaccaagaccaccaagggcttcaagctgggcaagcacaagcacgagaccttcatcaccagcagcggcaagagcgagtacatcgagcccgccaagagagcccacgtggtgcccccccccagaggcagaggcagaggcggcttcggccagggcatcagaccccacgacatcttcagacagagaaagcagaacaccagcagaccccccagcatgcacgtggacgacttcgtggccgccgagagcaaggaggtggtgccccaggacggcatccccccccccaagagacccctgaaggtgagccagaagatcagcagcagaggcggcttcagcggcaacagaggcggcagaggcgccttccacagccagaacagattcttcaccccccccgccagcaagggcaactacagcagaagagagggcaccagaggcagcagctggagcgcccagaacacccccagaggcaactacaacgagagcagaggcggccagagcaacttcaacagaggccccctgccccccctgagacccctgagcagcaccggctacagacccagccccagagacagagccagcagaggcagaggcggcctgggccccagctgggccagcgccaacagcggcagcggcggcagcagaggcaagttcgtgagcggcggcagcggcagaggcagacacgtgagaagcttcaccagatag

SEQ ID NO: 9184 - DNA, 1038 bp, Artificial Sequence
  Description of Artificial Sequence: Synthetic coding sequence
atgaagcagctgaagagaaagagaaagagcaacttcagcgtgcaggagacccagaccctgctgaaggagatcaccaagagaaaggaggtgatcttcagcaagcagctgaacaccaccatcaacgtgatgaagagaatggcctgggaggagatcgcccagtgcgtgaacgccgtgggcgagggcgagcagagaaccggcaccgaggtgaagagaagatacctggactggagagccctgatgaagagaaagagaatgaaggccaacatcaagctggtgggcagcggcttccccctgcccagcagcgacctggacgacagcctgaccgaggagatcgacgagaagatcggcttcagaaacgacgccaacttcgactggcagaacgtggccgacttcagagacgccggcggcagcctgaccgaggtgaaggtggaggaggaggagagagacccccagagccccgagttcgagatcgaggaggaggaggagatgctgagcagcgtgatccccgacagcagaagagagaacgagctgcccgacttcccccacatcgacgagttcttcaccctgaacagcacccccagcagaagcgcctacgacgagccccacctgctggtgaacatcgagaagcagaagctggagctggagaagagaagactggacatcgaggccgagagactgcaggtggagaaggagagactgcagatcgagaaggagagactgagacacctggacatggagcacgagagactgcagctggagaaggagagactgcagatcgagagagagaagctgagactgcagatcgtgaacagcgagaagcccagcctggagaacgagctgggccagggcgagaagagcatgctgcagccccaggacatcgagaccgagaagctgaagctggagagagagagactgcagctggagaaggacagactgcagttcctgaagttcgagagcgagaagctgcagatcgagaaggagagactgcaggtggagaaggacagactgagaatccagaaggagggccacctgcagtag

SEQ ID NO: 9185 - DNA, 6738 bp, Artificial Sequence
  Description of Artificial Sequence: Synthetic coding sequence
atgcccgagatgaccgagaacgagacccccaccaagaagcagcacagaaagaagaacagagagacccacaacgccgtggagagacacagaaagaagaagatcaacgccggcatcaacagaatcggcgagctgatcccctgcagccccgccctgaagcagagcaagaacatgatcctggaccaggccttcaagtacatcaccgagctgaagagacagaacgacgagctgctgctgaacggcggcaacaacgagcaggccgaggagatcaagaagctgagaaagcagctggaggagatccagaaggagaacggcagatacatcgagctgctgaaggccaacgacatctgcctgtacgacgaccccaccatccactggaagggcaacctgaagaacagcaaggtgagcgtggtgatccccagcgaccaggtgcagaagaagatcatcgtgtacagcaacggcaaccagcccggcggcaacagccagggcaccgccgtgcagggcatcaccttcaacgtgagccacaacctgcagaagcagaccgccaacgtggtgcccgtgcagagaacctgcaacctggtgacccccgtgagcatcagcggcgtgtaccccagcgagaacaagccctggcaccagaccaccgtgcccgccctggccaccaaccagcccgtgcccctgtgcctgcccgccgccatcagcgcccagagcatcctggagctgcccaccagcgagagcgagagcaacgtgctgggcgccaccagcggcagcctgatcgccgtgagcatcgagagcgagccccaccagcaccacagcctgcacacctgcctgaacgaccagaacagcagcgagaacaagaacggccaggagaaccccaaggtgctgaagaagatgaccccctgcgtgaccaacatcccccacagcagcagcgccaccgccaccaaggtgcaccacggcaacaagagctgcctgagcatccaggacttcagaggcgacttccagaacaccttcgtggtgagcgtgaccaccaccgtgtgcagccagccccccagaaccgccggcgacagcagccccatgagcatcagcaagagcgccgacctgaccagcaccgccaccgtggtggccagcagcgcccccggcgtgggcaaggccaccatccccatcagcaccctgagcggcaaccccctggacaacggctggaccctgagctgcagcctgcccagcagcagcgtgagcaccagcgacctgaagaacatcaacagcctgaccagaatcagcagcgccggcaacacccagaccacctggaccaccctgcagctggccggcaacaccatccagcccctgagccagacccccagcagcgccgtgacccccgtgctgaacgagagcggcaccagccccaccaccagcaaccacagcagatacgtggccaccgacatcaacctgaacaacagcttccccgccgacggccagcccgtggagcaggtggtggtgaccctgcccagctgccccagcctgcccatgcagcccctgatcgcccagccccaggtgaagagccagccccccaagaacatcctgcccctgaacagcgccatgcaggtgatccagatggcccagcccgtgggcagcgccgtgaacagcgcccccaccaaccagaacgtgatcatcctgcagccccccagcaccaccccctgccccaccgtgatgagagccgaggtgagcaaccagaccgtgggccagcagatcgtgatcatccaggccgccaaccagaaccccctgcccctgctgcccgcccccccccccggcagcgtgagactgcccatcaacggcgccaacaccgtgatcggcagcaacaacagcgtgcagaacgtgcccaccccccagaccttcggcggcaagcacctggtgcacatcctgcccagacccagcagcctgagcgccagcaacagcacccagaccttcagcgtgaccatgagcaaccagcagccccagaccatcagcctgaacggccagctgttcgccctgcagcccgtgatgagcagcagcggcaccaccaaccagacccccatgcagatcatccagcccaccaccagcgaggaccccaacaccaacgtggccctgaacaccttcggcgccctggccagcctgaaccagagcatcagccagatggccggccagagctgcgtgcagctgagcatcagccagcccgccaacagccagaccgccgccaacagccagaccaccaccgccaactgcgtgagcctgaccaccaccgccgccccccccgtgaccaccgacagcagcgccaccctggccagcacctacaacctggtgagcaccagcagcatgaacaccgtggcctgcctgcccaacatgaagagcaagagactgaacaagaagcccggcggcagaaagcacctggccgccaacaagagcgcctgccccctgaacagcgtgagagacgtgagcaagctggactgccccaacaccgagggcagcgccgagcccccctgcaacgacggcctgctggagagcttccccgccgtgctgcccagcgtgagcgtgagccaggccaacagcgtgagcgtgagcgccagccacagcctgggcgtgctgagcagcgagagcctgatccccgagagcgtgagcaagagcaagagcgccgagaagagcagcccccccagccaggagagcgtgaccagcgagcacttcgccatggccgccgccaagagcaaggacagcacccccaacctgcagcaggagaccagccaggacaagccccccagcagcctggccctgagcgacgccgccaagccctgcgccagcgccaacgtgctgatccccagccccagcgacccccacatcctggtgagccaggtgcccggcctgagcagcaccaccagcaccaccagcaccgactgcgtgagcgaggtggagatcatcgccgagccctgcagagtggagcaggacagcagcgacaccatgcagaccaccggcctgctgaagggccagggcctgaccaccctgctgagcgacctggccaagaagaagaacccccagaagagcagcctgagcgaccagatggaccaccccgacttcagcagcgagaaccccaagatcgtggacagcagcgtgaacctgcaccccaagcaggagctgctgctgatgaacaacgacgacagagaccccccccagcaccacagctgcctgcccgaccaggaggtgatcaacggcagcctgatcaacggcagacaggccgacagccccatgagcaccagcagcggcagcagcagaagcttcagcgtggccagcatgctgcccgagaccaccagagaggacgtgaccagcaacgccaccaccaacacctgcgacagctgcaccttcgtggagcagaccgacatcgtggccctggccgccagagccatcttcgaccaggagaacctggagaagggcagagtgggcctgcaggccgacatcagagaggtggccagcaagcccagcgaggccagcctgctggagggcgacccccccttcaagagccagatccccaaggagagcggcaccggccaggccgaggccacccccaacgagttcaacagccagggcagcatcgaggccaccatggagagacccctggagaagcccagctgcagcctgggcatcaagaccagcaacgccagcctgcaggacagcaccagccagccccccagcatcaccagcctgagcgtgaacaacctgatccaccagagcagcatcagccaccccctggccagctgcgccggcctgagccccaccagcgagcagaccaccgtgcccgccaccgtgaacctgaccgtgagcagcagcagctacggcagccagccccccggccccagcctgatgaccgagtacagccaggagcagctgaacaccatgaccagcaccatccccaacagccagatccaggagcccctgctgaagcccagccacgagagcagaaaggacagcgccaagagagccgtgcaggacgacctgctgctgagcagcgccaagagacagaagcactgccagcccgcccccctgagactggagagcatgagcctgatgagcagaacccccgacaccatcagcgaccagacccagatgatggtgagccagatcccccccaacagcagcaacagcgtggtgcccgtgagcaaccccgcccacggcgacggcctgaccagactgttcccccccagcaacaacttcgtgacccccgccctgagacagaccgaggtgcagtgcggcagccagcccagcgtggccgagcagcagcagacccaggccagccagcacctgcaggccctgcagcagcacgtgcccgcccagggcgtgagccacctgcacagcaaccacctgtacatcaagcagcagcagcagcagcagcagcagcagcagcagcagcagcagcagcagcaggccggccagctgagagagagacaccacctgtaccagatgcagcaccacgtgccccacgccgagagcagcgtgcacagccagccccacaacgtgcaccagcagagaaccctgcagcaggaggtgcagatgcagaagaagagaaacctggtgcagggcacccagaccagccagctgagcctgcagcccaagcaccacggcaccgaccagagcagaagcaagaccggccagccccacccccaccaccagcagatgcagcagcagatgcagcagcacttcggcagcagccagaccgagaagagctgcgagaaccccagcaccagcagaaaccaccacaaccacccccagaaccacctgaaccaggacatcatgcaccagcagcaggacgtgggcagcagacagcagggcagcggcgtgagcagcgagcacgtgagcggccacaaccccatgcagagactgctgaccagcagaggcctggagcagcagatggtgagccagcccagcatcgtgaccagaagcagcgacatgacctgcaccccccacagacccgagagaaacagagtgagcagctacagcgccgaggccctgatcggcaagaccagcagcaacagcgagcagagaatgggcatcagcatccagggcagcagagtgagcgaccagctggagatgagaagctacctggacgtgcccagaaacaagagcctggccatccacaacatgcagggcagagtggaccacaccgtggccagcgacatcagactgagcgactgccagaccttcaagcccagcggcgccagccagcagccccagagcaacttcgaggtgcagagcagcagaaacaacgagatcggcaaccccgtgagcagcctgagaagcatgcagagccaggccttcagaatcagccagaacaccggccccccccccatcgacagacagaagagactgagctacccccccgtgcagagcatccccaccggcaacggcatccccagcagagacagcgagaacacctgccaccagagcttcatgcagagcctgctggccccccacctgagcgaccaggtgatcggcagccagagaagcctgagcgagcaccagagaaacacccagtgcggccccagcagcgccatcgagtacaactgcccccccacccacgagaacgtgcacatcagaagagagagcgagagccagaacagagagagctgcgacatgagcctgggcgccatcaacaccagaaacagcaccctgaacatccccttcagcagcagcagcagcagcggcgacatccagggcagaaacaccagccccaacgtgagcgtgcagaagagcaaccccatgagaatcaccgagagccacgccaccaagggccacatgaacccccccgtgaccaccaacatgcacggcgtggccagacccgccctgccccaccccagcgtgagccacggcaacggcgaccagggccccgccgtgagacaggccaacagcagcgtgccccagagaagcagacaccccctgcaggacagcagcggcagcaagatcagacagcccgagagaaacagaagcggcaaccagagacagagcaccgtgttcgaccccagcctgccccacctgcccctgagcaccggcggcagcatgatcctgggcagacagcagcccgccaccgagaagagaggcagcatcgtgagattcatgcccgacagcccccaggtgcccaacgacaacagcggccccgaccagcacaccctgagccagaacttcggcttcagcttcatccccgagggcggcatgaacccccccatcaacgccaacgccagcttcatcccccaggtgacccagcccagcgccaccagaacccccgccctgatccccgtggacccccagaacaccctgcccagcttctaccccccctacagccccgcccaccccaccctgagcaacgacatcagcatcccctacttccccaaccagatgttcagcaaccccagcaccgagaaggtgaacagcggcagcctgaacaacagattcggcagcatcctgagcccccccagacccgtgggcttcgcccagcccagcttccccctgctgcccgacatgccccccatgcacatgaccaacagccacctgagcaacttcaacatgaccagcctgttccccgagatcgccaccgtgctgcccgacggcagcgccatgagccccctgctgaccatcgccaacagcagcgccagcgacagcagcaagcagagcagcaacagacccgcccacaacatcagccacatcctgggccacgactgcagcagcgccgtgtag

SEQ ID NO: 9186 - DNA, 3444 bp, Artificial Sequence
  Description of Artificial Sequence: Synthetic coding sequence
atggccgtggacagcgccatggagctgctgttcctggacaccttcaagcaccccagcgccgagcagagcagccacatcgacgtggtgagattcccctgcgtggtgtacatcaacgaggtgagagtgatcccccccggcgtgagagcccacagcagcctgcccgacaacagagcctacggcgagaccagcccccacaccttccagctggacctgttcttcaacaacgtgagcaagcccagcgcccccgtgttcgacagactgggcagcctggagtacgacgagaacaccagcatcatcttcagacccaacagcaaggtgaacaccgacggcctggtgctgagaggctggtacaactgcctgaccctggccatctacggcagcgtggacagagtgatcagccacgacagagacagcccccccccccccccccccccccccccccccccccagccccagcccagcctgaagagaaaccccaagcacgccgacggcgagaaggaggaccagttcaacggcagcccccccagaccccagcccagaggccccagaaccccccccggcccccccccccccgacgacgacgaggacgaccccgtgcccctgcccgtgagcggcgacaaggaggaggacgccccccacagagaggactacttcgagcccatcagccccgacagaaacagcgtgccccaggagggccagtacagcgacgagggcgaggtggaggaggagcagcaggaggagggcgaggaggacgaggacgacgtggacgtggaggaggaggaggacgaggacgaggacgacagaagaaccgtggacagcatccccgaggaggaggaggaggacgaggaggaggagggcgaggaggacgaggagggcgagggcgacgacggctacgagcagatcagcagcgacgaggacggcatcgccgacctggagagagagaccttcaagtaccccaacttcgacgtggagtacaccgccgaggacctggccagcgtgccccccatgacctacgacccctacgacagagagctggtgcccctgctgtacttcagctgcccctacaagaccaccttcgagatcgagatcagcagaatgaaggaccagggccccgacaaggagaacagcggcgccatcgaggccagcgtgaagctgaccgagctgctggacctgtacagagaggacagaggcgccaagtgggtgaccgccctggaggagatccccagcctgatcatcaagggcctgagctacctgcagctgaagaacaccaagcaggacagcctgggccagctggtggactggaccatgcaggccctgaacctgcaggtggccctgagacagcccatcgccctgaacgtgagacagctgaaggccggcaccaagctggtgagcagcctggccgagtgcggcgcccagggcgtgaccggcctgctgcaggccggcgtgatcagcggcctgttcgagctgctgttcgccgaccacgtgagcagcagcctgaagctgaacgccttcaaggccctggacagcgtgatcagcatgaccgagggcatggaggccttcctgagaggcagacagaacgagaagagcggctaccagaagctgctggagctgatcctgctggaccagaccgtgagagtggtgaccgccggcagcgccatcctgcagaagtgccacttctacgaggtgctgagcgagatcaagagactgggcgaccacctggccgagaagaccagcagcctgcccaaccacagcgagcccgaccacgacaccgacgccggcctggagagaaccaaccccgagtacgagaacgaggtggaggccagcatggacatggacctgctggagagcagcaacatcagcgagggcgagatcgagagactgatcaacctgctggaggaggtgttccacctgatggagaccgccccccacaccatgatccagcagcccgtgaagagcttccccaccatggccagaatcaccggcccccccgagagagacgacccctaccccgtgctgttcagatacctgcacagccaccacttcctggagctggtgaccctgctgctgagcatccccgtgaccagcgcccaccccggcgtgctgcaggccaccaaggacgtgctgaagttcctggcccagagccagaagggcctgctgttcttcatgagcgagtacgaggccaccaacctgctgatcagagccctgtgccacttctacgaccaggacgaggaggagggcctgcagagcgacggcgtgatcgacgacgccttcgccctgtggctgcaggacagcacccagaccctgcagtgcatcaccgagctgttcagccacttccagagatgcaccgccagcgaggagaccgaccacagcgacctgctgggcaccctgcacaacctgtacctgatcaccttcaaccccgtgggcagaagcgccgtgggccacgtgttcagcctggagaagaacctgcagagcctgatcaccctgatggagtactacagcaaggaggccctgggcgacagcaagagcaagaagagcgtggcctacaactacgcctgcatcctgatcctggtggtggtgcagagcagcagcgacgtgcagatgctggagcagcacgccgccagcctgctgaagctgtgcaaggccgacgagaacaacgccaagctgcaggagctgggcaagtggctggagcccctgaagaacctgagattcgagatcaactgcatccccaacctgatcgagtacgtgaagcagaacatcgacaacctgatgacccccgagggcgtgggcctgaccaccgccctgagagtgctgtgcaacgtggcctgcccccccccccccgtggagggccagcagaaggacctgaagtggaacctggccgtgatccagctgttcagcgccgagggcatggacaccttcatcagagtgctgcagaagctgaacagcatcctgacccagccctggagactgcacgtgaacatgggcaccaccctgcacagagtgaccaccatcagcatggccagatgcaccctgaccctgctgaagaccatgctgaccgagctgctgagaggcggcagcttcgagttcaaggacatgagagtgcccagcgccctggtgaccctgcacatgctgctgtgcagcatccccctgagcggcagactggacagcgacgagcagaagatccagaacgacatcatcgacatcctgctgaccttcacccagggcgtgaacgagaagctgaccatcagcgaggagaccctggccaacaacacctggagcctgatgctgaaggaggtgctgagcagcatcctgaaggtgcccgagggcttcttcagcggcctgatcctgctgagcgagctgctgcccctgcccctgcccatgcagaccacccaggtgagcctgccctacaacatgcacctgatcaacgactgcagcaacaccttctag

SEQ ID NO: 9187 - DNA, 4134 bp, Artificial Sequence
  Description of Artificial Sequence: Synthetic coding sequence
atggccgtggacagcgccatggagctgctgttcctggacaccttcaagcaccccagcgccgagcagagcagccacatcgacgtggtgagattcccctgcgtggtgtacatcaacgaggtgagagtgatcccccccggcgtgagagcccacagcagcctgcccgacaacagagcctacggcgagaccagcccccacaccttccagctggacctgttcttcaacaacgtgagcaagcccagcgcccccgtgttcgacagactgggcagcctggagtacgacgagaacaccagcatcatcttcagacccaacagcaaggtgaacaccgacggcctggtgctgagaggctggtacaactgcctgaccctggccatctacggcagcgtggacagagtgatcagccacgacagagacagcccccccccccccccccccccccccccccccccccagccccagcccagcctgaagagaaaccccaagcacgccgacggcgagaaggaggaccagttcaacggcagcccccccagaccccagcccagaggccccagaaccccccccggcccccccccccccgacgacgacgaggacgaccccgtgcccctgcccgtgagcggcgacaaggaggaggacgccccccacagagaggactacttcgagcccatcagccccgacagaaacagcgtgccccaggagggccagtacagcgacgagggcgaggtggaggaggagcagcaggaggagggcgaggaggacgaggacgacgtggacgtggaggaggaggaggacgaggacgaggacgacagaagaaccgtggacagcatccccgaggaggaggaggaggacgaggaggaggagggcgaggaggacgaggagggcgagggcgacgacggctacgagcagatcagcagcgacgaggacggcatcgccgacctggagagagagaccttcaagtaccccaacttcgacgtggagtacaccgccgaggacctggccagcgtgccccccatgacctacgacccctacgacagagagctggtgcccctgctgtacttcagctgcccctacaagaccaccttcgagatcgagatcagcagaatgaaggaccagggccccgacaaggagaacagcggcgccatcgaggccagcgtgaagctgaccgagctgctggacctgtacagagaggacagaggcgccaagtgggtgaccgccctggaggagatccccagcctgatcatcaagggcctgagctacctgcagctgaagaacaccaagcaggacagcctgggccagctggtggactggaccatgcaggccctgaacctgcaggtggccctgagacagcccatcgccctgaacgtgagacagctgaaggccggcaccaagctggtgagcagcctggccgagtgcggcgcccagggcgtgaccggcctgctgcaggccggcgtgatcagcggcctgttcgagctgctgttcgccgaccacgtgagcagcagcctgaagctgaacgccttcaaggccctggacagcgtgatcagcatgaccgagggcatggaggccttcctgagaggcagacagaacgagaagagcggctaccagaagctgctggagctgatcctgctggaccagaccgtgagagtggtgaccgccggcagcgccatcctgcagaagtgccacttctacgaggtgctgagcgagatcaagagactgggcgaccacctggccgagaagaccagcagcctgcccaaccacagcgagcccgaccacgacaccgacgccggcctggagagaaccaaccccgagtacgagaacgaggtggaggccagcatggacatggacctgctggagagcagcaacatcagcgagggcgagatcgagagactgatcaacctgctggaggaggtgttccacctgatggagaccgccccccacaccatgatccagcagcccgtgaagagcttccccaccatggccagaatcaccggcccccccgagagagacgacccctaccccgtgctgttcagatacctgcacagccaccacttcctggagctggtgaccctgctgctgagcatccccgtgaccagcgcccaccccggcgtgctgcaggccaccaaggacgtgctgaagttcctggcccagagccagaagggcctgctgttcttcatgagcgagtacgaggccaccaacctgctgatcagagccctgtgccacttctacgaccaggacgaggaggagggcctgcagagcgacggcgtgatcgacgacgccttcgccctgtggctgcaggacagcacccagaccctgcagtgcatcaccgagctgttcagccacttccagagatgcaccgccagcgaggagaccgaccacagcgacctgctgggcaccctgcacaacctgtacctgatcaccttcaaccccgtgggcagaagcgccgtgggccacgtgttcagcctggagaagaacctgcagagcctgatcaccctgatggagtactacagcaaggaggccctgggcgacagcaagagcaagaagagcgtggcctacaactacgcctgcatcctgatcctggtggtggtgcagagcagcagcgacgtgcagatgctggagcagcacgccgccagcctgctgaagctgtgcaaggccgacgagaacaacgccaagctgcaggagctgggcaagtggctggagcccctgaagaacctgagattcgagatcaactgcatccccaacctgatcgagtacgtgaagcagaacatcgacaacctgatgacccccgagggcgtgggcctgaccaccgccctgagagtgctgtgcaacgtggcctgcccccccccccccgtggagggccagcagaaggacctgaagtggaacctggccgtgatccagctgttcagcgccgagggcatggacaccttcatcagagtgctgcagaagctgaacagcatcctgacccagccctggagactgcacgtgaacatgggcaccaccctgcacagagtgaccaccatcagcatggccagatgcaccctgaccctgctgaagaccatgctgaccgagctgctgagaggcggcagcttcgagttcaaggacatgagagtgcccagcgccctggtgaccctgcacatgctgctgtgcagcatccccctgagcggcagactggacagcgacgagcagaagatccagaacgacatcatcgacatcctgctgaccttcacccagggcgtgaacgagaagctgaccatcagcgaggagaccctggccaacaacacctggagcctgatgctgaaggaggtgctgagcagcatcctgaaggtgcccgagggcttcttcagcggcctgatcctgctgagcgagctgctgcccctgcccctgcccatgcagaccacccaggtgatcgagccccacgacatcagcgtggccctgaacaccagaaagctgtggagcatgcacctgcacgtgcaggccaagctgctgcaggagatcgtgagaagcttcagcggcaccacctgccagcccatccagcacatgctgagaagaatctgcgtgcagctgtgcgacctggccagccccaccgccctgctgatcatgagaaccgtgctggacctgatcgtggaggacctgcagagcaccagcgaggacaaggagaagcagtacaccagccagaccaccagactgctggccctgctggacgccctggccagccacaaggcctgcaagctggccatcctgcacctgatcaacggcaccatcaagggcgacgagagatacgccgagatcttccaggacctgctggccctggtgagaagccccggcgacagcgtgatcagacagcagtgcgtggagtacgtgaccagcatcctgcagagcctgtgcgaccaggacatcgccctgatcctgcccagcagcagcgagggcagcatcagcgagctggagcagctgagcaacagcctgcccaacaaggagctgatgaccagcatctgcgactgcctgctggccaccctggccaacagcgagagcagctacaactgcctgctgacctgcgtgagaaccatgatgttcctggccgagcacgactacggcctgttccacctgaagagagacgccgtggagatgatcatggtgagctggaagtag

SEQ ID NO: 9188 - DNA, 288 bp, Artificial Sequence
  Description of Artificial Sequence: Synthetic coding sequence
atggccgacgagaagcccaaggagggcgtgaagaccgagaacaacgaccacatcaacctgaaggtggccggccaggacggcagcgtggtgcagttcaagatcaagagacacacccccctgagcaagctgatgaaggcctactgcgagagacagggcctgagcgtgagacagatcagattcagattcgacggccagcccatcaacgagaccgacacccccgcccagctggagatggaggacgaggacaccatcgacgtgttccagcagcagaccggcggcgtgtactag

SEQ ID NO: 9189 - DNA, 6738 bp, Artificial Sequence; identical to SEQ ID NO: 9185
  Description of Artificial Sequence: Synthetic coding sequence

SEQ ID NO: 9190 - DNA, 216 bp, Artificial Sequence
  Description of Artificial Sequence: Synthetic coding sequence
atgaagcagctgaagagaaagagaaagagcaacttcagcgtgcaggagacccagaccctgctgaaggagatcaccaagagaaaggaggtgatcttcagcaagcagctgaacaccaccatcaacgtgatgaagagaatggcctgggaggagatcgcccagtgcgtgaacgccgtgggcgagggcgagcagagaaccggcaccgaggtgaagagatag

SEQ ID NO: 9191 - DNA, 591 bp, Artificial Sequence
  Description of Artificial Sequence: Synthetic coding sequence
atgaagcagctgaagagaaagagaaagagcaacttcagcgtgcaggagacccagaccctgctgaaggagatcaccaagagaaaggaggtgatcttcagcaagcagctgaacaccaccatcaacgtgatgaagagaatggcctgggaggagatcgcccagtgcgtgaacgccgtgggcgagggcgagcagagaaccggcaccgaggtgaagagaagatacctggactggagagccctgatgaagagaaagagaatgaaggccaacatcaagctggtgggcagcggcttccccctgcccagcagcgacctggacgacagcctgaccgaggagatcgacgagaagatcggcttcagaaacgacgccaacttcgactggcagaacgtggccgacttcagagacgccggcggcagcctgaccgaggtgaaggtggaggaggaggagagagacccccagagccccgagttcgagatcgaggaggaggaggagatgctgagcagcgtgatccccgacagcagaagagagaacgagctgcccgacttcccccacatcgacgagttcttcaccctgaacagcacccccagcagaagctag

SEQ ID NO: 9192 - DNA, 336 bp, Artificial Sequence
  Description of Artificial Sequence: Synthetic coding sequence
atgaagcagctgaagagaaagagaaagagcaacttcagcgtgcaggagacccagaccctgctgaaggagatcaccaagagaaaggaggtgatcttcagcaagcagctgaacaccaccatcaacgtgatgaagagaatggcctgggaggagatcgcccagtgcgtgaacgccgtgggcgagggcgagcagagaaccggcaccgaggtgaagagaagatacctggactggagagccctgatgaagagaaagagaatgaaggccaacatcaagctggtgggcagcggcttccccctgcccagcagcgacctggacgacagcctgaccgaggagatctag

SEQ ID NO: 9193 - DNA, 1158 bp, Artificial Sequence
  Description of Artificial Sequence: Synthetic coding sequence
atgcaggcctgcggcggcggcgccgccggcagaagagccttcgacagcatctgccccaacagaatgctggccctgcccggcagagccctgctgtgcaagcccggcaagcccgagagaaagttcgccccccccagaaagttcttccccggctgcaccggcggcagccccgtgagcgtgtacgaggacccccccgacgccgagcccaccgccctgcccgccctgaccaccatcgacctgcaggacctggccgactgcagcagcctgctgggcagcgacgccccccccggcggcgacctggccgccagccagaaccacagccaccagaccgaggccgacttcaacctgcaggacttcagagacaccgtggacgacctgatcagcgacagcagcagcatgatgagccccaccctggccagcggcgacttccccttcagcccctgcgacatcagccccttcggcccctgcctgagcccccccctggaccccagagccctgcagagcccccccctgagaccccccgacgtgcccccccccgagcagtactggaaggaggtggccgaccagaaccagagagccctgggcgacgccctggtggagaacaaccagctgcacgtgaccctgacccagaagcaggaggagatcgccagcctgaaggagagaaacgtgcagctgaaggagctggccagcagaaccagacacctggccagcgtgctggacaagctgatgatcacccagagcagagactgcggcgccgccgccgagcccttcctgctgaaggccaaggccaagagaagcctggaggagctggtgagcgccgccggccaggactgcgccgaggtggacgccatcctgagagagatcagcgagagatgcgacgaggccctgcagagcagagaccccaagagacccagactgctgcccgagcccgccaacaccgacaccagacccggcaacctgcacggcgccttcagaggcctgagaaccgactgcagcagaagcgccctgaacctgagccacagcgagctggaggagggcggcagcttcagcaccagaatcagaagccacagcaccatcagaaccctggccttcccccagggcaacgccttcaccatcagaaccgccaacggcggctacaagttcagatgggtgcccagctag

SEQ ID NO: 9194 - DNA, 1866 bp, Artificial Sequence
  Description of Artificial Sequence: Synthetic coding sequence
atggccgacttcgaggagctgagaaacatggtgagcagcttcagagtgagcgagctgcaggtgctgctgggcttcgccggcagaaacaagagcggcagaaagcacgacctgctgatgagagccctgcacctgctgaagagcggctgcagccccgccgtgcagatcaagatcagagagctgtacagaagaagataccccagaaccctggagggcctgagcgacctgagcaccatcaagagcagcgtgttcagcctggacggcggcagcagccccgtggagcccgacctggccgtggccggcatccacagcctgcccagcaccagcgtgaccccccacagccccagcagccccgtgggcagcgtgctgctgcaggacaccaagcccaccttcgagatgcagcagcccagcccccccatcccccccgtgcaccccgacgtgcagctgaagaacctgcccttctacgacgtgctggacgtgctgatcaagcccaccagcctggtgcagagcagcatccagagattccaggagaagttcttcatcttcgccctgaccccccagcaggtgagagagatctgcatcagcagagacttcctgcccggcggcagaagagactacaccgtgcaggtgcagctgagactgtgcctggccgagaccagctgcccccaggaggacaactaccccaacagcctgtgcatcaaggtgaacggcaagctgttccccctgcccggctacgcccccccccccaagaacggcatcgagcagaagagacccggcagacccctgaacatcaccagcctggtgagactgagcagcgccgtgcccaaccagatcagcatcagctgggccagcgagatcggcaagaactacagcatgagcgtgtacctggtgagacagctgaccagcgccatgctgctgcagagactgaagatgaagggcatcagaaaccccgaccacagcagagccctgatcaaggagaagctgaccgccgaccccgacagcgagatcgccaccaccagcctgagagtgagcctgatgtgccccctgggcaagatgagactgaccatcccctgcagagccgtgacctgcacccacctgcagtgcttcgacgccgccctgtacctgcagatgaacgagaagaagcccacctggatctgccccgtgtgcgacaagaaggccgcctacgagagcctgatcctggacggcctgttcatggagatcctgaacgactgcagcgacgtggacgagatcaagttccaggaggacggcagctggtgccccatgagacccaagaaggaggccatgaaggtgagcagccagccctgcaccaagatcgagagcagcagcgtgctgagcaagccctgcagcgtgaccgtggccagcgaggccagcaagaagaaggtggacgtgatcgacctgaccatcgagagcagcagcgacgaggaggaggacccccccgccaagagaaagtgcatcttcatgagcgagacccagagcagccccaccaagggcgtgctgatgtaccagcccagcagcgtgagagtgcccagcgtgaccagcgtggaccccgccgccatcccccccagcctgaccgactacagcgtgcccttccaccacacccccatcagcagcatgagcagcgacctgcccggcctggacttcctgagcctgatccccgtggacccccagtactgcccccccatgttcctggacagcctgaccagccccctgaccgccagcagcaccagcgtgaccaccaccagcagccacgagagcagcacccacgtgagcagcagcagcagcagaagcgagaccggcgtgatcaccagcagcggcagcaacatccccgacatcatcagcctggactag

SEQ ID NO: 9195 - DNA, 1866 bp, Artificial Sequence
  Description of Artificial Sequence: Synthetic coding sequence
atggccaacttcgaggagatcatcaacatggtgagcagcttcagagtgagcgagctgcaggtgctgctgggcttcgccggcagaaacaagagcggcagaaagcacgacctgctgatgagagccctgcacctgctgaagagcggctgcagccccgccgtgcagatcaagatcagagagctgtacagaagaagataccccagaaccctggagggcctgagcgacctgagcaccatcaagagcagcgtgttcagcctggacggcggcagcagccccgtggagcccgacctggccgtggccggcatccacagcctgcccagcaccagcgtgaccccccacagccccagcagccccgtgggcagcgtgctgctgcaggacaccaagcccaccttcgagatgcagcagcccagcccccccatcccccccgtgcaccccgacgtgcagctgaagaacctgcccttctacgacgtgctggacgtgctgatcaagcccaccagcctggtgcagagcagcatccagagattccaggagaagttcttcatcttcgccctgaccccccagcaggtgagagagatctgcatcagcagagacttcctgcccggcggcagaagagactacaccgtgcaggtgcagctgagactgtgcctggccgagaccagctgcccccaggaggacaactaccccaacagcctgtgcatcaaggtgaacggcaagctgttccccctgcccggctacgcccccccccccaagaacggcatcgagcagaagagacccggcagacccctgaacatcaccagcctggtgagactgagcagcgccgtgcccaaccagatcagcatcagctgggccagcgagatcggcaagaactacagcatgagcgtgtacctggtgagacagctgaccagcgccatgctgctgcagagactgaagatgaagggcatcagaaaccccgaccacagcagagccctgatcaaggagaagctgaccgccgaccccgacagcgagatcgccaccaccagcctgagagtgagcctgatgtgccccctgggcaagatgagactgaccatcccctgcagagccgtgacctgcacccacctgcagtgcttcgacgccgccctgtacctgcagatgaacgagaagaagcccacctggatctgccccgtgtgcgacaagaaggccgcctacgagagcctgatcctggacggcctgttcatggagatcctgaacgactgcagcgacgtggacgagatcaagttccaggaggacggcagctggtgccccatgagacccaagaaggaggccatgaaggtgagcagccagccctgcaccaagatcgagagcagcagcgtgctgagcaagccctgcagcgtgaccgtggccagcgaggccagcaagaagaaggtggacgtgatcgacctgaccatcgagagcagcagcgacgaggaggaggacccccccgccaagagaaagtgcatcttcatgagcgagacccagagcagccccaccaagggcgtgctgatgtaccagcccagcagcgtgagagtgcccagcgtgaccagcgtggaccccgccgccatcccccccagcctgaccgactacagcgtgcccttccaccacacccccatcagcagcatgagcagcgacctgcccggcctggacttcctgagcctgatccccgtggacccccagtactgcccccccatgttcctggacagcctgaccagccccctgaccgccagcagcaccagcgtgaccaccaccagcagccacgagagcagcacccacgtgagcagcagcagcagcagaagcgagaccggcgtgatcaccagcagcggcagcaacatccccgacatcatcagcctggactag

SEQ ID NO: 9196 - DNA, 1719 bp, Artificial Sequence
  Description of Artificial Sequence: Synthetic coding sequence
atggccgacttcgaggagctgagaaacatggtgagcagcttcagagtgagcgagctgcaggtgctgctgggcttcgccggcagaaacaagagcggcagaaagcacgacctgctgatgagagccctgcacctgctgaagagcggctgcagccccgccgtgcagatcaagatcagagagctgtacagaagaagataccccagaaccctggagggcctgagcgacctgagcaccatcaagagcagcgtgttcagcctggacggcggcagcagccccgtggagcccgacctggccgtggccggcatccacagcctgcccagcaccagcgtgaccccccacagccccagcagccccgtgggcagcgtgctgctgcaggacaccaagcccaccttcgagatgcagcagcccagcccccccatcccccccgtgcaccccgacgtgcagctgaagaacctgcccttctacgacgtgctggacgtgctgatcaagcccaccagcctggtgcagagcagcatccagagattccaggagaagttcttcatcttcgccctgaccccccagcaggtgagagagatctgcatcagcagagacttcctgcccggcggcagaagagactacaccgtgcaggtgcagctgagactgtgcctggccgagaccagctgcccccaggaggacaactaccccaacagcctgtgcatcaaggtgaacggcaagctgttccccctgcccggctacgcccccccccccaagaacggcatcgagcagaagagacccggcagacccctgaacatcaccagcctggtgagactgagcagcgccgtgcccaaccagatcagcatcagctgggccagcgagatcggcaagaactacagcatgagcgtgtacctggtgagacagctgaccagcgccatgctgctgcagagactgaagatgaagggcatcagaaaccccgaccacagcagagccctgatcaaggagaagctgaccgccgaccccgacagcgagatcgccaccaccagcctgagagtgagcctgatgtgccccctgggcaagatgagactgaccatcccctgcagagccgtgacctgcacccacctgcagtgcttcgacgccgccctgtacctgcagatgaacgagaagaagcccacctggatctgccccgtgtgcgacaagaaggccgcctacgagagcctgatcctggacggcctgttcatggagatcctgaacgactgcagcgacgtggacgagatcaagttccaggaggacggcagctggtgccccatgagacccaagaaggaggccatgaaggtgagcagccagccctgcaccaagatcgagagcagcagcgtgctgagcaagccctgcagcgtgaccgtggccagcgaggccagcaagaagaaggtggacgtgatcgacctgaccatcgagagcagcagcgacgaggaggaggacccccccgccaagagaaagtgcatcttcatgagcgagacccagagcagccccaccaagggcgtgctgatgtaccagcccagcagcgtgagagtgcccagcgtgaccagcgtggaccccgccgccatcccccccagcctgaccgactacagcgtgcccttccaccacacccccatcagcagcatgagcagcgacctgcccggcgagcagagaagaaacgacatcaacaacgagctgaagctgggcaccagcagcgacaccgtgcagcagtag

SEQ ID NO: 9197 - DNA, 1191 bp, Artificial Sequence
  Description of Artificial Sequence: Synthetic coding sequence
agaaacctgaacaacatggtgagcagcttcagagtgagcgagctgcaggtgctgctgggcttcgccggcagaaacaagagcggcagaaagcacgacctgctgatgagagccctgcacctgctgaagagcggctgcagccccgccgtgcagatcaagatcagagagctgtacagaagaagataccccagaaccctggagggcctgagcgacctgagcaccatcaagagcagcgtgttcagcctggacggcggcagcagccccgtggagcccgacctggccgtggccggcatccacagcctgcccagcaccagcgtgaccccccacagccccagcagccccgtgggcagcgtgctgctgcaggacaccaagcccaccttcgagatgcagcagcccagcccccccatcccccccgtgcaccccgacgtgcagctgaagaacctgcccttctacgacgtgctggacgtgctgatcaagcccaccagcctggtgcagagcagcatccagagattccaggagaagttcttcatcttcgccctgaccccccagcaggtgagagagatctgcatcagcagagacttcctgcccggcggcagaagagactacaccgtgcaggtgcagctgagactgtgcctggccgagaccagctgcccccaggaggacaactaccccaacagcctgtgcatcaaggtgaacggcaagctgttccccctgcccggctacgcccccccccccaagaacggcatcgagcagaagagacccggcagacccctgaacatcaccagcctggtgagactgagcagcgccgtgcccaaccagatcagcatcagctgggccagcgagatcggcaagaactacagcatgagcgtgtacctggtgagacagctgaccagcgccatgctgctgcagagactgaagatgaagggcatcagaaaccccgaccacagcagagccctgatcaaggagaagctgaccgccgaccccgacagcgagatcgccaccaccagcctgagagtgagcctgatgtgccccctgggcaagatgagactgaccatcccctgcagagccgtgacctgcacccacctgcagtgcttcgacgccgccctgtacctgcagatgaacgagaagaagcccacctggatctgccccgtgtgcgacaagaaggccgcctacgagagcctgatcctggactag

SEQ ID NO: 9198 - DNA, 1866 bp, Artificial Sequence; identical to SEQ ID NO: 9194
  Description of Artificial Sequence: Synthetic coding sequence

SEQ ID NO: 9199 - DNA, 849 bp, Artificial Sequence
  Description of Artificial Sequence: Synthetic coding sequence
atgagcgtgtacctggtgagacagctgaccagcgccatgctgctgcagagactgaagatgaagggcatcagaaaccccgaccacagcagagccctgatcaaggagaagctgaccgccgaccccgacagcgagatcgccaccaccagcctgagagtgagcctgatgtgccccctgggcaagatgagactgaccatcccctgcagagccgtgacctgcacccacctgcagtgcttcgacgccgccctgtacctgcagatgaacgagaagaagcccacctggatctgccccgtgtgcgacaagaaggccgcctacgagagcctgatcctggacggcctgttcatggagatcctgaacgactgcagcgacgtggacgagatcaagttccaggaggacggcagctggtgccccatgagacccaagaaggaggccatgaaggtgagcagccagccctgcaccaagatcgagagcagcagcgtgctgagcaagccctgcagcgtgaccgtggccagcgaggccagcaagaagaaggtggacgtgatcgacctgaccatcgagagcagcagcgacgaggaggaggacccccccgccaagagaaagtgcatcttcatgagcgagacccagagcagccccaccaagggcgtgctgatgtaccagcccagcagcgtgagagtgcccagcgtgaccagcgtggaccccgccgccatcccccccagcctgaccgactacagcgtgcccttccaccacacccccatcagcagcatgagcagcgacctgcccggcgagcagagaagaaacgacatcaacaacgagctgaagctgggcaccagcagcgacaccgtgcagcagtag

SEQ ID NO: 9200 - DNA, 1023 bp, Artificial Sequence
  Description of Artificial Sequence: Synthetic coding sequence
atggagaccgtgatcagcagcgacagcagccccgccgtggagaacgagcacccccaggagacccccgagagcaacaacagcgtgtacaccagcttcatgaagagccacagatgctacgacctgatccccaccagcagcaagctggtggtgttcgacaccagcctgcaggtgaagaaggccttcttcgccctggtgaccaacggcgtgagagccgcccccctgtgggacagcaagaagcagagcttcgtggtgctgagagccctgagctgccccctgggcatgctgaccatcaccgacttcatcaacatcctgcacagatactacaagagcgccctggtgcagatctacgagctggaggagcacaagatcgagacctggagagaggtgtacctgcaggacagcttcaagcccctggtgtgcatcagccccaacgccagcctgttcgacgccgtgagcagcctgatcagaaacaagatccacagactgcccgtgatcgaccccgagagcggcaacaccctgtacatcctgacccacaagagaatcctgaagttcctgaagctgttcatcaccgagttccccaagcccgagttcatgagcaagagcctggaggagctgcagatcggcacctacgccaacatcgccatggtgagaaccaccacccccgtgtacgtggccctgggcatcttcgtgcagcacagagtgagcgccctgcccgtggtggacgagaagggcagagtggtggacatctacagcaagttcgacgtgatcaacctggccgccgagaagacctacaacaacctggacgtgagcgtgaccaaggccctgcagcacagaagccactacttcgagggcgtgctgaagtgctacctgcacgagaccctggagaccatcatcaacagactggtggaggccgaggtgcacagactggtggtggtggacgagaacgacgtggtgaagggcatcgtgagcctgagcgacatcctgcaggccctggtgctgaccggcggcgagaagaagccctag

SEQ ID NO: 9201 - DNA, 900 bp, Artificial Sequence
  Description of Artificial Sequence: Synthetic coding sequence
atgaagagccacagatgctacgacctgatccccaccagcagcaagctggtggtgttcgacaccagcctgcaggtgaagaaggccttcttcgccctggtgaccaacggcgtgagagccgcccccctgtgggacagcaagaagcagagcttcgtgggcatgctgaccatcaccgacttcatcaacatcctgcacagatactacaagagcgccctggtgcagatctacgagctggaggagcacaagatcgagacctggagagaggtgtacctgcaggacagcttcaagcccctggtgtgcatcagccccaacgccagcctgttcgacgccgtgagcagcctgatcagaaacaagatccacagactgcccgtgatcgaccccgagagcggcaacaccctgtacatcctgacccacaagagaatcctgaagttcctgaagctgttcatcaccgagttccccaagcccgagttcatgagcaagagcctggaggagctgcagatcggcacctacgccaacatcgccatggtgagaaccaccacccccgtgtacgtggccctgggcatcttcgtgcagcacagagtgagcgccctgcccgtggtggacgagaagggcagagtggtggacatctacagcaagttcgacgtgatcaacctggccgccgagaagacctacaacaacctggacgtgagcgtgaccaaggccctgcagcacagaagccactacttcgagggcgtgctgaagtgctacctgcacgagaccctggagaccatcatcaacagactggtggaggccgaggtgcacagactggtggtggtggacgagaacgacgtggtgaagggcatcgtgagcctgagcgacatcctgcaggccctggtgctgaccggcggcgagaagaagccctag

SEQ ID NO: 9202 - DNA, 2823 bp, Artificial Sequence
  Description of Artificial Sequence: Synthetic coding sequence
atgggcagcggccccatcgaccccaaggagctgctgaagggcctggacagcttcctgaacagagacggcgaggtgaagagcgtggacggcatcagcaagatcttcagcctgatgaaggaggccagaaagatggtgagcagatgcacctacctgaacatcctgctgcagaccagaagccccgagatcctggtgaagttcatcgacgtgggcggctacaagctgctgaacaactggctgacctacagcaagaccaccaacaacatccccctgctgcagcagatcctgctgaccctgcagcacctgcccctgaccgtggaccacctgaagcagaacaacaccgccaagctggtgaagcagctgagcaagagcagcgaggacgaggagctgagaaagctggccagcgtgctggtgagcgactggatggccgtgatcagaagccagagcagcacccagcccgccgagaaggacaagaagaagagaaaggacgagggcaagagcagaaccaccctgcccgagagacccctgaccgaggtgaaggccgagaccagagccgaggaggcccccgagaagaagagagagaagcccaagagcctgagaaccaccgcccccagccacgccaagttcagaagcaccggcctggagctggagacccccagcctggtgcccgtgaagaagaacgccagcaccgtggtggtgagcgacaagtacaacctgaagcccatccccctgaagagacagagcaacgtggccgcccccggcgacgccaccccccccgccgagaagaagtacaagcccctgaacaccacccccaacgccaccaaggagatcaaggtgaagatcatccccccccagcccatggagggcctgggcttcctggacgccctgaacagcgcccccgtgcccggcatcaagatcaagaagaagaagaaggtgctgagccccaccgccgccaagcccagccccttcgagggcaagaccagcaccgagcccagcaccgccaagcccagcagccccgagcccgccccccccagcgaggccatggacgccgacagacccggcacccccgtgccccccgtggaggtgcccgagctgatggacaccgccagcctggagcccggcgccctggacgccaagcccgtggagagccccggcgaccccaaccagctgaccagaaagggcagaaagagaaagagcgtgacctggcccgaggagggcaagctgagagagtacttctacttcgagctggacgagaccgagagagtgaacgtgaacaagatcaaggacttcggcgaggccgccaagagagagatcctgagcgacagacacgccttcgagaccgccagaagactgagccacgacaacatggaggagaaggtgccctgggtgtgccccagacccctggtgctgcccagccccctggtgacccccggcagcaacagccaggagagatacatccaggccgagagagagaagggcatcctgcaggagctgttcctgaacaaggagagcccccacgagcccgaccccgagccctacgagcccatcccccccaagctgatccccctggacgaggagtgcagcatggacgagaccccctacgtggagaccctggagcccggcggcagcggcggcagccccgacggcgccggcggcagcaagctgccccccgtgctggccaacctgatgggcagcatgggcgccggcaagggcccccagggccccggcggcggcggcatcaacgtgcaggagatcctgaccagcatcatgggcagccccaacagccaccccagcgaggagctgctgaagcagcccgactacagcgacaagatcaagcagatgctggtgccccacggcctgctgggccccggccccatcgccaacggcttcccccccggcggccccggcggccccaagggcatgcagcacttcccccccggccccggcggccccatgcccggcccccacggcggccccggcggccccgtgggccccagactgctgggccccccccccccccccagaggcggcgaccccttctgggacggccccggcgaccccatgagaggcggccccatgagaggcggccccggccccggccccggcccctaccacagaggcagaggcggcagaggcggcaacgagcccccccccccccccccccccttcagaggcgccagaggcggcagaagcggcggcggcccccccaacggcagaggcggccccggcggcggcatggtgggcggcggcggccacagaccccacgagggccccggcggcggcatgggcaacagcagcggccacagaccccacgagggccccggcggcggcatgggcagcggccacagaccccacgagggccccggcggcagcatgggcggcggcggcggccacagaccccacgagggccccggcggcggcatcagcggcggcagcggccacagaccccacgagggccccggcggcggcatgggcgccggcggcggccacagaccccacgagggccccggcggcagcatgggcggcagcggcggccacagaccccacgagggccccggccacggcggcccccacggccacagaccccacgacgtgcccggccacagaggccacgaccacagaggcccccccccccacgagcacagaggccacgacggccccggccacggcggcggcggccacagaggccacgacggcggccacagccacggcggcgacatgagcaacagacccgtgtgcagacacttcatgatgaagggcaactgcagatacgagaacaactgcgccttctaccaccccggcgtgaacggcccccccctgccctag

SEQ ID NO: 9203 - DNA, 2823 bp, Artificial Sequence; identical to SEQ ID NO: 9202
  Description of Artificial Sequence: Synthetic coding sequence

SEQ ID NO: 9204 - DNA, 2823 bp, Artificial Sequence; identical to SEQ ID NO: 9202
  Description of Artificial Sequence: Synthetic coding sequence

SEQ ID NO: 9205 - DNA, 2823 bp, Artificial Sequence; identical to SEQ ID NO: 9202
  Description of Artificial Sequence: Synthetic coding sequence

SEQ ID NO: 9206 - DNA, 2823 bp, Artificial Sequence; identical to SEQ ID NO: 9202
  Description of Artificial Sequence: Synthetic coding sequence

SEQ ID NO: 9207 - DNA, 2823 bp, Artificial Sequence; identical to SEQ ID NO: 9202
  Description of Artificial Sequence: Synthetic coding sequence

SEQ ID NO: 9208 - DNA, 2823 bp, Artificial Sequence; identical to SEQ ID NO: 9202
  Description of Artificial Sequence: Synthetic coding sequence

SEQ ID NO: 9209 - DNA, 939 bp, Artificial Sequence
  Description of Artificial Sequence: Synthetic coding sequence
atgggcagcggccccatcgaccccaaggagctgctgaagggcctggacagcttcctgaacagagacggcgaggtgaagagcgtggacggcatcagcaagatcttcagcctgatgaaggaggccagaaagatggtgagcagatgcacctacctgaacatcctgctgcagaccagaagccccgagatcctggtgaagttcatcgacgtgggcggctacaagctgctgaacaactggctgacctacagcaagaccaccaacaacatccccctgctgcagcagatcctgctgaccctgcagcacctgcccctgaccgtggaccacctgaagcagaacaacaccgccaagctggtgaagcagctgagcaagagcagcgaggacgaggagctgagaaagctggccagcgtgctggtgagcgactggatggccgtgatcagaagccagagcagcacccagcccgccgagaaggacaagaagaagagaaaggacgagggcaagagcagaaccaccctgcccgagagacccctgaccgaggtgaaggccgagaccagagccgaggaggcccccgagaagaagagagagaagcccaagagcctgagaaccaccgcccccagccacgccaagttcagaagcaccggcctggagctggagacccccagcctggtgcccgtgaagaagaacgccagcaccgtggtggtgagcgacaagtacaacctgaagcccatccccctgaagagacagagcaacgtggccgcccccggcgacgccaccccccccgccgagaagaagtacaagcccctgaacaccacccccaacgccaccaaggagatcaaggtgaagatcatccccccccagcccatggagggcctgggcttcctggacgccctgaacagcgcccccgtgcccggcatcaagatcaagaagaagaagaagaagaagtag

SEQ ID NO: 9210 - DNA, 939 bp, Artificial Sequence; identical to SEQ ID NO: 9209
  Description of Artificial Sequence: Synthetic coding sequence

SEQ ID NO: 9211 - DNA, 939 bp, Artificial Sequence; identical to SEQ ID NO: 9209
  Description of Artificial Sequence: Synthetic coding sequence

SEQ ID NO: 9212 - DNA, 939 bp, Artificial Sequence; identical to SEQ ID NO: 9209
  Description of Artificial Sequence: Synthetic coding sequence

SEQ ID NO: 9213 - DNA, 939 bp, Artificial Sequence; identical to SEQ ID NO: 9209
  Description of Artificial Sequence: Synthetic coding sequence

SEQ ID NO: 9214 - DNA, 939 bp, Artificial Sequence; identical to SEQ ID NO: 9209
  Description of Artificial Sequence: Synthetic coding sequence

SEQ ID NO: 9215 - DNA, 939 bp, Artificial Sequence; identical to SEQ ID NO: 9209
  Description of Artificial Sequence: Synthetic coding sequence

SEQ ID NO: 9216 - DNA, 3630 bp, Artificial Sequence
  Description of Artificial Sequence: Synthetic coding sequence
atgttcctgatgaacgccagccccgtggtggccctgcagagcaagtgggaggccttcggcccccccggcagctgcagattccccagatgcttcagcgaggccgacgagggcgtggagagcgccagcgtgagcgccagagtgcagatgctgatcagcaccctgcagagagacggcgccgccagaggcaccagcgacgagagagccgcccagagaggccacagagccgagggctgccacgacgccagacccgccgccaagcccaccgtgcacaaggagccccccgccctggccgtgtgcggcctggtggccgacttcgaccccatgggcgaggaggagaccaccgacttcggccccctggtgctggacagcgacagcgacgacagcgtggacagagacatcgaggaggccatccaggagtacctgaaggccaagagcggcgccgcccagcccggcgccggcggcgcccagcccggcgccgcccagcccagcagagccgccggcggcggcagcagatgcaagcccgagcccgcccacggcagcgcccccaccgccctgtgcccccccaagctggtgcccggcagcggcggcggccccggcagccaggtgggcagcagcaaggaccagggcagcgccagccccgtgagcgtgagcagcgacgacagcttcgagcagagcatcagagccgagatcgagcagttcctgaacgagaagagacagcacgagacccagaagtgcgacggcagcgtggagaagaagcccgacaccaacgagaacagcgccaagagcctgctgaagagccaccaggagccccccaccaaggtggtgcacagacagggcctgctgggcgtgcagaaggagttcgccttcagaaagccccccagactggccaagatgaacgtgcagcccagaagcctgagaagcaaggtgaccaccacccaggagaacgagggcagcaccaagcccgccaccccctgcagacccagcgaggccgcccagaacaagggcggcatcaagagaagcgccagcgccgccagaagaggcaagagagtgatgagcgccgcccaggccagcgaggccagcgacagcagcagcgacgacggcatcgaggaggccatccagctgtaccagctgcagaagaccagaaaggaggccgacggcgacctgccccagagagtgcagctgagagaggagagagcccccgacccccccgcccacagcaccagcagcgccaccaagagcgccctgcccgagacccacagaaagacccccagcaagaagaagctggtggccaccaagaccatggaccccggccccggcggcctggacaccgaccacgcccccaagctgctgaaggagaccaaggcccccccccccgccagccccgccagcagaagcgagttcgtggagagaagcagctgcagagccgacaccagcgccgagctgatgtgcgccgaggccatcctggacatcagcaagaccatcctgcccgcccccgtggagggcagcgacggcagcctgagcgccagccccctgttctacagccccaacgtgcccagcagaagcgacggcgacagcagcagcgtggacagcgacgacagcatcgagcaggagatcagaaccttcctggccctgaaggcccagagcggcagcctgctggccagaggcgagagctgcccccaggccgcccagggccccctgctgccccccggcctgaacagccagaccggcggccacaagacccccctgagcaagacccccgaccccctgctgggctgcaagagaaagagaagaggcggcggccacgtgagacccagcacccccaagaagatgcaggaggtggtgaaggacggcagccaggacgccgaccacagccagggcagagccgagcccggccacgagagaagagacctgcccatccagggcaaggccagcgaggccctgggcggcgagggcaccgccagaggccccggcgacaccagaatgagccagggccagggcaagaccgacgaggccagaagactggacgagaaggagagcagcgaggacaagagcagcagcctggacagcgacgaggacctggacaccgccatcaaggacctgctgagaagcaagagaaagctgaagaagagatgcagagagcccagagccgcctgcagaaagaaggtgagattcagcaccgcccagacccacttcctggagcagctgggcggcctgagaagagactggaaggacagaggcccccccgtgctgaagagctgcctgagcaagagcaagagagacagcggcgagggccccggcaagaagccccccagcgtgttcggcagcaccgccgagagaatgagacaggagggcgccgccagccaggacgccgccctggccttcagagtgagaagacccgccagcgccagcgccagcgagggcaaccccttccccagagagagccagggccccgcccccagccccggcagcctgagcgacgacagcagcagcgtggacagcaacgacagcatcgagctggagatcagaaagttcctggccgagaaggccaaggagagcgtgagcagcagcgaggtgcaggccgagggccccaccgccctgggcaccggcggccccgccagacccgaggtgctgtgcagaaaggagcccgcccccccccccggcgtgtgcaccagaagccagagagccagaggcgtgccccacctggccgagggcctgagaggcaccgagagcgccggcgcccagggcaccgccggcctgttcagccagggcggcaagggcctgcccgccgcccccgccagaggcgaccccgtgccccccagaagcaccagcggcggcgtgagcgccaagggcctgagcgtgagcagaagaaacgtgtacgtgcacaaggaccagagccccagaggcgccgagcccgccgccaagagcgccttcggccagctgcccagctgcgccaccgccggcaccgaggccggcggcgccagaggcaccttccacatgggctgcggcagccccagcttcctgacccccagccccggcgccgagagagacgccggcgcccaggccgacagaacccccccctggagcgacttcgcccaccagagcagactgcccagcccctgggtgctgagaagcgagggcagagacgccgtgtggagaggcggcgtgggcagcgagagagacaagggcagcgagggccccgccagaggcctgcccagcctgcccctggccggcttcagccccctgctgagcacccagctgttccacttcggcaagggcgtgagctggggcggcagacaggccggcctgttcagcccccacctgggcctgcccctgcagggccccagcttcagcgccttcagagaggcccaggccggccccagccccgtgttcggcagcccccacctgctggccaagaaggacggcggcccctggcccaccagaaaggcccaggccggcctgagcctgcacgacagaagaagcagcggcagcgaggagagcatcctggacctgagatacagaagaagagtgaacagagacgaccaggagcaggacgccctgggcagcgacgccagcgacttcagcgacaccagcaccgaggacagcggcggcagcagcgtggtgaaggtgtag

SEQ ID NO: 9217 - DNA, 327 bp, Artificial Sequence
  Description of Artificial Sequence: Synthetic coding sequence
atgttcctgatgaacgccagccccgtggtggccctgcagagcaagtgggaggccttcggcccccccggcagctgcagattccccagatgcttcagcgaggccgacgagggcgtggagagcgccagcgtgagcgccagagtgcagatgctgatcagcaccctgcagagagacggcgccgccagaggcaccagcgacgagagagccgcccagagaggccacagagccgagggctgccacgacgccagacccgccgccaagcccaccgtgcacaaggagccccccgccctggccgtgtgcggcctggtggccgacttcgaccccatgtag

SEQ ID NO: 9218 - DNA, 1728 bp, Artificial Sequence
  Description of Artificial Sequence: Synthetic coding sequence
atgccccccggcaaggtgctgcagcccgtgctgaagatgaaggtggacgagctgttcctgtactggctgagcgaggccagcacccagagaatgctgcaggactgcctgagaagaatcaaggcccccggcagagaccagcccacccccggcgacggcgagcagcccggcgcctggcccaccgcccccctggccgcccccagacccagcggcctggagccccccggcacccccggccccggccccgccctgcccctgggcgccgccagcagccccagaaacgccccccacgtgagaggcaccagaagaagcgccggcaccagagtggtgcagaccagaaaggaggagcccctgccccccgccaccagccagagcatccccaccttctacttccccagaggcagaccccaggacagcgtgaacgtggacgccgtgatcagcaagatcgagagcaccttcgccagattcccccacgagagagccaccatggacgacatgggcctggtggccaaggcctgcggctgccccctgtactggaagggccccctgttctacggcgccggcggcgagagaaccggcagcgtgagcgtgcacaagttcgtggccatgtggagaaagatcctgcagaactgccacgacgacgccgccaagttcgtgcacctgctgatgagccccggctgcaactacctggtgcaggaggacttcgtgcccttcctgcaggacgtggtgaacacccaccccggcctgagcttcctgaaggaggccagcgagttccacagcagatacatcaccaccgtgatccagagaatcttctacgccgtgaacagaagctggagcggcagaatcacctgcgccgagctgagaagaagcagcttcctgcagaacgtggccctgctggaggaggaggccgacatcaaccagctgaccgagttcttcagctacgagcacttctacgtgatctactgcaagttctgggagctggacaccgaccacgacctgctgatcgacgccgacgacctggccagacacaacgaccacgccctgagcaccaagatgatcgacagaatcttcagcggcgccgtgaccagaggcagaaaggtgcagaaggagggcaagatcagctacgccgacttcgtgtggttcctgatcagcgaggaggacaagaagacccccaccagcatcgagtactggttcagatgcatggacctggacggcgacggcgccctgagcatgttcgagctggagtacttctacgaggagcagtgcagaagactggacagcatggccatcgaggccctgcccttccaggactgcctgtgccagatgctggacctggtgaagcccagaaccgagggcaagatcaccctgcaggacctgaagagatgcaagctggccaacgtgttcttcgacaccttcttcaacatcgagaagtacctggaccacgagcagaaggagcagatcagcctgctgagagacggcgacagcggcggccccgagctgagcgactgggagaagtacgccgccgaggagtacgacatcctggtggccgaggagaccgccggcgagccctgggaggacggcttcgaggccgagctgagccccgtggagcagaagctgagcgccctgagaagccccctggcccagagacccttcttcgaggcccccagccccctgggcgccgtggacctgtacgagtacgcctgcggcgacgaggacctggagcccctgtag

SEQ ID NO: 9219 - DNA, 2286 bp, Artificial Sequence
  Description of Artificial Sequence: Synthetic coding sequence
atgcccaacttctgcgccgcccccaactgcaccagaaagagcacccagagcgacctggccttcttcagattccccagagaccccgccagatgccagaagtgggtggagaactgcagaagagccgacctggaggacaagacccccgaccagctgaacaagcactacagactgtgcgccaagcacttcgagaccagcatgatctgcagaaccagcccctacagaaccgtgctgagagacaacgccatccccaccatcttcgacctgaccagccacctgaacaacccccacagcagacacagaaagagaatcaaggagctgagcgaggacgagatcagaaccctgaagcagaagaagatcgacgagaccagcgagcaggagcagaagcacaaggagaccaacaacagcaacgcccagaaccccagcgaggaggagggcgagggccaggacgaggacatcctgcccctgaccctggaggagaaggagaacaaggagtacctgaagagcctgttcgagatcctgatcctgatgggcaagcagaacatccccctggacggccacgaggccgacgagatccccgagggcctgttcacccccgacaacttccaggccctgctggagtgcagaatcaacagcggcgaggaggtgctgagaaagagattcgagaccaccgccgtgaacaccctgttctgcagcaagacccagcagagacagatgctggagatctgcgagagctgcatcagagaggagaccctgagagaggtgagagacagccacttcttcagcatcatcaccgacgacgtggtggacatcgccggcgaggagcacctgcccgtgctggtgagattcgtggacgagagccacaacctgagagaggagttcatcggcttcctgccctacgaggccgacgccgagatcctggccgtgaagttccacaccatgatcaccgagaagtggggcctgaacatggagtactgcagaggccaggcctacatcgtgagcagcggcttcagcagcaagatgaaggtggtggccagcagactgctggagaagtacccccaggccatctacaccctgtgcagcagctgcgccctgaacatgtggctggccaagagcgtgcccgtgatgggcgtgagcgtggccctgggcaccatcgaggaggtgtgcagcttcttccacagaagcccccagctgctgctggagctggacaacgtgatcagcgtgctgttccagaacagcaaggagagaggcaaggagctgaaggagatctgccacagccagtggaccggcagacacgacgccttcgagatcctggtggagctgctgcaggccctggtgctgtgcctggacggcatcaacagcgacaccaacatcagatggaacaactacatcgccggcagagccttcgtgctgtgcagcgccgtgagcgacttcgacttcatcgtgaccatcgtggtgctgaagaacgtgctgagcttcaccagagccttcggcaagaacctgcagggccagaccagcgacgtgttcttcgccgccggcagcctgaccgccgtgctgcacagcctgaacgaggtgatggagaacatcgaggtgtaccacgagttctggttcgaggaggccaccaacctggccaccaagctggacatccagatgaagctgcccggcaagttcagaagagcccaccagggcaacctggagagccagctgaccagcgagagctactacaaggagaccctgagcgtgcccaccgtggagcacatcatccaggagctgaaggacatcttcagcgagcagcacctgaaggccctgaagtgcctgagcctggtgcccagcgtgatgggccagctgaagttcaacaccagcgaggagcaccacgccgacatgtacagaagcgacctgcccaaccccgacaccctgagcgccgagctgcactgctggagaatcaagtggaagcacagaggcaaggacatcgagctgcccagcaccatctacgaggccctgcacctgcccgacatcaagttcttccccaacgtgtacgccctgctgaaggtgctgtgcatcctgcccgtgatgaaggtggagaacgagagatacgagaacggcagaaagagactgaaggcctacctgagaaacaccctgaccgaccagagaagcagcaacctggccctgctgaacatcaacttcgacatcaagcacgacctggacctgatggtggacacctacatcaagctgtacaccagcaagagcgagctgcccaccgacaacagcgagaccgtggagaacacctag

SEQ ID NO: 9220 - DNA, 1761 bp, Artificial Sequence
  Description of Artificial Sequence: Synthetic coding sequence
atgggcaagcagaacatccccctggacggccacgaggccgacgagatccccgagggcctgttcacccccgacaacttccaggccctgctggagtgcagaatcaacagcggcgaggaggtgctgagaaagagattcgagaccaccgccgtgaacaccctgttctgcagcaagacccagcagagacagatgctggagatctgcgagagctgcatcagagaggagaccctgagagaggtgagagacagccacttcttcagcatcatcaccgacgacgtggtggacatcgccggcgaggagcacctgcccgtgctggtgagattcgtggacgagagccacaacctgagagaggagttcatcggcttcctgccctacgaggccgacgccgagatcctggccgtgaagttccacaccatgatcaccgagaagtggggcctgaacatggagtactgcagaggccaggcctacatcgtgagcagcggcttcagcagcaagatgaaggtggtggccagcagactgctggagaagtacccccaggccatctacaccctgtgcagcagctgcgccctgaacatgtggctggccaagagcgtgcccgtgatgggcgtgagcgtggccctgggcaccatcgaggaggtgtgcagcttcttccacagaagcccccagctgctgctggagctggacaacgtgatcagcgtgctgttccagaacagcaaggagagaggcaaggagctgaaggagatctgccacagccagtggaccggcagacacgacgccttcgagatcctggtggagctgctgcaggccctggtgctgtgcctggacggcatcaacagcgacaccaacatcagatggaacaactacatcgccggcagagccttcgtgctgtgcagcgccgtgagcgacttcgacttcatcgtgaccatcgtggtgctgaagaacgtgctgagcttcaccagagccttcggcaagaacctgcagggccagaccagcgacgtgttcttcgccgccggcagcctgaccgccgtgctgcacagcctgaacgaggtgatggagaacatcgaggtgtaccacgagttctggttcgaggaggccaccaacctggccaccaagctggacatccagatgaagctgcccggcaagttcagaagagcccaccagggcaacctggagagccagctgaccagcgagagctactacaaggagaccctgagcgtgcccaccgtggagcacatcatccaggagctgaaggacatcttcagcgagcagcacctgaaggccctgaagtgcctgagcctggtgcccagcgtgatgggccagctgaagttcaacaccagcgaggagcaccacgccgacatgtacagaagcgacctgcccaaccccgacaccctgagcgccgagctgcactgctggagaatcaagtggaagcacagaggcaaggacatcgagctgcccagcaccatctacgaggccctgcacctgcccgacatcaagttcttccccaacgtgtacgccctgctgaaggtgctgtgcatcctgcccgtgatgaaggtggagaacgagagatacgagaacggcagaaagagactgaaggcctacctgagaaacaccctgaccgaccagagaagcagcaacctggccctgctgaacatcaacttcgacatcaagcacgacctggacctgatggtggacacctacatcaagctgtacaccagcaagagcgagctgcccaccgacaacagcgagaccgtggagaacacctag

SEQ ID NO: 9221 - DNA, 939 bp, Artificial Sequence
  Description of Artificial Sequence: Synthetic coding sequence
atggccaacagaaccgtgaaggacgcccacagcatccacggcaccaacccccagtacctggtggagaagatcatcagaaccagaatctacgagagcaagtactggaaggaggagtgcttcggcctgaccgccgagctggtggtggacaaggccatggagctgagattcgtgggcggcgtgtacggcggcaacatcaagcccacccccttcctgtgcctgaccctgaagatgctgcagatccagcccgagaaggacatcatcgtggagttcatcaagaacgaggacttcaagtacgtgagaatgctgggcgccctgtacatgagactgaccggcaccgccatcgactgctacaagtacctggagcccctgtacaacgactacagaaagatcaagagccagaacagaaacggcgagttcgagctgatgcacgtggacgagttcatcgacgagctgctgcacagcgagagagtgtgcgacatcatcctgcccagactgcagaagagatacgtgctggaggaggccgagcagctggagcccagagtgagcgccctggaggaggacatggacgacgtggagagcagcgaggaggaggaggaggaggacgagaagctggagagagtgcccagccccgaccacagaagaagaagctacagagacctggacaagcccagaagaagccccaccctgagatacagaagaagcagaagcagaagccccagaagaagaagcagaagccccaagagaagaagccccagccccagaagagagagacacagaagcaagagccccagaagacacagaagcagaagcagagacagaagacacagaagcagaagcaagagccccggccaccacagaagccacagacacagaagccacagcaagagccccgagagaagcaagaagagccacaagaagagcagaagaggcaacgagtag

SEQ ID NO: 9222 - DNA, 1308 bp, Artificial Sequence
  Description of Artificial Sequence: Synthetic coding sequence
atgtgcggcggcgtgagaggcgtgggcaccggcggcatcgtgagcaccgccttctgcctgctgtacaagctgttcaccctgaagctgaccagaaagcaggtgatgggcctgatcacccacaccgacagcccctacatcagagccctgggcttcatgtacatcagatacacccagccccccaccgacctgtgggactggttcgagagcttcctggacgacgaggaggacctggacgtgaaggccggcggcggctgcgtgatgaccatcggcgagatgctgagaagcttcctgaccaagctggagtggttcagcaccctgttccccagaatccccgtgcccgtgcagaagaacatcgaccagcagatcaagaccagacccagaaagatcaagaaggacggcaaggagggcgccgaggagatcgacagacacgtggagagaagaagaagcagaagccccagaagaagcctgagccccagaagaagccccagaagaagcagaagcagaagccaccacagagagggccacggcagcagcagcttcgacagagagctggagagagagaaggagagacagagactggagagagaggccaaggagagagagaaggagagaagaagaagcagaagcatcgacagaggcctggagagaagaagaagcagaagcagagagagacacagaagcagaagcagaagcagagacagaaagggcgacagaagagacagagacagagagagagagaaggagaacgagagaggcagaagaagagacagagactacgacaaggagagaggcaacgagagagagaaggagagagagagaagcagagagagaagcaaggagcagagaagcagaggcgaggtggaggagaagaagcacaaggaggacaaggacgacagaagacacagagacgacaagagagacagcaagaaggagaagaagcacagcagaagcagaagcagagagagaaagcacagaagcagaagcagaagcagaaacgccggcaagagaagcagaagcagaagcaaggagaagagcagcaagcacaagaacgagagcaaggagaagagcaacaagagaagcagaagcggcagccagggcagaaccgacagcgtggagaagagcaagaagagagagcacagccccagcaaggagaagagcagaaagagaagcagaagcaaggagagaagccacaagagagaccacagcgacagcaaggaccagagcgacaagcacgacagaagaagaagccagagcatcgagcaggagagccaggagaagcagcacaagaacaaggacgagaccgtgtag

SEQ ID NO: 9223 - DNA, 573 bp, Artificial Sequence
  Description of Artificial Sequence: Synthetic coding sequence
atggccaacaacagccccgccctgaccggcaacagccagccccagcaccaggccgccgccgccgccgcccagcagcagcagcagtgcggcggcggcggcgccaccaagcccgccgtgagcggcaagcagggcaacgtgctgcccctgtggggcaacgagaagaccatgaacctgaaccccatgatcctgaccaacatcctgagcagcccctacttcaaggtgcagctgtacgagctgaagacctaccacgaggtggtggacgagatctacttcaaggtgacccacgtggagccctgggagaagggcagcagaaagaccgccggccagaccggcatgtgcggcggcgtgagaggcgtgggcaccggcggcatcgtgagcaccgccttctgcctgctgtacaagctgttcaccctgaagctgaccagaaagcaggtgatgggcctgatcacccacaccgacagcccctacatcagagccctgggcttcatgtacatcagatacacccagccccccaccgacctgtgggactggttcgagagcttcctggacgacgaggagttcttcaccctgtag

SEQ ID NO: 9224 - DNA, 1641 bp, Artificial Sequence
  Description of Artificial Sequence: Synthetic coding sequence
atggccaacaacagccccgccctgaccggcaacagccagccccagcaccaggccgccgccgccgccgcccagcagcagcagcagtgcggcggcggcggcgccaccaagcccgccgtgagcggcaagcagggcaacgtgctgcccctgtggggcaacgagaagaccatgaacctgaaccccatgatcctgaccaacatcctgagcagcccctacttcaaggtgcagctgtacgagctgaagacctaccacgaggtggtggacgagatctacttcaaggtgacccacgtggagccctgggagaagggcagcagaaagaccgccggccagaccggcatgtgcggcggcgtgagaggcgtgggcaccggcggcatcgtgagcaccgccttctgcctgctgtacaagctgttcaccctgaagctgaccagaaagcaggtgatgggcctgatcacccacaccgacagcccctacatcagagccctgggcttcatgtacatcagatacacccagccccccaccgacctgtgggactggttcgagagcttcctggacgacgaggaggacctggacgtgaaggccggcggcggctgcgtgatgaccatcggcgagatgctgagaagcttcctgaccaagctggagtggttcagcaccctgttccccagaatccccgtgcccgtgcagaagaacatcgaccagcagatcaagaccagacccagaaagatcaagaaggacggcaaggagggcgccgaggagatcgacagacacgtggagagaagaagaagcagaagccccagaagaagcctgagccccagaagaagccccagaagaagcagaagcagaagccaccacagagagggccacggcagcagcagcttcgacagagagctggagagagagaaggagagacagagactggagagagaggccaaggagagagagaaggagagaagaagaagcagaagcatcgacagaggcctggagagaagaagaagcagaagcagagagagacacagaagcagaagcagaagcagagacagaaagggcgacagaagagacagagacagagagagagagaaggagaacgagagaggcagaagaagagacagagactacgacaaggagagaggcaacgagagagagaaggagagagagagaagcagagagagaagcaaggagcagagaagcagaggcgaggtggaggagaagaagcacaaggaggacaaggacgacagaagacacagagacgacaagagagacagcaagaaggagaagaagcacagcagaagcagaagcagagagagaaagcacagaagcagaagcagaagcagaaacgccggcaagagaagcagaagcagaagcaaggagaagagcagcaagcacaagaacgagagcaaggagaagagcaacaagagaagcagaagcggcagccagggcagaaccgacagcgtggagaagagcaagaagagagagcacagccccagcaaggagaagagcagaaagagaagcagaagcaaggagagaagccacaagagagaccacagcgacagcaaggaccagagcgacaagcacgacagaagaagaagccagagcatcgagcaggagagccaggagaagcagcacaagaacaaggacgagaccgtgtag

SEQ ID NO: 9225 - DNA, 2010 bp, Artificial Sequence
  Description of Artificial Sequence: Synthetic coding sequence
atgcagaacagccacatggacgagtacagaaacagcagcaacggcagcaccggcaacagcagcgaggtggtggtggagcaccccaccgacttcagcaccgagatcatgaacgtgaccgagatggagcagagccccgacgacagccccaacgtgaacgccagcaccgaggagaccgagatggccagcgccgtggacctgcccgtgaccctgaccgagaccgaggccaacttcccccccgagtacgagaagttctggaagaccgtggagaacaacccccaggacttcaccggctgggtgtacctgctgcagtacgtggagcaggagaaccacctgatggccgccagaaaggccttcgacagattcttcatccactacccctactgctacggctactggaagaagtacgccgacctggagaagagacacgacaacatcaagcccagcgacgaggtgtacagaagaggcctgcaggccatccccctgagcgtggacctgtggatccactacatcaacttcctgaaggagaccctggaccccggcgaccccgagaccaacaacaccatcagaggcaccttcgagcacgccgtgctggccgccggcaccgacttcagaagcgacagactgtgggagatgtacatcaactgggagaacgagcagggcaacctgagagaggtgaccgccatctacgacagaatcctgggcatccccacccagctgtacagccaccacttccagagattcaaggagcacgtgcagaacaacctgcccagagacctgctgaccggcgagcagttcatccagctgagaagagagctggccagcgtgaacggccacagcggcgacgacggcccccccggcgacgacctgcccagcggcatcgaggacatcaccgaccccgccaagctgatcaccgagatcgagaacatgagacacagaatcatcgagatccaccaggagatgttcaactacaacgagcacgaggtgagcaagagatggaccttcgaggagggcatcaagagaccctacttccacgtgaagcccctggagaaggcccagctgaagaactggaaggagtacctggagttcgagatcgagaacggcacccacgagagagtggtggtgctgttcgagagatgcgtgatcagctgcgccctgtacgaggagttctggatcaagtacgccaagtacatggagaaccacagcatcgagggcgtgagacacgtgttcagcagagcctgcaccatccacctgcccaagaagcccatggtgcacatgctgtgggccgccttcgaggagcagcagggcaacatcaacgaggccagaaacatcctgaagaccttcgaggagtgcgtgctgggcctggccatggtgagactgagaagagtgagcctggagagaagacacggcaacctggaggaggccgagcacctgctgcaggacgccatcaagaacgccaagagcaacaacgagagcagcttctacgccgtgaagctggccagacacctgttcaagatccagaagaacctgcccaagagcagaaaggtgctgctggaggccatcgagagagacaaggagaacaccaagctgtacctgaacctgctggagatggagtacagcggcgacctgaagcagaacgaggagaacatcctgaactgcttcgacaaggccgtgcacggcagcctgcccatcaagatgagaatcaccttcagccagagaaaggtggagttcctggaggacttcggcagcgacgtgaacaagctgctgaacgcctacgacgagcaccagaccctgctgaaggagcaggacagcctgaagagaaaggccgagaacggcagcgaggagcccgaggagaagaaggcccacaccgaggacaccaccagcagcagcacccagatgatcgacggcgacctgcaggccaaccaggccgtgtacaactacagcgcctggtaccagtacaactaccagaacccctggaactacggccagtactacccccccccccccacctag

SEQ ID NO: 9226 - DNA, 723 bp, Artificial Sequence
  Description of Artificial Sequence: Synthetic coding sequence
atgcagggcctgctgagattcgaggaccaggacagcgccagaggcgaccagaacatcgccatgttctaccccaccagcacccagatggtgtacagaagaggcctgcaggccatccccctgagcgtggacctgtggatccactacatcaacttcctgaaggagaccctggaccccggcgaccccgagaccaacaacaccatcagaggcaccttcgagcacgccgtgctggccgccggcaccgacttcagaagcgacagactgtgggagatgtacatcaactgggagaacgagcagggcaacctgagagaggtgaccgccatctacgacagaatcctgggcatccccacccagctgtacagccaccacttccagagattcaaggagcacgtgcagaacaacctgcccagagacctgctgaccggcgagcagttcatccagctgagaagagagctggccagcgtgaacggccacagcggcgacgacggcccccccggcgacgacctgcccagcggcatcgaggacatcaccgaccccgccaagctgatcaccgagatcgagaacatgagacacagaatcatcgagatccaccaggagatgttcaactacaacgagcacgaggtgagcaagagatggaccttcgaggagggcatcaagagaccctacttccacgtgaagcccctggagaaggcccagaagaagctggagagaatcctgagaatctag

SEQ ID NO: 9227 - DNA, 2577 bp, Artificial Sequence
  Description of Artificial Sequence: Synthetic coding sequence
atgcccccccccggcatccccccccccttcccccccatgggcctgccccccatgagccagagaccccccgccatcccccccatgccccccggcatcctgccccccatgctgccccccatgggcgcccccccccccctgacccagatccccggcatggtgccccccatgatgcccggcatgctgatgcccgccgtgcccgtgaccgccgccaccgcccccggcgccgacaccgccagcagcgccgtggccggcaccggcccccccagagccctgtggagcgagcacgtggcccccgacggcagaatctactactacaacgccgacgacaagcagagcgtgtgggagaagcccagcgtgctgaagagcaaggccgagctgctgctgagccagtgcccctggaaggagtacaagagcgacaccggcaagccctactactacaacaaccagagcaaggagagcagatggaccagacccaaggacctggacgacctggaggtgctggtgaagcaggaggccgccggcaagcagcagcagcagctgccccagaccctgcagccccagcccccccagccccagcccgaccccccccccgtgccccccggccccacccccgtgcccaccggcctgctggagcccgagcccggcggcagcgaggactgcgacgtgctggaggccacccagcccctggagcagggcttcctgcagcagctggaggagggccccagcagcagcggccagcaccagccccagcaggaggaggaggagagcaagcccgagcccgagagaagcggcctgagctggagcaacagagagaaggccaagcaggccttcaaggagctgctgagagacaaggccgtgcccagcaacgccagctgggagcaggccatgaagatggtggtgaccgaccccagatacagcgccctgcccaagctgagcgagaagaagcaggccttcaacgcctacaaggcccagagagagaaggaggagaaggaggaggccagactgagagccaaggaggccaagcagaccctgcagcacttcctggagcagcacgagagaatgaccagcaccaccagatacagaagagccgagcagaccttcggcgagctggaggtgtgggccgtggtgcccgagagagacagaaaggaggtgtacgacgacgtgctgttcttcctggccaagaaggagaaggagcaggccaagcagctgagaagaagaaacatccaggccctgaagagcatcctggacggcatgagcagcgtgaacttccagaccacctggagccaggcccagcagtacctgatggacaaccccagcttcgcccaggaccaccagctgcagaacatggacaaggaggacgccctgatctgcttcgaggagcacatcagagccctggagagagaggaggaggaggagagagagagagccagactgagagagagaagacagcagagaaagaacagagaggccttccagaccttcctggacgagctgcacgagaccggccagctgcacagcatgagcacctggatggagctgtaccccgccgtgagcaccgacgtgagattcgccaacatgctgggccagcccggcagcacccccctggacctgttcaagttctacgtggaggagctgaaggccagattccacgacgagaagaagatcatcaaggacatcctgaaggtgaacaccgccttcgaggacttcgcccacgtgatcagcttcgacaagagagccgccgccctggacgccggcaacatcaagctgaccttcaacagcctgctggagaaggccgaggccagagagagagagagagagaaggaggaggccagaagaatgagaagaagagaggccgccttcagaagcatgctgagacaggccgtgcccgccctggagctgggcaccgcctgggaggaggtgagagagagattcgtgtgcgacagcgccttcgagcagatcaccctggagagcgagagaatcagactgttcagagagttcctgcaggtgctggagcagaccgagtgccagcacctgcacaccaagggcagaaagcacggcagaaagggcaagaagcaccaccacaagagaagccacagccccagcggcagcgagagcgaggaggaggagctgcccccccccagcctgagaccccccaagagaagaagaagaaaccccagcgagagcggcagcgagcccagcagcagcctggacagcgtggagagcggcggcgccgccctgggcggcagaggcagccccagcagccacctgctgggcgccgaccacggcctgagaaaggccaagaagcccaagaagaagaccaagaagagaagacacaagagcaacagccccgagagcgagaccgaccccgaggagaaggccggcaaggagagcgacgagaaggagcaggagcaggacaaggacagagagctgcagcaggccgagctgcccaacagaagccccggcttcggcatcaagaaggagaagaccggctgggacaccagcgagagcgagctgagcgagggcgagctggagagaagaagaagaaccctgctgcagcagctggacgaccaccagtag

SEQ ID NO: 9228 - DNA, 2616 bp, Artificial Sequence
  Description of Artificial Sequence: Synthetic coding sequence
atgatgcccccccccttcatgcccccccccggcatccccccccccttcccccccatgggcctgccccccatgagccagagaccccccgccatcccccccatgccccccggcatcctgccccccatgctgccccccatgggcgcccccccccccctgacccagatccccggcatggtgccccccatgatgcccggcatgctgatgcccgccgtgcccgtgaccgccgccaccgcccccggcgccgacaccgccagcagcgccgtggccggcaccggcccccccagagccctgtggagcgagcacgtggcccccgacggcagaatctactactacaacgccgacgacaagcagagcgtgtgggagaagcccagcgtgctgaagagcaaggccgagctgctgctgagccagtgcccctggaaggagtacaagagcgacaccggcaagccctactactacaacaaccagagcaaggagagcagatggaccagacccaaggacctggacgacctggaggtgctggtgaagcaggaggccgccggcaagcagcagcagcagctgccccagaccctgcagccccagcccccccagccccagcccgaccccccccccgtgccccccggccccacccccgtgcccaccggcctgctggagcccgagcccggcggcagcgaggactgcgacgtgctggaggccacccagcccctggagcagggcttcctgcagcagctggaggagggccccagcagcagcggccagcaccagccccagcaggaggaggaggagagcaagcccgagcccgagagaagcggcctgagctggagcaacagagagaaggccaagcaggccttcaaggagctgctgagagacaaggccgtgcccagcaacgccagctgggagcaggccatgaagatggtggtgaccgaccccagatacagcgccctgcccaagctgagcgagaagaagcaggccttcaacgcctacaaggcccagagagagaaggaggagaaggaggaggccagactgagagccaaggaggccaagcagaccctgcagcacttcctggagcagcacgagagaatgaccagcaccaccagatacagaagagccgagcagaccttcggcgagctggaggtgtgggccgtggtgcccgagagagacagaaaggaggtgtacgacgacgtgctgttcttcctggccaagaaggagaaggagcaggccaagcagctgagaagaagaaacatccaggccctgaagagcatcctggacggcatgagcagcgtgaacttccagaccacctggagccaggcccagcagtacctgatggacaaccccagcttcgcccaggaccaccagctgcagaacatggacaaggaggacgccctgatctgcttcgaggagcacatcagagccctggagagagaggaggaggaggagagagagagagccagactgagagagagaagacagcagagaaagaacagagaggccttccagaccttcctggacgagctgcacgagaccggccagctgcacagcatgagcacctggatggagctgtaccccgccgtgagcaccgacgtgagattcgccaacatgctgggccagcccggcagcacccccctggacctgttcaagttctacgtggaggagctgaaggccagattccacgacgagaagaagatcatcaaggacatcctgaaggacagaggcttctgcgtggaggtgaacaccgccttcgaggacttcgcccacgtgatcagcttcgacaagagagccgccgccctggacgccggcaacatcaagctgaccttcaacagcctgctggagaaggccgaggccagagagagagagagagagaaggaggaggccagaagaatgagaagaagagaggccgccttcagaagcatgctgagacaggccgtgcccgccctggagctgggcaccgcctgggaggaggtgagagagagattcgtgtgcgacagcgccttcgagcagatcaccctggagagcgagagaatcagactgttcagagagttcctgcaggtgctggagcagaccgagtgccagcacctgcacaccaagggcagaaagcacggcagaaagggcaagaagcaccaccacaagagaagccacagccccagcggcagcgagagcgaggaggaggagctgcccccccccagcctgagaccccccaagagaagaagaagaaaccccagcgagagcggcagcgagcccagcagcagcctggacagcgtggagagcggcggcgccgccctgggcggcagaggcagccccagcagccacctgctgggcgccgaccacggcctgagaaaggccaagaagcccaagaagaagaccaagaagagaagacacaagagcaacagccccgagagcgagaccgaccccgaggagaaggccggcaaggagagcgacgagaaggagcaggagcaggacaaggacagagagctgcagcaggccgagctgcccaacagaagccccggcttcggcatcaagaaggagaagaccggctgggacaccagcgagagcgagctgagcgagggcgagctggagagaagaagaagaaccctgctgcagcagctggacgaccaccagtag

SEQ ID NO: 9229 - DNA, 21 bp, Artificial Sequence
  Description of Artificial Sequence: Synthetic coding sequence
atgatgcccccccccttctag

SEQ ID NO: 9230 - DNA, 1791 bp, Artificial Sequence
  Description of Artificial Sequence: Synthetic coding sequence
atggaggccgagccccccctgtaccccatggccggcgccgccggcccccagggcgacgaggacctgctgggcgtgcccgacggccccgaggcccccctggacgagctggtgggcgcctaccccaactacaacgaggaggaggaggagagaagatactacagaagaaagagactgggcgtgctgaagaacgtgctggccgccagcgccggcggcatgctgacctacggcgtgtacctgggcctgctgcagatgcagctgatcctgcactacgacgagacctacagagaggtgaagtacggcaacatgggcctgcccgacatcgacagcaagatgctgatgggcatcaacgtgacccccatcgccgccctgctgtacacccccgtgctgatcagattcttcggcaccaagtggatgatgttcctggccgtgggcatctacgccctgttcgtgagcaccaactactgggagagatactacaccctggtgcccagcgccgtggccctgggcatggccatcgtgcccctgtgggccagcatgggcaactacatcaccagaatggcccagaagtaccacgagtacagccactacaaggagcaggacggccagggcatgaagcagagaccccccagaggcagccacgccccctacctgctggtgttccaggccatcttctacagcttcttccacctgagcttcgcctgcgcccagctgcccatgatctacttcctgaaccactacctgtacgacctgaaccacaccctgtacaacgtgcagagctgcggcaccaacagccacggcatcctgagcggcttcaacaagaccgtgctgagaaccctgcccagaagcggcaacctgatcgtggtggagagcgtgctgatggccgtgttcctggccatgctgctggtgctgggcctgtgcggcgccgcctacagacccaccgaggagatcgacctgagaagcgtgggctggggcaacatcttccagctgcccttcaagcacgtgagagactacagactgagacacctggtgcccttcttcatctacagcggcttcgaggtgctgttcgcctgcaccggcatcgccctgggctacggcgtgtgcagcgtgggcctggagagactggcctacctgctggtggcctacagcctgggcgccagcgccgccagcctgctgggcctgctgggcctgtggctgcccagacccgtgcccctggtggccggcgccggcgtgcacctgctgctgaccttcatcctgttcttctgggcccccgtgcccagagtgctgcagcacagctggatcctgtacgtggccgccgccctgtggggcgtgggcagcgccctgaacaagaccggcctgagcaccctgctgggcatcctgtacgaggacaaggagagacaggacttcatcttcaccatctaccactggtggcaggccgtggccatcttcaccgtgtacctgggcagcagcctgcacatgaaggccaagctggccgtgctgctggtgaccctggtggccgccgccgtgagctacctgagaatggagcagaagctgagaagaggcgtggcccccagacagcccagaatccccagaccccagcacaaggtgagaggctacagatacctggaggaggacaacagcgacgagagcgacgccgagggcgagcacggcgacggcgccgaggaggaggccccccccgccggccccagacccggccccgagcccgccggcctgggcagaagaccctgcccctacgagcaggcccagggcggcgacggccccgaggagcagtag

SEQ ID NO: 9231 - DNA, 1446 bp, Artificial Sequence
  Description of Artificial Sequence: Synthetic coding sequence
atggcctacaacgacaccgacagaaaccagaccgagaagctgctgaagagagtgagagagctggagcaggaggtgcagagactgaagaaggagcaggccaagaacaaggaggacagcaacatcagagagaacagcgccggcgccggcaagaccaagagagccttcgacttcagcgcccacggcagaagacacgtggccctgagaatcgcctacatgggctggggctaccagggcttcgccagccaggagaacaccaacaacaccatcgaggagaagctgttcgaggccctgaccaagaccagactggtggagagcagacagaccagcaactaccacagatgcggcagaaccgacaagggcgtgagcgccttcggccaggtgatcagcctggacctgagaagccagttccccagaggcagagacagcgaggacttcaacgtgaaggaggaggccaacgccgccgccgaggagatcagatacacccacatcctgaacagagtgctgccccccgacatcagaatcctggcctgggcccccgtggagcccagcttcagcgccagattcagctgcctggagagaacctacagatacttcttccccagagccgacctggacatcgtgaccatggactacgccgcccagaagtacgtgggcacccacgacttcagaaacctgtgcaagatggacgtggccaacggcgtgatcaacttccagagaaccatcctgagcgcccaggtgcagctggtgggccagagccccggcgagggcagatggcaggagcccttccagctgtgccagttcgaggtgaccggccaggccttcctgtaccaccaggtgagatgcatgatggccatcctgttcctgatcggccagggcatggagaagcccgagatcatcgacgagctgctgaacatcgagaagaacccccagaagccccagtacagcatggccgtggagttccccctggtgctgtacgactgcaagttcgagaacgtgaagtggatctacgaccaggaggcccaggagttcaacatcacccacctgcagcagctgtgggccaaccacgccgtgaagacccacatgctgtacagcatgctgcagggcctggacaccgtgcccgtgccctgcggcatcggccccaagatggacggcatgaccgagtggggcaacgtgaagcccagcgtgatcaagcagaccagcgccttcgtggagggcgtgaagatgagaacctacaagcccctgatggacagacccaagtgccagggcctggagagcagaatccagcacttcgtgagaagaggcagaatcgagcacccccacctgttccacgaggaggagaccaaggccaagagagactgcaacgacaccctggaggaggagaacaccaacctggagacccccaccaagagagtgtgcgtggacaccgagatcaagagcatcatctag

SEQ ID NO: 9232 - DNA, 939 bp, Artificial Sequence
  Description of Artificial Sequence: Synthetic coding sequence
atggccgacggcgacagcggcagcgagagaggcggcggcggcggcccctgcggcttccagcccgccagcagaggcggcggcgagcaggagacccaggagctggccagcaagagactggacatccagaacaagagattctacctggacgtgaagcagaacgccaagggcagattcctgaagatcgccgaggtgggcgccggcggcagcaagagcagactgaccctgagcatggccgtggccgccgagttcagagacagcctgggcgacttcatcgagcactacgcccagctgggccccagcagccccgagcagctggccgccggcgccgaggagggcggcggccccagaagagccctgaagagcgagttcctggtgagagagaacagaaagtactacctggacctgaaggagaaccagagaggcagattcctgagaatcagacagaccgtgaacagaggcggcggcggcttcggcgccggccccggccccggcggcctgcagagcggccagaccatcgccctgcccgcccagggcctgatcgagttcagagacgccctggccaagctgatcgacgactacggcggcgaggacgacgagctggccggcggccccggcggcggcgccggcggccccggcggcggcctgtacggcgagctgcccgagggcaccagcatcaccgtggacagcaagagattcttcttcgacgtgggctgcaacaagtacggcgtgttcctgagagtgagcgaggtgaagcccagctacagaaacgccatcaccgtgcccttcaaggcctggggcaagttcggcggcgccttctgcagatacgccgacgagatgaaggagatccaggagagacagagagacaagctgtacgagagaagaggcggcggcagcggcggcggcgaggagagcgagggcgaggaggtggacgaggactag

SEQ ID NO: 9233 - DNA, 969 bp, Artificial Sequence
  Description of Artificial Sequence: Synthetic coding sequence
atggagagagccagaagaagaggcggcggcggcggcagaggcagaggcggcaagaacgtgggcggcagcggcctgagcaagagcagactgtacccccaggcccagcacagccactacccccactacgccgccagcgccacccccaaccaggccggcggcgccgccgagatccaggagctggccagcaagagagtggacatccagaagaagagattctacctggacgtgaagcagagcagcagaggcagattcctgaagatcgccgaggtgtggatcggcagaggcagacaggacaacatcagaaagagcaagctgaccctgagcctgagcgtggccgccgagctgaaggactgcctgggcgacttcatcgagcactacgcccacctgggcctgaagggccacagacaggagcacggccacagcaaggagcagggcagcagaagaagacagaagcacagcgcccccagcccccccgtgagcgtgggcagcgaggagcacccccacagcgtgctgaagaccgactacatcgagagagacaacagaaagtactacctggacctgaaggagaaccagagaggcagattcctgagaatcagacagaccatgatgagaggcaccggcatgatcggctacttcggccacagcctgggccaggagcagaccatcgtgctgcccgcccagggcatgatcgagttcagagacgccctggtgcagctgatcgaggactacggcgagggcgacatcgaggagagaagaggcggcgacgacgaccccctggagctgcccgagggcaccagcttcagagtggacaacaagagattctacttcgacgtgggcagcaacaagtacggcatcttcctgaagctgaccaactaccccaagagcagagagaacatcaacctgttccactgctgccagatcaagcacaaggagcagccccacgacaccaccaagaccgtggaggagtag

SEQ ID NO: 9234 - DNA, 1044 bp, Artificial Sequence
  Description of Artificial Sequence: Synthetic coding sequence
atggagagagccagaagaagaggcggcggcggcggcagaggcagaggcggcaagaacgtgggcggcagcggcctgagcaagagcagactgtacccccaggcccagcacagccactacccccactacgccgccagcgccacccccaaccaggccggcggcgccgccgagatccaggagctggccagcaagagagtggacatccagaagaagagattctacctggacgtgaagcagagcagcagaggcagattcctgaagatcgccgaggtgtggatcggcagaggcagacaggacaacatcagaaagagcaagctgaccctgagcctgagcgtggccgccgagctgaaggactgcctgggcgacttcatcgagcactacgcccacctgggcctgaagggccacagacaggagcacggccacagcaaggagcagggcagcagaagaagacagaagcacagcgcccccagcccccccgtgagcgtgggcagcgaggagcacccccacagcgtgctgaagaccgactacatcgagagagacaacagaaagtactacctggacctgaaggagaaccagagaggcagattcctgagaatcagacagaccatgatgagaggcaccggcatgatcggctacttcggccacagcctgggccaggagcagaccatcgtgctgcccgcccagggcatgatcgagttcagagacgccctggtgcagctgatcgaggactacggcgagggcgacatcgaggagagaagaggcggcgacgacgaccccctggagctgcccgagggcaccagcttcagagtggacaacaagagattctacttcgacgtgggcagcaacaagtacggcatcttcctgaaggtgagcgaggtgagacccccctacagaaacaccatcaccgtgcccttcaaggcctggaccagattcggcgagaacttcatcaagtacgaggaggagatgagaaagatctgcaacagccacaaggagaagagaatggacggcagaaaggccagcggcgaggagcaggagtgcctggactag

SEQ ID NO: 9235 - DNA, 429 bp, Artificial Sequence
  Description of Artificial Sequence: Synthetic coding sequence
atggcccccgtgaagatcagccacgtggtgagcttcagcagccaggaccccaagtaccccgtggagaacctgctgaaccccgacagccccagaagaccctggctgggctgcccccaggacaagagcggccagctgaaggtggagctgcagctggagagagccgtgcccaccggctacatcgacgtgggcaactgcggctgcgccttcctgcagatcgacgtgggccacagcagctggcccctggacagacccttcatcaccctgctgcccgccaccaccctgatgagcctgaccgacagcaagcagggcaagaacagaagcggcgtgagaatgttcaaggacggcaaggagggcaagagcagaaaggacggcggcggcctgtacgagaagcagagatgcagcaccaaggaggactgcgagtgctactag

SEQ ID NO: 9236 - DNA, 1506 bp, Artificial Sequence
  Description of Artificial Sequence: Synthetic coding sequence
atgaacagaagcagacaggtgacctgcgtggcctgggtgagatgcggcgtggccaaggagacccccgacaaggtggagctgagcaaggaggaggtgaagagactgatcgccgaggccaaggagaagctgcaggaggagggcggcggcagcgacgaggaggagaccggcagccccagcgaggacggcatgcagagcgccagaacccaggccagacccagagagcccctggaggacggcgaccccgaggacgacagaaccctggacgacgacgagctggccgagtacgacctggacaagtacgacgaggagggcgaccccgacgccgagaccctgggcgagagcctgctgggcctgaccgtgtacggcagcaacgaccaggacccctacgtgaccctgaaggacaccgagcagtacgagagagaggacttcctgatcaagcccagcgacaacctgatcgtgtgcggcagagccgagcaggaccagtgcaacctggaggtgcacgtgtacaaccaggaggaggacagcttctacgtgcaccacgacatcctgctgagcgcctaccccctgagcgtggagtggctgaacttcgaccccagccccgacgacagcaccggcaactacatcgccgtgggcaacatgacccccgtgatcgaggtgtgggacctggacatcgtggacagcctggagcccgtgttcaccctgggcagcaagctgagcaagaagaagaagaagaagggcaagaagagcagcagcgccgagggccacaccgacgccgtgctggacctgagctggaacaagctgatcagaaacgtgctggccagcgccagcgccgacaacaccgtgatcctgtgggacatgagcctgggcaagcccgccgccagcctggccgtgcacaccgacaaggtgcagaccctgcagttccaccccttcgaggcccagaccctgatcagcggcagctacgacaagagcgtggccctgtacgactgcagaagccccgacgagagccacagaatgtggagattcagcggccagatcgagagagtgacctggaaccacttcagcccctgccacttcctggccagcaccgacgacggcttcgtgtacaacctggacgccagaagcgacaagcccatcttcaccctgaacgcccacaacgacgagatcagcggcctggacctgagcagccagatcaagggctgcctggtgaccgccagcgccgacaagtacgtgaagatctgggacatcctgggcgacagacccagcctggtgcacagcagagacatgaagatgggcgtgctgttctgcagcagctgctgccccgacctgcccttcatctacgccttcggcggccagaaggagggcctgagagtgtgggacatcagcaccgtgagcagcgtgaacgaggccttcggcagaagagagagactggtgctgggcagcgccagaaacagcagcatcagcggccccttcggcagcagaagcagcgacacccccatggagagctag

SEQ ID NO: 9237 - DNA, 762 bp, Artificial Sequence
  Description of Artificial Sequence: Synthetic coding sequence
atgaacagaagcagacaggtgacctgcgtggcctgggtgagatgcggcgtggccaaggagacccccgacaaggtggagctgagcaaggaggaggtgaagagactgatcgccgaggccaaggagaagctgcaggaggagggcggcggcagcgacgaggaggagaccggcagccccagcgaggacggcatgcagagcgccagaacccaggccagacccagagagcccctggaggacggcgaccccgaggacgacagaaccctggacgacgacgagctggccgagtacgacctggacaagtacgacgaggagggcgaccccgacgccgagaccctgggcgagagcctgctgggcctgaccgtgtacggcagcaacgaccaggacccctacgtgaccctgaaggacaccgagcagtacgagagagaggacttcctgatcaagcccagcgacaacctgatcgtgtgcggcagagccgagcaggaccagtgcaacctggaggtgcacgtgtacaaccaggaggaggacagcttctacgtgcaccacgacatcctgctgagcgcctaccccctgagcgtggagtggctgaacttcgaccccagccccgacgacagcaccggcaactacatcgccgtgggcaacatgacccccgtgatcgaggtgtgggacctggacatcgtggacagcctggagcccgtgttcaccctgggcagcaagctgagcaagaagaagaagaagaagggcaagaaggtgaagaagaagagatag

SEQ ID NO: 9238 - DNA, 750 bp, Artificial Sequence
  Description of Artificial Sequence: Synthetic coding sequence
atgaacagaagcagacaggtgacctgcgtggcctgggtgagatgcggcgtggccaaggagacccccgacaaggtggagctgagcaaggaggaggtgaagagactgatcgccgaggccaaggagaagctgcaggaggagggcggcggcagcgacgaggaggagaccggcagccccagcgaggacggcatgcagagcgccagaacccaggccagacccagagagcccctggaggacggcgaccccgaggacgacagaaccctggacgacgacgagctggccgagtacgacctggacaagtacgacgaggagggcgaccccgacgccgagaccctgggcgagagcctgctgggcctgaccgtgtacggcagcaacgaccaggacccctacgtgaccctgaaggacaccgagcagtacgagagagaggacttcctgatcaagcccagcgacaacctgatcgtgtgcggcagagccgagcaggaccagtgcaacctggaggtgcacgtgtacaaccaggaggaggacagcttctacgtgcaccacgacatcctgctgagcgcctaccccctgagcgtggagtggctgaacttcgaccccagccccgacgacagcaccggcaactacatcgccgtgggcaacatgacccccgtgatcgaggtgtgggacctggacatcgtggacagcctggagcccgtgttcaccctgggcagcaagctgagcaagaagaagaagaagaagggcaagaagaagtag

SEQ ID NO: 9239 - DNA, 297 bp, Artificial Sequence
  Description of Artificial Sequence: Synthetic coding sequence
atgcagagcgccagaacccaggccagacccagagagcccctggaggacggcgaccccgaggacgacagaaccctggacgacgacgagctggccgagtacgacctggacaagtacgacgaggagggcgaccccgacgccgagaccctgggcgagagcctgctgggcctgaccgtgtacggcagcaacgaccaggacccctacgtgaccctgaaggacaccgagcagtacgagagagaggacttcctgatcaagcccagcgacaacctgatcgtgtgcggcagagccgagcaggactag

SEQ ID NO: 9240 - DNA, 1260 bp, Artificial Sequence
  Description of Artificial Sequence: Synthetic coding sequence
atgcccgccgagaacagccccgcccccgcctacaaggtgagcagccacggcggcgacagcggcctggacggcctgggcggccccggcgtgcagctgggcagccccgacaagaagaagagaaaggccaacacccagggccccagcttcccccccctgagcgagtacgcccccccccccaaccccaacagcgaccacctggtggccgccaaccccttcgacgacaactacaacaccatcagctacaagcccctgcccagcagcaacccctacctgggccccggctaccccggcttcggcggctacagcaccttcagaatgcccccccacgtgccccccagaatgagcagcccctactgcggcccctacagcctgagaaaccagccccaccccttcccccagaaccccctgggcatgggcttcaacagaccccacgccttcaacttcggcccccacgacaacagcagcttcggcaaccccagctacaacaacgccctgagccagaacgtgaacatgcccaaccagcacttcagacagaaccccgccgagaacttcagccagatccccccccagaacgccagccaggtgagcaaccccgacctggccagcaacttcgtgcccggcaacaacagcaacttcaccagccccctggagagcaaccacagcttcatccccccccccaacaccttcggccaggccaaggcccccccccccaagcaggacttcacccagggcgccaccaagaacaccaaccagaacagcagcgcccaccccccccacctgaacatggacgacaccgtgaaccagagcaacatcgagctgaagaacgtgaacagaaacaacgccgtgaaccaggagaacagcagaagcagcagcaccgaggccaccaacaacaaccccgccaacggcacccagaacaagcccagacagcccagaggcgccgccgacgcctgcaccaccgagaagagcaacaagagcagcctgcaccccaacagacacggccacagcagcagcgaccccgtgtacccctgcggcatctgcaccaacgaggtgaacgacgaccaggacgccatcctgtgcgaggccagctgccagaagtggttccacagaatctgcaccggcatgaccgagaccgcctacggcctgctgaccgccgaggccagcgccgtgtggggctgcgacacctgcatggccgacaaggacgtgcagctgatgagaaccagagagaccttcggccccagcgccgtgggcagcgacgcctag

SEQ ID NO: 9241 - DNA, 1260 bp, Artificial Sequence
  Description of Artificial Sequence: Synthetic coding sequence
atgagcgccgagcaggagaaggaccccatcagcctgaagagagtgagaggcggcgacagcggcctggacggcctgggcggccccggcgtgcagctgggcagccccgacaagaagaagagaaaggccaacacccagggccccagcttcccccccctgagcgagtacgcccccccccccaaccccaacagcgaccacctggtggccgccaaccccttcgacgacaactacaacaccatcagctacaagcccctgcccagcagcaacccctacctgggccccggctaccccggcttcggcggctacagcaccttcagaatgcccccccacgtgccccccagaatgagcagcccctactgcggcccctacagcctgagaaaccagccccaccccttcccccagaaccccctgggcatgggcttcaacagaccccacgccttcaacttcggcccccacgacaacagcagcttcggcaaccccagctacaacaacgccctgagccagaacgtgaacatgcccaaccagcacttcagacagaaccccgccgagaacttcagccagatccccccccagaacgccagccaggtgagcaaccccgacctggccagcaacttcgtgcccggcaacaacagcaacttcaccagccccctggagagcaaccacagcttcatccccccccccaacaccttcggccaggccaaggcccccccccccaagcaggacttcacccagggcgccaccaagaacaccaaccagaacagcagcgcccaccccccccacctgaacatggacgacaccgtgaaccagagcaacatcgagctgaagaacgtgaacagaaacaacgccgtgaaccaggagaacagcagaagcagcagcaccgaggccaccaacaacaaccccgccaacggcacccagaacaagcccagacagcccagaggcgccgccgacgcctgcaccaccgagaagagcaacaagagcagcctgcaccccaacagacacggccacagcagcagcgaccccgtgtacccctgcggcatctgcaccaacgaggtgaacgacgaccaggacgccatcctgtgcgaggccagctgccagaagtggttccacagaatctgcaccggcatgaccgagaccgcctacggcctgctgaccgccgaggccagcgccgtgtggggctgcgacacctgcatggccgacaaggacgtgcagctgatgagaaccagagagaccttcggccccagcgccgtgggcagcgacgcctag

SEQ ID NO: 9242 - DNA, 2931 bp, Artificial Sequence
  Description of Artificial Sequence: Synthetic coding sequence
atgagcaacagcaacaccacccaggagaccctggagatcatgaaggagagcgagaagaagctggtggaggagagcgtgaacaagaacaagttcatcagcaagacccccagcaaggaggagatcgagaaggagtgcgaggacaccagcctgagacaggagacccagagaagaaccagcaaccacggccacgccagaaagagagccaagagcaacagcaagctgaagctggtgagaagcctggccgtgtgcgaggagagcagcacccccttcgccgacggccccctggagacccaggacatcatccagctgcacatcagctgccccagcgacaaggaggaggagaagagcaccaaggacgtgagcgagaaggaggacaaggacaagaacaaggagaagatccccagaaagatgctgagcagagacagcagccaggagtacaccgacagcaccggcatcgacctgcacgagttcctggtgaacaccctgaagaagaaccccagagacagaatgatgctgctgaagctggagcaggagatcctggagttcatcaacgacaacaacaaccagttcaagaagttcccccagatgaccagctaccacagaatgctgctgcacagagtggccgcctacttcggcatggaccacaacgtggaccagaccggcaaggccgtgatcatcaacaagaccagcaacaccagaatccccgagcagagattcagcgagcacatcaaggacgagaagaacaccgagttccagcagagattcatcctgaagagagacgacgccagcatggacagagacgacaaccagaccggccagaacggctacctgaacgacatcagactgagcaaggaggccttcagcagcagcagccacaagagaagacagatcttcagaggcaacagagagggcctgagcagaaccagcagcagcagacagagcagcaccgacagcgagctgaagagcctggagcccagaccctggagcagcaccgacagcgacggcagcgtgagaagcatgagaccccccgtgaccaaggccagcagcttcagcggcatcagcatcctgaccagaggcgacagcatcggcagcagcaagggcggcagcgccggcagaatcagcagacccggcatggccctgggcgcccccgaggtgtgcaaccaggtgaccagcagccagagcgtgagaggcctgctgccctgcaccgcccagcagcagcagcagcagcagcagcagcagctgcccgccctgccccccaccccccagcagcagccccccctgaacaaccacatgatcagccaggccgacgacctgagcaaccccttcggccagatgagcctgagcagacagggcagcaccgaggccgccgaccccagcgccgccctgttccagacccccctgatcagccagcacccccagcagaccagcttcatcatggccagcaccggccagcccctgcccaccagcaactacagcaccagcagccacgccccccccacccagcaggtgctgcccccccagggctacatgcagcccccccagcagatccaggtgagctactacccccccggccagtaccccaacagcaaccagcagtacagacccctgagccaccccgtggcctacagcccccagagaggccagcagctgccccagcccagccagcagcccggcctgcagcccatgatgcccaaccagcagcaggccgcctaccagggcatgatcggcgtgcagcagccccagaaccagggcctgctgagcagccagagaagcagcatgggcggccagatgcagggcctggtggtgcagtacacccccctgcccagctaccaggtgcccgtgggcagcgacagccagaacgtggtgcagccccccttccagcagcccatgctggtgcccgtgagccagagcgtgcagggcggcctgcccgccgccggcgtgcccgtgtactacagcatgatcccccccgcccagcagaacggcaccagccccagcgtgggcttcctgcagccccccggcagcgagcagtaccagatgccccagagccccagcccctgcagccccccccagatgccccagcagtacagcggcgtgagccccagcggccccggcgtggtggtgatgcagctgaacgtgcccaacggcccccagcccccccagaaccccagcatggtgcagtggagccactgcaagtactacagcatggaccagagaggccagaagcccggcgacctgtacagccccgacagcagcccccaggccaacacccagatgagcagcagccccgtgaccagccccacccagagccccgcccccagccccgtgaccagcctgagcagcgtgtgcaccggcctgagccccctgcccgtgctgacccagttccccagacccggcggccccgcccagggcgacggcagatacagcctgctgggccagcccctgcagtacaacctgagcatctgcccccccctgctgcacggccagagcacctacaccgtgcaccagggccagagcggcctgaagcacggcaacagaggcaagagacaggccctgaagagcgccagcaccgacctgggcaccgccgacgtggtgctgggcagagtgctggaggtgaccgacctgcccgagggcatcaccagaaccgaggccgacaagctgttcacccagctggccatgagcggcgccaagatccagtggctgaaggacgcccagggcctgcccggcggcggcggcggcgacaacagcggcaccgccgagaacggcagacacagcgacctggccgccctgtacaccatcgtggccgtgttccccagccccctggccgcccagaacgccagcctgagactgaacaacagcgtgagcagattcaagctgagaatggccaagaagaactacgacctgagaatcctggagagagccagcagccagtag

SEQ ID NO: 9243 - DNA, 2931 bp, Artificial Sequence; identical to SEQ ID NO: 9242
  Description of Artificial Sequence: Synthetic coding sequence

SEQ ID NO: 9244 - DNA, 2112 bp, Artificial Sequence
  Description of Artificial Sequence: Synthetic coding sequence
atgagaagaatccagaacttcaacagaggcagcttcagcagagagatgatgcccgtgtggaccgagatgatcaccagaggcaacagagagggcctgagcagaaccagcagcagcagacagagcagcaccgacagcgagctgaagagcctggagcccagaccctggagcagcaccgacagcgacggcagcgtgagaagcatgagaccccccgtgaccaaggccagcagcttcagcggcatcagcatcctgaccagaggcgacagcatcggcagcagcaagggcggcagcgccggcagaatcagcagacccggcatggccctgggcgcccccgaggtgtgcaaccaggtgaccagcagccagagcgtgagaggcctgctgccctgcaccgcccagcagcagcagcagcagcagcagcagcagctgcccgccctgccccccaccccccagcagcagccccccctgaacaaccacatgatcagccaggccgacgacctgagcaaccccttcggccagatgagcctgagcagacagggcagcaccgaggccgccgaccccagcgccgccctgttccagacccccctgatcagccagcacccccagcagaccagcttcatcatggccagcaccggccagcccctgcccaccagcaactacagcaccagcagccacgccccccccacccagcaggtgctgcccccccagggctacatgcagcccccccagcagatccaggtgagctactacccccccggccagtaccccaacagcaaccagcagtacagacccctgagccaccccgtggcctacagcccccagagaggccagcagctgccccagcccagccagcagcccggcctgcagcccatgatgcccaaccagcagcaggccgcctaccagggcatgatcggcgtgcagcagccccagaaccagggcctgctgagcagccagagaagcagcatgggcggccagatgcagggcctggtggtgcagtacacccccctgcccagctaccaggtgcccgtgggcagcgacagccagaacgtggtgcagccccccttccagcagcccatgctggtgcccgtgagccagagcgtgcagggcggcctgcccgccgccggcgtgcccgtgtactacagcatgatcccccccgcccagcagaacggcaccagccccagcgtgggcttcctgcagccccccggcagcgagcagtaccagatgccccagagccccagcccctgcagccccccccagatgccccagcagtacagcggcgtgagccccagcggccccggcgtggtggtgatgcagctgaacgtgcccaacggcccccagcccccccagaaccccagcatggtgcagtggagccactgcaagtactacagcatggaccagagaggccagaagcccggcgacctgtacagccccgacagcagcccccaggccaacacccagatgagcagcagccccgtgaccagccccacccagagccccgcccccagccccgtgaccagcctgagcagcgtgtgcaccggcctgagccccctgcccgtgctgacccagttccccagacccggcggccccgcccagggcgacggcagatacagcctgctgggccagcccctgcagtacaacctgagcatctgcccccccctgctgcacggccagagcacctacaccgtgcaccagggccagagcggcctgaagcacggcaacagaggcaagagacaggccctgaagagcgccagcaccgacctgggcaccgccgacgtggtgctgggcagagtgctggaggtgaccgacctgcccgagggcatcaccagaaccgaggccgacaagctgttcacccagctggccatgagcggcgccaagatccagtggctgaaggacgcccagggcctgcccggcggcggcggcggcgacaacagcggcaccgccgagaacggcagacacagcgacctggccgccctgtacaccatcgtggccgtgttccccagccccctggccgcccagaacgccagcctgagactgaacaacagcgtgagcagattcaagctgagaatggccaagaagaactacgacctgagaatcctggagagagccagcagccagtag

SEQ ID NO: 9245 - DNA, 1791 bp, Artificial Sequence
  Description of Artificial Sequence: Synthetic coding sequence
atgagaagaatccagaacttcaacagaggcagcttcagcagagagatgatgcccgtgtggaccgagatgatcaccagaggcaacagagagggcctgagcagaaccagcagcagcagacagagcagcaccgacagcgagctgaagagcctggagcccagaccctggagcagcaccgacagcgacggcagcgtgagaagcatgagaccccccgtgaccaaggccagcagcttcagcggcatcagcatcctgaccagaggcgacagcatcggcagcagcaagggcggcagcgccggcagaatcagcagacccggcatggccctgggcgcccccgaggtgtgcaaccaggtgaccagcagccagagcgtgagaggcctgctgccctgcaccgcccagcagcagcagcagcagcagcagcagcagctgcccgccctgccccccaccccccagcagcagccccccctgaacaaccacatgatcagccaggccgacgacctgagcaaccccttcggccagatgagcctgagcagacagggcagcaccgaggccgccgaccccagcgccgccctgttccagacccccctgatcagccagcacccccagcagaccagcttcatcatggccagcaccggccagcccctgcccaccagcaactacagcaccagcagccacgccccccccacccagcaggtgctgcccccccagggctacatgcagcccccccagcagatccaggtgagctactacccccccggccagtaccccaacagcaaccagcagtacagacccctgagccaccccgtggcctacagcccccagagaggccagcagctgccccagcccagccagcagcccggcctgcagcccatgatgcccaaccagcagcaggccgcctaccagggcatgatcggcgtgcagcagccccagaaccagggcctgctgagcagccagagaagcagcatgggcggccagatgcagggcctggtggtgcagtacacccccctgcccagctaccaggtgcccgtgggcagcgacagccagaacgtggtgcagccccccttccagcagcccatgctggtgcccgtgagccagagcgtgcagggcggcctgcccgccgccggcgtgcccgtgtactacagcatgatcccccccgcccagcagaacggcaccagccccagcgtgggcttcctgcagccccccggcagcgagcagtaccagatgccccagagccccagcccctgcagccccccccagatgccccagcagtacagcggcgtgagccccagcggccccggcgtggtggtgatgcagctgaacgtgcccaacggcccccagcccccccagaaccccagcatggtgcagtggagccactgcaagtactacagcatggaccagagaggccagaagcccggcgacctgtacagccccgacagcagcccccaggccaacacccagatgagcagcagccccgtgaccagccccacccagagccccgcccccagccccgtgaccagcctgagcagcgtgtgcaccggcctgagccccctgcccgtgctgacccagttccccagacccggcggccccgcccagggcgacggcagatacagcctgctgggccagcccctgcagtacaacctgagcatctgcccccccctgctgcacggccagagcacctacaccgtgcaccagggccagagcggcctgaagcacggcaacagaggcaagagacaggccctgaagagcgccagcaccgacctgggcaccgccgacgtggccctgagcttccagccctag

SEQ ID NO: 9246 - DNA, 2016 bp, Artificial Sequence
  Description of Artificial Sequence: Synthetic coding sequence
atgagaccccccgtgaccaaggccagcagcttcagcggcatcagcatcctgaccagaggcgacagcatcggcagcagcaagggcggcagcgccggcagaatcagcagacccggcatggccctgggcgcccccgaggtgtgcaaccaggtgaccagcagccagagcgtgagaggcctgctgccctgcaccgcccagcagcagcagcagcagcagcagcagcagctgcccgccctgccccccaccccccagcagcagccccccctgaacaaccacatgatcagccagcccgtgcccgccctgcagcccagcccccagcccgtgcagttcagccccagcagctgcccccaggtgctgctgcccgtgagccccccccagcagtacaacatggccgacgacctgagcaaccccttcggccagatgagcctgagcagacagggcagcaccgaggccgccgaccccagcgccgccctgttccagacccccctgatcagccagcacccccagcagaccagcttcatcatggccagcaccggccagcccctgcccaccagcaactacagcaccagcagccacgccccccccacccagcaggtgctgcccccccagggctacatgcagcccccccagcagatccaggtgagctactacccccccggccagtaccccaacagcaaccagcagtacagacccctgagccaccccgtggcctacagcccccagagaggccagcagctgccccagcccagccagcagcccggcctgcagcccatgatgcccaaccagcagcaggccgcctaccagggcatgatcggcgtgcagcagccccagaaccagggcctgctgagcagccagagaagcagcatgggcggccagatgcagggcctggtggtgcagtacacccccctgcccagctaccaggtgcccgtgggcagcgacagccagaacgtggtgcagccccccttccagcagcccatgctggtgcccgtgagccagagcgtgcagggcggcctgcccgccgccggcgtgcccgtgtactacagcatgatcccccccgcccagcagaacggcaccagccccagcgtgggcttcctgcagccccccggcagcgagcagtaccagatgccccagagccccagcccctgcagccccccccagatgccccagcagtacagcggcgtgagccccagcggccccggcgtggtggtgatgcagctgaacgtgcccaacggcccccagcccccccagaaccccagcatggtgcagtggagccactgcaagtactacagcatggaccagagaggccagaagcccggcgacctgtacagccccgacagcagcccccaggccaacacccagatgagcagcagccccgtgaccagccccacccagagccccgcccccagccccgtgaccagcctgagcagcgtgtgcaccggcctgagccccctgcccgtgctgacccagttccccagacccggcggccccgcccagggcgacggcagatacagcctgctgggccagcccctgcagtacaacctgagcatctgcccccccctgctgcacggccagagcacctacaccgtgcaccagggccagagcggcctgaagcacggcaacagaggcaagagacaggccctgaagagcgccagcaccgacctgggcaccgccgacgtggtgctgggcagagtgctggaggtgaccgacctgcccgagggcatcaccagaaccgaggccgacaagctgttcacccagctggccatgagcggcgccaagatccagtggctgaaggacgcccagggcctgcccggcggcggcggcggcgacaacagcggcaccgccgagaacggcagacacagcgacctggccgccctgtacaccatcgtggccgtgttccccagccccctggccgcccagaacgccagcctgagactgaacaacagcgtgagcagattcaagctgagaatggccaagaagaactacgacctgagaatcctggagagagccagcagccagtag

SEQ ID NO: 9247 - DNA, 90 bp, Artificial Sequence
  Description of Artificial Sequence: Synthetic coding sequence
atgagcaacagcaacaccacccaggagaccctggagatcatgaaggagagcgagaagaagctggtggaggagagcgtgaacaagaactag

SEQ ID NO: 9248 - DNA, 198 bp, Artificial Sequence
  Description of Artificial Sequence: Synthetic coding sequence
atgttctacacccacgtgctgatgagcaagagaggccccctggccaagatctggctggccgcccactgggagaagaagctgaccaaggcccacgtgttcgagtgcaacctggagatcaccatcgagaagatcctgagccccaaggtgaagatcgccctgagaaccagcggccacctgctgctgggcgtggtgagatag

SEQ ID NO: 9249 - DNA, 1566 bp, Artificial Sequence
  Description of Artificial Sequence: Synthetic coding sequence
atgttctacacccacgtgctgatgagcaagagaggccccctggccaagatctggctggccgcccactgggagaagaagctgaccaaggcccacgtgttcgagtgcaacctggagatcaccatcgagaagatcctgagccccaaggtgaagatcgccctgagaaccagcggccacctgctgctgggcgtggtgagaatctacaacagaaaggccaagtacctgctggccgactgcagcgaggccttcctgaagatgaagatgaccttctgccccggcctggtggacctgcccaaggagaacttcgaggccagctacaacgccatcaccctgcccgaggagttccacgacttcgacacccagaacatgaacgccatcgacgtgagcgagcacttcacccagaaccagagcagacccgaggagatcaccctgagagagaacttcgacaacgacctgatcttccaggccgagagcttcggcgaggagagcgagatcctgagaagacacagcttcttcgacgacaacatcctgctgaacagcagcggccccctgatcgagcacagcagcggcagcctgaccggcgagagaagcctgttctacgacagcggcgacggcttcggcgacgagggcgccgccggcgagatgatcgacaacctgctgcaggacgaccagaacatcctgctggaggacatgcacctgaacagagagatcagcctgcccagcgagccccccaacagcctggccgtggagcccgacaacagcgagtgcatctgcgtgcccgagaacgagaagatgaacgagaccatcctgctgagcaccgaggaggagggcttcaccctggaccccatcgacatcagcgacatcgccgagaagagaaagggcaagaagagaagactgctgatcgaccccatcaaggagctgagcagcaaggtgatccacaagcagctgaccagcttcgccgacaccctgatggtgctggagctggccccccccacccagagactgatgatgtggaagaagagaggcggcgtgcacaccctgctgagcaccgccgcccaggacctgatccacgccgagctgaagatgctgttcaccaagtgcttcctgagcagcggcttcaagctgggcagaaagatgatccagaaggagagcgtgagagaggaggtgggcaaccagaacatcgtggagaccagcatgatgcaggagcccaactaccagcaggagctgagcaagccccagacctggaaggacgtgatcggcggcagccagcacagcagccacgaggacaccaacaagaacatcaacagcgaggagagcctgagcaacgaggagaacatcgagaccgagagatggaacggcagaatcctgcagatgctgaacagactgagagtggccgaccagggccaggccgccgccgccgccaccgccgaggccctgagacaggccggccccgagtggtgcgagcccgccggcctgagaagagccagcggcctgagccccagagacaccgcccaccccaccccctacagcgacccccagccccacggccacgtgcccgccagaaagtag

SEQ ID NO: 9250 - DNA, 1566 bp, Artificial Sequence; identical to SEQ ID NO: 9249
  Description of Artificial Sequence: Synthetic coding sequence

SEQ ID NO: 9251 - DNA, 1671 bp, Artificial Sequence
  Description of Artificial Sequence: Synthetic coding sequence
atgttctacacccacgtgctgatgagcaagagaggccccctggccaagatctggctggccgcccactgggagaagaagctgaccaaggcccacgtgttcgagtgcaacctggagatcaccatcgagaagatcctgagccccaaggtgaagatcgccctgagaaccagcggccacctgctgctgggcgtggtgagaatctacaacagaaaggccaagtacctgctggccgactgcagcgaggccttcctgaagatgaagatgaccttctgccccggcctggtggacctgcccaaggagaacttcgaggccagctacaacgccatcaccctgcccgaggagttccacgacttcgacacccagaacatgaacgccatcgacgtgagcgagcacttcacccagaaccagagcagacccgaggagatcaccctgagagagaacttcgacaacgacctgatcttccaggccgagagcttcggcgaggagagcgagatcctgagaagacacagcttcttcgacgacaacatcctgctgaacagcagcggccccctgatcgagcacagcagcggcagcctgaccggcgagagaagcctgttctacgacagcggcgacggcttcggcgacgagggcgccgccggcgagatgatcgacaacctgctgcaggacgaccagaacatcctgctggaggacatgcacctgaacagagagatcagcctgcccagcgagccccccaacagcctggccgtggagcccgacaacagcgagtgcatctgcgtgcccgagaacgagaagatgaacgagaccatcctgctgagcaccgaggaggagggcttcaccctggaccccatcgacatcagcgacatcgccgagaagagaaagggcaagaagagaagactgctgatcgaccccatcaaggagctgagcagcaaggtgatccacaagcagctgaccagcttcgccgacaccctgatggtgctggagctggccccccccacccagagactgatgatgtggaagaagagaggcggcgtgcacaccctgctgagcaccgccgcccaggacctgatccacgccgagctgaagatgctgttcaccaagtgcttcctgagcagcggcttcaagctgggcagaaagatgatccagaaggagagcgtgagagaggaggtgggcaaccagaacatcgtggagaccagcatgatgcaggagcccaactaccagcaggagctgagcaagccccagacctggaaggacgtgatcggcggcagccagcacagcagccacgaggacaccaacaagaacatcaacagcgagcaggacatcgtggagatggtgagcctggccgccgaggagagcagcctgatgaacgacctgttcgcccaggagatcgagtacagccccgtggagctggagagcctgagcaacgaggagaacatcgagaccgagagatggaacggcagaatcctgcagatgctgaacagactgagagagagcaacaagatgggcatgcagagcttcagcctgatgaagctgtgcagaaacagcgacagaaagcaggccgccgccaagttctacagcttcctggtgctgaagaagcagctggccatcgagctgagccagagcgccccctacgccgacatcatcgccaccatgggccccatgttctacaacatctag

SEQ ID NO: 9252 - DNA, 3486 bp, Artificial Sequence
  Description of Artificial Sequence: Synthetic coding sequence
atgggcctgggcaagaccctgcaggtgatcagcttcatcgacgtgctgttcagacacacccccgccaagaccgtgctggccatcgtgcccgtgaacaccctgcagaactggctggccgagttcaacatgtggctgcccccccccgaggccctgcccgccgacaacaagcccgaggaggtgcagcccagattcttcaaggtgcacatcctgaacgacgagcacaagaccatggccagcagagccaaggtgatggccgactgggtgagcgagggcggcgtgctgctgatgggctacgagatgtacagactgctgaccctgaagaagagcttcgccaccggcagacccaagaagaccaagaagagaagccaccccgtgatcatcgacctggacgaggaggacagacagcaggagttcagaagagagttcgagaaggccctgtgcagacccggccccgacgtggtgatctgcgacgagggccacagaatcaagaactgccaggccagcaccagccaggccctgaagaacatcagaagcagaagaagagtggtgctgaccggctaccccctgcagaacaacctgatcgagtactggtgcatggtggacttcgtgagacccgacttcctgggcaccagacaggagttcagcaacatgttcgagagacccatcctgaacggccagtgcatcgacagcaccccccaggacgtgagactgatgagatacagaagccacgtgctgcacagcctgctggagggcttcgtgcagagaagaggccacaccgtgctgaagatccacctgcccgccaaggaggagaacgtgatcctggtgagactgagcaagatccagagagacctgtacacccagttcatggacagattcagagactgcggcagcagcggctggctgggcctgaaccccctgaaggccttctgcgtgtgctgcaagatctggaaccaccccgacgtgctgtacgaggccctgcagaaggagagcctggccaacgagcaggacctggacgtggaggagctgggcagcgccggcaccagcgccagatgccccccccagggcaccaagggcaagggcgaggacagcaccctggccagcagcatgggcgaggccaccaacagcaagttcctgcagggcgtgggcttcaaccccttccaggagagaggcaacaacatcgtgacctacgagtgggccaaggacctgctgaccaactaccagaccggcgtgctggagaacagccccaagatggtgctgctgttccacctgatcgaggagagcgtgaagctgggcgacaagatcctggtgttcagccagagcctgagcaccctggccctgatcgaggagttcctgggcaagagagaggtgccctgcccccccggcaccgagggccagggcgcccagaagtgggtgagaaacatcagctacttcagactggacggcagcacccccgccttcgagagagagagactgatcaaccagttcaacgaccccagcaacctgaccacctggctgttcctgctgagcaccagagccggctgcctgggcgtgaacctgatcggcgccaacagagtggtggtgttcgacgccagctggaacccctgccacgacgcccaggccgtgtgcagagtgtacagatacggccagaagaagccctgctacatctacagactggtggccgactacaccctggagaagaagatctacgacagacagatcagcaagcagggcatgagcgacagagtggtggacgacctgaaccccatgctgaacttcaccagaaaggaggtggagaacctgctgcacttcgtggagaaggagcccgccccccaggtgagcctgaacgtgaagggcatcaaggagagcgtgctgcagctggcctgcctgaagtacccccacctgatcaccaaggagcccttcgagcacgagagcctgctgctgaacagaaaggaccacaagctgaccaaggccgagaagaaggccgccaagaagagctacgaggaggacaagagaaccagcgtgccctacaccagacccagctacgcccagtactaccccgccagcgaccagagcctgaccagcatccccgccttcagccagagaaactggcagcccaccctgaagggcgacgagaagcccgtggccagcgtgagacccgtgcagagcacccccatccccatgatgcccagacacgtgcccctgggcggcagcgtgagcagcgccagcagcaccaaccccagcatgaacttccccatcaactacctgcagagagccggcgtgctggtgcagaaggtggtgaccaccaccgacatcgtgatccccggcctgaacagcagcaccgacgtgcaggccagaatcaacgccggcgagagcatccacatcatcagaggcaccaagggcacctacatcagaaccagcgacggcagaatcttcgccgtgagagccaccggcaagcccaaggtgcccgaggacggcagaatggccgccagcggcagccagggccccagctgcgagagcaccagcaacggcagacacagcgccagcagccccaaggcccccgaccccgagggcctggccagacccgtgagccccgacagccccgagatcatcagcgagctgcagcagtacgccgacgtggccgccgccagagagagcagacagagcagccccagcaccaacgccgccctgcccggcccccccgcccagctgatggacagcagcgccgtgcccggcaccgccctgggcaccgagcccagactgggcggccactgcctgaacagcagcctgctggtgaccggccagccctgcggcgacagacaccccgtgctggacctgagaggccacaagagaaagctggccaccccccccgccgcccaggagagcagcagaagaagaagcagaaagggccacctgcccgcccccgtgcagccctacgagcacggctaccccgtgagcggcggcttcgccatgccccccgtgagcctgaaccacaacctgaccacccccttcaccagccaggccggcgagaacagcctgttcatgggcagcacccccagctactaccagctgagcaacctgctggccgacgccagactggtgttccccgtgaccaccgaccccctggtgcccgccggccccgtgagcagcagcagcaccgccaccagcgtgaccgccagcaaccccagcttcatgctgaaccccagcgtgcccggcatcctgcccagctacagcctgcccttcagccagcccctgctgagcgagcccagaatgttcgcccccttccccagccccgtgctgcccagcaacctgagcagaggcatgagcatctaccccggctacatgagcccccacgccggctaccccgccggcggcctgctgagaagccaggtgccccccttcgacagccacgaggtggccgaggtgggcttcagcagcaacgacgacgaggacaaggacgacgacgtgatcgaggtgaccggcaagtag

SEQ ID NO: 9253 - DNA, 4404 bp, Artificial Sequence
  Description of Artificial Sequence: Synthetic coding sequence
atgagcgacgagagcgccagcggcagcgaccccgacctggaccccgacgtggagctggaggacgccgaggaggaggaggaggaggaggaggtggccgtggaggagtgcgacagagacgacgaggaggacctgctggacgaccccagcctggagggcatgtgcggcaccgagcacgcccagctgggcgaggacggccagcagccccccagatgcaccagcaccaccagcagccagagcgagcccagcgagcagctgagaagacaccagggcaagaacctggccagcgaggaccccaagaagaagagagcccagaagcccagccacatgagaagaaacatcagaaagctgctgagagaggaccagctggagcccgtgaccaaggccgcccagcaggaggagctggagagaagaaagagactggagcagcagagaaaggactacgccgcccccatccccaccgtgcccctggagttcctgcccgaggagatcgccctgagagccagcgacggcccccagctgccccccagagtgctggcccaggaggtgatctgcctggacagcagcagcggcagcgaggacgagaagagcagcagagacgaggtgatcgagctgagcagcggcgaggaggacaccctgcacatcgtggacagcagcgagagcgtgagcgaggacgacgaggaggaggagaagggcggcacccacgtgaacgacgtgctgaaccagagagacgccctgggcagagtgctggtgaacctgaaccacccccccgaggaggagaacgtgttcctggccccccagctggccagagccgtgaagccccaccagatcggcggcatcagattcctgtacgacaacctggtggagagcctggagagattcaagaccagcagcggcttcggctgcatcctggcccacagcatgggcctgggcaagaccctgcaggtgatcagcttcatcgacgtgctgttcagacacacccccgccaagaccgtgctggccatcgtgcccgtgaacaccctgcagaactggctggccgagttcaacatgtggctgcccccccccgaggccctgcccgccgacaacaagcccgaggaggtgcagcccagattcttcaaggtgcacatcctgaacgacgagcacaagaccatggccagcagagccaaggtgatggccgactgggtgagcgagggcggcgtgctgctgatgggctacgagatgtacagactgctgaccctgaagaagagcttcgccaccggcagacccaagaagaccaagaagagaagccaccccgtgatcatcgacctggacgaggaggacagacagcaggagttcagaagagagttcgagaaggccctgtgcagacccggccccgacgtggtgatctgcgacgagggccacagaatcaagaactgccaggccagcaccagccaggccctgaagaacatcagaagcagaagaagagtggtgctgaccggctaccccctgcagaacaacctgatcgagtactggtgcatggtggacttcgtgagacccgacttcctgggcaccagacaggagttcagcaacatgttcgagagacccatcctgaacggccagtgcatcgacagcaccccccaggacgtgagactgatgagatacagaagccacgtgctgcacagcctgctggagggcttcgtgcagagaagaggccacaccgtgctgaagatccacctgcccgccaaggaggagaacgtgatcctggtgagactgagcaagatccagagagacctgtacacccagttcatggacagattcagagactgcggcagcagcggctggctgggcctgaaccccctgaaggccttctgcgtgtgctgcaagatctggaaccaccccgacgtgctgtacgaggccctgcagaaggagagcctggccaacgagcaggacctggacgtggaggagctgggcagcgccggcaccagcgccagatgccccccccagggcaccaagggcaagggcgaggacagcaccctggccagcagcatgggcgaggccaccaacagcaagttcctgcagggcgtgggcttcaaccccttccaggagagaggcaacaacatcgtgacctacgagtgggccaaggacctgctgaccaactaccagaccggcgtgctggagaacagccccaagatggtgctgctgttccacctgatcgaggagagcgtgaagctgggcgacaagatcctggtgttcagccagagcctgagcaccctggccctgatcgaggagttcctgggcaagagagaggtgccctgcccccccggcaccgagggccagggcgcccagaagtgggtgagaaacatcagctacttcagactggacggcagcacccccgccttcgagagagagagactgatcaaccagttcaacgaccccagcaacctgaccacctggctgttcctgctgagcaccagagccggctgcctgggcgtgaacctgatcggcgccaacagagtggtggtgttcgacgccagctggaacccctgccacgacgcccaggccgtgtgcagagtgtacagatacggccagaagaagccctgctacatctacagactggtggccgactacaccctggagaagaagatctacgacagacagatcagcaagcagggcatgagcgacagagtggtggacgacctgaaccccatgctgaacttcaccagaaaggaggtggagaacctgctgcacttcgtggagaaggagcccgccccccaggtgagcctgaacgtgaagggcatcaaggagagcgtgctgcagctggcctgcctgaagtacccccacctgatcaccaaggagcccttcgagcacgagagcctgctgctgaacagaaaggaccacaagctgaccaaggccgagaagaaggccgccaagaagagctacgaggaggacaagagaaccagcgtgccctacaccagacccagctacgcccagtactaccccgccagcgaccagagcctgaccagcatccccgccttcagccagagaaactggcagcccaccctgaagggcgacgagaagcccgtggccagcgtgagacccgtgcagagcacccccatccccatgatgcccagacacgtgcccctgggcggcagcgtgagcagcgccagcagcaccaaccccagcatgaacttccccatcaactacctgcagagagccggcgtgctggtgcagaaggtggtgaccaccaccgacatcgtgatccccggcctgaacagcagcaccgacgtgcaggccagaatcaacgccggcgagagcatccacatcatcagaggcaccaagggcacctacatcagaaccagcgacggcagaatcttcgccgtgagagccaccggcaagcccaaggtgcccgaggacggcagaatggccgccagcggcagccagggccccagctgcgagagcaccagcaacggcagacacagcgccagcagccccaaggcccccgaccccgagggcctggccagacccgtgagccccgacagccccgagatcatcagcgagctgcagcagtacgccgacgtggccgccgccagagagagcagacagagcagccccagcaccaacgccgccctgcccggcccccccgcccagctgatggacagcagcgccgtgcccggcaccgccctgggcaccgagcccagactgggcggccactgcctgaacagcagcctgctggtgaccggccagccctgcggcgacagacaccccgtgctggacctgagaggccacaagagaaagctggccaccccccccgccgcccaggagagcagcagaagaagaagcagaaagggccacctgcccgcccccgtgcagccctacgagcacggctaccccgtgagcggcggcttcgccatgccccccgtgagcctgaaccacaacctgaccacccccttcaccagccaggccggcgagaacagcctgttcatgggcagcacccccagctactaccagctgagcaacctgctggccgacgccagactggtgttccccgtgaccaccgaccccctggtgcccgccggccccgtgagcagcagcagcaccgccaccagcgtgaccgccagcaaccccagcttcatgctgaaccccagcgtgcccggcatcctgcccagctacagcctgcccttcagccagcccctgctgagcgagcccagaatgttcgcccccttccccagccccgtgctgcccagcaacctgagcagaggcatgagcatctaccccggctacatgagcccccacgccggctaccccgccggcggcctgctgagaagccaggtgccccccttcgacagccacgaggtggccgaggtgggcttcagcagcaacgacgacgaggacaaggacgacgacgtgatcgaggtgaccggcaagtag

SEQ ID NO: 9254 - DNA, 675 bp, Artificial Sequence
  Description of Artificial Sequence: Synthetic coding sequence
atgccccccagaaagaagagaagacagcccagccagaaggcccccctgctgttccaccagcagcccctggagggccccaagcacagctgcgccagcacccagctgcccatcacccacaccagacaggtgagccccgacttcgacaccgccgccggcagcctgttccccgcctaccagaagcaccagaacagagccagacacagcagcagaaagcccaccaccagcaagttcccccacctgaccttcgagagcccccagagcagcagcagcgagaccctgggcatccccctgatcagagagtgccccagcgagagcgagaaggacgtgagcagaagacccctggtgcccgtgctgagcccccagagctgcggcaacatgagcgtgcaggccctgcagagcctgccctacgtgttcatcccccccgacatccagacccccgagagcagcagcgtgaaggaggagctgatcccccaggaccagaaggagaacagcctgctgagctgcaccctgcacaccggcacccccaacagccccgagcccggccccgtgctggtgaaggacacccccgaggacaagtacggcatcaaggtgacctggagaagaagacagcacctgctggcctacctgagagagagaggcaagctgagcagaagccagttcctggtgaagagctag

SEQ ID NO: 9255 - DNA, 1335 bp, Artificial Sequence
  Description of Artificial Sequence: Synthetic coding sequence
atgggcagcagcagactgagagtgttcgacccccacctggagagaaaggacagcgccgccgccctgagcgacagagagctgcccctgcccaccttcgacgtgccctacttcaagtacatcgacgaggaggacgaggacgacgagtggagcagcagaagccagagcagcaccgaggacgacagcgtggacagcctgctgagcgacagatacgtggtggtgagcggcacccccgagaagatcctggagcacctgctgaacgacctgcacctggaggaggtgcaggacaaggagaccgagaccctgctggacgacttcctgctgacctacaccgtgttcatgaccaccgacgacctgtgccaggccctgctgagaatctacagcgccaagaagtaccagggcaaggaggagaacagcgacgtgcccagaagaaagagaaaggtgctgcacctggtgagccagtggatcgccctgtacaaggactggctgcccgaggacgagcacagcaagatgttcctgaagaccatctacagaaacgtgctggacgacgtgtacgagtaccccatcctggagaaggagctgaaggagttccagaagatcctgggcatgcacagaagacacaccgtggacgagtacagcccccagaagaagaacaaggccctgttccaccagttcagcctgaaggagaactggctgcagcacagaggcaccgtgaccgagaccgaggagatcttctgccacgtgtacatcaccgagcacagctacgtgagcgtgaaggccaaggtgagcagcatcgcccaggagatcctgctgtgcagccagctgggcaagagagtgcagctggtgaagaagttcatcaagatcgccgcccactgcaaggcccagagaaacctgaacagcttcttcgccatcgtgatgggcctgaacaccgccagcgtgagcagactgagccagacctgggagaagatccccggcaagttcaagaagctgttcagcgagctggagagcctgaccgaccccagcctgaaccacaaggcctacagagacgccttcaagaagatgaagccccccaagatccccttcatgcccctgctgctgaaggacgtgaccttcatccacgagggcaacaagaccttcctggacaacctggtgaacttcgagaagctgcacatgatcgccgacaccgtgagaaccctgagacactgcagaaccaaccagttcggcgacctgagccccaaggagcaccaggagctgaagagctacgtgaaccacctgtacgtgatcgacagccagcaggccctgttcgagctgagccacagaatcgagcccagagtgtag

SEQ ID NO: 9256 - DNA, 2193 bp, Artificial Sequence
  Description of Artificial Sequence: Synthetic coding sequence
atggccatcggcgtgtggcagctgctgctggacatgggcatcatgctgagcgtggaccagcacctgtacttccaggacacctacgtgttctaccagttcagcagcgacgagtgcagctacctgtactgcgagttcgagagagaggaggagtggcagaacggcgtgaagctgctgctgcagctggtgcccctgatccccgccagaggcggcatctgcgagctgagccaccagaagatcgaggacagcgaggagagcagcgacgagatcctggtgagactgaccagcgccgtgcagagagagctggccgccgtgatcgccctgaaggccagaaagagcgccatcgagcaggacgaggagaacaacgacaagcacgtggccgtgaccgaggccgagagcgtgcccgacagccaggccggcgtgatgtgcaagctgcaggagagagacgagatcggcagaatcgagctggtgcagaagctggccaaggagaactaccagttcctgcagaccgacaagaaggagcaggagaagagcgagcaccaggacgacgaggtgaccaccgtgcaggtgaaggagcaggaccagagcgtgctggtgctgaagaaggtgcagtgctgcggccccgcccccaccgccggcagcgccgagagccactggagatacgtggtggtgagcggcacccccgagaagatcctggagcacctgctgaacgacctgcacctggaggaggtgcaggacaaggagaccgagaccctgctggacgacttcctgctgacctacaccgtgttcatgaccaccgacgacctgtgccaggccctgctgagacactacagcgccaagaagtaccagggcaaggaggagaacagcgacgtgcccagaagaaagagaaaggtgctgcacctggtgagccagtggatcgccctgtacaaggactggctgcccgaggacgagcacagcaagatgttcctgaagaccatctacagaaacgtgctggacgacgtgtacgagtaccccatcctggagaaggagctgaaggagttccagaagatcctgggcatgcacagaagacacaccgtggacgagtacagcccccagaagaagaacaaggccctgttccaccagttcagcctgaaggagaactggctgcagcacagaggcaccgtgaccgagaccgaggagatcttctgccacgtgtacatcaccgagcacagctacgtgagcgtgaaggccaaggtgagcagcatcgcccaggagatcctgaaggtggtggccgagaagatccagtacgccgaggaggacctggccctggtggccatcaccttcagcggcgagaagcacgagctgcagcccaacgacctggtgatcagcaagagcctggaggccagcggcagaatctacgtgtacagaaaggacctggccgacaccctgaaccccttcgccgagaacgaggagagccagcagagaagcatgagaatcctgggcatgaacacctgggacctggccctggagctgatgaacttcgactggagcctgttcaacagcatccacgagcaggagctgatctacttcaccttcagcagacagggcagcggcgagcacaccgccaacctgagcctgctgctgcagagatgcaacgaggtgcagctgtgggtggccaccgagatcctgctgtgcagccagctgggcaagagagtgcagctggtgaagaagttcatcaagatcgccgcccactgcaaggcccagagaaacctgaacagcttcttcgccatcgtgatgggcctgaacaccgccagcgtgagcagactgagccagacctgggagaagatccccggcaagttcaagaagctgttcagcgagctggagagcctgaccgaccccagcctgaaccacaaggcctacagagacgccttcaagaagatgaagccccccaagatccccttcatgcccctgctgctgaaggacgtgaccttcatccacgagggcaacaagaccttcctggacaacctggtgaacttcgagaagctgcacatgatcgccgacaccgtgagaaccctgagacactgcagaaccaaccagttcggcgacctgagccccaaggagcaccaggagctgaagagctacgtgaaccacctgtacgtgatcgacagccagcaggccctgttcgagctgagccacagaatcgagcccagagtgtag

SEQ ID NO: 9257 - DNA, 1743 bp, Artificial Sequence
  Description of Artificial Sequence: Synthetic coding sequence
atgggcagcagcagactgagagtgttcgacccccacctggagagaaaggacagcgccgccgccctgagcgacagagagctgcccctgcccaccttcgacgtgccctacttcaagtacatcgacgaggaggacgaggacgacgagtggagcagcagaagccagagcagcaccgaggacgacagcgtggacagcctgctgagcgacagatacgtggtggtgagcggcacccccgagaagatcctggagcacctgctgaacgacctgcacctggaggaggtgcaggacaaggagaccgagaccctgctggacgacttcctgctgacctacaccgtgttcatgaccaccgacgacctgtgccaggccctgctgagacactacagcgccaagaagtaccagggcaaggaggagaacagcgacgtgcccagaagaaagagaaaggtgctgcacctggtgagccagtggatcgccctgtacaaggactggctgcccgaggacgagcacagcaagatgttcctgaagaccatctacagaaacgtgctggacgacgtgtacgagtaccccatcctggagaaggagctgaaggagttccagaagatcctgggcatgcacagaagacacaccgtggacgagtacagcccccagaagaagaacaaggccctgttccaccagttcagcctgaaggagaactggctgcagcacagaggcaccgtgaccgagaccgaggagatcttctgccacgtgtacatcaccgagcacagctacgtgagcgtgaaggccaaggtgagcagcatcgcccaggagatcctgaaggtggtggccgagaagatccagtacgccgaggaggacctggccctggtggccatcaccttcagcggcgagaagcacgagctgcagcccaacgacctggtgatcagcaagagcctggaggccagcggcagaatctacgtgtacagaaaggacctggccgacaccctgaaccccttcgccgagaacgaggagagccagcagagaagcatgagaatcctgggcatgaacacctgggacctggccctggagctgatgaacttcgactggagcctgttcaacagcatccacgagcaggagctgatctacttcaccttcagcagacagggcagcggcgagcacaccgccaacctgagcctgctgctgcagagatgcaacgaggtgcagctgtgggtggccaccgagatcctgctgtgcagccagctgggcaagagagtgcagctggtgaagaagttcatcaagatcgccgcccactgcaaggcccagagaaacctgaacagcttcttcgccatcgtgatgggcctgaacaccgccagcgtgagcagactgagccagacctgggagaagatccccggcaagttcaagaagctgttcagcgagctggagagcctgaccgaccccagcctgaaccacaaggcctacagagacgccttcaagaagatgaagccccccaagatccccttcatgcccctgctgctgaaggacgtgaccttcatccacgagggcaacaagaccttcctggacaacctggtgaacttcgagaagctgcacatgatcgccgacaccgtgagaaccctgagacactgcagaaccaaccagttcggcgacctgagccccaaggagcaccaggagctgaagagctacgtgaaccacctgtacgtgatcgacagccagcaggccctgttcgagctgagccacagaatcgagcccagagtgtag

SEQ ID NO: 9258 - DNA, 1749 bp, Artificial Sequence
  Description of Artificial Sequence: Synthetic coding sequence
atgggcagcagcagactgagagtgttcgacccccacctggagagaaaggacagcgccgccgccctgagcgacagagagctgcccctgcccaccttcgacgtgccctacttcaagtacatcgacgaggaggacgaggacgacgagtggagcagcagaagccagagcagcaccgaggacgacagcgtggacagcctgctgagcgacagatacgtggtggtgagcggcacccccgagaagatcctggagcacctgctgaacgacctgcacctggaggaggtgcaggacaaggagaccgagaccctgctggacgacttcctgctgacctacaccgtgttcatgaccaccgacgacctgtgccaggccctgctgagaatctacagcgccaagaagtaccagggcaaggaggagaacagcgacgtgcccagaagaaagagaaaggtgctgcacctggtgagccagtggatcgccctgtacaaggactggctgcccgaggacgagcacagcaagatgttcctgaagaccatctacagaaacgtgctggacgacgtgtacgagtaccccatcctggagaaggagctgaaggagttccagaagatcctgggcatgcacagaagacacaccgtggacgagtacagcccccagaagaagaacaaggccctgttccaccagttcagcctgaaggagaactggctgcagcacagaggcaccgtgaccgagaccgaggagatcttctgccacgtgtacatcaccgagcacagctacgtgagcgtgaaggccaaggtgagcagcatcgcccaggagatcctgaaggtggtggccgagaagatccagtacgccgaggaggacctggccctggtggccatcaccttcagcggcgacaaggagaagcacgagctgcagcccaacgacctggtgatcagcaagagcctggaggccagcggcagaatctacgtgtacagaaaggacctggccgacaccctgaaccccttcgccgagaacgaggagagccagcagagaagcatgagaatcctgggcatgaacacctgggacctggccctggagctgatgaacttcgactggagcctgttcaacagcatccacgagcaggagctgatctacttcaccttcagcagacagggcagcggcgagcacaccgccaacctgagcctgctgctgcagagatgcaacgaggtgcagctgtgggtggccaccgagatcctgctgtgcagccagctgggcaagagagtgcagctggtgaagaagttcatcaagatcgccgcccactgcaaggcccagagaaacctgaacagcttcttcgccatcgtgatgggcctgaacaccgccagcgtgagcagactgagccagacctgggagaagatccccggcaagttcaagaagctgttcagcgagctggagagcctgaccgaccccagcctgaaccacaaggcctacagagacgccttcaagaagatgaagccccccaagatccccttcatgcccctgctgctgaaggacgtgaccttcatccacgagggcaacaagaccttcctggacaacctggtgaacttcgagaagctgcacatgatcgccgacaccgtgagaaccctgagacactgcagaaccaaccagttcggcgacctgagccccaaggagcaccaggagctgaagagctacgtgaaccacctgtacgtgatcgacagccagcaggccctgttcgagctgagccacagaatcgagcccagagtgtag

SEQ ID NO: 9259 - DNA, 1122 bp, Artificial Sequence
  Description of Artificial Sequence: Synthetic coding sequence
atgctgctgggcctggccgccatggagctgaaggtgtgggtggacggcatccagagagtggtgtgcggcgtgagcgagcagaccacctgccaggaggtggtgatcgccctggcccaggccatcggccagaccggcagattcgtgctggtgcagagactgagagagaaggagagacagctgctgccccaggagtgccccgtgggcgcccaggccacctgcggccagttcgccagcgacgtgcagttcgtgctgagaagaaccggccccagcctggccggcagacccagcagcgacagctgccccccccccgagagatgcctgatcagagccagcctgcccgtgaagcccagagccgccctgggctgcgagcccagaaagaccctgacccccgagcccgcccccagcctgagcagacccggccccgccgcccccgtgacccccacccccggctgctgcaccgacctgagaggcctggagctgagagtgcagagaaacgccgaggagctgggccacgaggccttctgggagcaggagctgagaagagagcaggccagagagagagagggccaggccagactgcaggccctgagcgccgccaccgccgagcacgccgccagactgcaggccctggacgcccaggccagagccctggaggccgagctgcagctggccgccgaggcccccggcccccccagccccatggccagcgccaccgagagactgcaccaggacctggccgtgcaggagagacagagcgccgaggtgcagggcagcctggccctggtgagcagagccctggaggccgccgagagagccctgcaggcccaggcccaggagctggaggagctgaacagagagctgagacagtgcaacctgcagcagttcatccagcagaccggcgccgccctgccccccccccccagacccgacagaggcccccccggcacccagggccccctgccccccgccagagaggagagcctgctgggcgcccccagcgagagccacgccggcgcccagcccagacccagaggcggcccccacgacgccgagctgctggaggtggccgccgcccccgcccccgagtggtgccccctggccgcccagccccaggccctgtag

SEQ ID NO: 9260 - DNA, 1014 bp, Artificial Sequence
  Description of Artificial Sequence: Synthetic coding sequence
atgctgctgggcctggccgccatggagctgaaggtgtgggtggacggcatccagagagtggtgtgcggcgtgagcgagcagaccacctgccaggaggtggtgatcgccctggcccaggccatcggccagaccggcagattcgtgctggtgcagagactgagagagaaggagagacagctgctgccccaggagtgccccgtgggcgcccaggccacctgcggccagttcgccagcgacgtgcagttcgtgctgagaagaaccggccccagcctggccggcagacccagcagcgacagctgccccccccccgagagatgcctgatcagagccagcctgcccgtgaagcccagagccgccctgggctgcgagcccagaaagaccctgacccccgagcccgcccccagcctgagcagacccggccccgccgcccccgtgacccccacccccggctgctgcaccgacctgagaggcctggagctgagagtgcagagaaacgccgaggagctgggccacgaggccttctgggagcaggagctgagaagagagcaggccagagagagagagggccaggccagactgcaggccctgagcgccgccaccgccgagcacgccgccagactgcaggccctggacgcccaggccagagccctggaggccgagctgcagctggccgccgaggcccccggcccccccagccccatggccagcgccaccgagagactgcaccaggacctggccgtgcaggagagacagagcgccgaggtgcagggcagcctggccctggtgagcagagccctggaggccgccgagagagccctgcaggcccaggcccaggagctggaggagctgaacagagagctgagacagtgcaacctgcagcagttcatccagcagaccggcgccgccctgccccccccccccagacccgacagaggcccccccggcacccaggtgggcgtggtgctgggcggcggctgggaggtgagaacctggcccagccccacccccagctag

SEQ ID NO: 9261 - DNA, 1122 bp, Artificial Sequence; identical to SEQ ID NO: 9259
  Description of Artificial Sequence: Synthetic coding sequence

SEQ ID NO: 9262 - DNA, 1014 bp, Artificial Sequence; identical to SEQ ID NO: 9260
  Description of Artificial Sequence: Synthetic coding sequence

SEQ ID NO: 9263 - DNA, 963 bp, Artificial Sequence
  Description of Artificial Sequence: Synthetic coding sequence
atgctgctgggcctggccgccatggagctgaaggtgtgggtggacggcatccagagagtggtgtgcggcgtgagcgagcagaccacctgccaggaggtggtgatcgccctggcccaggccatcggccagaccggcagattcgtgctggtgcagagactgagagagaaggagagacagctgctgccccaggagtgccccgtgggcgcccaggccacctgcggccagttcgccagcgacgtgcagttcgtgctgagaagaaccggccccagcctggccggcagacccagcagcgacagctgccccccccccgagagatgcctgatcagagccagcctgcccgtgaagcccagagccgccctgggctgcgagcccagaaagaccctgacccccgagcccgcccccagcctgagcagacccggccccgccgcccccgtgacccccacccccggctgctgcaccgacctgagaggcctggagctgagagtgcagagaaacgccgaggagctgggccacgaggccttctgggagcaggagctgagaagagagcaggccagagagagagagggccaggccagactgcaggccctgagcgccgccaccgccgagcacgccgccagactgcaggccctggacgcccaggccagagccctggaggccgagctgcagctggccgccgaggcccccggcccccccagccccatggccagcgccaccgagagactgcaccaggacctggccgtgcaggagagacagagcgccgaggtgcagggcagcctggccctggtgagcagagccctggaggccgccgagagagccctgcaggcccaggcccaggagctggaggagctgaacagagagctgagacagtgcaacctgcagcagttcatccagcagaccggcgccgccctgccccccccccccagacccgacagaggcccccccggcacccagtggcccccctag

SEQ ID NO: 9264 - DNA, 255 bp, Artificial Sequence
  Description of Artificial Sequence: Synthetic coding sequence
atgctgctgggcctggccgccatggagctgaaggtgtgggtggacggcatccagagagtggtgtgcggcgtgagcgagcagaccacctgccaggaggtggtgatcgccctggcccaggccatcggccagaccggcagattcgtgctggtgcagagactgagagagaaggagagacagctgctgccccaggagtgccccgtgggcgcccaggccacctgcggccagttcgccagcgacgtgcagttcgtgctgtag

SEQ ID NO: 9265 - DNA, 2145 bp, Artificial Sequence
  Description of Artificial Sequence: Synthetic coding sequence
atgaacaccctgcagggccccgtgagcttcaaggacgtggccgtggacttcacccaggaggagtggcagcagctggaccccgacgagaagatcacctacagagacgtgatgctggagaactacagccacctggtgagcgtgggctacgacaccaccaagcccaacgtgatcatcaagctggagcagggcgaggagccctggatcatgggcggcgagttcccctgccagcacagccccgaggcctggagagtggacgacctgatcgagagaatccaggagaacgaggacaagcacagcagacaggccgcctgcatcaacagcaagaccctgaccgaggagaaggagaacaccttcagccagatctacatggagaccagcctggtgcccagcagcatcatcgcccacaactgcgtgagctgcggcaagaacctggagagcatcagccagctgatcagcagcgacggcagctacgccagaaccaagcccgacgagtgcaacgagtgcggcaagacctaccacggcgagaagatgtgcgagttcaaccagaacggcgacacctacagccacaacgaggagaacatcctgcagaagatcagcatcctggagaagcccttcgagtacaacgagtgcatggaggccctggacaacgaggccgtgttcatcgcccacaagagagcctacatcggcgagaagccctacgagtggaacgacagcggccccgacttcatccagatgagcaacttcaacgcctaccagagaagccagatggagatgaagcccttcgagtgcagcgagtgcggcaagagcttctgcaagaagagcaagttcatcatccaccagagagcccacaccggcgagaagccctacgagtgcaacgtgtgcggcaagagcttcagccagaagggcaccctgaccgtgcacagaagaagccacctggaggagaagccctacaagtgcaacgagtgcggcaagaccttctgccagaagctgcacctgacccagcacctgagaacccacagcggcgagaagccctacgagtgcagcgagtgcggcaagaccttctgccagaagacccacctgaccctgcaccagagaaaccacagcggcgagagaccctacccctgcaacgagtgcggcaagagcttcagcagaaagagcgccctgagcgaccaccagagaacccacaccggcgagaagctgtacaagtgcaacgagtgcggcaagagctactacagaaagagcaccctgatcacccaccagagaacccacaccggcgagaagccctaccagtgcagcgagtgcggcaagttcttcagcagagtgagctacctgaccatccactacagaagccacctggaggagaagccctacgagtgcaacgagtgcggcaagaccttcaacctgaacagcgccttcatcagacacagaaaggtgcacaccgaggagaagagccacgagtgcagcgagtgcggcaagttcagccagctgtacctgaccgaccaccacaccgcccacctggaggagaagccctacgagtgcaacgagtgcggcaagaccttcctggtgaacagcgccttcgacggccaccagcccctgcccaagggcgagaagagctacgagtgcaacgtgtgcggcaagctgttcaacgagctgagctactacaccgagcactacagaagccacagcgaggagaagccctacggctgcagcgagtgcggcaagaccttcagccacaacagcagcctgttcagacaccagagagtgcacaccggcgagaagccctacgagtgctacgagtgcggcaagttcttcagccagaagagctacctgaccatccaccacagaatccacagcggcgagaagccctacgagtgcagcaagtgcggcaaggtgttcagcagaatgagcaacctgaccgtgcactacagaagccacagcggcgagaagccctacgagtgcaacgagtgcggcaaggtgttcagccagaagagctacctgaccgtgcactacagaacccacagcggcgagaagccctacgagtgcaacgagtgcggcaagaagttccaccacagaagcgccttcaacagccaccagagaatccacagaagaggcaacatgaacgtgctggacgtggagaacctgtag

SEQ ID NO: 9266 - DNA, 2145 bp, Artificial Sequence; identical to SEQ ID NO: 9265
  Description of Artificial Sequence: Synthetic coding sequence

SEQ ID NO: 9267 - DNA, 732 bp, Artificial Sequence
  Description of Artificial Sequence: Synthetic coding sequence
atgaacaccctgcagggccccgtgagcttcaaggacgtggccgtggacttcacccaggaggagtggcagcagctggaccccgacgagaagatcacctacagagacgtgatgctggagaactacagccacctggtgagcgtgggctacgacaccaccaagcccaacgtgatcatcaagctggagcagggcgaggagccctggatcatgggcggcgagttcccctgccagcacagccccgaggcctggagagtggacgacctgatcgagagaatccaggagaacgaggacaagcacagcagcagacccgccagaagaccctgcggccccagatgctgctgctgctgctgctgcagcagaccccccagaagccccccccccaagcccctgcccaccagaatgctgacccccagaaaggccttcagaacctgcagcaaggagagcggcctggccgagaccgagagctgcggccagacccacacctggcccagagccctggccgtgctgatgggcctgtggtggcccagagaccagaaggccggcgaggaggacctgagattcagagagagaagacccggcctgcaggccaccgccaccggcagcggcgagcacggcgccttccccgtgcacagccagggcgtgtgggccagcacccactggcagggcaccgccgtgtgccccctgcagacccccccccccgacgccttcatcagaaacaacaaggtgctgagctag

SEQ ID NO: 9268 - DNA, 342 bp, Artificial Sequence
  Description of Artificial Sequence: Synthetic coding sequence
atgaacaccctgcagggccccgtgagcttcaaggacgtggccgtggacttcacccaggaggagtggcagcagctggaccccgacgagaagatcacctacagagacgtgatgctggagaactacagccacctggtgagcgtgggctacgacaccaccaagcccaacgtgatcatcaagctggagcagggcgaggagccctggatcatgggcggcgagttcccctgccagcacagccccgccgccctgcccgccggccacgtggcccccgccgtggccgccgccgccgccgcccccggcagacccggcccccacagacagagcagaagcccccccggctgctag

SEQ ID NO: 9269 - DNA, 1554 bp, Artificial Sequence
  Description of Artificial Sequence: Synthetic coding sequence
atggaccccgccggcgccgccgaccccagcgtgccccccaaccccctgacccacctgagcctgcaggacagaagcgagatgcagctgcagagcgaggccgacagaagaagcctgcccggcacctggaccagaagcagccccgagcacaccaccatcctgagaggcggcgtgagaagatgcctgcagcagcagtgcgagcagaccgtgagaatcctgcacgccaaggtggcccagaagagctacggcaacgagaagagattcttctgcccccccccctgcgtgtacctgagcggccccggctggagagtgaagcccggccaggaccaggcccaccaggccggcgagaccggccccaccgtgtgcggctacatgggcctggacagcgccagcggcagcgccaccgagacccagaagctgaacttcgagcagcagcccgacagcagagagttcggctgcgccaagaccctgtacatcagcgacgccgacaagagaaagcacttcagactggtgctgagactggtgctgagaggcggcagagagctgggcaccttccacagcagactgatcaaggtgatcagcaagcccagccagaagaagcagagcctgaagaacaccgacctgtgcatcagcagcggcagcaaggtgagcctgttcaacagactgagaagccagaccgtgagcaccagatacctgagcgtggaggacggcgccttcgtggccagcgccagacagtgggccgccttcaccctgcacctggccgacggccacagcgcccagggcgacttcccccccagagagggctacgtgagatacggcagcctggtgcagctggtgtgcaccgtgaccggcatcaccctgccccccatgatcatcagaaaggtggccaagcagtgcgccctgctggacgtggacgagcccatcagccagctgcacaagtgcgccttccagttccccggcagcccccccggcggcggcggcacctacctgtgcctggccaccgagaaggtggtgcagttccaggccagcccctgccccaaggaggccaacagagccctgctgaacgacagcagctgctggaccatcatcggcaccgagagcgtggagttcagcttcagcaccagcctggcctgcaccctggagcccgtgacccccgtgcccctgatcagcaccctggagctgagcggcggcggcgacgtggccaccctggagctgcacggcgagaacttccacgccggcctgaaggtgtggttcggcgacgtggaggccgagaccatgtacagaagccccagaagcctggtgtgcgtggtgcccgacgtggccgccttctgcagcgactggagatggctgagagcccccatcaccatccccatgagcctggtgagagccgacggcctgttctaccccagcgccttcagcttcacctacacccccgagtacagcgtgagacccggccaccccggcgtgcccgagcccgccaccgacgccgacgccctgctggagagcatccaccaggagttcaccagaaccaacttccacctgttcatccagacctag

SEQ ID NO: 9270 - DNA, 1416 bp, Artificial Sequence
  Description of Artificial Sequence: Synthetic coding sequence
atggaccccgccggcgccgccgaccccagcgtgccccccaaccccctgacccacctgagcctgcaggacagaagcgagatgcagctgcagagcgaggccgacagaagaagcctgcccggcacctggaccagaagcagccccgagcacaccaccatcctgagaggcggcgtgagaagatgcctgcagcagcagtgcgagcagaccgtgagaatcctgcacgccaaggtggcccagaagagctacggcaacgagaagagattcttctgcccccccccctgcgtgtacctgagcggccccggctggagagtgaagcccggccaggaccaggcccaccaggccggcgagaccggccccaccgtgtgcggctacatgggcctggacagcgccagcggcagcgccaccgagacccagaagctgaacttcgagcagcagcccgacagcagagagttcggctgcgccaagaccctgtacatcagcgacgccgacaagagaaagcacttcagactggtgctgagactggtgctgagaggcggcagagagctgggcaccttccacagcagactgatcaaggtgatcagcaagcccagccagaagaagcagagcctgaagaacaccgacctgtgcatcagcagcggcagcaaggtgagcctgttcaacagactgagaagccagaccgtgagcaccagatacctgagcgtggaggacggcgccttcgtggccagcgccagacagtgggccgccttcaccctgcacctggccgacggccacagcgcccagggcgacttcccccccagagagggctacgtgagatacggcagcctggtgcagctggtgtgcaccgtgaccggcatcaccctgccccccatgatcatcagaaaggtggccaagcagtgcgccctgctggacgtggacgagcccatcagccagctgcacaagtgcgccttccagttccccggcagcccccccggcggcggcggcacctacctgtgcctggccaccgagaaggtggtgcagttccaggccagcccctgccccaaggaggccaacagagccctgctgaacgacagcagctgctggaccatcatcggcaccgagagcgtggagttcagcttcagcaccagcctggcctgcaccctggagcccgtgacccccgtgcccctgatcagcaccctggagctgagcggcggcggcgacgtggccaccctggagctgcacggcgagaacttccacgccggcctgaaggtgtggttcggcgacgtggaggccgagaccatgtacagatacggcgtggagcccgccgtgcccggcgtgagaggcgccggcagaggcggcctgctgcagagactggccctggccgccagaagccaccacaacccccacgagcccggcgccagaagaagagccctgctgccctag

SEQ ID NO: 9271 - DNA, 1551 bp, Artificial Sequence
  Description of Artificial Sequence: Synthetic coding sequence
atggaccccgccggcgccgccgaccccagcgtgccccccaaccccctgacccacctgagcctgcaggacagaagcgagatgcagctgcagagcgaggccgacagaagaagcctgcccggcacctggaccagaagcagccccgagcacaccaccatcctgagaggcggcgtgagaagatgcctgcagcagcagtgcgagcagaccgtgagaatcctgcacgccaaggtggcccagaagagctacggcaacgagaagagattcttctgcccccccccctgcgtgtacctgagcggccccggctggagagtgaagcccggccaggaccaggcccaccaggccggcgagaccggccccaccgtgtgcggctacatgggcctggacagcgccagcggcagcgccaccgagacccagaagctgaacttcgagcagcagcccgacagcagagagttcggctgcgccaagaccctgtacatcagcgacgccgacaagagaaagcacttcagactggtgctgagactggtgctgagaggcggcagagagctgggcaccttccacagcagactgatcaaggtgatcagcaagcccagccagaagaagcagagcctgaagaacaccgacctgtgcatcagcagcggcagcaaggtgagcctgttcaacagactgagaagccagaccgtgagcaccagatacctgagcgtggaggacggcgccttcgtggccagcgccagacagtgggccgccttcaccctgcacctggccgacggccacagcgcccagggcgacttcccccccagagagggctacgtgagatacggcagcctggtgcagctggtgtgcaccgtgaccggcatcaccctgccccccatgatcatcagaaaggtggccaagcagtgcgccctgctggacgtggacgagcccatcagccagctgcacaagtgcgccttccagttccccggcagcccccccggcggcggcggcacctacctgtgcctggccaccgagaaggtggtgcagttccaggccagcccctgccccaaggaggccaacagagccctgctgaacgacagcagctgctggaccatcatcggcaccgagagcgtggagttcagcttcagcaccagcctggcctgcaccctggagcccgtgacccccgtgcccctgatcagcaccctggagctgagcggcggcggcgacgtggccaccctggagctgcacggcgagaacttccacgccggcctgaaggtgtggttcggcgacgtggaggccgagaccatgtacagccccagaagcctggtgtgcgtggtgcccgacgtggccgccttctgcagcgactggagatggctgagagcccccatcaccatccccatgagcctggtgagagccgacggcctgttctaccccagcgccttcagcttcacctacacccccgagtacagcgtgagacccggccaccccggcgtgcccgagcccgccaccgacgccgacgccctgctggagagcatccaccaggagttcaccagaaccaacttccacctgttcatccagacctag

SEQ ID NO: 9272 - DNA, 2124 bp, Artificial Sequence
  Description of Artificial Sequence: Synthetic coding sequence
atgcagaccagcgagaccggcagcgacaccggcagcaccgtgaccctgcagaccagcgtggccagccaggccgccgtgcccacccaggtggtgcagcaggtgcccgtgcagcagcaggtgcagcaggtgcagaccgtgcagcaggtgcagcacgtgtaccccgcccaggtgcagtacgtggagggcagcgacaccgtgtacaccaacggcgccatcagaaccaccacctacccctacaccgagacccagatgtacagccagaacaccggcggcaactacttcgacacccagggcagcagcgcccaggtgaccaccgtggtgagcagccacagcatggtgggcaccggcggcatccagatgggcgtgaccggcggccagctgatcagcagcagcggcggcacctacctgatcggcaacagcatggagaacagcggccacagcgtgacccacaccaccagagccagccccgccaccatcgagatggccatcgagaccctgcagaagagcgacggcctgagcacccacagaagcagcctgctgaacagccacctgcagtggctgctggacaactacgagaccgccgagggcgtgagcctgcccagaagcaccctgtacaaccactacctgagacactgccaggagcacaagctggaccccgtgaacgccgccagcttcggcaagctgatcagaagcatcttcatgggcctgagaaccagaagactgggcaccagaggcaacagcaagtaccactactacggcatcagagtgaagcccgacagccccctgaacagactgcaggaggacatgcagtacatggccatgagacagcagcccatgcagcagaagcagagatacaagcccatgcagaaggtggacggcgtggccgacggcttcaccggcagcggccagcagaccggcaccagcgtggagcagaccgtgatcgcccagagccagcaccaccagcagttcctggacgccagcagagccctgcccgagttcggcgaggtggagatcagcagcctgcccgacggcaccaccttcgaggacatcaagagcctgcagagcctgtacagagagcactgcgaggccatcctggacgtggtggtgaacctgcagttcagcctgatcgagaagctgtggcagaccttctggagatacagccccagcacccccaccgacggcaccaccatcaccgagagcagcaacctgagcgagatcgagagcagactgcccaaggccaagctgatcaccctgtgcaagcacgagagcatcctgaagtggatgtgcaactgcgaccacggcatgtaccaggccctggtggagatcctgatccccgacgtgctgagacccatccccagcgccctgacccaggccatcagaaacttcgccaagagcctggagggctggctgagcaacgccatgaacaacatcccccagagaatgatccagaccaaggtggccgccgtgagcgccttcgcccagaccctgagaagatacaccagcctgaaccacctggcccaggccgccagagccgtgctgcagaacaccagccagatcaaccagatgctgagcgacctgaacagagtggacttcgccaacgtgcaggagcaggccagctgggtgtgccagtgcgacgacaacatggtgcagagactggagaccgacttcaagatgaccctgcagcagcagagcaccctggagcagtgggccgcctggctggacaacgtgatgatgcaggccctgaagccctacgagggcagacccagcttccccaaggccgccagacagttcctgctgaagtggagcttctacagcagcatggtgatcagagacctgaccctgagaagcgccgccagcttcggcagcttccacctgatcagactgctgtacgacgagtacatgttctacctggtggagcacagagtggcccaggccaccggcgagacccccatcgccgtgatgggcgaggtgagagaggccgagagagccgtgacccactgggtgatcaagaacaagcccgagctgcacttcagcctgaacaccctgctgatcaagaccatggtgcccaaccaggtgagcctgagagccagaagagactgcggcgtgatcgccagagtgccctag

SEQ ID NO: 9273 - DNA, 2124 bp, Artificial Sequence; identical to SEQ ID NO: 9272
  Description of Artificial Sequence: Synthetic coding sequence

SEQ ID NO: 9274 - DNA, 258 bp, Artificial Sequence
  Description of Artificial Sequence: Synthetic coding sequence
atgcagaccagcgagaccggcagcgacaccggcagcaccgtgaccctgcagaccagcgtggccagccaggccgccgtgcccacccaggtggtgcagcaggtgcccgtgcagcagcaggtgcagcaggtgcagaccgtgcagcaggtgcagcacgtgtaccccgcccaggtgcagtacgtggagggcagcgacaccgtgtacaccaacggcgccatgagcagagccccctggagcatgatcctggagagcagcccctag

SEQ ID NO: 9275 - DNA, 588 bp, Artificial Sequence
  Description of Artificial Sequence: Synthetic coding sequence
atgcagaccagcgagaccggcagcgacaccggcagcaccgtgaccctgcagaccagcgtggccagccaggccgccgtgcccacccaggtggtgcagcaggtgcccgtgcagcagcaggtgcagcaggtgcagaccgtgcagcaggtgcagcacgtgtaccccgcccaggtgcagtacgtggagggcagcgacaccgtgtacaccaacggcgccatcagaaccaccacctacccctacaccgagacccagatgtacagccagaacaccggcggcaactacttcgacacccagggcagcagcgcccaggtgaccaccgtggtgagcagccacagcatggtgggcaccggcggcatccagatgggcgtgaccggcggccagctgatcagcagcagcggcggcacctacctgatcggcaacagcatggagaacagcggccacagcgtgacccacaccaccagagccagccccgccaccgccaacagcgtgcccgagatgaagctgctgagacagatcaccatgaacagactgttccccaccctgaaccacaagctgaccgagggcagcggcccccacttccagagcatctag

SEQ ID NO: 9276 - DNA, 417 bp, Artificial Sequence
  Description of Artificial Sequence: Synthetic coding sequence
atgctgagcgacctgaacagagtggacttcgccaacgtgcaggagcaggccagctgggtgtgccagtgcgacgacaacatggtgcagagactggagaccgacttcaagatgaccctgcagcagcagagcaccctggagcagtgggccgcctggctggacaacgtgatgatgcaggccctgaagccctacgagggcagacccagcttccccaaggccgccagacagttcctgctgaagtggagcttctacagcagcatggtgatcagagacctgaccctgagaagcgccgccagcttcggcagcttccacctgatcagactgctgtacgacgagtacatgttctacctggtggagcacagagtggcccaggccaccggcgagacccccatcgccgtgatgggcgaggtgcccatgtag

SEQ ID NO: 9277 - DNA, 651 bp, Artificial Sequence
  Description of Artificial Sequence: Synthetic coding sequence
atgcagaccagcgagaccggcagcgacaccggcagcaccgtgaccctgcagaccagcgtggccagccaggccgccgtgcccacccaggtggtgcagcaggtgcccgtgcagcagcaggtgcagcaggtgcagaccgtgcagcaggtgcagcacgtgtaccccgcccaggtgcagtacgtggagggcagcgacaccgtgtacaccaacggcgccatcagaaccaccacctacccctacaccgagacccagatgtacagccagaacaccggcggcaactacttcgacacccagggcagcagcgcccaggtgaccaccgtggtgagcagccacagcatggtgggcaccggcggcatccagatgggcgtgaccggcggccagctgatcagcagcagcggcggcacctacctgatcggcaacagcatggagaacagcggccacagcgtgacccacaccaccagagccagccccgccaccctgcagtggctgctggacaactacgagaccgccgagggcgtgagcctgcccagaagcaccctgtacaaccactacctgagacactgccaggagcacaagctggaccccgtgaacgccgccagcttcggcaagctgatcagaagcatcttcatgggcctgagaaccagaagactgtag

SEQ ID NO: 9278 - DNA, 2250 bp, Artificial Sequence
  Description of Artificial Sequence: Synthetic coding sequence
atgcagaccagcgagaccggcagcgacaccggcagcaccgtgaccctgcagaccagcgtggccagccaggccgccgtgcccacccaggtggtgcagcaggtgcccgtgcagcagcaggtgcagcaggtgcagaccgtgcagcaggtgcagcacgtgtaccccgcccaggtgcagtacgtggagggcagcgacaccgtgtacaccaacggcgccatcagaaccaccacctacccctacaccgagacccagatgtacagccagaacaccggcggcaactacttcgacacccagggcagcagcgcccaggtgaccaccgtggtgagcagccacagcatggtgggcaccggcggcatccagatgggcgtgaccggcggccagctgatcagcagcagcggcggcacctacctgatcggcaacagcatggagaacagcggccacagcgtgacccacaccaccagagccagccccgccaccatcgagatggccatcgagaccctgcagaagagcgacggcctgagcacccacagaagcagcctgctgaacagccacctgcagtggctgctggacaactacgagaccgccgagggcgtgagcctgcccagaagcaccctgtacaaccactacctgagacactgccaggagcacaagctggaccccgtgaacgccgccagcttcggcaagctgatcagaagcatcttcatgggcctgagaaccagaagactgggcaccagaggcaacagcaagtaccactactacggcatcagagtgaagcccgacagccccctgaacagactgcaggaggacatgcagtacatggccatgagacagcagcccatgcagcagaagcagagatacaagcccatgcagaaggtggacggcgtggccgacggcttcaccggcagcggccagcagaccggcaccagcgtggagcagaccgtgatcgcccagagccagcaccaccagcagttcctggacgccagcagagccctgcccgagttcggcgaggtggagatcagcagcctgcccgacggcaccaccttcgaggacatcaagagcctgcagagcctgtacagagagcactgcgaggccatcctggacgtggtggtgaacctgcagttcagcctgatcgagaagctgtggcagaccttctggagatacagccccagcacccccaccgacggcaccaccatcaccgagagcagcaacctgagcgagatcgagagcagactgcccaaggccaagctgatcaccctgtgcaagcacgagagcatcctgaagtggatgtgcaactgcgaccacggcatgtaccaggccctggtggagatcctgatccccgacgtgctgagacccatccccagcgccctgacccaggccatcagaaacttcgccaagagcctggagggctggctgagcaacgccatgaacaacatcccccagagaatgatccagaccaaggtggccgccgtgagcgccttcgcccagaccctgagaagatacaccagcctgaaccacctggcccaggccgccagagccgtgctgcagaacaccagccagatcaaccagatgctgagcgacctgaacagagtggacttcgccaacgtgcaggagcaggccagctgggtgtgccagtgcgacgacaacatggtgcagagactggagaccgacttcaagatgaccctgcagcagcagagcaccctggagcagtgggccgcctggctggacaacgtgatgatgcaggccctgaagccctacgagggcagacccagcttccccaaggccgccagacagttcctgctgaagtggagcttctacagcagcatggtgatcagagacctgaccctgagaagcgccgccagcttcggcagcttccacctgatcagactgctgtacgacgagtacatgttctacctggtggagcacagagtggcccaggccaccggcgagacccccatcgccgtgatgggcgagttcggcgacctgaacgccgtgagccccggcaacctggacaaggacgagggcagcgaggtggagagcgagatggacgaggagctggacgacagcagcgagccccaggccaagagagagaagaccgagctgagccaggccttccccgtgggctgcatgcagcccgtgctggagaccggcgtgcagcccagcctgctgaaccccatccacagcgagcacatcgtgaccagcacccagaccatcagacagtgcagcgccaccggcaacacctacaccgccgtgtag

SEQ ID NO: 9279 - DNA, 471 bp, Artificial Sequence
  Description of Artificial Sequence: Synthetic coding sequence
gtgcagcaggtgcagaccgtgcagcaggtgcagcacgtgtaccccgcccaggtgcagtacgtggagggcagcgacaccgtgtacaccaacggcgccatcagaaccaccacctacccctacaccgagacccagatgtacagccagaacaccggcggcaactacttcgacacccagggcagcagcgcccaggtgaccaccgtggtgagcagccacagcatggtgggcaccggcggcatccagatgggcgtgaccggcggccagctgatcagcagcagcggcggcacctacctgatcggcaacagcatggagaacagcggccacagcgtgacccacaccaccagagccagccccgccaccgccaacagcgtgcccgagatgaagctgctgagacagatcaccatgaacagactgttccccaccctgaaccacaagctgaccgagggcagcggcccccacttccagagcatctag

SEQ ID NO: 9280 - DNA, 408 bp, Artificial Sequence
  Description of Artificial Sequence: Synthetic coding sequence
gtgcagcaggtgcagaccgtgcagcaggtgcagcacgtgtaccccgcccaggtgcagtacgtggagggcagcgacaccgtgtacaccaacggcgccatcagaaccaccacctacccctacaccgagacccagatgtacagccagaacaccggcggcaactacttcgacacccagggcagcagcgcccaggtgaccaccgtggtgagcagccacagcatggtgggcaccggcggcatccagatgggcgtgaccggcggccagctgatcagcagcagcggcggcacctacctgatcggcaacagcatggagaacagcggccacagcgtgacccacaccaccagagccagccccgccaccctgttcctgttcagctgcgtgcccttcagcctgggccagctgagcccctag

SEQ ID NO: 9281 - DNA, 417 bp, Artificial Sequence
  Description of Artificial Sequence: Synthetic coding sequence
atgcagaccagcgagaccggcagcgacaccggcagcaccgtgaccctgcagaccagcgtggccagccaggccgccgtgcccacccaggtggtgcagcaggtgcccgtgcagcagcaggtgcagcaggtgcagaccgtgcagcaggtgcagcacgtgtaccccgcccaggtgcagtacgtggagggcagcgacaccgtgtacaccaacggcgccatcagaaccaccacctacccctacaccgagacccagatgtacagccagaacaccggcggcaactacttcgacacccagggcagcagcgcccaggtgaccaccgtggtgagcagccacagcatggtgggcaccggcggcatccagatgggcgtgaccggcggccagctgatcagcagcagcggcggcacctacctgatcggctag

SEQ ID NO: 9282 - DNA, 375 bp, Artificial Sequence
  Description of Artificial Sequence: Synthetic coding sequence
gagcaggccagctgggtgtgccagtgcgacgacaacatggtgcagagactggagaccgacttcaagatgaccctgcagcagcagagcaccctggagcagtgggccgcctggctggacaacgtgatgatgcaggccctgaagccctacgagggcagacccagcttccccaaggccgccagacagttcctgctgaagtggagcttctacagcagcatggtgatcagagacctgaccctgagaagcgccgccagcttcggcagcttccacctgatcagactgctgtacgacgagtacatgttctacctggtggagcacagagtggcccaggccaccggcgagacccccatcgccgtgatgggcgaggtgcccatgtag

SEQ ID NO: 9283 - DNA, 555 bp, Artificial Sequence
  Description of Artificial Sequence: Synthetic coding sequence
atgcagaccagcgagaccggcagcgacaccggcagcaccgtgaccctgcagaccagcgtggccagccaggccgccgtgcccacccaggtggtgcagcaggtgcccgtgcagcagcaggtgcagcaggtgcagaccgtgcagcaggtgcagcacgtgtaccccgcccaggtgcagtacgtggagggcagcgacaccgtgtacaccaacggcgccatcagaaccaccacctacccctacaccgagacccagatgtacagccagaacaccggcggcaactacttcgacacccagggcagcagcgcccaggtgaccaccgtggtgagcagccacagcatggtgggcaccggcggcatccagatgggcgtgaccggcggccagctgatcagcagcagcggcggcacctacctgatcggcaacagcatggagaacagcggccacagcgtgacccacaccaccagagccagccccgccaccatcgagatggccatcgagaccctgcagaagagcgacggcctgagcacccacagaagcagcctgctgaacagccacgtgtag

SEQ ID NO: 9284 - DNA, 651 bp, Artificial Sequence; identical to SEQ ID NO: 9277
  Description of Artificial Sequence: Synthetic coding sequence

SEQ ID NO: 9285 - DNA, 525 bp, Artificial Sequence
  Description of Artificial Sequence: Synthetic coding sequence
atgtgcaactgcgaccacggcatgtaccaggccctggtggagatcctgatccccgacgtgctgagacccatccccagcgccctgacccaggccatcagaaacttcgccaagagcctggagggctggctgagcaacgccatgaacaacatcccccagagaatgatccagaccaaggtggccgccgtgagcgccttcgcccagaccctgagaagatacaccagcctgaaccacctggcccaggccgccagagccgtgctgcagaacaccagccagatcaaccagatgctgagcgacctgaacagagtggacttcgccaacgtgcaggagcaggccagctgggtgtgccagtgcgacgacaacatggtgcagagactggagaccgacttcaagatgaccctgcagcagcagagcaccctggagcagtgggccgcctggctggacaacgtgatgatgcaggccctgaagccctacgagggcagacccagcttccccaaggccgccagacagttcctgctgaagtggtag

SEQ ID NO: 9286 - DNA, 330 bp, Artificial Sequence
  Description of Artificial Sequence: Synthetic coding sequence
atggccgtggtgggcgtgagcagcgtgagcagactgctgggcagaagcagaccccagctgggcagacccatgagcagcggcgcccacggcgaggagggcagcgccagaatgtggaagaccctgaccttcttcgtggccctgcccggcgtggccgtgagcatgctgaacgtgtacctgaagagccaccacggcgagcacgagagacccgagttcatcgcctacccccacctgagaatcagaaccaagcccttcccctggggcgacggcaaccacaccctgttccacaacccccacgtgaaccccctgcccaccggctacgaggacgagtag

SEQ ID NO: 9287 - DNA, 2235 bp, Artificial Sequence
  Description of Artificial Sequence: Synthetic coding sequence
atgatcaagagaagagcccaccccggcgccggcggcgacagaaccagacccagaagaagaagaagcaccgagagctggatcgagagatgcctgaacgagagcgagaacaagagatacagcagccacaccagcctgggcaacgtgagcaacgacgagaacgaggagaaggagaacaacagagccagcaagccccacagcacccccgccaccctgcagtggctggaggagaactacgagatcgccgagggcgtgtgcatccccagaagcgccctgtacatgcactacctggacttctgcgagaagaacgacacccagcccgtgaacgccgccagcttcggcaagatcatcagacagcagttcccccagctgaccaccagaagactgggcaccagaggccagagcaagtaccactactacggcatcgccgtgaaggagagcagccagtactacgacgtgatgtacagcaagaagggcgccgcctgggtgagcgagaccggcaagaaggaggtgagcaagcagaccgtggcctacagccccagaagcaagctgggcaccctgctgcccgagttccccaacgtgaaggacctgaacctgcccgccagcctgcccgaggagaaggtgagcaccttcatcatgatgtacagaacccactgccagagaatcctggacaccgtgatcagagccaacttcgacgaggtgcagagcttcctgctgcacttctggcagggcatgcccccccacatgctgcccgtgctgggcagcagcaccgtggtgaacatcgtgggcgtgtgcgacagcatcctgtacaaggccatcagcggcgtgctgatgcccaccgtgctgcaggccctgcccgacagcctgacccaggtgatcagaaagttcgccaagcagctggacgagtggctgaaggtggccctgcacgacctgcccgagaacctgagaaacatcaagttcgagctgagcagaagattcagccagatcctgagaagacagaccagcctgaaccacctgtgccaggccagcagaaccgtgatccacagcgccgacatcaccttccagatgctggaggactggagaaacgtggacctgaacagcatcaccaagcagaccctgtacaccatggaggacagcagagacgagcacagaaagctgatcacccagctgtaccaggagttcgaccacctgctggaggagcagagccccatcgagagctacatcgagtggctggacaccatggtggacagatgcgtggtgaaggtggccgccaagagacagggcagcctgaagaaggtggcccagcagttcctgctgatgtggagctgcttcggcaccagagtgatcagagacatgaccctgcacagcgcccccagcttcggcagcttccacctgatccacctgatgttcgacgactacgtgctgtacctgctggagagcctgcactgccaggagagagccaacgagctgatgagagccatgaagggcgagggcagcaccgccgaggtgagagaggagatcatcctgaccgaggccgccgcccccacccccagccccgtgcccagcttcagccccgccaagagcgccaccagcgtggaggtgcccccccccagcagccccgtgagcaaccccagccccgagtacaccggcctgagcaccaccggcgccatgcagagctacacctggagcctgacctacaccgtgaccaccgccgccggcagccccgccgagaacagccagcagctgccctgcatgagaaacacccacgtgcccagcagcagcgtgacccacagaatccccgtgtacccccacagagaggagcacggctacaccggcagctacaactacggcagctacggcaaccagcacccccaccccatgcagagccagtaccccgccctgccccacgacaccgccatcagcggccccctgcactacgccccctaccacagaagcagcgcccagtaccccttcaacagccccaccagcagaatggagccctgcctgatgagcagcacccccagactgcaccccacccccgtgacccccagatggcccgaggtgcccagcgccaacacctgctacaccagccccagcgtgcacagcgccagatacggcaacagcagcgacatgtacacccccctgaccaccagaagaaacagcgagtacgagcacatgcagcacttccccggcttcgcctacatcaacggcgaggccagcaccggctgggccaagtag

SEQ ID NO: 9288 - DNA, 2208 bp, Artificial Sequence
  Description of Artificial Sequence: Synthetic coding sequence
atgcactgcggcctgctggaggagcccgacatggacagcaccgagagctggatcgagagatgcctgaacgagagcgagaacaagagatacagcagccacaccagcctgggcaacgtgagcaacgacgagaacgaggagaaggagaacaacagagccagcaagccccacagcacccccgccaccctgcagtggctggaggagaactacgagatcgccgagggcgtgtgcatccccagaagcgccctgtacatgcactacctggacttctgcgagaagaacgacacccagcccgtgaacgccgccagcttcggcaagatcatcagacagcagttcccccagctgaccaccagaagactgggcaccagaggccagagcaagtaccactactacggcatcgccgtgaaggagagcagccagtactacgacgtgatgtacagcaagaagggcgccgcctgggtgagcgagaccggcaagaaggaggtgagcaagcagaccgtggcctacagccccagaagcaagctgggcaccctgctgcccgagttccccaacgtgaaggacctgaacctgcccgccagcctgcccgaggagaaggtgagcaccttcatcatgatgtacagaacccactgccagagaatcctggacaccgtgatcagagccaacttcgacgaggtgcagagcttcctgctgcacttctggcagggcatgcccccccacatgctgcccgtgctgggcagcagcaccgtggtgaacatcgtgggcgtgtgcgacagcatcctgtacaaggccatcagcggcgtgctgatgcccaccgtgctgcaggccctgcccgacagcctgacccaggtgatcagaaagttcgccaagcagctggacgagtggctgaaggtggccctgcacgacctgcccgagaacctgagaaacatcaagttcgagctgagcagaagattcagccagatcctgagaagacagaccagcctgaaccacctgtgccaggccagcagaaccgtgatccacagcgccgacatcaccttccagatgctggaggactggagaaacgtggacctgaacagcatcaccaagcagaccctgtacaccatggaggacagcagagacgagcacagaaagctgatcacccagctgtaccaggagttcgaccacctgctggaggagcagagccccatcgagagctacatcgagtggctggacaccatggtggacagatgcgtggtgaaggtggccgccaagagacagggcagcctgaagaaggtggcccagcagttcctgctgatgtggagctgcttcggcaccagagtgatcagagacatgaccctgcacagcgcccccagcttcggcagcttccacctgatccacctgatgttcgacgactacgtgctgtacctgctggagagcctgcactgccaggagagagccaacgagctgatgagagccatgaagggcgagggcagcaccgccgaggtgagagaggagatcatcctgaccgaggccgccgcccccacccccagccccgtgcccagcttcagccccgccaagagcgccaccagcgtggaggtgcccccccccagcagccccgtgagcaaccccagccccgagtacaccggcctgagcaccaccggcgccatgcagagctacacctggagcctgacctacaccgtgaccaccgccgccggcagccccgccgagaacagccagcagctgccctgcatgagaaacacccacgtgcccagcagcagcgtgacccacagaatccccgtgtacccccacagagaggagcacggctacaccggcagctacaactacggcagctacggcaaccagcacccccaccccatgcagagccagtaccccgccctgccccacgacaccgccatcagcggccccctgcactacgccccctaccacagaagcagcgcccagtaccccttcaacagccccaccagcagaatggagccctgcctgatgagcagcacccccagactgcaccccacccccgtgacccccagatggcccgaggtgcccagcgccaacacctgctacaccagccccagcgtgcacagcgccagatacggcaacagcagcgacatgtacacccccctgaccaccagaagaaacagcgagtacgagcacatgcagcacttccccggcttcgcctacatcaacggcgaggccagcaccggctgggccaagtag

SEQ ID NO: 9289 - DNA, 1761 bp, Artificial Sequence
  Description of Artificial Sequence: Synthetic coding sequence
atggccgagggcgtgcccgccagccccagcagcggcgagggcagcagaggcccccacagcggcgtgatccagtggctggtggacaacttctgcatctgcgaggagtgcagcgtgcccagatgcctgatgtacgagatctacgtggagacctgcggccagaacaccgagaaccaggtgaaccccgccaccttcggcaagctggtgagactggtgttccccgacctgggcaccagaagactgggcaccagaggcagcgccagataccactacgacggcatctgcatcaagaagagcagcttcttctacgcccagtactgctacctgatcggcgagaagagataccacagcggcgacgccatcgccttcgagaagagcaccaactacaacagcatcatccagcaggaggccacctgcgaggaccacagccccatgaagaccgaccccgtgggcagccccctgagcgagttcagaagatgccccttcctggagcaggagcaggccaagaagtacagctgcaacatgatggccttcctggccgacgagtactgcaactactgcagagacatcctgagaaacgtggaggacctgctgaccagcttctggaagagcctgcagcaggacaccgtgatgctgatgagcctgcccgacgtgtgccagctgttcaagtgctacgacgtgcagctgtacaagggcatcgaggacgtgctgctgcacgacttcctggaggacgtgagcatccagtacctgaagagcgtgcagctgttcagcaagaagttcaagctgtggctgctgaacgccctggagggcgtgcccgccctgctgcagatcagcaagctgaaggaggtgaccctgttcgtgaagagactgagaagaaagacctacctgagcaacatggccaagaccatgagaatggtgctgaagagcaagagaagagtgagcgtgctgaagagcgacctgcaggccatcatcaaccagggcaccctggccaccagcaagaaggccctggccagcgacagaagcggcgccgacgagctggagaacaaccccgagatgaagtgcctgagaaacctgatcagcctgctgggcaccagcaccgacctgagagtgttcctgagctgcctgagcagccacctgcaggccttcgtgttccagaccagcagaagcaaggaggagttcaccaagctggccgccagcttccagctgagatggaacctgctgctgaccgccgtgagcaaggccatgaccctgtgccacagagacagcttcggcagctggcacctgttccacctgctgctgctggagtacatgatccacatcctgcagagctgcctggaggaggaggaggaggaggaggacatgggcaccgtgaaggagatgctgcccgacgaccccaccctgggccagcccgaccaggccctgttccacagcctgaacagcagcctgagccaggcctgcgccagccccagcatggagcccctgggcgtgatgcccacccacatgggccagggcagataccccgtgggcgtgagcaacatggtgctgagaatcctgggcttcctggtggacaccgccatgggcaacaagctgatccaggtgctgctggaggacgagaccaccgagagcgccgtgaagctgagcctgcccatgggccaggaggccctgatcaccctgaaggacggccagcagttcgtgatccagatcagcgacgtgccccagagcagcgaggacatctacttcagagagaacaacgccaacgtgtag

SEQ ID NO: 9290 - DNA, 1422 bp, Artificial Sequence
  Description of Artificial Sequence: Synthetic coding sequence
atgtacgagatctacgtggagacctgcggccagaacaccgagaaccaggtgaaccccgccaccttcggcaagtgcgaggaccacagccccatgaagaccgaccccgtgggcagccccctgagcgagttcagaagatgccccttcctggagcaggagcaggccaagaagtacagctgcaacatgatggccttcctggccgacgagtactgcaactactgcagagacatcctgagaaacgtggaggacctgctgaccagcttctggaagagcctgcagcaggacaccgtgatgctgatgagcctgcccgacgtgtgccagctgttcaagtgctacgacgtgcagctgtacaagggcatcgaggacgtgctgctgcacgacttcctggaggacgtgagcatccagtacctgaagagcgtgcagctgttcagcaagaagttcaagctgtggctgctgaacgccctggagggcgtgcccgccctgctgcagatcagcaagctgaaggaggtgaccctgttcgtgaagagactgagaagaaagacctacctgagcaacatggccaagaccatgagaatggtgctgaagagcaagagaagagtgagcgtgctgaagagcgacctgcaggccatcatcaaccagggcaccctggccaccagcaagaaggccctggccagcgacagaagcggcgccgacgagctggagaacaaccccgagatgaagtgcctgagaaacctgatcagcctgctgggcaccagcaccgacctgagagtgttcctgagctgcctgagcagccacctgcaggccttcgtgttccagaccagcagaagcaaggaggagttcaccaagctggccgccagcttccagctgagatggaacctgctgctgaccgccgtgagcaaggccatgaccctgtgccacagagacagcttcggcagctggcacctgttccacctgctgctgctggagtacatgatccacatcctgcagagctgcctggaggaggaggaggaggaggaggacatgggcaccgtgaaggagatgctgcccgacgaccccaccctgggccagcccgaccaggccctgttccacagcctgaacagcagcctgagccaggcctgcgccagccccagcatggagcccctgggcgtgatgcccacccacatgggccagggcagataccccgtgggcgtgagcaacatggtgctgagaatcctgggcttcctggtggacaccgccatgggcaacaagctgatccaggtgctgctggaggacgagaccaccgagagcgccgtgaagctgagcctgcccatgggccaggaggccctgatcaccctgaaggacggccagcagttcgtgatccagatcagcgacgtgccccagagcagcgaggacatctacttcagagagaacaacgccaacgtgtag

SEQ ID NO: 9291 - DNA, 138 bp, Artificial Sequence
  Description of Artificial Sequence: Synthetic coding sequence
atgtacgagatctacgtggagacctgcggccagaacaccgagaaccaggtgaaccccgccaccttcggcaagatggccttcctggccgacgagtactgcaactactgcagagacatcctgagaaacgtgagaaactag

SEQ ID NO: 9292 - DNA, 1704 bp, Artificial Sequence
  Description of Artificial Sequence: Synthetic coding sequence
atgctggagagaagatgcagaggccccctggccatgggcctggcccagcccagactgctgagcggccccagccaggagagcccccagaccctgggcaaggagagcagaggcctgagacagcagggcaccagcgtggcccagagcggcgcccaggcccccggcagagcccacagatgcgcccactgcagaagacacttccccggctgggtggccctgtggctgcacaccagaagatgccaggccagactgcccctgccctgccccgagtgcggcagaagattcagacacgcccccttcctggccctgcacagacaggtgcacgccgccgccacccccgacctgggcttcgcctgccacctgtgcggccagagcttcagaggctgggtggccctggtgctgcacctgagagcccacagcgccgccaagagacccatcgcctgccccaagtgcgagagaagattctggagaagaaagcagctgagagcccacctgagaagatgccacccccccgcccccgaggccagacccttcatctgcggcaactgcggcagaagcttcgcccagtgggaccagctggtggcccacaagagagtgcacgtggccgaggccctggaggaggccgccgccaaggccctgggccccagacccagaggcagacccgccgtgaccgcccccagacccggcggcgacgccgtggacagacccttccagtgcgcctgctgcggcaagagattcagacacaagcccaacctgatcgcccacagaagagtgcacaccggcgagagaccccaccagtgccccgagtgcggcaagagattcaccaacaagccctacctgaccagccacagaagaatccacaccggcgagaagccctacccctgcaaggagtgcggcagaagattcagacacaagcccaacctgctgagccacagcaagatccacaagagaagcgagggcagcgcccaggccgcccccggccccggcagcccccagctgcccgccggcccccaggagagcgccgccgagcccacccccgccgtgcccctgaagcccgcccaggagcccccccccggcgccccccccgagcacccccaggaccccatcgaggccccccccagcctgtacagctgcgacgactgcggcagaagcttcagactggagagattcctgagagcccaccagagacagcacaccggcgagagacccttcacctgcgccgagtgcggcaagaacttcggcaagaagacccacctggtggcccacagcagagtgcacagcggcgagagacccttcgcctgcgaggagtgcggcagaagattcagccagggcagccacctggccgcccacagaagagaccacgcccccgacagacccttcgtgtgccccgactgcggcaaggccttcagacacaagccctacctggccgcccacagaagaatccacaccggcgagaagccctacgtgtgccccgactgcggcaaggccttcagccagaagagcaacctggtgagccacagaagaatccacaccggcgagagaccctacgcctgccccgactgcgacagaagcttcagccagaagagcaacctgatcacccacagaaagagccacatcagagacggcgccttctgctgcgccatctgcggccagaccttcgacgacgaggagagactgctggcccaccagaagaagcacgacgtgtag

SEQ ID NO: 9293 - DNA, 1704 bp, Artificial Sequence; identical to SEQ ID NO: 9292
  Description of Artificial Sequence: Synthetic coding sequence

SEQ ID NO: 9294 - DNA, 1704 bp, Artificial Sequence; identical to SEQ ID NO: 9292
  Description of Artificial Sequence: Synthetic coding sequence

SEQ ID NO: 9295 - DNA, 615 bp, Artificial Sequence
  Description of Artificial Sequence: Synthetic coding sequence
atgggcatcggcgtgagcctgctgctgcagttcagcctgacccccggcggctacagaagcgtgggcagaagcagaagatgcagcagaggcagcatccccagaaacatccccaagagaagctggaagaagccccacccccagctgtgcagcctgcaggccgaggaggagcccatgctggagagaagatgcagaggccccctggccatgggcctggcccagcccagactgctgagcggccccagccaggagagcccccagaccctgggcaaggagagcagaggcctgagacagcagggcaccagcgtggcccagagcggcgcccaggcccccggcagagcccacagatgcgcccactgcagaagacacttccccggctgggtggccctgtggctgcacaccagaagatgccaggccagactgcccctgccctgccccgagtgcggcagaagattcagacacgcccccttcctggccctgcacagacaggtgcacgccgccgccacccccgacctgggcttcgcctgccacctgtgcggccagagcttcagaggctgggtggccctggtgctgcacctgagagcccacagcgccgccaagagacccatcgcctgctag

SEQ ID NO: 9296 - DNA, 1875 bp, Artificial Sequence
  Description of Artificial Sequence: Synthetic coding sequence
atgggcatcggcgtgagcctgctgctgcagttcagcctgacccccggcggctacagaagcgtgggcagaagcagaagatgcagcagaggcagcatccccagaaacatccccaagagaagctggaagaagccccacccccagctgtgcagcctgcaggccgaggaggagcccatgctggagagaagatgcagaggccccctggccatgggcctggcccagcccagactgctgagcggccccagccaggagagcccccagaccctgggcaaggagagcagaggcctgagacagcagggcaccagcgtggcccagagcggcgcccaggcccccggcagagcccacagatgcgcccactgcagaagacacttccccggctgggtggccctgtggctgcacaccagaagatgccaggccagactgcccctgccctgccccgagtgcggcagaagattcagacacgcccccttcctggccctgcacagacaggtgcacgccgccgccacccccgacctgggcttcgcctgccacctgtgcggccagagcttcagaggctgggtggccctggtgctgcacctgagagcccacagcgccgccaagagacccatcgcctgccccaagtgcgagagaagattctggagaagaaagcagctgagagcccacctgagaagatgccacccccccgcccccgaggccagacccttcatctgcggcaactgcggcagaagcttcgcccagtgggaccagctggtggcccacaagagagtgcacgtggccgaggccctggaggaggccgccgccaaggccctgggccccagacccagaggcagacccgccgtgaccgcccccagacccggcggcgacgccgtggacagacccttccagtgcgcctgctgcggcaagagattcagacacaagcccaacctgatcgcccacagaagagtgcacaccggcgagagaccccaccagtgccccgagtgcggcaagagattcaccaacaagccctacctgaccagccacagaagaatccacaccggcgagaagccctacccctgcaaggagtgcggcagaagattcagacacaagcccaacctgctgagccacagcaagatccacaagagaagcgagggcagcgcccaggccgcccccggccccggcagcccccagctgcccgccggcccccaggagagcgccgccgagcccacccccgccgtgcccctgaagcccgcccaggagcccccccccggcgccccccccgagcacccccaggaccccatcgaggccccccccagcctgtacagctgcgacgactgcggcagaagcttcagactggagagattcctgagagcccaccagagacagcacaccggcgagagacccttcacctgcgccgagtgcggcaagaacttcggcaagaagacccacctggtggcccacagcagagtgcacagcggcgagagacccttcgcctgcgaggagtgcggcagaagattcagccagggcagccacctggccgcccacagaagagaccacgcccccgacagacccttcgtgtgccccgactgcggcaaggccttcagacacaagccctacctggccgcccacagaagaatccacaccggcgagaagccctacgtgtgccccgactgcggcaaggccttcagccagaagagcaacctggtgagccacagaagaatccacaccggcgagagaccctacgcctgccccgactgcgacagaagcttcagccagaagagcaacctgatcacccacagaaagagccacatcagagacggcgccttctgctgcgccatctgcggccagaccttcgacgacgaggagagactgctggcccaccagaagaagcacgacgtgtag

SEQ ID NO: 9297 - DNA, 441 bp, Artificial Sequence
  Description of Artificial Sequence: Synthetic coding sequence
atgctggagagaagatgcagaggccccctggccatgggcctggcccagcccagactgctgagcggccccagccaggagagcccccagaccctgggcaaggagagcagaggcctgagacagcagggcaccagcgtggcccagagcggcgcccaggcccccggcagagcccacagatgcgcccactgcagaagacacttccccggctgggtggccctgtggctgcacaccagaagatgccaggccagactgcccctgccctgccccgagtgcggcagaagattcagacacgcccccttcctggccctgcacagacaggtgcacgccgccgccacccccgacctgggcttcgcctgccacctgtgcggccagagcttcagaggctgggtggccctggtgctgcacctgagagcccacagcgccgccaagagacccatcgcctag

SEQ ID NO: 9298 - DNA, 1704 bp, Artificial Sequence; identical to SEQ ID NO: 9292
  Description of Artificial Sequence: Synthetic coding sequence

SEQ ID NO: 9299 - DNA, 1449 bp, Artificial Sequence
  Description of Artificial Sequence: Synthetic coding sequence
atggtggagaagggccccgaggtgagcggcaagagaagaggcagaaacaacgccgccgccagcgccagcgccgccgccgccagcgccgccgccagcgccgcctgcgccagccccgccgccaccgccgccagcggcgccgccgccagcagcgccagcgccgccgccgccagcgccgccgccgcccccaacaacggccagaacaagagcctggccgccgccgcccccaacggcaacagcagcagcaacagctgggaggagggcagcagcggcagcagcagcgacgaggagcacggcggcggcggcatgagagtgggcccccagtaccaggccgtggtgcccgacttcgaccccgccaagctggccagaagaagccaggagagagacaacctgggcatgctggtgtggagccccaaccagaacctgagcgaggccaagctggacgagtacatcgccatcgccaaggagaagcacggctacaacatggagcaggccctgggcatgctgttctggcacaagcacaacatcgagaagagcctggccgacctgcccaacttcacccccttccccgacgagtggaccgtggaggacaaggtgctgttcgagcaggccttcagcttccacggcaagaccttccacagaatccagcagatgctgcccgacaagagcatcgccagcctggtgaagttctactacagctggaagaagaccagaaccaagaccagcgtgatggacagacacgccagaaagcagaagagagagagagaggagagcgaggacgagctggaggaggccaacggcaacaaccccatcgacatcgaggtggaccagaacaaggagagcaagaaggaggtgccccccaccgagaccgtgccccaggtgaagaaggagaagcacagcacccaggccaagaacagagccaagagaaagccccccaagggcatgttcctgagccaggaggacgtggaggccgtgagcgccaacgccaccgccgccaccaccgtgctgagacagctggacatggagctggtgagcgtgaagagacagatccagaacatcaagcagaccaacagcgccctgaaggagaagctggacggcggcatcgagccctacagactgcccgaggtgatccagaagtgcaacgccagatggaccaccgaggagcagctgctggccgtgcaggccatcagaaagtacggcagagacttccaggccatcagcgacgtgatcggcaacaagagcgtggtgcaggtgaagaacttcttcgtgaactacagaagaagattcaacatcgacgaggtgctgcaggagtgggaggccgagcacggcaaggaggagaccaacggccccagcaaccagaagcccgtgaagagccccgacaacagcatcaagatgcccgaggaggaggacgaggcccccgtgctggacgtgagatacgccagcgccagctag

SEQ ID NO: 9300 - DNA, 1449 bp, Artificial Sequence; identical to SEQ ID NO: 9299
  Description of Artificial Sequence: Synthetic coding sequence

SEQ ID NO: 9301 - DNA, 1572 bp, Artificial Sequence
  Description of Artificial Sequence: Synthetic coding sequence
atgcccagcgtgatggagaagcccagcgccggcagcggcatcctgagcagaagcagagccaagaccgtgcccaacggcggccagccccacagcgaggacgacagcagcgaggaggagcacagccacgacagcatgatcagagtgggcaccaactaccaggccgtgatccccgagtgcaagcccgagagccccgccagatacagcaacaaggagctgaagggcatgctggtgtggagccccaaccactgcgtgagcgacgccaagctggacaagtacatcgccatggccaaggagaagcacggctacaacatcgagcaggccctgggcatgctgctgtggcacaagcacgacgtggagaagagcctggccgacctggccaacttcacccccttccccgacgagtggaccgtggaggacaaggtgctgttcgagcaggccttcggcttccacggcaagtgcttccagagaatccagcagatgctgcccgacaagctgatccccagcctggtgaagtactactacagctggaagaagaccagaagcagaaccagcgtgatggacagacaggccagaagactgggcggcagaaaggacaaggaggacagcgacgagctggaggagggcagaggcggcgtgagcgagggcgagcccgaccccgccgaccccaagagagagcccctgcccagcagacccctgaacgccagacccggccccggcaagaaggaggtgcaggtgagccagtacagacaccaccccctgagaaccagaagaagaccccccaagggcatgtacctgagccccgagggcctgaccgccgtgagcggcagccccgacctggccaacctgaccctgagaggcctggacagccagctgatcagcctgaagagacaggtgcagagcatgaagcagaccaacagcagcctgagacaggccctggagggcggcatcgaccccctgagaccccccgaggccaacaccaagttcaacagcagatggaccaccgacgagcagctgctggccgtgcaggccatcagaagatacggcaaggacttcggcgccatcgccgaggtgatcggcaacaagaccctgacccaggtgaagaccttcttcgtgagctacagaagaagattcaacctggaggaggtgctgcaggagtgggaggccgagcaggacggcgcccccggcgcccccgtgcccatggaggaggccagaagaggcgcccccctgcccgcccccgccctggaggaggacgacgaggtgcagatcaccagcgtgagcaccagcgtgcccagaagcgtgccccccgcccccccccccccccccccccccaccagcctgagccagcccccccccctgctgagaccccccctgcccaccgcccccaccctgctgagacagcccccccccctgcagcagggcagattcctgcagcccagactggcccccaaccagccccccccccccctgatcagacccgccctggccgcccccagacacagcgccagacccggcccccagcccccccccaccctgatcggcacccccctggagccccccgcccccagcctgtag

SEQ ID NO: 9302 - DNA, 1488 bp, Artificial Sequence
  Description of Artificial Sequence: Synthetic coding sequence
atgagagtgggcgccgagtaccaggccagaatccccgagttcgaccccggcgccaccaagtacaccgacaaggacaacggcggcatgctggtgtggagcccctaccacagcatccccgacgccaagctggacgagtacatcgccatcgccaaggagaagcacggctacaacgtggagcaggccctgggcatgctgttctggcacaagcacaacatcgagaagagcctggccgacctgcccaacttcacccccttccccgacgagtggaccgtggaggacaaggtgctgttcgagcaggccttcagcttccacggcaagagcttccacagaatccagcagatgctgcccgacaagaccatcgccagcctggtgaagtactactacagctggaagaagaccagaagcagaaccagcctgatggacagacaggccagaaagctggccaacagacacaaccagggcgacagcgacgacgacgtggaggagacccaccccatggacggcaacgacagcgactacgaccccaagaaggaggccaagaaggagggcaacaccgagcagcccgtgcagaccagcaagatcggcctgggcagaagagagtaccagagcctgcagcacagacaccacagccagagaagcaagtgcagaccccccaagggcatgtacctgacccaggaggacgtggtggccgtgagctgcagccccaacgccgccaacaccatcctgagacagctggacatggagctgatcagcctgaagagacaggtgcagaacgccaagcaggtgaacagcgccctgaagcagaagatggagggcggcatcgaggagttcaagccccccgagagcaaccagaagatcaacgccagatggaccaccgaggagcagctgctggccgtgcagggcgtgagaaagtacggcaaggacttccaggccatcgccgacgtgatcggcaacaagaccgtgggccaggtgaagaacttcttcgtgaactacagaagaagattcaacctggaggaggtgctgcaggagtgggaggccgagcagggcacccaggccagcaacggcgacgccagcaccctgggcgaggagaccaagagcgccagcaacgtgcccagcggcaagagcaccgacgaggaggaggaggcccagaccccccaggcccccagaaccctgggccccagcccccccgcccccagcagcacccccacccccaccgcccccatcgccaccctgaaccagcccccccccctgctgagacccaccctgcccgccgcccccgccctgcacagacagcccccccccctgcagcagcaggccagattcatccagcccagacccaccctgaaccagccccccccccccctgatcagacccgccaacagcatgccccccagactgaaccccagacccgtgctgagcaccgtgggcggccagcagccccccagcctgatcggcatccagaccgacagccagagcagcctgcactag

SEQ ID NO: 9303 - DNA, 1311 bp, Artificial Sequence
  Description of Artificial Sequence: Synthetic coding sequence
atgcccggcatgatggagaagggccccgagctgctgggcaagaacagaagcgccaacggcagcgccaagagccccgccggcggcggcggcagcggcgccagcagcaccaacggcggcctgcactacagcgagcccgagagcggctgcagcagcgacgacgagcacgacgtgggcatgagagtgggcgccgagtaccaggccagaatccccgagttcgaccccggcgccaccaagtacaccgacaaggacaacggcggcatgctggtgtggagcccctaccacagcatccccgacgccaagctggacgagtacatcgccatcgccaaggagaagcacggctacaacgtggagcaggccctgggcatgctgttctggcacaagcacaacatcgagaagagcctggccgacctgcccaacttcacccccttccccgacgagtggaccgtggaggacaaggtgctgttcgagcaggccttcagcttccacggcaagagcttccacagaatccagcagatgctgcccgacaagaccatcgccagcctggtgaagtactactacagctggaagaagaccagaagcagaaccagcctgatggacagacaggccagaaagctggccaacagacacaaccagggcgacagcgacgacgacgtggaggagacccaccccatggacggcaacgacagcgactacgaccccaagaaggaggccaagaaggagggcaacaccgagcagcccgtgcagaccagcaagatcggcctgggcagaagagagtaccagagcctgcagcacagacaccacagccagagaagcaagtgcagaccccccaagggcatgtacctgacccaggaggacgtggtggccgtgagctgcagccccaacgccgccaacaccatcctgagacagctggacatggagctgatcagcctgaagagacaggtgcagaacgccaagcaggtgaacagcgccctgaagcagaagatggagggcggcatcgaggagttcaagccccccgagagcaaccagaagatcaacgccagatggaccaccgaggagcagctgctggccgtgcagggcaccgaccccaccggcagcagcgacaccggcagcatcaccagctgccccatcatccacagcaacaccaacagcccctactgccacagcgagcccgccagcaccaccagcagcagcaacaccgcctgctgccccggcagcagccccgccgccagcagcacccccgccgccggcagcgtgcaccccgcccccgccaacttcaagagcgccagcaccaccagctacagcccctgctag

SEQ ID NO: 9304 - DNA, 1662 bp, Artificial Sequence
  Description of Artificial Sequence: Synthetic coding sequence
atgcccggcatgatggagaagggccccgagctgctgggcaagaacagaagcgccaacggcagcgccaagagccccgccggcggcggcggcagcggcgccagcagcaccaacggcggcctgcactacagcgagcccgagagcggctgcagcagcgacgacgagcacgacgtgggcatgagagtgggcgccgagtaccaggccagaatccccgagttcgaccccggcgccaccaagtacaccgacaaggacaacggcggcatgctggtgtggagcccctaccacagcatccccgacgccaagctggacgagtacatcgccatcgccaaggagaagcacggctacaacgtggagcaggccctgggcatgctgttctggcacaagcacaacatcgagaagagcctggccgacctgcccaacttcacccccttccccgacgagtggaccgtggaggacaaggtgctgttcgagcaggccttcagcttccacggcaagagcttccacagaatccagcagatgctgcccgacaagaccatcgccagcctggtgaagtactactacagctggaagaagaccagaagcagaaccagcctgatggacagacaggccagaaagctggccaacagacacaaccagggcgacagcgacgacgacgtggaggagacccaccccatggacggcaacgacagcgactacgaccccaagaaggaggccaagaaggagggcaacaccgagcagcccgtgcagaccagcaagatcggcctgggcagaagagagtaccagagcctgcagcacagacaccacagccagagaagcaagtgcagaccccccaagggcatgtacctgacccaggaggacgtggtggccgtgagctgcagccccaacgccgccaacaccatcctgagacagctggacatggagctgatcagcctgaagagacaggtgcagaacgccaagcaggtgaacagcgccctgaagcagaagatggagggcggcatcgaggagttcaagccccccgagagcaaccagaagatcaacgccagatggaccaccgaggagcagctgctggccgtgcagggcgtgagaaagtacggcaaggacttccaggccatcgccgacgtgatcggcaacaagaccgtgggccaggtgaagaacttcttcgtgaactacagaagaagattcaacctggaggaggtgctgcaggagtgggaggccgagcagggcacccaggccagcaacggcgacgccagcaccctgggcgaggagaccaagagcgccagcaacgtgcccagcggcaagagcaccgacgaggaggaggaggcccagaccccccaggcccccagaaccctgggccccagcccccccgcccccagcagcacccccacccccaccgcccccatcgccaccctgaaccagcccccccccctgctgagacccaccctgcccgccgcccccgccctgcacagacagcccccccccctgcagcagcaggccagattcatccagcccagacccaccctgaaccagccccccccccccctgatcagacccgccaacagcatgccccccagactgaaccccagacccgtgctgagcaccgtgggcggccagcagccccccagcctgatcggcatccagaccgacagccagagcagcctgcactag

SEQ ID NO: 9305 - DNA, 1350 bp, Artificial Sequence
  Description of Artificial Sequence: Synthetic coding sequence
atgcccggcatgatggagaagggccccgagctgctgggcaagaacagaagcgccaacggcagcgccaagagccccgccggcggcggcggcagcggcgccagcagcaccaacggcggcctgcactacagcgagcccgagagcggctgcagcagcgacgacgagcacgacgtgggcatgagagtgggcgccgagtaccaggccagaatccccgagttcgaccccggcgccaccaagtacaccgacaaggacaacggcggcatgctggtgtggagcccctaccacagcatccccgacgccaagctggacgagtacatcgccatcgccaaggagaagcacggctacaacgtggagcaggccctgggcatgctgttctggcacaagcacaacatcgagaagagcctggccgacctgcccaacttcacccccttccccgacgagtggaccgtggaggacaaggtgctgttcgagcaggccttcagcttccacggcaagagcttccacagaatccagcagatgctgcccgacaagaccatcgccagcctggtgaagtactactacagctggaagaagaccagaagcagaaccagcctgatggacagacaggccagaaagctggccaacagacacaaccagggcgacagcgacgacgacgtggaggagacccaccccatggacggcaacgacagcgactacgaccccaagaaggaggccaagaaggagggcaacaccgagcagcccgtgcagaccagcaagatcggcctgggcagaagagagtaccagagcctgcagcacagacaccacagccagagaagcaagtgcagaccccccaagggcatgtacctgacccaggaggacgtggtggccgtgagctgcagccccaacgccgccaacaccatcctgagacagctggacatggagctgatcagcctgaagagacaggtgcagaacgccaagcaggtgaacagcgccctgaagcagaagatggagggcggcatcgaggagttcaagccccccgagagcaaccagaagatcaacgccagatggaccaccgaggagcagctgctggccgtgcagggcgtgagaaagtacggcaaggacttccaggccatcgccgacgtgatcggcaacaagaccgtgggccaggtgaagaacttcttcgtgaactacagaagaagattcaacctggaggaggtgctgcaggagtgggaggccgagcagggcacccaggccagcaacggcgacgccagcaccctgggcgaggagaccaagagcgccagcaacgtgcccagcggcaagagcaccgacgaggaggaggaggtgtgcctgtgcatggagttcgagctgatctag

SEQ ID NO: 9306 - DNA, 450 bp, Artificial Sequence
  Description of Artificial Sequence: Synthetic coding sequence
atgagagtgggcgccgagtaccaggccagaatccccgagttcgaccccggcgccaccaagtacaccgacaaggacaacggcggcatgctggtgtggagcccctaccacagcatccccgacgccaagctggacgagtacatcgccatcgccaaggagaagcacggctacaacgtggagcaggccctgggcatgctgttctggcacaagcacaacatcgagaagagcctggccgacctgcccaacttcacccccttccccgacgagtggaccgtggaggacaaggtgctgttcgagcaggccttcagcttccacggcaagagcttccacagaatccagcagatgctgcccgacaagaccatcgccagcctggtgaagtactactacagctggaagaagaccagaagcagaaccagcctgatggacagacaggccagaaagctggccaactag

SEQ ID NO: 9307 - DNA, 261 bp, Artificial Sequence
  Description of Artificial Sequence: Synthetic coding sequence
atgagagtgggcgccgagtaccaggccagaatccccgagttcgaccccggcgccaccaagtacaccgacaaggacaacggcggcatgctggtgtggagcccctaccacagcatccccgacgccaagctggacgagtacatcgccatcgccaaggagaagcacggctacaacgtggagcaggccctgggcatgctgttctggcacaagcacaacatcgagaagagcctggccgacctgcccaacttcacccccttcccctag

SEQ ID NO: 9308 - DNA, 555 bp, Artificial Sequence
  Description of Artificial Sequence: Synthetic coding sequence
atgttcctgagccccggcgagggccccgccaccgagggcggcggcctgggccccggcgaggaggcccccaagaagaagcacagaagaaacagaaccaccttcaccacctaccagctgcaccagctggagagagccttcgaggccagccactaccccgacgtgtacagcagagaggagctggccgccaaggtgcacctgcccgaggtgagagtgcaggtgtggttccagaacagaagagccaagtggagaagacaggagagactggagagcggcagcggcgccgtggccgcccccagactgcccgaggcccccgccctgcccttcgccagaccccccgccatgagcctgcccctggagccctggctgggccccggcccccccgccgtgcccggcctgcccagactgctgggccccggccccggcctgcaggccagcttcggcccccacgccttcgcccccaccttcgccgacggcttcgccctggaggaggccagcctgagactgctggccaaggagcacgcccaggccctggacagagcctggccccccgcctag

SEQ ID NO: 9309 - DNA, 693 bp, Artificial Sequence
  Description of Artificial Sequence: Synthetic coding sequence
atgcccgcccccgtggagggcaccgacttccccggcgccggcagacaggcctggggcagccccgccctgagcctgcccgtggccccccccgccgtgagcccccccagcgtgcccctgcccagccaccaggtgggcgccatgttcctgagccccggcgagggccccgccaccgagggcggcggcctgggccccggcgaggaggcccccaagaagaagcacagaagaaacagaaccaccttcaccacctaccagctgcaccagctggagagagccttcgaggccagccactaccccgacgtgtacagcagagaggagctggccgccaaggtgcacctgcccgaggtgagagtgcaggtgtggttccagaacagaagagccaagtggagaagacaggagagactggagagcggcagcggcgccgtggccgcccccagactgcccgaggcccccgccctgcccttcgccagaccccccgccatgagcctgcccctggagccctggctgggccccggcccccccgccgtgcccggcctgcccagactgctgggccccggccccggcctgcaggccagcttcggcccccacgccttcgcccccaccttcgccgacggcttcgccctggaggaggccagcctgagactgctggccaaggagcacgcccaggccctggacagagcctggccccccgcctag

SEQ ID NO: 9310 - DNA, 615 bp, Artificial Sequence
  Description of Artificial Sequence: Synthetic coding sequence
tgagccggcgccggcgtgccctggaagagcaccgagggcctgccctgggccgtgggcgccatgttcctgagccccggcgagggccccgccaccgagggcggcggcctgggccccggcgaggaggcccccaagaagaagcacagaagaaacagaaccaccttcaccacctaccagctgcaccagctggagagagccttcgaggccagccactaccccgacgtgtacagcagagaggagctggccgccaaggtgcacctgcccgaggtgagagtgcaggtgtggttccagaacagaagagccaagtggagaagacaggagagactggagagcggcagcggcgccgtggccgcccccagactgcccgaggcccccgccctgcccttcgccagaccccccgccatgagcctgcccctggagccctggctgggccccggcccccccgccgtgcccggcctgcccagactgctgggccccggccccggcctgcaggccagcttcggcccccacgccttcgcccccaccttcgccgacggcttcgccctggaggaggccagcctgagactgctggccaaggagcacgcccaggccctggacagagcctggccccccgcctag

SEQ ID NO: 9311 - DNA, 1278 bp, Artificial Sequence
  Description of Artificial Sequence: Synthetic coding sequence
atggccgacaaggaggccgccttcgacgacgccgtggaggagagagtgatcaacgaggagtacaagatctggaagaagaacacccccttcctgtacgacctggtgatgacccacgccctggagtggcccagcctgaccgcccagtggctgcccgacgtgaccagacccgagggcaaggacttcagcatccacagactggtgctgggcacccacaccagcgacgagcagaaccacctggtgatcgccagcgtgcagctgcccaacgacgacgcccagttcgacgccagccactacgacagcgagaagggcgagttcggcggcttcggcagcgtgagcggcaagatcgagatcgagatcaagatcaaccacgagggcgaggtgaacagagccagatacatgccccagaacccctgcatcatcgccaccaagacccccagcagcgacgtgctggtgttcgactacaccaagcaccccagcaagcccgaccccagcggcgagtgcaaccccgacctgagactgagaggccaccagaaggagggctacggcctgagctggaaccccaacctgagcggccacctgctgagcgccagcgacgaccacaccatctgcctgtgggacatcagcgccgtgcccaaggagggcaaggtggtggacgccaagaccatcttcaccggccacaccgccgtggtggaggacgtgagctggcacctgctgcacgagagcctgttcggcagcgtggccgacgaccagaagctgatgatctgggacaccagaagcaacaacaccagcaagcccagccacagcgtggacgcccacaccgccgaggtgaactgcctgagcttcaacccctacagcgagttcatcctggccaccggcagcgccgacaagaccgtggccctgtgggacctgagaaacctgaagctgaagctgcacagcttcgagagccacaaggacgagatcttccaggtgcagtggagcccccacaacgagaccatcctggccagcagcggcaccgacagaagactgaacgtgtgggacctgagcaagatcggcgaggagcagagccccgaggacgccgaggacggcccccccgagctgctgttcatccacggcggccacaccgccaagatcagcgacttcagctggaaccccaacgagccctgggtgatctgcagcgtgagcgaggacaacatcatgcaggtgtggcagatggccgagaacatctacaacgacgaggaccccgagggcagcgtggaccccgagggccagggcagctag

SEQ ID NO: 9312 - DNA, 1275 bp, Artificial Sequence
  Description of Artificial Sequence: Synthetic coding sequence
atggccgacaaggaggccttcgacgacgccgtggaggagagagtgatcaacgaggagtacaagatctggaagaagaacacccccttcctgtacgacctggtgatgacccacgccctggagtggcccagcctgaccgcccagtggctgcccgacgtgaccagacccgagggcaaggacttcagcatccacagactggtgctgggcacccacaccagcgacgagcagaaccacctggtgatcgccagcgtgcagctgcccaacgacgacgcccagttcgacgccagccactacgacagcgagaagggcgagttcggcggcttcggcagcgtgagcggcaagatcgagatcgagatcaagatcaaccacgagggcgaggtgaacagagccagatacatgccccagaacccctgcatcatcgccaccaagacccccagcagcgacgtgctggtgttcgactacaccaagcaccccagcaagcccgaccccagcggcgagtgcaaccccgacctgagactgagaggccaccagaaggagggctacggcctgagctggaaccccaacctgagcggccacctgctgagcgccagcgacgaccacaccatctgcctgtgggacatcagcgccgtgcccaaggagggcaaggtggtggacgccaagaccatcttcaccggccacaccgccgtggtggaggacgtgagctggcacctgctgcacgagagcctgttcggcagcgtggccgacgaccagaagctgatgatctgggacaccagaagcaacaacaccagcaagcccagccacagcgtggacgcccacaccgccgaggtgaactgcctgagcttcaacccctacagcgagttcatcctggccaccggcagcgccgacaagaccgtggccctgtgggacctgagaaacctgaagctgaagctgcacagcttcgagagccacaaggacgagatcttccaggtgcagtggagcccccacaacgagaccatcctggccagcagcggcaccgacagaagactgaacgtgtgggacctgagcaagatcggcgaggagcagagccccgaggacgccgaggacggcccccccgagctgctgttcatccacggcggccacaccgccaagatcagcgacttcagctggaaccccaacgagccctgggtgatctgcagcgtgagcgaggacaacatcatgcaggtgtggcagatggccgagaacatctacaacgacgaggaccccgagggcagcgtggaccccgagggccagggcagctag

SEQ ID NO: 9313 - DNA, 264 bp, Artificial Sequence
  Description of Artificial Sequence: Synthetic coding sequence
atgacccacgccctggagtggcccagcctgaccgcccagtggctgcccgacgtgaccagacccgagggcaaggacttcagcatccacagactggtgctgggcacccacaccagcgacgagcagaaccacctggtgatcgccagcgtgcagctgcccaacgacgacgcccagttcgacgccagccactacgacagcgagaagggcgagttcggcggcttcggcagcgtgagcggcaagatcgagatcgagatcaagatcaactag

SEQ ID NO: 9314 - DNA, 1173 bp, Artificial Sequence
  Description of Artificial Sequence: Synthetic coding sequence
atgacccacgccctggagtggcccagcctgaccgcccagtggctgcccgacgtgaccagacccgagggcaaggacttcagcatccacagactggtgctgggcacccacaccagcgacgagcagaaccacctggtgatcgccagcgtgcagctgcccaacgacgacgcccagttcgacgccagccactacgacagcgagaagggcgagttcggcggcttcggcagcgtgagcggcaagatcgagatcgagatcaagatcaaccacgagggcgaggtgaacagagccagatacatgccccagaacccctgcatcatcgccaccaagacccccagcagcgacgtgctggtgttcgactacaccaagcaccccagcaagcccgaccccagcggcgagtgcaaccccgacctgagactgagaggccaccagaaggagggctacggcctgagctggaaccccaacctgagcggccacctgctgagcgccagcgacgaccacaccatctgcctgtgggacatcagcgccgtgcccaaggagggcaaggtggtggacgccaagaccatcttcaccggccacaccgccgtggtggaggacgtgagctggcacctgctgcacgagagcctgttcggcagcgtggccgacgaccagaagctgatgatctgggacaccagaagcaacaacaccagcaagcccagccacagcgtggacgcccacaccgccgaggtgaactgcctgagcttcaacccctacagcgagttcatcctggccaccggcagcgccgacaagaccgtggccctgtgggacctgagaaacctgaagctgaagctgcacagcttcgagagccacaaggacgagatcttccaggtgcagtggagcccccacaacgagaccatcctggccagcagcggcaccgacagaagactgaacgtgtgggacctgagcaagatcggcgaggagcagagccccgaggacgccgaggacggcccccccgagctgctgttcatccacggcggccacaccgccaagatcagcgacttcagctggaaccccaacgagccctgggtgatctgcagcgtgagcgaggacaacatcatgcaggtgtggcagatggccgagaacatctacaacgacgaggaccccgagggcagcgtggaccccgagggccagggcagctag

SEQ ID NO: 9315 - DNA, 543 bp, Artificial Sequence
  Description of Artificial Sequence: Synthetic coding sequence
gtggccgacgaccagaagctgatgatctgggacaccagaagcaacaacaccagcaagcccagccacagcgtggacgcccacaccgccgaggtgaactgcctgagcttcaacccctacagcgagttcatcctggccaccggcagcgccgacaagaccgtggccctgtgggacctgagaaacctgaagctgaagctgcacagcttcgagagccacaaggacgagatcttccaggtgcagtggagcccccacaacgagaccatcctggccagcagcggcaccgacagaagactgaacgtgtgggacctgagcaagatcggcgaggagcagagccccgaggacgccgaggacggcccccccgagctgctgttcatccacggcggccacaccgccaagatcagcgacttcagctggaaccccaacgagccctgggtgatctgcagcgtgagcgaggacaacatcatgcaggtgtggcagatggccgagaacatctacaacgacgaggaccccgagggcagcgtggaccccgagggccagggcagctag

SEQ ID NO: 9316 - DNA, 207 bp, Artificial Sequence
  Description of Artificial Sequence: Synthetic coding sequence
atgacccacgccctggagtggcccagcctgaccgcccagtggctgcccgacgtgaccagacccgagggcaaggacttcagcatccacagactggtgctgggcacccacaccagcgacgagcagaaccacctggtgatcgccagcgtgcagctgcccaacgacgacgcccagttcgacgccagccactacgacagcgagaagggctag

SEQ ID NO: 9317 - DNA, 522 bp, Artificial Sequence
  Description of Artificial Sequence: Synthetic coding sequence
atgatctgggacaccagaagcaacaacaccagcaagcccagccacagcgtggacgcccacaccgccgaggtgaactgcctgagcttcaacccctacagcgagttcatcctggccaccggcagcgccgacaagaccgtggccctgtgggacctgagaaacctgaagctgaagctgcacagcttcgagagccacaaggacgagatcttccaggtgcagtggagcccccacaacgagaccatcctggccagcagcggcaccgacagaagactgaacgtgtgggacctgagcaagatcggcgaggagcagagccccgaggacgccgaggacggcccccccgagctgctgttcatccacggcggccacaccgccaagatcagcgacttcagctggaaccccaacgagccctgggtgatctgcagcgtgagcgaggacaacatcatgcaggtgtggcagatggccgagaacatctacaacgacgaggaccccgagggcagcgtggaccccgagggccagggcagctag

SEQ ID NO: 9318 - DNA, 588 bp, Artificial Sequence
  Description of Artificial Sequence: Synthetic coding sequence
atggccgccgaggacgtggtggccaccggcgccgaccccagcgacctggagagcggcggcctgctgcacgagatcttcaccagccccctgaacctgctgctgctgggcctgtgcatcttcctgctgtacaagatcgtgagaggcgaccagcccgccgccagcggcgacagcgacgacgacgagcccccccccctgcccagactgaagagaagagacttcacccccgccgagctgagaagattcgacggcgtgcaggaccccagaatcctgatggccatcaacggcaaggtgttcgacgtgaccaagggcagaaagttctacggccccgagggcccctacggcgtgttcgccggcagagacgccagcagaggcctggccaccttctgcctggacaaggaggccctgaaggacgagtacgacgacctgagcgacctgaccgccgcccagcaggagaccctgagcgactgggagagccagttcaccttcaagtaccaccacgtgggcaagctgctgaaggagggcgaggagcccaccgtgtacagcgacgaggaggagcccaaggacgagagcgccagaaagaacgactag

SEQ ID NO: 9319 - DNA, 867 bp, Artificial Sequence
  Description of Artificial Sequence: Synthetic coding sequence
atggagccccccgaccagtgcagccagtacatgaccagcctgctgagccccgccgtggacgacgagaaggagctgcaggacatgaacgccatggtgctgagcctgaccgaggaggtgaaggaggaggaggaggacgcccagcccgagcccgagcagggcaccgccgccggcgagaagctgaagagcgccggcgcccagggcggcgaggagaaggacggcggcggcgaggagaaggacggcggcggcgccggcgtgcccggccacctgtgggagggcgacctggagggcaccagcggcagcgacggcaacgtggaggacagcgaccagagcgagaaggagcccggccagcagtacagcagaccccagggcgccgtgggcggcctggagcccggcaacgcccagcagcccaacgtgcacgccttcacccccctgcagctgcaggagctggagagaatcttccagagagagcagttccccagcgagttcctgagaagaagactggccagaagcatgaacgtgaccgagctggccgtgcagatctggttcgagaacagaagagccaagtggagaagacaccagagagccctgatggccagaaacatgctgcccttcatggccgtgggccagcccgtgatggtgaccgccgccgaggccatcaccgcccccctgttcatcagcggcatgagagacgactacttctgggaccacagccacagcagcagcctgtgcttccccatgccccccttccccccccccagcctgcccctgcccctgatgctgctgccccccatgccccccgccggccaggccgagttcggccccttccccttcgtgatcgtgcccagcttcaccttccccaacgtgtag

SEQ ID NO: 9320 - DNA, 867 bp, Artificial Sequence
  Description of Artificial Sequence: Synthetic coding sequence
atggagccccccgaccagtgcagccagtacatgaccagcctgctgagccccgccgtggacgacgagaaggagctgcaggacatgaacgccatggtgctgagcctgaccgaggaggtgaaggaggaggaggaggacgcccagcccgagcccgagcagggcaccgccgccggcgagaagctgaagagcgccggcgcccagggcggcgaggagaaggacggcggcggcgaggagaaggacggcggcggcgccggcgtgcccggccacctgtgggagggcaacctggagggcaccagcggcagcgacggcaacgtggaggacagcgaccagagcgagaaggagcccggccagcagtacagcagaccccagggcgccgtgggcggcctggagcccggcaacgcccagcagcccaacgtgcacgccttcacccccctgcagctgcaggagctggagtgcatcttccagagagagcagttccccagcgagttcctgagaagaagactggccagaagcatgaacgtgaccgagctggccgtgcagatctggttcgagaacagaagagccaagtggagaagacaccagagagccctgatggccagaaacatgctgcccttcatggccgtgggccagcccgtgatggtgaccgccgccgaggccatcaccgcccccctgttcatcagcggcatgagagacgactacttctgggaccacagccacagcagcagcctgtgcttccccatgccccccttccccccccccagcctgcccctgcccctgatgctgctgccccccatgccccccgccggccaggccgagttcggccccttccccttcgtgatcgtgcccagcttcaccttccccaacgtgtag

SEQ ID NO: 9321 - DNA, 375 bp, Artificial Sequence
  Description of Artificial Sequence: Synthetic coding sequence
atgcccgcccccgccgccacctacgagagagtggtgtacaagaaccccagcgagtaccactacatgaaggtgtgcctggagttccaggactgcggcgtgggcctgaacgccgcccagttcaagcagctgctgatcagcgccgtgaaggacctgttcggcgaggtggacgccgccctgcccctggacatcctgacctacgaggagaagaccctgagcgccatcctgagaatctgcagcagcggcctggtgaagctgtggagcagcctgaccctgctgggcagctacaagggcaagaagtgcgccttcagagtgatccaggtgagccccttcctgctggccctgagcggcaacagcagagagctggtgctggactag

SEQ ID NO: 9322 - DNA, 375 bp, Artificial Sequence; identical to SEQ ID NO: 9321
  Description of Artificial Sequence: Synthetic coding sequence

SEQ ID NO: 9323 - DNA, 375 bp, Artificial Sequence; identical to SEQ ID NO: 9321
  Description of Artificial Sequence: Synthetic coding sequence

SEQ ID NO: 9324 - DNA, 600 bp, Artificial Sequence
  Description of Artificial Sequence: Synthetic coding sequence
atggagaacttcagaaaggtgagaagcgaggaggcccccgccggctgcggcgccgagggcggcggccccggcagcggccccttcgccgacctggcccccggcgccgtgcacatgagagtgaaggagggcagcaagatcagaaacctgatggccttcgccaccgccagcatggcccagcccgccaccagagccatcgtgttcagcggctgcggcagagccaccaccaagaccgtgacctgcgccgagatcctgaagagaagactggccggcctgcaccaggtgaccagactgagatacagaagcgtgagagaggtgtggcagagcctgccccccggccccacccagggccagacccccggcgagcccgccgccagcctgagcgtgctgaagaacgtgcccggcctggccatcctgctgagcaaggacgccctggaccccagacagcccggctaccagccccccaacccccaccccggccccagcagcccccccgccgcccccgccagcaagagaagcctgggcgagcccgccgccggcgagggcagcgccaagagaagccagcccgagcccggcgtggccgacgaggaccagaccgcctag

SEQ ID NO: 9325 - DNA, 600 bp, Artificial Sequence; identical to SEQ ID NO: 9324
  Description of Artificial Sequence: Synthetic coding sequence

SEQ ID NO: 9326 - DNA, 1386 bp, Artificial Sequence
  Description of Artificial Sequence: Synthetic coding sequence
atggtgagcagagtgcagctgccccccgagatccagctggcccagagactggccggcaacgagcaggtgaccagagacagagccgtgagaaagctgagaaagtacatcgtggccagaacccagagagccgccggcggcttcacccacgacgagctgctgaaggtgtggaagggcctgttctactgcatgtggatgcaggacaagcccctgctgcaggaggagctgggcagaaccatcagccagctggtgcacgccttccagaccaccgaggcccagcacctgttcctgcaggccttctggcagaccatgaacagagagtggaccggcatcgacagactgagactggacaagttctacatgctgatgagaatggtgctgaacgagagcctgaaggtgctgaagatgcagggctgggaggagagacagatcgaggagctgctggagctgctgatgaccgagatcctgcaccccagcagccaggcccccaacggcgtgaagagccacttcatcgagatcttcctggaggagctgaccaaggtgggcgccgaggagctgaccgccgaccagaacctgaagttcatcgaccccttctgcagaatcgccgccagaaccaaggacagcctggtgctgaacaacatcaccagaggcatcttcgagaccatcgtggagcaggcccccctggccatcgaggacctgctgaacgagctggacacccaggacgaggaggtggccagcgacagcgacgagagcagcgagggcggcgagagaggcgacgccctgagccagaagagaagcgagaagccccccgccggcagcatctgcagagccgagcccgaggccggcgaggagcaggccggcgacgacagagacagcggcggccccgtgctgcagttcgactacgaggccgtggccaacagactgttcgagatggccagcagacagagcacccccagccagaacagaaagagactgtacaaggtgatcagaaagctgctgccctggttcagcggcatcttccccgaggacgagatccccgagaaggcctgcagaagactgctggagggcagaagacagaagaagaccaagaagcagaagagactgctgagactgcagcaggagagaggcaagggcgagaaggagccccccagccccggcatggagagaaagagaagcagaagaagaggcgtgggcgccgaccccgaggccagagccgaggccggcgagcagcccggcaccgccgagagagccctgctgagagaccagcccagaggcagaggccagagaggcgccagacagagaagaagaacccccagacccctgaccagcgccagagccaaggccgccaacgtgcaggagcccgagaagaagaagaagagaagagagtag

SEQ ID NO: 9327 - DNA, 1386 bp, Artificial Sequence
  Description of Artificial Sequence: Synthetic coding sequence
atggtgagcagagtgcagctgccccccgagatccagctggcccagagactggccggcaacgagcaggtgaccagagacagagccgtgagaaagctgagaaagtacatcgtggccagaacccagagagccgccggcggcttcacccacgacgagctgctgaaggtgtggaagggcctgttctactgcatgtggatgcaggacaagcccctgctgcaggaggagctgggcagaaccatcagccagctggtgcacgccttccagaccaccgaggcccagcacctgttcctgcaggccttctggcagaccatgaacagagagtggaccggcatcgacagactgagactggacaagttctacatgctgatgagaatggtgctgaacgagagcctgaaggtgctgaagatgcagggctgggaggagagacagatcgaggagctgctggagctgctgatgaccgagatcctgcaccccagcagccaggcccccaacggcgtgaagagccacttcatcgagatcttcctggaggagctgaccaaggtgggcgccgaggagctgaccgccgaccagaacctgaagttcatcgaccccttctgcagaatcgccgccagaaccaaggacagcctggtgctgaacaacatcaccagaggcatcttcgagaccatcgtggagcaggcccccctggccatcgaggacctgctgaacgagctggacacccaggacgaggaggtggccagcgacagcgacgagagcagcgagggcggcgagagaggcgacgccctgagccagaagagaagcgagaagccccccgccggcagcatctgcagagccgagcccgaggccggcgaggagcaggccggcgacgacagagacagcggcggccccgtgctgcagttcgactacgaggccgtggccaacagactgttcgagatggccagcagacagagcacccccagccagaacagaaagagactgtacaaggtgatcagaaagctgcaggacctggccggcggcatcttccccgaggacgagatccccgagaaggcctgcagaagactgctggagggcagaagacagaagaagaccaagaagcagaagagactgctgagactgcagcaggagagaggcaagggcgagaaggagccccccagccccggcatggagagaaagagaagcagaagaagaggcgtgggcgccgaccccgaggccagagccgaggccggcgagcagcccggcaccgccgagagagccctgctgagagaccagcccagaggcagaggccagagaggcgccagacagagaagaagaacccccagacccctgaccagcgccagagccaaggccgccaacgtgcaggagcccgagaagaagaagaagagaagagagtag

SEQ ID NO: 9328 - DNA, 1371 bp, Artificial Sequence
  Description of Artificial Sequence: Synthetic coding sequence
atgttcgaggagcccgagtgggccgaggccgcccccgtggccgccggcctgggccccgtgatcagcagacccccccccgccgccagcagccagaacaagggcagcaagagaagacagctgctggccaccctgagagccctggaggccgccagcctgagccagcacccccccagcctgtgcatcagcgacagcgaggaggaggaggaggagagaaagaagaagtgccccaagaaggccagcttcgccagcgccagcgccgaggtgggcaagaagggcaagaagaagtgccagaagcagggccccccctgcagcgacagcgaggaggaggtggagagaaagaagaagtgccacaagcaggccctggtgggcagcgacagcgccgaggacgagaagagaaagagaaagtgccagaagcacgcccccatcaacagcgcccagcacctggacaacgtggaccagaccggccccaaggcctggaagggcagcaccaccaacgacccccccaagcagagccccggcagcaccagccccaagcccccccacaccctgagcagaaagcagtggagaaacagacagaagaacaagagaagatgcaagaacaagttccagcccccccaggtgcccgaccaggcccccgccgaggcccccaccgagaagaccgaggtgagccccgtgcccagaaccgacagccacgaggccagagccggcgccctgagagccagaatggcccagagactggacggcgccagattcagatacctgaacgagcagctgtacagcggccccagcagcgccgcccagagactgttccaggaggaccccgaggccttcctgctgtaccacagaggcttccagagccaggtgaagaagtggcccctgcagcccgtggacagaatcgccagagacctgagacagagacccgccagcctggtggtggccgacttcggctgcggcgactgcagactggccagcagcatcagaaaccccgtgcactgcttcgacctggccagcctggaccccagagtgaccgtgtgcgacatggcccaggtgcccctggaggacgagagcgtggacgtggccgtgttctgcctgagcctgatgggcaccaacatcagagacttcctggaggaggccaacagagtgctgaagcccggcggcctgctgaaggtggccgaggtgagcagcagattcgaggacgtgagaaccttcctgagagccgtgaccaagctgggcttcaagatcgtgagcaaggacctgaccaacagccacttcttcctgttcgacttccagaagaccggcccccccctggtgggccccaaggcccagctgagcggcctgcagctgcagccctgcctgtacaagagaagatag

SEQ ID NO: 9329 - DNA, 1017 bp, Artificial Sequence
  Description of Artificial Sequence: Synthetic coding sequence
atggagctgtggggcagaatgctgtgggccctgctgagcggccccggcagaagaggcagcaccagaggctgggccttcagcagctggcagccccagccccccctggccggcctgagcagcgccatcgagctggtgagccactggaccggcgtgttcgagaagagaggcatccccgaggccagagagagcagcgagtacatcgtggcccacgtgctgggcgccaagaccttccagagcctgagacccgccctgtggacccagcccctgaccagccagcagctgcagtgcatcagagagctgagcagcagaagactgcagagaatgcccgtgcagtacatcctgggcgagtgggacttccagggcctgagcctgagaatggtgccccccgtgttcatccccagacccgagaccgaggagctggtggagtgggtgctggaggaggtggcccagagaagccacgccgtgggcagccccggcagccccctgatcctggaggtgggctgcggcagcggcgccatcagcctgagcctgctgagccagctgccccagagcagagtgatcgccgtggacaagagagaggccgccatcagcctgacccacgagaacgcccagagactgagactgcaggacagaatctggatcatccacctggacatgaccagcgagagaagctggacccacctgccctggggccccatggacctgatcgtgagcaaccccccctacgtgttccaccaggacatggagcagctggcccccgagatcagaagctacgaggaccccgccgccctggacggcggcgaggagggcatggacatcatcacccacatcctggccctggcccccagactgctgaaggacagcggcagcatcttcctggaggtggaccccagacaccccgagctggtgagcagctggctgcagagcagacccgacctgtacctgaacctggtggccgtgagaagagacttctgcggcagacccagattcctgcacatcagaagaagcggcccctag

SEQ ID NO: 9330 - DNA, 1050 bp, Artificial Sequence
  Description of Artificial Sequence: Synthetic coding sequence
atggccaaggccggcgacaagagcagcagcagcggcaagaagagcctgaagagaaaggccgccgccgaggagctgcaggaggccgccggcgccggcgacggcgccaccgagaacggcgtgcagccccccaaggccgccgccttcccccccggcttcagcatcagcgagatcaagaacaagcagagaagacacctgatgttcaccagatggaagcagcagcagagaaaggagaagctggccgccaagaagaagctgaagaaggagagagaggccctgggcgacaaggccccccccaagcccgtgcccaagaccatcgacaaccagagagtgtacgacgagaccaccgtggaccccaacgacgaggaggtggcctacgacgaggccaccgacgagttcgccagctacttcaacaagcagaccagccccaagatcctgatcaccaccagcgacagaccccacggcagaaccgtgagactgtgcgagcagctgagcaccgtgatccccaacagccacgtgtactacagaagaggcctggccctgaagaagatcatcccccagtgcatcgccagagacttcaccgacctgatcgtgatcaacgaggacagaaagacccccaacggcctgatcctgagccacctgcccaacggccccaccgcccacttcaagatgagcagcgtgagactgagaaaggagatcaagagaagaggcaaggaccccaccgagcacatccccgagatcatcctgaacaacttcaccaccagactgggccacagcatcggcagaatgttcgccagcctgttcccccacaacccccagttcatcggcagacaggtggccaccttccacaaccagagagactacatcttcttcagattccacagatacatcttcagaagcgagaagaaggtgggcatccaggagctgggccccagattcaccctgaagctgagaagcctgcagaagggcaccttcgacagcaagtacggcgagtacgagtgggtgcacaagcccagagagatggacaccagcagaagaaagttccacctgtag

SEQ ID NO: 9331 - DNA, 390 bp, Artificial Sequence
  Description of Artificial Sequence: Synthetic coding sequence
atggccaaggccggcgacaagagcagcagcagcggcaagaagagcctgaagagaaaggccgccgccgaggagctgcaggaggccgccggcgccggcgacggcgccaccgagaacggcgtgcagccccccaaggccgccgccttcccccccggcttcagcatcagcgagatcaagaacaagcagagaagacacctgatgttcaccagatggaagcagcagcagagaaaggagaagctggccgccaagaagaagctgaagaaggagagagaggccctgggcgacaaggccccccccaagcccgtgcccaagaccatcgacaaccagagagtgtacgacgagaccaccgtggaccccaacgacgaggaggtgatgctggaggtgctgaactag

SEQ ID NO: 9332 - DNA, 627 bp, Artificial Sequence
  Description of Artificial Sequence: Synthetic coding sequence
atgtgcttcgtgctgaaggccatcaacttcgtgctgcagtacgccctgaagaagccctacggcgtgctgtacaagaagaagaacatcaccagacccttcgaggaccagaccagcctggagttcttcagcaagaagagcgactgcagcctgttcatgttcggcagccacaacaagaagagacccaacaacctggtgatcggcagaatgtacgactaccacgtgctggacatgatcgagctgggcatcgagaacttcgtgagcctgaaggacatcaagaacagcaagtgccccgagggcaccaagcccatgctgatcttcgccggcgacgacttcgacgtgaccgaggactacagaagactgaagagcctgctgatcgacttcttcagaggccccaccgtgagcaacatcagactggccggcctggagtacgtgctgcacttcaccgccctgaacggcaagatctacttcagaagctacaagctgctgctgaagaagagcggctgcagaacccccagaatcgagctggaggagatgggccccagcctggacctggtgctgagaagaacccacctggccagcgacgacctgtacaagctgagcatgaagatgcccaaggccctgaagtag

SEQ ID NO: 9333 - DNA, 645 bp, Artificial Sequence
  Description of Artificial Sequence: Synthetic coding sequence
atgctgatcaagggcggcaacgccaacgccaccgtgaccaaggtgctgaaggacgtgtacgccctgaagaagccctacggcgtgctgtacaagaagaagaacatcaccagacccttcgaggaccagaccagcctggagttcttcagcaagaagagcgactgcagcctgttcatgttcggcagccacaacaagaagagacccaacaacctggtgatcggcagaatgtacgactaccacgtgctggacatgatcgagctgggcatcgagaacttcgtgagcctgaaggacatcaagaacagcaagtgccccgagggcaccaagcccatgctgatcttcgccggcgacgacttcgacgtgaccgaggactacagaagactgaagagcctgctgatcgacttcttcagaggccccaccgtgagcaacatcagactggccggcctggagtacgtgctgcacttcaccgccctgaacggcaagatctacttcagaagctacaagctgctgctgaagaagagcggctgcagaacccccagaatcgagctggaggagatgggccccagcctggacctggtgctgagaagaacccacctggccagcgacgacctgtacaagctgagcatgaagatgcccaaggccctgaagtag

SEQ ID NO: 9334 - DNA, 921 bp, Artificial Sequence
  Description of Artificial Sequence: Synthetic coding sequence
atggacaccctggacagagtggtgaagcccaagaccaagagagccaagagattcctggagaagagagagcccaagctgaacgagaacatcaagaacgccatgctgatcaagggcggcaacgccaacgccaccgtgaccaaggtgctgaaggacgtgtacgccctgaagaagccctacggcgtgctgtacaagaagaagaacatcaccagacccttcgaggaccagaccagcctggagttcttcagcaagaagagcgactgcagcctgttcatgttcggcagccacaacaagaagagacccaacaacctggtgatcggcagaatgtacgactaccacgtgctggacatgatcgagctgggcatcgagaacttcgtgagcctgaaggacatcaagaacagcaagtgccccgagggcaccaagcccatgctgatcttcgccggcgacgacttcgacgtgaccgaggactacagaagactgaagagcctgctgatcgacttcttcagaggccccaccgtgagcaacatcagactggccggcctggagtacgtgctgcacttcaccgccctgaacggcaagatctacttcagaagctacaagctgctgctgaagaagagcggctgcagaacccccagaatcgagctggaggagatgggccccagcctggacctggtgctgagaagaacccacctggccagcgacgacctgtacaagctgagcatgaagatgcccaaggccctgaagcccaagaagaagaagaacatcagccacgacaccttcggcaccacctacggcagaatccacatgcagaagcaggacctgagcaagctgcagaccagaaagatgaagggcctgaagaagagacccgccgagagaatcaccgaggaccacgagaagaagagcaagagaatcaagaagaactag

SEQ ID NO: 9335 - DNA, 546 bp, Artificial Sequence
  Description of Artificial Sequence: Synthetic coding sequence
atgagcggcatcggcaacaagagagccgccggcgagcccggcaccagcatgccccccgagaagaaggccgccgtggaggacagcggcaccaccgtggagaccatcaagctgggcggcgtgagcagcaccgaggagctggacatcagaaccctgcagaccaagaacagaaagctggccgagatgctggaccagagacaggccatcgaggacgagctgagagagcacatcgagaagctggagagaagacaggccaccgacgacgccagcctgctgatcgtgaacagatactggagccagttcgacgagaacatcagaatcatcctgaagagatacgacctggagcagggcctgggcgacctgctgaccgagagaaaggccctggtggtgcccgagcccgagcccgacagcgacagcaaccaggagagaaaggacgacagagagagaggcgagggccaggagcccgccttcagcttcctggccaccctggccagcagcagcagcgaggagatggagagccagctgcaggagagagtggagagcagctag

SEQ ID NO: 9336 - DNA, 2928 bp, Artificial Sequence
  Description of Artificial Sequence: Synthetic coding sequence
atgagcggcatcggcaacaagagagccgccggcgagcccggcaccagcatgccccccgagaagaaggccgccgtggaggacagcggcaccaccgtggagaccatcaagctgggcggcgtgagcagcaccgaggagctggacatcagaaccctgcagaccaagaacagaaagctggccgagatgctggaccagagacaggccatcgaggacgagctgagagagcacatcgagaagctggagagaagacaggccaccgacgacgccagcctgctgatcgtgaacagatactggagccagttcgacgagaacatcagaatcatcctgaagagatacgacctggagcagggcctgggcgacctgctgaccgagagaaaggccctggtggtgcccgagcccgagcccgacagcgacagcaaccaggagagaaaggacgacagagagagaggcgagggccaggagcccgccttcagcttcctggccaccctggccagcagcagcagcgaggagatggagagccagctgcaggagagagtggagagcagcagaagagccgtgagccagatcgtgaccgtgtacgacaagctgcaggagaaggtggagctgctgagcagaaagctgaacagcggcgacaacctgatcgtggaggaggccgtgcaggagctgaacagcttcctggcccaggagaacatgagactgcaggagctgaccgacctgctgcaggagaagcacagaaccatgagccaggagttcagcaagctgcagagcaaggtggagaccgccgagagcagagtgagcgtgctggagagcatgatcgacgacctgcagtgggacatcgacaagatcagaaagagagagcagagactgaacagacacctggccgaggtgctggagagagtgaacagcaagggctacaaggtgtacggcgccggcagcagcctgtacggcggcaccatcaccatcaacgccagaaagttcgaggagatgaacgccgagctggaggagaacaaggagctggcccagaacagactgtgcgagctggagaagctgagacaggacttcgaggaggtgaccacccagaacgagaagctgaaggtggagctgagaagcgccgtggagcaggtggtgaaggagacccccgagtacagatgcatgcagagccagttcagcgtgctgtacaacgagagcctgcagctgaaggcccacctggacgaggccagaaccctgctgcacggcaccagaggcacccaccagcaccaggtggagctgatcgagagagacgaggtgagcctgcacaagaagctgagaaccgaggtgatccagctggaggacaccctggcccaggtgagaaaggagtacgagatgctgagaatcgagttcgagcagaccctggccgccaacgagcaggccggccccatcaacagagagatgagacacctgatcagcagcctgcagaaccacaaccaccagctgaagggcgaggtgctgagatacaagagaaagctgagagaggcccagagcgacctgaacaagaccagactgagaagcggcagcgccctgctgcagagccagagcagcaccgaggaccccaaggacgagcccgccgagctgaagcccgacagcgaggacctgagcagccagagcagcgccagcaaggccagccaggaggacgccaacgagatcaagagcaagagagacgaggaggagagagagagagagagaagagagaaggagagagagagagagagagagagagagaaggagaaggagagagagagagagaagcagaagctgaaggagagcgagaaggagagagacagcgccaaggacaaggagaagggcaagcacgacgacggcagaaagaaggaggccgagatcatcaagcagctgaagatcgagctgaagaaggcccaggagagccagaaggagatgaagctgctgctggacatgtacagaagcgcccccaaggagcagagagacaaggtgcagctgatggccgccgagaagaagagcaaggccgagctggaggacctgagacagagactgaaggacctggaggacaaggagaagaaggagaacaagaagatggccgacgaggacgccctgagaaagatcagagccgtggaggagcagatcgagtacctgcagaagaagctggccatggccaagcaggaggaggaggccctgctgagcgagatggacgtgaccggccaggccttcgaggacatgcaggagcagaacatcagactgatgcagcagctgagagagaaggacgacgccaacttcaagctgatgagcgagagaatcaagagcaaccagatccacaagctgctgaaggaggagaaggaggagctggccgaccaggtgctgaccctgaagacccaggtggacgcccagctgcaggtggtgagaaagctggaggagaaggagcacctgctgcagagcaacatcggcaccggcgagaaggagctgggcctgagaacccaggccctggagatgaacaagagaaaggccatggaggccgcccagctggccgacgacctgaaggcccagctggagctggcccagaagaagctgcacgacttccaggacgagatcgtggagaacagcgtgaccaaggagaaggacatgttcaacttcaagagagcccaggaggacatcagcagactgagaagaaagctggagaccaccaagaagcccgacaacgtgcccaagtgcgacgagatcctgatggaggagatcaaggactacaaggccagactgacctgcccctgctgcaacatgagaaagaaggacgccgtgctgaccaagtgcttccacgtgttctgcttcgagtgcgtgaagaccagatacgacaccagacagagaaagtgccccaagtgcaacgccgccttcggcgccaacgacttccacagaatctacatcggctag

SEQ ID NO: 9337 - DNA, 438 bp, Artificial Sequence
  Description of Artificial Sequence: Synthetic coding sequence
atgagcggcatcggcaacaagagagccgccggcgagcccggcaccagcatgccccccgagaagaaggccgccgtggaggacagcggcaccaccgtggagaccatcaagctgggcggcgtgagcagcaccgaggagctggacatcagaaccctgcagaccaagaacagaaagctggccgagatgctggaccagagacaggccatcgaggacgagctgagagagcacatcgagaagctggagagaagacaggccaccgacgacgccagcctgctgatcgtgaacagatactggagccagttcgacgagaacatcagaatcatcctgaagagatacgacctggagcagggcctgggcgacctgctgaccgagagaaaggccctggtggtgcccgagcccgagcccgacagcgacagcaaccaggagagaaaggacgactag

SEQ ID NO: 9338 - DNA, 300 bp, Artificial Sequence
  Description of Artificial Sequence: Synthetic coding sequence
atgagcggcatcggcaacaagagagccgccggcgagcccggcaccagcatgccccccgagaagaaggccgccgtggaggacagcggcaccaccgtggagaccatcaagctgggcggcgtgagcagcaccgaggagctggacatcagaaccctgcagaccaagaacagaaagctggccgagatgctggaccagagacaggccatcgaggacgagctgagagagcacatcgagaagctggagagaagacaggccaccgacgacgccagcctgctgatcgtgaacagatactggagccagtag

SEQ ID NO: 9339 - DNA, 1878 bp, Artificial Sequence
  Description of Artificial Sequence: Synthetic coding sequence
atgaacgtgaccagcatcgccctgagagccgagacctggctgctggccgcctggcacgtgaaggtgccccccatgtggctggaggcctgcatcaactggatccaggaggagaacaacaacgtgaacctgagccaggcccagatgaacaagcaggtgttcgagcagtggctgctgaccgacctgagagacctggagcaccccctgctgcccgacggcatcctggagatccccaagggcgagctgaacggcttctacgccctgcagatcaacagcctggtggacgtgagccagcccgcctacagccagatccagaagctgagaggcaagaacaccaccaacgacctggtgaccgccgaggcccaggtgacccccaagccctgggaggccaagcccagcagaatgctgatgctgcagctgaccgacggcatcgtgcagatccagggcatggagtaccagcccatccccatcctgcacagcgacctgccccccggcaccaagatcctgatctacggcaacatcagcttcagactgggcgtgctgctgctgaagcccgagaacgtgaaggtgctgggcggcgaggtggacgccctgctggaggagtacgcccaggagaaggtgctggccagactgatcggcgagcccgacctggtggtgagcgtgatccccaacaacagcaacgagaacatccccagagtgaccgacgtgctggaccccgccctgggccccagcgacgaggagctgctggccagcctggacgagaacgacgagctgaccgccaacaacgacaccagcagcgagagatgcttcaccaccggcagcagcagcaacaccatccccaccagacagagcagcttcgagcccgagttcgtgatcagccccagacccaaggaggagcccagcaacctgagcatccacgtgatggacggcgagctggacgacttcagcctggaggaggccctgctgctggaggagaccgtgcagaaggagcagatggagaccaaggagctgcagcccctgaccttcaacagaaacgccgacagaagcatcgagagattcagccacaaccccaacaccaccaacaacttcagcctgacctgcaagaacggcaacaacaactggagcgagaagaacgtgagcgagcagatgaccaacgaggacaagagcttcggctgccccagcgtgagagaccagaacagaagcatcttcagcgtgcactgcaacgtgcccctggcccacgacttcaccaacaaggagaagaacctggagaccgacaacaagatcaagcagaccagcagcagcgacagccacagcctgaacaacaagatcctgaacagagaggtggtgaactacgtgcagaagagaaacagccagatcagcaacgagaacgactgcaacctgcagagctgcagcctgagaagcagcgagaacagcatcaacctgagcatcgccatggacctgtacagcccccccttcgtgtacctgagcgtgctgatggccagcaagcccaaggaggtgaccaccgtgaaggtgaaggccttcatcgtgaccctgaccggcaacctgagcagcagcggcggcatctggagcatcaccgccaaggtgagcgacggcaccgcctacctggacgtggacttcgtggacgagatcctgaccagcctgatcggcttcagcgtgcccgagatgaagcagagcaagaaggaccccctgcagtaccagaagttcctggagggcctgcagaagtgccagagagacctgatcgacctgtgctgcctgatgaccatcagcttcaaccccagcctgagcaaggccatggtgctggccctgcaggacgtgaacatggagcacctggagaacctgaagaagagactgaacaagtag

SEQ ID NO: 9340 - DNA, 2196 bp, Artificial Sequence
  Description of Artificial Sequence: Synthetic coding sequence
atgcccagcatcccccccatccccgtgcccccccccgtgcccaccctgccccccgtgccccccgtgccccccatcccccccgtgcccagcgtgccccccatgacccccctgccccccatgagcggcatgccccccctgaaccccccccccgtggcccccctgcccgccggcatgaacggcagcggcgcccccatgaacctgaacaacaacctgaaccccatgttcctgggccccctgaaccccgtgaaccccatccagatgaacagccagagcagcgtgaagcccctgcccatcaaccccgacgacctgtacgtgagcgtgcacggcatgcccttcagcgccatggagaacgacgtgagagacttcttccacggcctgagagtggacgccgtgcacctgctgaaggaccacgtgggcagaaacaacggcaacggcctggtgaagttcctgagcccccaggacaccttcgaggccctgaagagaaacagaatgctgatgatccagagatacgtggaggtgagccccgccaccgagagacagtgggtggccgccggcggccacatcaccttcaagcagaacatgggccccagcggccagacccacccccccccccagaccctgcccagaagcaagagccccagcggccagaagagaagcagaagcagaagcccccacgaggccggcttctgcgtgtacctgaagggcctgcccttcgaggccgagaacaagcacgtgatcgacttcttcaagaagctggacatcgtggaggacagcatctacatcgcctacggccccaacggcaaggccaccggcgagggcttcgtggagttcagaaacgaggccgactacaaggccgccctgtgcagacacaagcagtacatgggcaacagattcatccaggtgcaccccatcaccaagaagggcatgctggagaagatcgacatgatcagaaagagactgcagaacttcagctacgaccagagagagatgatcctgaaccccgagggcgacgtgaacagcgccaaggtgtgcgcccacatcaccaacatccccttcagcatcaccaagatggacgtgctgcagttcctggagggcatccccgtggacgagaacgccgtgcacgtgctggtggacaacaacggccagggcctgggccaggccctggtgcagttcaagaacgaggacgacgccagaaagagcgagagactgcacagaaagaagctgaacggcagagaggccttcgtgcacgtggtgaccctggaggacatgagagagatcgagaagaacccccccgcccagggcaagaagggcctgaagatgcccgtgcccggcaaccccgccgtgcccggcatgcccaacgccggcctgcccggcgtgggcctgcccagcgccggcctgcccggcgccggcctgcccagcaccggcctgcccggcagcgccatcaccagcgccggcctgcccggcgccggcatgcccagcgccggcatccccagcgccggcggcgaggagcacgccttcctgaccgtgggcagcaaggaggccaacaacggcccccccttcaacttccccggcaacttcggcggcagcaacgccttcggcccccccatccccccccccggcctgggcggcggcgccttcggcgacgccagacccggcatgcccagcgtgggcaacagcggcctgcccggcctgggcctggacgtgcccggcttcggcggcggccccaacaacctgagcggccccagcggcttcggcggcggcccccagaacttcggcaacggccccggcagcctgggcggcccccccggcttcggcagcggcccccccggcctgggcagcgcccccggccacctgggcggcccccccgccttcggccccggccccggccccggccccggccccggccccatccacatcggcggcccccccggcttcgccagcagcagcggcaagcccggccccaccgtgatcaaggtgcagaacatgcccttcaccgtgagcatcgacgagatcctggacttcttctacggctaccaggtgatccccggcagcgtgtgcctgaagtacaacgagaagggcatgcccaccggcgaggccatggtggccttcgagagcagagacgaggccaccgccgccgtgatcgacctgaacgacagacccatcggcagcagaaaggtgaagctggtgctgggctag

SEQ ID NO: 9341 - DNA, 2799 bp, Artificial Sequence
  Description of Artificial Sequence: Synthetic coding sequence
atggccgtggtgatcagactgcagggcctgcccatcgtggccggcaccatggacatcagacacttcttcagcggcctgaccatccccgacggcggcgtgcacatcgtgggcggcgagctgggcgaggccttcatcgtgttcgccaccgacgaggacgccagactgggcatgatgagaaccggcggcaccatcaagggcagcaaggtgaccctgctgctgagcagcaagaccgagatgcagaacatgatcgagctgagcagaagaagattcgagaccgccaacctggacatcccccccgccaacgccagcagaagcggccccccccccagcagcggcatgagcagcagagtgaacctgcccaccaccgtgagcaacttcaacaaccccagccccagcgtggtgaccgccaccaccagcgtgcacgagagcaacaagaacatccagaccttcagcaccgccagcgtgggcaccgccccccccaacatgggcgccagcttcggcagccccaccttcagcagcaccgtgcccagcaccgccagccccatgaacaccgtgccccccccccccatcccccccatccccgccatgcccagcctgccccccatgcccagcatcccccccatccccgtgcccccccccgtgcccaccctgccccccgtgccccccgtgccccccatcccccccgtgcccagcgtgccccccatgacccccctgccccccatgagcggcatgccccccctgaaccccccccccgtggcccccctgcccgccggcatgaacggcagcggcgcccccatgaacctgaacaacaacctgaaccccatgttcctgggccccctgaaccccgtgaaccccatccagatgaacagccagagcagcgtgaagcccctgcccatcaaccccgacgacctgtacgtgagcgtgcacggcatgcccttcagcgccatggagaacgacgtgagagacttcttccacggcctgagagtggacgccgtgcacctgctgaaggaccacgtgggcagaaacaacggcaacggcctggtgaagttcctgagcccccaggacaccttcgaggccctgaagagaaacagaatgctgatgatccagagatacgtggaggtgagccccgccaccgagagacagtgggtggccgccggcggccacatcaccttcaagcagaacatgggccccagcggccagacccacccccccccccagaccctgcccagaagcaagagccccagcggccagaagagaagcagaagcagaagcccccacgaggccggcttctgcgtgtacctgaagggcctgcccttcgaggccgagaacaagcacgtgatcgacttcttcaagaagctggacatcgtggaggacagcatctacatcgcctacggccccaacggcaaggccaccggcgagggcttcgtggagttcagaaacgaggccgactacaaggccgccctgtgcagacacaagcagtacatgggcaacagattcatccaggtgcaccccatcaccaagaagggcatgctggagaagatcgacatgatcagaaagagactgcagaacttcagctacgaccagagagagatgatcctgaaccccgagggcgacgtgaacagcgccaaggtgtgcgcccacatcaccaacatccccttcagcatcaccaagatggacgtgctgcagttcctggagggcatccccgtggacgagaacgccgtgcacgtgctggtggacaacaacggccagggcctgggccaggccctggtgcagttcaagaacgaggacgacgccagaaagagcgagagactgcacagaaagaagctgaacggcagagaggccttcgtgcacgtggtgaccctggaggacatgagagagatcgagaagaacccccccgcccagggcaagaagggcctgaagatgcccgtgcccggcaaccccgccgtgcccggcatgcccaacgccggcctgcccggcgtgggcctgcccagcgccggcctgcccggcgccggcctgcccagcaccggcctgcccggcagcgccatcaccagcgccggcctgcccggcgccggcatgcccagcgccggcatccccagcgccggcggcgaggagcacgccttcctgaccgtgggcagcaaggaggccaacaacggcccccccttcaacttccccggcaacttcggcggcagcaacgccttcggcccccccatccccccccccggcctgggcggcggcgccttcggcgacgccagacccggcatgcccagcgtgggcaacagcggcctgcccggcctgggcctggacgtgcccggcttcggcggcggccccaacaacctgagcggccccagcggcttcggcggcggcccccagaacttcggcaacggccccggcagcctgggcggcccccccggcttcggcagcggcccccccggcctgggcagcgcccccggccacctgggcggcccccccgccttcggccccggccccggccccggccccggccccggccccatccacatcggcggcccccccggcttcgccagcagcagcggcaagcccggccccaccgtgatcaaggtgcagaacatgcccttcaccgtgagcatcgacgagatcctggacttcttctacggctaccaggtgatccccggcagcgtgtgcctgaagtacaacgagaagggcatgcccaccggcgaggccatggtggccttcgagagcagagacgaggccaccgccgccgtgatcgacctgaacgacagacccatcggcagcagaaaggtgaagctggtgctgggctag

SEQ ID NO: 9342 - DNA, 2799 bp, Artificial Sequence; identical to SEQ ID NO: 9341
  Description of Artificial Sequence: Synthetic coding sequence

SEQ ID NO: 9343 - DNA, 2799 bp, Artificial Sequence; identical to SEQ ID NO: 9341
  Description of Artificial Sequence: Synthetic coding sequence

SEQ ID NO: 9344 - DNA, 876 bp, Artificial Sequence
  Description of Artificial Sequence: Synthetic coding sequence
atggccgtggtgatcagactgcagggcctgcccatcgtggccggcaccatggacatcagacacttcttcagcggcctgaccatccccgacggcggcgtgcacatcgtgggcggcgagctgggcgaggccttcatcgtgttcgccaccgacgaggacgccagactgggcatgatgagaaccggcggcaccatcaagggcagcaaggtgaccctgctgctgagcagcaagaccgagatgcagaacatgatcgagctgagcagaagaagattcgagaccgccaacctggacatcccccccgccaacgccagcagaagcggccccccccccagcagcggcatgagcagcagagtgaacctgcccaccaccgtgagcaacttcaacaaccccagccccagcgtggtgaccgccaccaccagcgtgcacgagagcaacaagaacatccagaccttcagcaccgccagcgtgggcaccgccccccccaacatgggcgccagcttcggcagccccaccttcagcagcaccgtgcccagcaccgccagccccatgaacaccgtgccccccccccccatcccccccatccccgccatgcccagcctgccccccatgcccagcatcccccccatccccgtgcccccccccgtgcccaccctgccccccgtgccccccgtgccccccatcccccccgtgcccagcgtgccccccatgacccccctgccccccatgagcggcatgccccccctgaaccccccccccgtggcccccctgcccgccggcatgaacggcagcggcgcccccatgaacctgaacaacaacctgaaccccatgttcctgggccccctgaaccccgtgaaccccatccagatgaacagccagtag

SEQ ID NO: 9345 - DNA, 432 bp, Artificial Sequence
  Description of Artificial Sequence: Synthetic coding sequence
atggccgtggtgatcagactgcagggcctgcccatcgtggccggcaccatggacatcagacacttcttcagcggcctgaccatccccgacggcggcgtgcacatcgtgggcggcgagctgggcgaggccttcatcgtgttcgccaccgacgaggacgccagactgggcatgatgagaaccggcggcaccatcaagggcagcaaggtgaccctgctgctgagcagcaagaccgagatgcagaacatgatcgagctgagcagaagaagattcgagaccgccaacctggacatcccccccgccaacgccagcagaagcggccccccccccagcagcggcatgagcagcagagtgaacctgcccaccaccgtgagcaacttcaacaaccccagccccagcgtggtgaccgccaccaccagcgtgcacgagagctag

SEQ ID NO: 9346 - DNA, 405 bp, Artificial Sequence
  Description of Artificial Sequence: Synthetic coding sequence
atggccgtggtgatcagactgcagggcctgcccatcgtggccggcaccatggacatcagacacttcttcagcggcctgaccatccccgacggcggcgtgcacatcgtgggcggcgagctgggcgaggccttcatcgtgttcgccaccgacgaggacgccagactgggcatgatgagaaccggcggcaccatcaagggcagcaaggtgaccctgctgctgagcagcaagaccgagatgcagaacatgatcgagctgagcagaagaagattcgagaccgccaacctggacatcccccccgccaacgccagcagaagcggccccccccccagcagcggcatgagcagcagagtgaacctgcccaccaccgtgagcaacttcaacaaccccagccccagcgtggtgtag

SEQ ID NO: 9347 - DNA, 1251 bp, Artificial Sequence
  Description of Artificial Sequence: Synthetic coding sequence
atgagcaacaagggcaagaagctgaagagaatcatcctggccatcccccccgccgcccccgccaccgtggccatgagacccgtggaggccgcccccagcggcagacaggccagaagaagaggcgtgggcgccatcatcaaggccggcatcgagagcgccgtggtggtggagatcggcatcggcatcgacggcgagatcgtgggcgccgaggtgcaggtgggcagcgtggtgagaagcagaagctgggacagaagacacggcagcgagagcagaagcagagaccacagaagagaggacagagtgcactacagaagcccccccctggccaccggctacagatacggccacagcaagagcccccacttcagagagaagagccccgtgagagagcccgtggacaacctgagccccgaggagagagacgccagaaccgtgttctgcatgcagctggccgccagaatcagacccagagacctggaggacttcttcagcgccgtgggcaaggtgagagacgtgagaatcatcagcgacagaaacagcagaagaagcaagggcatcgcctacgtggagttctgcgagatccagagcgtgcccctggccatcggcctgaccggccagagactgctgggcgtgcccatcatcgtgcaggccagccaggccgagaagaacagactggccgccatggccaacaacctgcagaagggcaacggcggccccatgagactgtacgtgggcagcctgcacttcaacatcaccgaggacatgctgagaggcatcttcgagcccttcggcaagatcgacaacatcgtgctgatgaaggacagcgacaccggcagaagcaagggctacggcttcatcaccttcagcgacagcgagtgcgccagaagagccctggagcagctgaacggcttcgagctggccggcagacccatgagagtgggccacgtgaccgagagactggacggcggcaccgacatcaccttccccgacggcgaccaggagctggacctgggcagcgccggcggcagattccagctgatggccaagctggccgagggcgccggcatccagctgcccagcaccgccgccgccgccgccgccgccgccgcccaggccgccgccctgcagctgaacggcgccgtgcccctgggcgccctgaaccccgccgccctgaccgccctgagccccgccctgaacctggccagccagtgcttccagctgagcagcctgttcaccccccagaccatgtag

SEQ ID NO: 9348 - DNA, 1218 bp, Artificial Sequence
  Description of Artificial Sequence: Synthetic coding sequence
atggccagcgacgacttcgacatcgtgatcgaggccatgctggaggccccctacaagaaggaggaggacgagcagcagagaaaggaggtgaagaaggactaccccagcaacaccaccagcagcaccagcaacagcggcaacgagaccagcggcagcagcaccatcggcgagaccagcaacagaagcagagacagagacagatacagaagaagaaacagcagaagcagaagccccggcagacagtgcagacacagaagcagaagctgggacagaagacacggcagcgagagcagaagcagagaccacagaagagaggacagagtgcactacagaagcccccccctggccaccggcgagcccgtggacaacctgagccccgaggagagagacgccagaaccgtgttctgcatgcagctggccgccagaatcagacccagagacctggaggacttcttcagcgccgtgggcaaggtgagagacgtgagaatcatcagcgacagaaacagcagaagaagcaagggcatcgcctacgtggagttctgcgagatccagagcgtgcccctggccatcggcctgaccggccagagactgctgggcgtgcccatcatcgtgcaggccagccaggccgagaagaacagactggccgccatggccaacaacctgcagaagggcaacggcggccccatgagactgtacgtgggcagcctgcacttcaacatcaccgaggacatgctgagaggcatcttcgagcccttcggcaagatcgacaacatcgtgctgatgaaggacagcgacaccggcagaagcaagggctacggcttcatcaccttcagcgacagcgagtgcgccagaagagccctggagcagctgaacggcttcgagctggccggcagacccatgagagtgggccacgtgaccgagagactggacggcggcaccgacatcaccttccccgacggcgaccaggagctggacctgggcagcgccggcggcagattccagctgatggccaagctggccgagggcgccggcatccagctgcccagcaccgccgccgccgccgccgccgccgccgcccaggccgccgccctgcagctgaacggcgccgtgcccctgggcgccctgaaccccgccgccctgaccgccctgagccccgccctgaacctggccagccagtgcttccagctgagcagcctgttcaccccccagaccatgtag

SEQ ID NO: 9349 - DNA, 1320 bp, Artificial Sequence
  Description of Artificial Sequence: Synthetic coding sequence
atggccagcgacgacttcgacatcgtgatcgaggccatgctggaggccccctacaagaaggaggaggacgagcagcagagaaaggaggtgaagaaggactaccccagcaacaccaccagcagcaccagcaacagcggcaacgagaccagcggcagcagcaccatcggcgagaccagcaagaagaagagaagcagaagccacaacaagagcagagacagaaagagaagcagaagcagagacagagacagatacagaagaagaaacagcagaagcagaagccccggcagacagtgcagacacagaagcagaagctgggacagaagacacggcagcgagagcagaagcagagaccacagaagagaggacagagtgcactacagaagcccccccctggccaccggctacagatacggccacagcaagagcccccacttcagagagaagagccccgtgagagagcccgtggacaacctgagccccgaggagagagacgccagaaccgtgttctgcatgcagctggccgccagaatcagacccagagacctggaggacttcttcagcgccgtgggcaaggtgagagacgtgagaatcatcagcgacagaaacagcagaagaagcaagggcatcgcctacgtggagttctgcgagatccagagcgtgcccctggccatcggcctgaccggccagagactgctgggcgtgcccatcatcgtgcaggccagccaggccgagaagaacagactggccgccatggccaacaacctgcagaagggcaacggcggccccatgagactgtacgtgggcagcctgcacttcaacatcaccgaggacatgctgagaggcatcttcgagcccttcggcaagatcgacaacatcgtgctgatgaaggacagcgacaccggcagaagcaagggctacggcttcatcaccttcagcgacagcgagtgcgccagaagagccctggagcagctgaacggcttcgagctggccggcagacccatgagagtgggccacgtgaccgagagactggacggcggcaccgacatcaccttccccgacggcgaccaggagctggacctgggcagcgccggcggcagattccagctgatggccaagctggccgagggcgccggcatccagctgcccagcaccgccgccgccgccgccgccgccgccgcccaggccgccgccctgcagctgaacggcgccgtgcccctgggcgccctgaaccccgccgccctgaccgccctgagccccgccctgaacctggccagccagtgcttccagctgagcagcctgttcaccccccagaccatgtag

SEQ ID NO: 9350 - DNA, 1272 bp, Artificial Sequence
  Description of Artificial Sequence: Synthetic coding sequence
atggccagcgacgacttcgacatcgtgatcgaggccatgctggaggccccctacaagaaggaggaggacgagcagcagagaaaggaggtgaagaaggactaccccagcaacaccaccagcagcaccagcaacagcggcaacgagaccagcggcagcagcaccatcggcgagaccagcaacagaagcagagacagagacagatacagaagaagaaacagcagaagcagaagccccggcagacagtgcagacacagaagcagaagctgggacagaagacacggcagcgagagcagaagcagagaccacagaagagaggacagagtgcactacagaagcccccccctggccaccggctacagatacggccacagcaagagcccccacttcagagagaagagccccgtgagagagcccgtggacaacctgagccccgaggagagagacgccagaaccgtgttctgcatgcagctggccgccagaatcagacccagagacctggaggacttcttcagcgccgtgggcaaggtgagagacgtgagaatcatcagcgacagaaacagcagaagaagcaagggcatcgcctacgtggagttctgcgagatccagagcgtgcccctggccatcggcctgaccggccagagactgctgggcgtgcccatcatcgtgcaggccagccaggccgagaagaacagactggccgccatggccaacaacctgcagaagggcaacggcggccccatgagactgtacgtgggcagcctgcacttcaacatcaccgaggacatgctgagaggcatcttcgagcccttcggcaagatcgacaacatcgtgctgatgaaggacagcgacaccggcagaagcaagggctacggcttcatcaccttcagcgacagcgagtgcgccagaagagccctggagcagctgaacggcttcgagctggccggcagacccatgagagtgggccacgtgaccgagagactggacggcggcaccgacatcaccttccccgacggcgaccaggagctggacctgggcagcgccggcggcagattccagctgatggccaagctggccgagggcgccggcatccagctgcccagcaccgccgccgccgccgccgccgccgccgcccaggccgccgccctgcagctgaacggcgccgtgcccctgggcgccctgaaccccgccgccctgaccgccctgagccccgccctgaacctggccagccagtgcttccagctgagcagcctgttcaccccccagaccatgtag

SEQ ID NO: 9351 - DNA, 183 bp, Artificial Sequence
  Description of Artificial Sequence: Synthetic coding sequence
atggccagcgacgacttcgacatcgtgatcgaggccatgctggaggccccctacaagaaggaggaggacgagcagcagagaaaggaggtgaagaaggactaccccagcaacaccaccagcagcaccagcaacagcggcaacgagaccagcggcagcagcaccatcggcgagaccagcaagtag

SEQ ID NO: 9352 - DNA, 435 bp, Artificial Sequence
  Description of Artificial Sequence: Synthetic coding sequence
atggccagcgacgacttcgacatcgtgatcgaggccatgctggaggccccctacaagaaggaggaggacgagcagcagagaaaggaggtgaagaaggactaccccagcaacaccaccagcagcaccagcaacagcggcaacgagaccagcggcagcagcaccatcggcgagaccagcaagaagaagagaagcagaagccacaacaagagcagagacagaaagagaagcagaagcagagacagagacagatacagaagaagaaacagcagaagcagaagccccggcagacagtgcagacacagaagcagaagctgggacagaagacacggcagcgagagcagaagcagagaccacagaagagaggacagagtgcactacagaagcccccccctggccaccggcgagcccgtggacaacctgagccccgaggagtag

SEQ ID NO: 9353 - DNA, 228 bp, Artificial Sequence
  Description of Artificial Sequence: Synthetic coding sequence
atggccagcgacgacttcgacatcgtgatcgaggccatgctggaggccccctacaagaaggaggaggacgagcagcagagaaaggaggtgaagaaggactaccccagcaacaccaccagcagcaccagcaacagcggcaacgagaccagcggcagcagcaccatcggcgagaccagcaagaagaagagaagcagaagccacaacaagagcagagacagaaagagatag

SEQ ID NO: 9354 - DNA, 303 bp, Artificial Sequence
  Description of Artificial Sequence: Synthetic coding sequence
atggccagcgacgacttcgacatcgtgatcgaggccatgctggaggccccctacaagaaggaggaggacgagcagcagagaaaggaggtgaagaaggactaccccagcaacaccaccagcagcaccagcaacagcggcaacgagaccagcggcagcagcaccatcggcgagaccagcaacagaagcagagacagagacagatacagaagaagaaacagcagaagcagaagccccggcagacagtgcagacacagaagcagaagctgggacagaagacacggcagcgagagcagaagcagatag

SEQ ID NO: 9355 - DNA, 174 bp, Artificial Sequence
  Description of Artificial Sequence: Synthetic coding sequence
atggccagcgacgacttcgacatcgtgatcgaggccatgctggaggccccctacaagaaggaggaggacgagcagcagagaaaggaggtgaagaaggactaccccagcaacaccaccagcagcaccagcaacagcggcaacgagaccagcggcagcagcaccatcggcgagtag

SEQ ID NO: 9356 - DNA, 279 bp, Artificial Sequence
  Description of Artificial Sequence: Synthetic coding sequence
atggccagcgacgacttcgacatcgtgatcgaggccatgctggaggccccctacaagaaggaggaggacgagcagcagagaaaggaggtgaagaaggactaccccagcaacaccaccagcagcaccagcaacagcggcaacgagaccagcggcagcagcaccatcggcgagaccagcaagaagaagagaagcagaagccacaacaagagcagagacagaaagagaagcagaagcagagacagagacagatacagaagaagaaacagcagaagcagatag

SEQ ID NO: 9357 - DNA, 201 bp, Artificial Sequence
  Description of Artificial Sequence: Synthetic coding sequence
atggccagcgacgacttcgacatcgtgatcgaggccatgctggaggccccctacaagaaggaggaggacgagcagcagagaaaggaggtgaagaaggactaccccagcaacaccaccagcagcaccagcaacagcggcaacgagaccagcggcagcagcaccatcggcgagaccagcaacagaagcagagacagagactag

SEQ ID NO: 9358 - DNA, 306 bp, Artificial Sequence
  Description of Artificial Sequence: Synthetic coding sequence
atggccagcgacgacttcgacatcgtgatcgaggccatgctggaggccccctacaagaaggaggaggacgagcagcagagaaaggaggtgaagaaggactaccccagcaacaccaccagcagcaccagcaacagcggcaacgagaccagcggcagcagcaccatcggcgagaccagcaacagaagcagagacagagacagatacagaagaagaaacagcagaagcagaagccccggcagacagtgcagacacagaagcagaagctgggacagaagacacggcagcgagagcagaagcagagactag

SEQ ID NO: 9359 - DNA, 276 bp, Artificial Sequence
  Description of Artificial Sequence: Synthetic coding sequence
atggccagcgacgacttcgacatcgtgatcgaggccatgctggaggccccctacaagaaggaggaggacgagcagcagagaaaggaggtgaagaaggactaccccagcaacaccaccagcagcaccagcaacagcggcaacgagaccagcggcagcagcaccatcggcgagaccagcaacagaagcagagacagagacagatacagaagaagaaacagcagaagcagaagccccggcagacagtgcagacacagaagcagaagctgggacagatag

SEQ ID NO: 9360 - DNA, 636 bp, Artificial Sequence
  Description of Artificial Sequence: Synthetic coding sequence
atggccctggagggcatgagcaagagaaagagaaagagaagcgtgcaggagggcgagaaccccgacgacggcgtgagaggcagcccccccgaggactacagactgggccaggtggccagcagcctgttcagaggcgagcaccacagcagaggcggcaccggcagactggccagcctgttcagcagcctggagccccagatccagcccgtgtacgtgcccgtgcccaagcagaccatcaagaagaccaagagaaacgaggaggaggagagcaccagccagatcgagagacccctgagccaggagcccgccaagaaggtgaaggccaagaagaagcacaccaacgccgagaagaagctggccgacagcagccccttcagactgatgctgagaccctgcctgagcatcagcagcaacaccctgtactgcatctacagattcaccatctacttctgggagagcgccctggccagcgccgacctggaggaggagatccaccagaagcagggccagaagagaaagaacagccagcccggcgtgaaggtggccgacagaaagatcctggacgacaccgaggacaccgtggtgagccagagaaagaagatccagatcaaccaggaggaggagagactgaagtag

SEQ ID NO: 9361 - DNA, 1293 bp, Artificial Sequence
  Description of Artificial Sequence: Synthetic coding sequence
atggccctggagggcatgagcaagagaaagagaaagagaagcgtgcaggagggcgagaaccccgacgacggcgtgagaggcagcccccccgaggactacagactgggccaggtggccagcagcctgttcagaggcgagcaccacagcagaggcggcaccggcagactggccagcctgttcagcagcctggagccccagatccagcccgtgtacgtgcccgtgcccaagcagaccatcaagaagaccaagagaaacgaggaggaggagagcaccagccagatcgagagacccctgagccaggagcccgccaagaaggtgaaggccaagaagaagcacaccaacgccgagaagaagctggccgacagagagagcgccctggccagcgccgacctggaggaggagatccaccagaagcagggccagaagagaaagaacagccagcccggcgtgaaggtggccgacagaaagatcctggacgacaccgaggacaccgtggtgagccagagaaagaagatccagatcaaccaggaggaggagagactgaagaacgagagaaccgtgttcgtgggcaacctgcccgtgacctgcaacaagaagaagctgaagagcttcttcaaggagtacggccagatcgagagcgtgagattcagaagcctgatccccgccgagggcaccctgagcaagaagctggccgccatcaagagaaagatccaccccgaccagaagaacatcaacgcctacgtggtgttcaaggaggagagcgccgccacccaggccctgaagagaaacggcgcccagatcgccgacggcttcagaatcagagtggacctggccagcgagaccagcagcagagacaagagaagcgtgttcgtgggcaacctgccctacaaggtggaggagagcgccatcgagaagcacttcctggactgcggcagcatcatggccgtgagaatcgtgagagacaagatgaccggcatcggcaagggcttcggctacgtgctgttcgagaacaccgacagcgtgcacctggccctgaagctgaacaacagcgagctgatgggcagaaagctgagagtgatgagaagcgtgaacaaggagaagttcaagcagcagaacagcaaccccagactgaagaacgtgagcaagcccaagcagggcctgaacttcaccagcaagaccgccgagggccaccccaagagcctgttcatcggcgagaaggccgtgctgctgaagaccaagaagaagggccagaagaagagcggcagacccaagaagcagagaaagcagaagtag

SEQ ID NO: 9362 - DNA, 636 bp, Artificial Sequence; identical to SEQ ID NO: 9360
  Description of Artificial Sequence: Synthetic coding sequence

SEQ ID NO: 9363 - DNA, 1074 bp, Artificial Sequence
  Description of Artificial Sequence: Synthetic coding sequence
atggccagcgtgctgaacgtgaaggagagcaaggcccccgagagaaccgtggtggtggccggcctgcccgtggacctgttcagcgaccagctgctggccgtgctggtgaagagccacttccaggacatcaagaacgagggcggcgacgtggaggacgtgatctaccccaccagaaccaagggcgtggcctacgtgatcttcaaggagaagaaggtggccgagaacgtgatcagacagaagaagcactggctggccagaaagaccagacacgccgagctgaccgtgagcctgagagtgagccacttcggcgacaagatcttcagcagcgtgaacgccatcctggacctgagcgtgttcggcaaggaggtgaccctggagaccctggtgaaggacctgaagaagaagatccccagcctgagcttcagccccctgaagcccaacggcagaatcagcgtggagggcagcttcctggccgtgaagagactgagagagagcctgctggccagagcctgcagcctgctggagaaggacagaaacttcaccagcgaggagagaaagtggaacagacagaacccccagagaaacctgcagagaagcaacaacagcctggccagcgtgagaaccctggtgcccgagaccgccagaagcggcgagatgctggtgctggacaccgacgtgttcctgtacctgaagcacaagtgcggcagctacgagagcaccctgaagaagttccacatcctgagccaggagaaggtggacggcgagatcaccaccatctgcctgaagagcatccaggtgggcagccagcccaacaacgccaagcacgtgaaggagctgatcgaggagtggagccacgccctgtacctgaagctgagaaaggagaccttcatcctggagggcaaggagaacagagagaagagaatgatcaagagagcctgcgagcagctgagcagcagatacctggaggtgctgatcaacctgtacagaacccacatcgacatcatcggcagcagcagcgacacctacctgttcaagaagggcgtgatgaagctgatcggccagaaggtgagctag

SEQ ID NO: 9364 - DNA, 1782 bp, Artificial Sequence
  Description of Artificial Sequence: Synthetic coding sequence
atgaccgccgaggacagcaccgccgccatgagcagcgacagcgccgccggcagcagcgccaaggtgcccgagggcgtggccggcgcccccaacgaggccgccctgctggccctgatggagagaaccggctacagcatggtgcaggagaacggccagagaaagtacggcggccccccccccggctgggagggcccccacccccagagaggctgcgaggtgttcgtgggcaagatccccagagacgtgtacgaggacgagctggtgcccgtgttcgaggccgtgggcagaatctacgagctgagactgatgatggacttcgacggcaagaacagaggctacgccttcgtgatgtactgccacaagcacgaggccaagagagccgtgagagagctgaacaactacgagatcagacccggcagactgctgggcgtgtgctgcagcgtggacaactgcagactgttcatcggcggcatccccaagatgaagaagagagaggagatcctggaggagatcgccaaggtgaccgagggcgtgctggacgtgatcgtgtacgccagcgccgccgacaagatgaagaacagaggcttcgccttcgtggagtacgagagccacagagccgccgccatggccagaagaaagctgatgcccggcagaatccagctgtggggccaccagatcgccgtggactgggccgagcccgagatcgacgtggacgaggacgtgatggagaccgtgaagatcctgtacgtgagaaacctgatgatcgagaccaccgaggacaccatcaagaagagcttcggccagttcaaccccggctgcgtggagagagtgaagaagatcagagactacgccttcgtgcacttcaccagcagagaggacgccgtgcacgccatgaacaacctgaacggcaccgagctggagggcagctgcctggaggtgaccctggccaagcccgtggacaaggagcagtacagcagataccagaaggccgccagaggcggcggcgccgccgaggccgcccagcagcccagctacgtgtacagctgcgacccctacaccctggcctactacggctacccctacaacgccctgatcggccccaacagagactacttcgtgaaggccggcagcatcagaggcagaggcagaggcgccgccggcaacagagcccccggccccagaggcagctacctgggcggctacagcgccggcagaggcatctacagcagataccacgagggcaagggcaagcagcaggagaagggctacgagctggtgcccaacctggagatccccaccgtgaaccccgtggccatcaagcccggcaccgtggccatccccgccatcggcgcccagtacagcatgttccccgccgcccccgcccccaagatgatcgaggacggcaagatccacaccgtggagcacatgatcagccccatcgccgtgcagcccgaccccgccagcgccgccgccgccgccgccgccgccgccgccgccgccgccgccgtgatccccaccgtgagcacccccccccccttccagggcagacccatcacccccgtgtacaccgtggcccccaacgtgcagagaatccccaccgccggcatctacggcgccagctacgtgcccttcgccgcccccgccaccgccaccatcgccaccctgcagaagaacgccgccgccgccgccgccatgtacggcggctacgccggctacatcccccaggccttccccgccgccgccatccaggtgcccatccccgacgtgtaccagacctactag

SEQ ID NO: 9365 - DNA, 1575 bp, Artificial Sequence
  Description of Artificial Sequence: Synthetic coding sequence
atgaccgccgaggacagcaccgccgccatgagcagcgacagcgccgccggcagcagcgccaaggtgcccgagggcgtggccggcgcccccaacgaggccgccctgctggccctgatggagagaaccggctacagcatggtgcaggagaacggccagagaaagtacggcggccccccccccggctgggagggcccccacccccagagaggctgcgaggtgttcgtgggcaagatccccagagacgtgtacgaggacgagctggtgcccgtgttcgaggccgtgggcagaatctacgagctgagactgatgatggacttcgacggcaagaacagaggctacgccttcgtgatgtactgccacaagcacgaggccaagagagccgtgagagagctgaacaactacgagatcagacccggcagactgctgggcgtgtgctgcagcgtggacaactgcagactgttcatcggcggcatccccaagatgaagaagagagaggagatcctggaggagatcgccaaggtgaccgagggcgtgctggacgtgatcgtgtacgccagcgccgccgacaagatgaagaacagaggcttcgccttcgtggagtacgagagccacagagccgccgccatggccagaagaaagctgatgcccggcagaatccagctgtggggccaccagatcgccgtggactgggccgagcccgagatcgacgtggacgaggacgtgatggagaccgtgaagatcctgtacgtgagaaacctgatgatcgagaccaccgaggacaccatcaagaagagcttcggccagttcaaccccggctgcgtggagagagtgaagaagatcagagactacgccttcgtgcacttcaccagcagagaggacgccgtgcacgccatgaacaacctgaacggcaccgagctggagggcagctgcctggaggtgaccctggccaagcccgtggacaaggagcagtacagcagataccagaaggccgccagaggcggcggcgccgccgaggccgcccagcagcccagctacgtgtacagctgcgacccctacaccctggcctactacggctacccctacaacgccctgatcggccccaacagagactacttcgtgaaggtggccatccccgccatcggcgcccagtacagcatgttccccgccgcccccgcccccaagatgatcgaggacggcaagatccacaccgtggagcacatgatcagccccatcgccgtgcagcccgaccccgccagcgccgccgccgccgccgccgccgccgccgccgccgccgccgccgtgatccccaccgtgagcacccccccccccttccagggcagacccatcacccccgtgtacaccgtggcccccaacgtgcagagaatccccaccgccggcatctacggcgccagctacgtgcccttcgccgcccccgccaccgccaccatcgccaccctgcagaagaacgccgccgccgccgccgccatgtacggcggctacgccggctacatcccccaggccttccccgccgccgccatccaggtgcccatccccgacgtgtaccagacctactag

SEQ ID NO: 9366 - DNA, 1782 bp, Artificial Sequence; identical to SEQ ID NO: 9364
  Description of Artificial Sequence: Synthetic coding sequence

SEQ ID NO: 9367 - DNA, 1575 bp, Artificial Sequence; identical to SEQ ID NO: 9365
  Description of Artificial Sequence: Synthetic coding sequence

SEQ ID NO: 9368 - DNA, 180 bp, Artificial Sequence
  Description of Artificial Sequence: Synthetic coding sequence
atgaccgccgaggacagcaccgccgccatgagcagcgacagcgccgccggcagcagcgccaaggtgcccgagggcgtggccggcgcccccaacgaggccgccctgctggccctgatggagagaaccggctacagcatggtgcaggagaacggccagagaaagtacggcggccccccctag

SEQ ID NO: 9369 - DNA, 480 bp, Artificial Sequence
  Description of Artificial Sequence: Synthetic coding sequence
atgaccgccgaggacagcaccgccgccatgagcagcgacagcgccgccggcagcagcgccaaggtgcccgagggcgtggccggcgcccccaacgaggccgccctgctggccctgatggagagaaccggctacagcatggtgcaggagaacggccagagaaagtacggcggccccccccccggctgggagggcccccacccccagagaggctgcgaggtgttcgtgggcaagatccccagagacgtgtacgaggacgagctggtgcccgtgttcgaggccgtgggcagaatctacgagctgagactgatgatggacttcgacggcaagaacagaggctacgccttcgtgatgtactgccacaagcacgaggccaagagagccgtgagagagctgaacaactacgagatcagacccggcagactgctgggcgtgtgctgcagcgtggacaactgcagactgttcatcggcggcatcccctag

SEQ ID NO: 9370 - DNA, 375 bp, Artificial Sequence
  Description of Artificial Sequence: Synthetic coding sequence
atgaccgccgaggacagcaccgccgccatgagcagcgacagcgccgccggcagcagcgccaaggtgcccgagggcgtggccggcgcccccaacgaggccgccctgctggccctgatggagagaaccggctacagcatggtgcaggagaacggccagagaaagtacggcggccccccccccggctgggagggcccccacccccagagaggctgcgaggtgttcgtgggcaagatccccagagacgtgtacgaggacgagctggtgcccgtgttcgaggccgtgggcagaatctacgagctgagactgatgatggacttcgacggcaagaacagaggctacgccttcgtgatgtactgccacaagcacgaggcctag

SEQ ID NO: 9371 - DNA, 345 bp, Artificial Sequence
  Description of Artificial Sequence: Synthetic coding sequence
atgaccgccgaggacagcaccgccgccatgagcagcgacagcgccgccggcagcagcgccaaggtgcccgagggcgtggccggcgcccccaacgaggccgccctgctggccctgatggagagaaccggctacagcatggtgcaggagaacggccagagaaagtacggcggccccccccccggctgggagggcccccacccccagagaggctgcgaggtgttcgtgggcaagatccccagagacgtgtacgaggacgagctggtgcccgtgttcgaggccgtgggcagaatctacgagctgagactgatgatggacttcgacggcaagaacagaggctacgcctag

SEQ ID NO: 9372 - DNA, 180 bp, Artificial Sequence; identical to SEQ ID NO: 9368
  Description of Artificial Sequence: Synthetic coding sequence

SEQ ID NO: 9373 - DNA, 582 bp, Artificial Sequence
  Description of Artificial Sequence: Synthetic coding sequence
atgaccgccgaggacagcaccgccgccatgagcagcgacagcgccgccggcagcagcgccaaggtgcccgagggcgtggccggcgcccccaacgaggccgccctgctggccctgatggagagaaccggctacagcatggtgcaggagaacggccagagaaagtacggcggccccccccccggctgggagggcccccacccccagagaggctgcgaggtgttcgtgggcaagatccccagagacgtgtacgaggacgagctggtgcccgtgttcgaggccgtgggcagaatctacgagctgagactgatgatggacttcgacggcaagaacagaggctacgccttcgtgatgtactgccacaagcacgaggccaagagagccgtgagagagctgaacaactacgagatcagacccggcagactgctgggcgtgtgctgcagcgtggacaactgcagactgttcatcggcggcatccccaagatgaagaagagagaggagatcctggaggagatcgccaaggtgaccgagggcgtgctggacgtgatcgtgtacgccagcgccgccgacaagatgaagaactag

SEQ ID NO: 9374 - DNA, 414 bp, Artificial Sequence
  Description of Artificial Sequence: Synthetic coding sequence
atgaccgccgaggacagcaccgccgccatgagcagcgacagcgccgccggcagcagcgccaaggtgcccgagggcgtggccggcgcccccaacgaggccgccctgctggccctgatggagagaaccggctacagcatggtgcaggagaacggccagagaaagtacggcggccccccccccggctgggagggcccccacccccagagaggctgcgaggtgttcgtgggcaagatccccagagacgtgtacgaggacgagctggtgcccgtgttcgaggccgtgggcagaatctacgagctgagactgatgatggacttcgacggcaagaacagaggctacgccttcgtgatgtactgccacaagcacgaggccaagagagccgtgagagagctgaacaactacgagatcagatag

SEQ ID NO: 9375 - DNA, 654 bp, Artificial Sequence
  Description of Artificial Sequence: Synthetic coding sequence
atgaccgccgaggacagcaccgccgccatgagcagcgacagcgccgccggcagcagcgccaaggtgcccgagggcgtggccggcgcccccaacgaggccgccctgctggccctgatggagagaaccggctacagcatggtgcaggagaacggccagagaaagtacggcggccccccccccggctgggagggcccccacccccagagaggctgcgaggtgttcgtgggcaagatccccagagacgtgtacgaggacgagctggtgcccgtgttcgaggccgtgggcagaatctacgagctgagactgatgatggacttcgacggcaagaacagaggctacgccttcgtgatgtactgccacaagcacgaggccaagagagccgtgagagagctgaacaactacgagatcagacccggcagactgctgggcgtgtgctgcagcgtggacaactgcagactgttcatcggcggcatccccaagatgaagaagagagaggagatcctggaggagatcgccaaggtgaccgagggcgtgctggacgtgatcgtgtacgccagcgccgccgacaagatgaagaacagaggcttcgccttcgtggagtacgagagccacagagccgccgccatggccagaagaaagctgatgcccggctag

SEQ ID NO: 9376 - DNA, 1080 bp, Artificial Sequence
  Description of Artificial Sequence: Synthetic coding sequence
atggtgaagctgttcatcggcaacctgcccagagaggccaccgagcaggagatcagaagcctgttcgagcagtacggcaaggtgctggagtgcgacatcatcaagaactacggcttcgtgcacatcgaggacaagaccgccgccgaggacgccatcagaaacctgcaccactacaagctgcacggcgtgaacatcaacgtggaggccagcaagaacaagagcaaggccagcaccaagctgcacgtgggcaacatcagccccacctgcaccaaccaggagctgagagccaagttcgaggagtacggccccgtgatcgagtgcgacatcgtgaaggactacgccttcgtgcacatggagagagccgaggacgccgtggaggccatcagaggcctggacaacaccgagttccagggcaagagaatgcacgtgcagctgagcaccagcagactgagaaccgcccccggcatgggcgaccagagcggctgctacagatgcggcaaggagggccactggagcaaggagtgccccgtggacagaaccggcagagtggccgacttcaccgagcagtacaacgagcagtacggcgccgtgagaaccccctacaccatgggctacggcgagagcatgtactacaacgacgcctacggcgccctggactactacaagagatacagagtgagaagctacgaggccgtggccgccgccgccgccgccagcgcctacaactacgccgagcagaccatgagccacctgccccaggtgcagagcaccaccgtgaccagccacctgaacagcaccagcgtggacccctacgacagacacctgctgcccaacagcggcgccgccgccaccagcgccgccatggccgccgccgccgccaccaccagcagctactacggcagagacagaagccccctgagaagagccgccgccatgctgcccaccgtgggcgagggctacggctacggccccgagagcgagctgagccaggccagcgccgccaccagaaacagcctgtacgacatggccagatacgagagagagcagtacgtggacagagccagatacagcgccttctag

SEQ ID NO: 9377 - DNA, 1080 bp, Artificial Sequence; identical to SEQ ID NO: 9376
  Description of Artificial Sequence: Synthetic coding sequence

SEQ ID NO: 9378 - DNA, 2448 bp, Artificial Sequence
  Description of Artificial Sequence: Synthetic coding sequence
atgggcagcgacaagagagtgagcagaaccgagagaagcggcagatacggcagcatcatcgacagagacgacagagacgagagagagagcagaagcagaagaagagacagcgactacaagagaagcagcgacgacagaagaggcgacagatacgacgactacagagactacgacagccccgagagagagagagagagaagaaacagcgacagaagcgaggacggctaccacagcgacggcgactacggcgagcacgactacagacacgacatcagcgacgagagagagagcaagaccatcatgctgagaggcctgcccatcaccatcaccgagagcgacatcagagagatgatggagagcttcgagggcccccagcccgccgacgtgagactgatgaagagaaagaccggcgtgagcagaggcttcgccttcgtggagttctaccacctgcaggacgccaccagctggatggaggccaaccagaagaagctggtgatccagggcaagcacatcgccatgcactacagcaaccccagacccaagttcgaggactggctgtgcaacaagtgctgcctgaacaacttcagaaagagactgaagtgcttcagatgcggcgccgacaagttcgacagcgagcaggaggtgccccccggcaccaccgagagcgtgcagagcgtggactactactgcgacaccatcatcctgagaaacatcgccccccacaccgtggtggacagcatcatgaccgccctgagcccctacgccagcctggccgtgaacaacatcagactgatcaaggacaagcagacccagcagaacagaggcttcgccttcgtgcagctgagcagcgccatggacgccagccagctgctgcagatcctgcagagcctgcacccccccctgaagatcgacggcaagaccatcggcgtggacttcgccaagagcgccagaaaggacctggtgctgagcgacggcaacagagtgagcgccttcagcgtggccagcaccgccatcgccgccgcccagtggagcagcacccagagccagagcggcgagggcggcagcgtggactacagctacctgcagcccggccaggacggctacgcccagtacgcccagtacagccaggactaccagcagttctaccagcagcaggccggcggcctggagagcgacgccagcagcgccagcggcaccgccgtgaccaccaccagcgccgccgtggtgagccagagcccccagctgtacaaccagaccagcaacccccccggcagccccaccgaggaggcccagcccagcaccagcaccagcacccaggcccccgccgccagccccaccggcgtggtgcccggcaccaagtacgccgtgcccgacaccagcacctaccagtacgacgagagcagcggctactactacgaccccaccaccggcctgtactacgaccccaacagccagtactactacaacagcctgacccagcagtacctgtactgggacggcgagaaggagacctacgtgcccgccgccgagagcagcagccaccagcagagcggcctgccccccgccaaggagggcaaggagaagaaggagaagcccaagagcaagaccgcccagcagatcgccaaggacatggagagatgggccaagagcctgaacaagcagaaggagaacttcaagaacagcttccagcccgtgaacagcctgagagaggaggagagaagagagagcgccgccgccgacgccggcttcgccctgttcgagaagaagggcgccctggccgagagacagcagctgatccccgagctggtgagaaacggcgacgaggagaaccccctgaagagaggcctggtggccgcctacagcggcgacagcgacaacgaggaggagctggtggagagactggagagcgaggaggagaagctggccgactggaagaagatggcctgcctgctgtgcagaagacagttccccaacaaggacgccctggtgagacaccagcagctgagcgacctgcacaagcagaacatggacatctacagaagaagcagactgagcgagcaggagctggaggccctggagctgagagagagagagatgaagtacagagacagagccgccgagagaagagagaagtacggcatccccgagccccccgagcccaagagaaagaagcagttcgacgccggcaccgtgaactacgagcagcccaccaaggacggcatcgaccacagcaacatcggcaacaagatgctgcaggccatgggctggagagagggcagcggcctgggcagaaagtgccagggcatcaccgcccccatcgaggcccaggtgagactgaagggcgccggcctgggcgccaagggcagcgcctacggcctgagcggcgccgacagctacaaggacgccgtgagaaaggccatgttcgccagattcaccgagatggagtag

SEQ ID NO: 9379 - DNA, 363 bp, Artificial Sequence
  Description of Artificial Sequence: Synthetic coding sequence
atgggcagcgacaagagagtgagcagaaccgagagaagcggcagatacggcagcatcatcgacagagacgacagagacgagagagagagcagaagcagaagaagagacagcgactacaagagaagcagcgacgacagaagaggcgacagatacgacgactacagagactacgacagccccgagagagagagagagagaagaaacagcgacagaagcgaggacggctaccacagcgacggcgactacggcgagcacgactacagacacgacatcagcgacgagagagagagcaagaccatcatgctgagaggcctgcccatcaccatcaccgagagcgacatcagagagatgatggagagctag

SEQ ID NO: 9380 - DNA, 318 bp, Artificial Sequence
  Description of Artificial Sequence: Synthetic coding sequence
atgggcagcgacaagagagtgagcagaaccgagagaagcggcagatacggcagcatcatcgacagagacgacagagacgagagagagagcagaagcagaagaagagacagcgactacaagagaagcagcgacgacagaagaggcgacagatacgacgactacagagactacgacagccccgagagagagagagagagaagaaacagcgacagaagcgaggacggctaccacagcgacggcgactacggcgagcacgactacagacacgacatcagcgacgagagagagagcaagaccatcatgctgagaggcctgtag

SEQ ID NO: 9381 - DNA, 414 bp, Artificial Sequence
  Description of Artificial Sequence: Synthetic coding sequence
atgggcagcgacaagagagtgagcagaaccgagagaagcggcagatacggcagcatcatcgacagagacgacagagacgagagagagagcagaagcagaagaagagacagcgactacaagagaagcagcgacgacagaagaggcgacagatacgacgactacagagactacgacagccccgagagagagagagagagaagaaacagcgacagaagcgaggacggctaccacagcgacggcgactacggcgagcacgactacagacacgacatcagcgacgagagagagagcaagaccatcatgctgagaggcctgcccatcaccatcaccgagagcgacatcagagagatgatggagagcttcgagggcccccagcccgccgacgtgagactgatgaagagaaagaccggctag

SEQ ID NO: 9382 - DNA, 432 bp, Artificial Sequence
  Description of Artificial Sequence: Synthetic coding sequence
atgggcagcgacaagagagtgagcagaaccgagagaagcggcagatacggcagcatcatcgacagagacgacagagacgagagagagagcagaagcagaagaagagacagcgactacaagagaagcagcgacgacagaagaggcgacagatacgacgactacagagactacgacagccccgagagagagagagagagaagaaacagcgacagaagcgaggacggctaccacagcgacggcgactacggcgagcacgactacagacacgacatcagcgacgagagagagagcaagaccatcatgctgagaggcctgcccatcaccatcaccgagagcgacatcagagagatgatggagagcttcgagggcccccagcccgccgacgtgagactgatgaagagaaagaccggcgagagcctgctgagcagctag

SEQ ID NO: 9383 - DNA, 381 bp, Artificial Sequence
  Description of Artificial Sequence: Synthetic coding sequence
atgggcagcgacaagagagtgagcagaaccgagagaagcggcagatacggcagcatcatcgacagagacgacagagacgagagagagagcagaagcagaagaagagacagcgactacaagagaagcagcgacgacagaagaggcgacagatacgacgactacagagactacgacagccccgagaacgacaagtacagcagaaacgacggcgtgctgagaagacccagcgcctgcggctgcgaggccgacgaggaggagaacagatgcaagccctggttcagactgagaggcgtgctgagcctggccagatgctaccagctggacggcagccagagcgagaaggtgggcgacagcagaaaggcccactgcaacgccctgtag

SEQ ID NO: 9384 - DNA, 450 bp, Artificial Sequence
  Description of Artificial Sequence: Synthetic coding sequence
ggcaccaagtgcagagtgagcagaaccgagagaagcggcagatacggcagcatcatcgacagagacgacagagacgagagagagagcagaagcagaagaagagacagcgactacaagagaagcagcgacgacagaagaggcgacagatacgacgactacagagactacgacagccccgagagagagagagagagaagaaacagcgacagaagcgaggacggctaccacagcgacggcgactacggcgagcacgactacagacacgacatcagcgacgagagagagagcaagaccatcatgctgagaggcctgcccatcaccatcaccgagagcgacatcagagagatgatggagagcttcgagggcccccagcccgccgacgtgagactgatgaagagaaagaccgagaaggtgggcgacagcagaaaggcccactgcaacgccctgtag

SEQ ID NO: 9385 - DNA, 2445 bp, Artificial Sequence
  Description of Artificial Sequence: Synthetic coding sequence
ggcaccaagtgcagagtgagcagaaccgagagaagcggcagatacggcagcatcatcgacagagacgacagagacgagagagagagcagaagcagaagaagagacagcgactacaagagaagcagcgacgacagaagaggcgacagatacgacgactacagagactacgacagccccgagagagagagagagagaagaaacagcgacagaagcgaggacggctaccacagcgacggcgactacggcgagcacgactacagacacgacatcagcgacgagagagagagcaagaccatcatgctgagaggcctgcccatcaccatcaccgagagcgacatcagagagatgatggagagcttcgagggcccccagcccgccgacgtgagactgatgaagagaaagaccggcgtgagcagaggcttcgccttcgtggagttctaccacctgcaggacgccaccagctggatggaggccaaccagaagaagctggtgatccagggcaagcacatcgccatgcactacagcaaccccagacccaagttcgaggactggctgtgcaacaagtgctgcctgaacaacttcagaaagagactgaagtgcttcagatgcggcgccgacaagttcgacagcgagcaggaggtgccccccggcaccaccgagagcgtgcagagcgtggactactactgcgacaccatcatcctgagaaacatcgccccccacaccgtggtggacagcatcatgaccgccctgagcccctacgccagcctggccgtgaacaacatcagactgatcaaggacaagcagacccagcagaacagaggcttcgccttcgtgcagctgagcagcgccatggacgccagccagctgctgcagatcctgcagagcctgcacccccccctgaagatcgacggcaagaccatcggcgtggacttcgccaagagcgccagaaaggacctggtgctgagcgacggcaacagagtgagcgccttcagcgtggccagcaccgccatcgccgccgcccagtggagcagcacccagagccagagcggcgagggcggcagcgtggactacagctacctgcagcccggccaggacggctacgcccagtacgcccagtacagccaggactaccagcagttctaccagcagcaggccggcggcctggagagcgacgccagcagcgccagcggcaccgccgtgaccaccaccagcgccgccgtggtgagccagagcccccagctgtacaaccagaccagcaacccccccggcagccccaccgaggaggcccagcccagcaccagcaccagcacccaggcccccgccgccagccccaccggcgtggtgcccggcaccaagtacgccgtgcccgacaccagcacctaccagtacgacgagagcagcggctactactacgaccccaccaccggcctgtactacgaccccaacagccagtactactacaacagcctgacccagcagtacctgtactgggacggcgagaaggagacctacgtgcccgccgccgagagcagcagccaccagcagagcggcctgccccccgccaaggagggcaaggagaagaaggagaagcccaagagcaagaccgcccagcagatcgccaaggacatggagagatgggccaagagcctgaacaagcagaaggagaacttcaagaacagcttccagcccgtgaacagcctgagagaggaggagagaagagagagcgccgccgccgacgccggcttcgccctgttcgagaagaagggcgccctggccgagagacagcagctgatccccgagctggtgagaaacggcgacgaggagaaccccctgaagagaggcctggtggccgcctacagcggcgacagcgacaacgaggaggagctggtggagagactggagagcgaggaggagaagctggccgactggaagaagatggcctgcctgctgtgcagaagacagttccccaacaaggacgccctggtgagacaccagcagctgagcgacctgcacaagcagaacatggacatctacagaagaagcagactgagcgagcaggagctggaggccctggagctgagagagagagagatgaagtacagagacagagccgccgagagaagagagaagtacggcatccccgagccccccgagcccaagagaaagaagcagttcgacgccggcaccgtgaactacgagcagcccaccaaggacggcatcgaccacagcaacatcggcaacaagatgctgcaggccatgggctggagagagggcagcggcctgggcagaaagtgccagggcatcaccgcccccatcgaggcccaggtgagactgaagggcgccggcctgggcgccaagggcagcgcctacggcctgagcggcgccgacagctacaaggacgccgtgagaaaggccatgttcgccagattcaccgagatggagtag

SEQ ID NO: 9386 - DNA, 1518 bp, Artificial Sequence
  Description of Artificial Sequence: Synthetic coding sequence
aacggcttcagaagcggcgagagagacctggtgctgagcgacggcaacagagtgagcgccttcagcgtggccagcaccgccatcgccgccgcccagtggagcagcacccagagccagagcggcgagggcggcagcgtggactacagctacctgcagcccggccaggacggctacgcccagtacgcccagtacagccaggactaccagcagttctaccagcagcaggccggcggcctggagagcgacgccagcagcgccagcggcaccgccgtgaccaccaccagcgccgccgtggtgagccagagcccccagctgtacaaccagaccagcaacccccccggcagccccaccgaggaggcccagcccagcaccagcaccagcacccaggcccccgccgccagccccaccggcgtggtgcccggcaccaagtacgccgtgcccgacaccagcacctaccagtacgacgagagcagcggctactactacgaccccaccaccggcctgtactacgaccccaacagccagtactactacaacagcctgacccagcagtacctgtactgggacggcgagaaggagacctacgtgcccgccgccgagagcagcagccaccagcagagcggcctgccccccgccaaggagggcaaggagaagaaggagaagcccaagagcaagaccgcccagcagatcgccaaggacatggagagatgggccaagagcctgaacaagcagaaggagaacttcaagaacagcttccagcccgtgaacagcctgagagaggaggagagaagagagagcgccgccgccgacgccggcttcgccctgttcgagaagaagggcgccctggccgagagacagcagctgatccccgagctggtgagaaacggcgacgaggagaaccccctgaagagaggcctggtggccgcctacagcggcgacagcgacaacgaggaggagctggtggagagactggagagcgaggaggagaagctggccgactggaagaagatggcctgcctgctgtgcagaagacagttccccaacaaggacgccctggtgagacaccagcagctgagcgacctgcacaagcagaacatggacatctacagaagaagcagactgagcgagcaggagctggaggccctggagctgagagagagagagatgaagtacagagacagagccgccgagagaagagagaagtacggcatccccgagccccccgagcccaagagaaagaagcagttcgacgccggcaccgtgaactacgagcagcccaccaaggacggcatcgaccacagcaacatcggcaacaagatgctgcaggccatgggctggagagagggcagcggcctgggcagaaagtgccagggcatcaccgcccccatcgaggcccaggtgagactgaagggcgccggcctgggcgccaagggcagcgcctacggcctgagcggcgccgacagctacaaggacgccgtgagaaaggccatgttcgccagattcaccgagatggagtag

SEQ ID NO: 9387 - DNA, 3372 bp, Artificial Sequence
  Description of Artificial Sequence: Synthetic coding sequence
atgtggggcgacagcagacccgccaacagaaccggccccttcagaggcagccaggaggagagattcgcccccggctggaacagagactacccccccccccccctgaagagccacgcccaggagagacacagcggcaacttccccggcagagacagcctgcccttcgacttccagggccacagcggcccccccttcgccaacgtggaggagcacagcttcagctacggcgccagagacggcccccacggcgactacagaggcggcgagggccccggccacgacttcagaggcggcgacttcagcagcagcgacttccagagcagagacagcagccagctggacttcagaggcagagacatccacagcggcgacttcagagacagagagggcccccccatggactacagaggcggcgacggcaccagcatggactacagaggcagagaggccccccacatgaactacagagacagagacgcccacgccgtggacttcagaggcagagacgccccccccagcgacttcagaggcagaggcacctacgacctggacttcagaggcagagacggcagccacgccgacttcagaggcagagacctgagcgacctggacttcagagccagagagcagagcagaagcgacttcagaaacagagacgtgagcgacctggacttcagagacaaggacggcacccaggtggacttcagaggcagaggcagcggcaccaccgacctggacttcagagacagagacaccccccacagcgacttcagaggcagacacagaagcagaaccgaccaggacttcagaggcagagagatgggcagctgcatggagttcaaggacagagagatgccccccgtggaccccaacatcctggactacatccagcccagcacccaggacagagagcacagcggcatgaacgtgaacagaagagaggagagcacccacgaccacaccatcgagagacccgccttcggcatccagaagggcgagttcgagcacagcgagaccagagagggcgagacccagggcgtggccttcgagcacgagagccccgccgacttccagaacagccagagccccgtgcaggaccaggacaagagccagctgagcggcagagaggagcagagcagcgacgccggcctgttcaaggaggagggcggcctggacttcctgggcagacaggacaccgactacagaagcatggagtacagagacgtggaccacagactgcccggcagccagatgttcggctacggccagagcaagagcttccccgagggcaagaccgccagagacgcccagagagacctgcaggaccaggactacagaaccggccccagcgaggagaagcccagcagactgatcagactgagcggcgtgcccgaggacgccaccaaggaggagatcctgaacgccttcagaacccccgacggcatgcccgtgaagaacctgcagctgaaggagtacaacaccggctacgactacggctacgtgtgcgtggagttcagcctgctggaggacgccatcggctgcatggaggccaaccagggcaccctgatgatccaggacaaggaggtgaccctggagtacgtgagcagcctggacttctggtactgcaagagatgcaaggccaacatcggcggccacagaagcagctgcagcttctgcaagaaccccagagaggtgaccgaggccaagcaggagctgatcacctacccccagccccagaagaccagcatccccgcccccctggagaagcagcccaaccagcccctgagacccgccgacaaggagcccgagcccagaaagagagaggagggccaggagagcagactgggccaccagaagagagaggccgagagatacctgccccccagcagaagagagggccccaccttcagaagagacagagagagagagagctggagcggcgagaccagacaggacggcgagagcaagaccatcatgctgaagagaatctacagaagcaccccccccgaggtgatcgtggaggtgctggagccctacgtgagactgaccaccgccaacgtgagaatcatcaagaacagaaccggccccatgggccacacctacggcttcatcgacctggacagccacgccgaggccctgagagtggtgaagatcctgcagaacctggacccccccttcagcatcgacggcaagatggtggccgtgaacctggccaccggcaagagaagaaacgacagcggcgaccacagcgaccacatgcactactaccagggcaagaagtacttcagagacagaagaggcggcggcagaaacagcgactggagcagcgacaccaacagacagggccagcagagcagcagcgactgctacatctacgacagcgccaccggctactactacgaccccctggccggcacctactacgaccccaacacccagcaggaggtgtacgtgccccaggaccccggcctgcccgaggaggaggagatcaaggagaagaagcccaccagccagggcaagagcagcagcaagaaggagatgagcaagagagacggcaaggagaagaaggacagaggcgtgaccagattccaggagaacgccagcgagggcaaggcccccgccgaggacgtgttcaagaagcccctgccccccaccgtgaagaaggaggagagcccccccccccccaaggtggtgaaccccctgatcggcctgctgggcgagtacggcggcgacagcgactacgaggaggaggaggaggaggagcagaccccccccccccagcccagaaccgcccagccccagaagagagaggagcagaccaagaaggagaacgaggaggacaagctgaccgactggaacaagctggcctgcctgctgtgcagaagacagttccccaacaaggaggtgctgatcaagcaccagcagctgagcgacctgcacaagcagaacctggagatccacagaaagatcaagcagagcgagcaggagctggcctacctggagagaagagagagagagggcaagttcaagggcagaggcaacgacagaagagagaagctgcagagcttcgacagccccgagagaaagagaatcaagtacagcagagagaccgacagcgacagaaagctggtggacaaggaggacatcgacaccagcagcaagggcggctgcgtgcagcaggccaccggctggagaaagggcaccggcctgggctacggccaccccggcctggccagcagcgaggaggccgagggcagaatgagaggccccagcgtgggcgccagcggcagaaccagcaagagacagagcaacgagacctacagagacgccgtgagaagagtgatgttcgccagatacaaggagctggactag

SEQ ID NO: 9388 - DNA, 429 bp, Artificial Sequence
  Description of Artificial Sequence: Synthetic coding sequence
atgtggggcgacagcagacccgccaacagaaccggccccttcagaggcagccaggaggagagattcgcccccggctggaacagagactacccccccccccccctgaagagccacgcccaggagagacacagcggcaacttccccggcagagacagcctgcccttcgacttccagggccacagcggcccccccttcgccaacgtggaggagcacagcttcagctacggcgccagagacggcccccacggcgactacagaggcggcgagggccccggccacgacttcagaggcggcgacttcagcagcagcgacttccagagcagagacagcagccagctggacttcagaggcagagacatccacagcggcgacttcagagacagagagggcccccccatggactacagaggcggcgacggcaccagctag

SEQ ID NO: 9389 - DNA, 1806 bp, Artificial Sequence
  Description of Artificial Sequence: Synthetic coding sequence
atgatccaggacaaggaggtgaccctggagtacgtgagcagcctggacttctggtactgcaagagatgcaaggccaacatcggcggccacagaagcagctgcagcttctgcaagaaccccagagaggtgaccgaggccaagcaggagctgatcacctacccccagccccagaagaccagcatccccgcccccctggagaagcagcccaaccagcccctgagacccgccgacaaggagcccgagcccagaaagagagaggagggccaggagagcagactgggccaccagaagagagaggccgagagatacctgccccccagcagaagagagggccccaccttcagaagagacagagagagagagagctggagcggcgagaccagacaggacggcgagagcaagaccatcatgctgaagagaatctacagaagcaccccccccgaggtgatcgtggaggtgctggagccctacgtgagactgaccaccgccaacgtgagaatcatcaagaacagaaccggccccatgggccacacctacggcttcatcgacctggacagccacgccgaggccctgagagtggtgaagatcctgcagaacctggacccccccttcagcatcgacggcaagatggtggccgtgaacctggccaccggcaagagaagaaacgacagcggcgaccacagcgaccacatgcactactaccagggcaagaagtacttcagagacagaagaggcggcggcagaaacagcgactggagcagcgacaccaacagacagggccagcagagcagcagcgactgctacatctacgacagcgccaccggctactactacgaccccctggccggcacctactacgaccccaacacccagcaggaggtgtacgtgccccaggaccccggcctgcccgaggaggaggagatcaaggagaagaagcccaccagccagggcaagagcagcagcaagaaggagatgagcaagagagacggcaaggagaagaaggacagaggcgtgaccagattccaggagaacgccagcgagggcaaggcccccgccgaggacgtgttcaagaagcccctgccccccaccgtgaagaaggaggagagcccccccccccccaaggtggtgaaccccctgatcggcctgctgggcgagtacggcggcgacagcgactacgaggaggaggaggaggaggagcagaccccccccccccagcccagaaccgcccagccccagaagagagaggagcagaccaagaaggagaacgaggaggacaagctgaccgactggaacaagctggcctgcctgctgtgcagaagacagttccccaacaaggaggtgctgatcaagcaccagcagctgagcgacctgcacaagcagaacctggagatccacagaaagatcaagcagagcgagcaggagctggcctacctggagagaagagagagagagggcaagttcaagggcagaggcaacgacagaagagagaagctgcagagcttcgacagccccgagagaaagagaatcaagtacagcagagagaccgacagcgacagaaagctggtggacaaggaggacatcgacaccagcagcaagggcggctgcgtgcagcaggccaccggctggagaaagggcaccggcctgggctacggccaccccggcctggccagcagcgaggaggccgagggcagaatgagaggccccagcgtgggcgccagcggcagaaccagcaagagacagagcaacgagacctacagagacgccgtgagaagagtgatgttcgccagatacaaggagctggactag

SEQ ID NO: 9390 - DNA, 1563 bp, Artificial Sequence
  Description of Artificial Sequence: Synthetic coding sequence
atgtggggcgacagcagacccgccaacagaaccggccccttcagaggcagccaggaggagagattcgcccccggctggaacagagactacccccccccccccctgaagagccacgcccaggagagacacagcggcaacttccccggcagagacagcctgcccttcgacttccagggccacagcggcccccccttcgccaacgtggaggagcacagcttcagctacggcgccagagacggcccccacggcgactacagaggcggcgagggccccggccacgacttcagaggcggcgacttcagcagcagcgacttccagagcagagacagcagccagctggacttcagaggcagagacatccacagcggcgacttcagagacagagagggcccccccatggactacagaggcggcgacggcaccagcatggactacagaggcagagaggccccccacatgaactacagagacagagacgcccacgccgtggacttcagaggcagagacgccccccccagcgacttcagaggcagaggcacctacgacctggacttcagaggcagagacggcagccacgccgacttcagaggcagagacctgagcgacctggacttcagagccagagagcagagcagaagcgacttcagaaacagagacgtgagcgacctggacttcagagacaaggacggcacccaggtggacttcagaggcagaggcagcggcaccaccgacctggacttcagagacagagacaccccccacagcgacttcagaggcagacacagaagcagaaccgaccaggacttcagaggcagagagatgggcagctgcatggagttcaaggacagagagatgccccccgtggaccccaacatcctggactacatccagcccagcacccaggacagagagcacagcggcatgaacgtgaacagaagagaggagagcacccacgaccacaccatcgagagacccgccttcggcatccagaagggcgagttcgagcacagcgagaccagagagggcgagacccagggcgtggccttcgagcacgagagccccgccgacttccagaacagccagagccccgtgcaggaccaggacaagagccagctgagcggcagagaggagcagagcagcgacgccggcctgttcaaggaggagggcggcctggacttcctgggcagacaggacaccgactacagaagcatggagtacagagacgtggaccacagactgcccggcagccagatgttcggctacggccagagcaagagcttccccgagggcaagaccgccagagacgcccagagagacctgcaggaccaggactacagaaccggccccagcgaggagaagcccagcagactgatcagactgagcggcgtgcccgaggacgccaccaaggaggagatcctgaacgccttcagaacccccgacggcatgcccgtgaagaacctgcagctgaaggagtacaacaccggcaacagcaacgaccccggccagagaagctaccccggcgtgtgcatcaagcccggcttcctggtgctgcagaccatgtag

SEQ ID NO: 9391 - DNA, 231 bp, Artificial Sequence
  Description of Artificial Sequence: Synthetic coding sequence
atgtggggcgacagcagacccgccaacagaaccggccccttcagaggcagccaggaggagagattcgcccccggctggaacagagactacccccccccccccctgaagagccacgcccaggagagacacagcggcaacttccccggcagagacagcctgcccttcgacttccagggccacagcggcccccccttcgccaacgtggaggagcacagcttcagctacggctag

SEQ ID NO: 9392 - DNA, 1806 bp, Artificial Sequence; identical to SEQ ID NO: 9389
  Description of Artificial Sequence: Synthetic coding sequence

SEQ ID NO: 9393 - DNA, 2976 bp, Artificial Sequence
  Description of Artificial Sequence: Synthetic coding sequence
atggactacagaggcggcgacggcaccagcatggactacagaggcagagaggccccccacatgaactacagagacagagacgcccacgccgtggacttcagaggcagagacgccccccccagcgacttcagaggcagaggcacctacgacctggacttcagaggcagagacggcagccacgccgacttcagaggcagagacctgagcgacctggacttcagagccagagagcagagcagaagcgacttcagaaacagagacgtgagcgacctggacttcagagacaaggacggcacccaggtggacttcagaggcagaggcagcggcaccaccgacctggacttcagagacagagacaccccccacagcgacttcagaggcagacacagaagcagaaccgaccaggacttcagaggcagagagatgggcagctgcatggagttcaaggacagagagatgccccccgtggaccccaacatcctggactacatccagcccagcacccaggacagagagcacagcggcatgaacgtgaacagaagagaggagagcacccacgaccacaccatcgagagacccgccttcggcatccagaagggcgagttcgagcacagcgagaccagagagggcgagacccagggcgtggccttcgagcacgagagccccgccgacttccagaacagccagagccccgtgcaggaccaggacaagagccagctgagcggcagagaggagcagagcagcgacgccggcctgttcaaggaggagggcggcctggacttcctgggcagacaggacaccgactacagaagcatggagtacagagacgtggaccacagactgcccggcagccagatgttcggctacggccagagcaagagcttccccgagggcaagaccgccagagacgcccagagagacctgcaggaccaggactacagaaccggccccagcgaggagaagcccagcagactgatcagactgagcggcgtgcccgaggacgccaccaaggaggagatcctgaacgccttcagaacccccgacggcatgcccgtgaagaacctgcagctgaaggagtacaacaccggctacgactacggctacgtgtgcgtggagttcagcctgctggaggacgccatcggctgcatggaggccaaccagggcaccctgatgatccaggacaaggaggtgaccctggagtacgtgagcagcctggacttctggtactgcaagagatgcaaggccaacatcggcggccacagaagcagctgcagcttctgcaagaaccccagagaggtgaccgaggccaagcaggagctgatcacctacccccagccccagaagaccagcatccccgcccccctggagaagcagcccaaccagcccctgagacccgccgacaaggagcccgagcccagaaagagagaggagggccaggagagcagactgggccaccagaagagagaggccgagagatacctgccccccagcagaagagagggccccaccttcagaagagacagagagagagagagctggagcggcgagaccagacaggacggcgagagcaagaccatcatgctgaagagaatctacagaagcaccccccccgaggtgatcgtggaggtgctggagccctacgtgagactgaccaccgccaacgtgagaatcatcaagaacagaaccggccccatgggccacacctacggcttcatcgacctggacagccacgccgaggccctgagagtggtgaagatcctgcagaacctggacccccccttcagcatcgacggcaagatggtggccgtgaacctggccaccggcaagagaagaaacgacagcggcgaccacagcgaccacatgcactactaccagggcaagaagtacttcagagacagaagaggcggcggcagaaacagcgactggagcagcgacaccaacagacagggccagcagagcagcagcgactgctacatctacgacagcgccaccggctactactacgaccccctggccggcacctactacgaccccaacacccagcaggaggtgtacgtgccccaggaccccggcctgcccgaggaggaggagatcaaggagaagaagcccaccagccagggcaagagcagcagcaagaaggagatgagcaagagagacggcaaggagaagaaggacagaggcgtgaccagattccaggagaacgccagcgagggcaaggcccccgccgaggacgtgttcaagaagcccctgccccccaccgtgaagaaggaggagagcccccccccccccaaggtggtgaaccccctgatcggcctgctgggcgagtacggcggcgacagcgactacgaggaggaggaggaggaggagcagaccccccccccccagcccagaaccgcccagccccagaagagagaggagcagaccaagaaggagaacgaggaggacaagctgaccgactggaacaagctggcctgcctgctgtgcagaagacagttccccaacaaggaggtgctgatcaagcaccagcagctgagcgacctgcacaagcagaacctggagatccacagaaagatcaagcagagcgagcaggagctggcctacctggagagaagagagagagagggcaagttcaagggcagaggcaacgacagaagagagaagctgcagagcttcgacagccccgagagaaagagaatcaagtacagcagagagaccgacagcgacagaaagctggtggacaaggaggacatcgacaccagcagcaagggcggctgcgtgcagcaggccaccggctggagaaagggcaccggcctgggctacggccaccccggcctggccagcagcgaggaggccgagggcagaatgagaggccccagcgtgggcgccagcggcagaaccagcaagagacagagcaacgagacctacagagacgccgtgagaagagtgatgttcgccagatacaaggagctggactag

SEQ ID NO: 9394 - DNA, 1398 bp, Artificial Sequence
  Description of Artificial Sequence: Synthetic coding sequence
atgctgaagagaatctacagaagcaccccccccgaggtgatcgtggaggtgctggagccctacgtgagactgaccaccgccaacgtgagaatcatcaagaacagaaccggccccatgggccacacctacggcttcatcgacctggacagccacgccgaggccctgagagtggtgaagatcctgcagaacctggacccccccttcagcatcgacggcaagatggtggccgtgaacctggccaccggcaagagaagaaacgacagcggcgaccacagcgaccacatgcactactaccagggcaagaagtacttcagagacagaagaggcggcggcagaaacagcgactggagcagcgacaccaacagacagggccagcagagcagcagcgactgctacatctacgacagcgccaccggctactactacgaccccctggccggcacctactacgaccccaacacccagcaggaggtgtacgtgccccaggaccccggcctgcccgaggaggaggagatcaaggagaagaagcccaccagccagggcaagagcagcagcaagaaggagatgagcaagagagacggcaaggagaagaaggacagaggcgtgaccagattccaggagaacgccagcgagggcaaggcccccgccgaggacgtgttcaagaagcccctgccccccaccgtgaagaaggaggagagcccccccccccccaaggtggtgaaccccctgatcggcctgctgggcgagtacggcggcgacagcgactacgaggaggaggaggaggaggagcagaccccccccccccagcccagaaccgcccagccccagaagagagaggagcagaccaagaaggagaacgaggaggacaagctgaccgactggaacaagctggcctgcctgctgtgcagaagacagttccccaacaaggaggtgctgatcaagcaccagcagctgagcgacctgcacaagcagaacctggagatccacagaaagatcaagcagagcgagcaggagctggcctacctggagagaagagagagagagggcaagttcaagggcagaggcaacgacagaagagagaagctgcagagcttcgacagccccgagagaaagagaatcaagtacagcagagagaccgacagcgacagaaagctggtggacaaggaggacatcgacaccagcagcaagggcggctgcgtgcagcaggccaccggctggagaaagggcaccggcctgggctacggccaccccggcctggccagcagcgaggaggccgagggcagaatgagaggccccagcgtgggcgccagcggcagaaccagcaagagacagagcaacgagacctacagagacgccgtgagaagagtgatgttcgccagatacaaggagctggactag

SEQ ID NO: 9395 - DNA, 1173 bp, Artificial Sequence
  Description of Artificial Sequence: Synthetic coding sequence
atggtggaggccgacagacccggcaagctgttcatcggcggcctgaacaccgagaccaacgagaaggccctggagaccgtgttcggcaagtacggcagaatcgtggaggtgctgctgatcaaggacagagagaccaacaagagcagaggcttcgccttcgtgaccttcgagagccccgccgacgccaaggacgccgccagagacatgaacggcaagagcctggacggcaaggccatcaaggtggagcaggccaccaagcccagcttcgagagaggcagacacggccccccccccccccccagaagcagaggcccccccagaggcttcggcgccggcagaggcggcagcggcggcaccagaggcccccccagcagaggcggccacatggacgacggcggctacagcatgaacttcaacatgagcagcagcagaggccccctgcccgtgaagagaggccccccccccagaagcggcggccccagccccaagagaagcgcccccagcggcctggtgagaagcagcagcggcatgggcggcagagcccccctgagcagaggcagagacagctacggcggcccccccagaagagagcccctgcccagcagaagagacgtgtacctgagccccagagacgacggctacagcaccaaggacagctacagcagcagagactaccccagcagcagagacaccagagactacgcccccccccccagagactacacctacagagactacggccacagcagcagcagagacgactaccccagcagaggctacggcgacagagacggctacggcagagacagagactacagcgaccaccccagcggcggcagctacagagacagctacgagagctacggcaacagcagaagcgcccccctgaccagaggccccccccccagctacggcggcagcagcagatacgacgactacagcagcagcagagacggctacggcggcagcagagacagctacagcagcagcagaagcgacctgtacagcagctgcgacagagtgggcagacaggagagaggcctgccccccagcgtggagagaggctaccccagcagcagagacagctacagcagcagcagcagaggcgcccccagaggcgccggccccggcggcagcagaagcgacagaggcggcggcagaagcagatactag

SEQ ID NO: 9396 - DNA, 1173 bp, Artificial Sequence; identical to SEQ ID NO: 9395
  Description of Artificial Sequence: Synthetic coding sequence

SEQ ID NO: 9397 - DNA, 1491 bp, Artificial Sequence
  Description of Artificial Sequence: Synthetic coding sequence
atggtggaggccgaccaccccggcaagctgttcatcggcggcctgaacagagagaccaacgagaagatgctgaaggccgtgttcggcaagcacggccccatcagcgaggtgctgctgatcaaggacagaaccagcaagagcagaggcttcgccttcatcaccttcgagaaccccgccgacgccaagaacgccgccaaggacatgaacggcaccagcctgcacggcaaggccatcaaggtggagcaggccaagaagcccagcttccagagcggcggcagaagaagaccccccgccagcagcagaaacagaagccccagcggcagcctgagaagcgccagaggcagcagcggcggcaccagaggctggctgcccagccacgagggccacctggacgacggcggctacacccccgacctgaagatgagctacagcagaggcctgatccccgtgaagagaggccccagcagcagaagcggcggccccccccccaagaagagcgcccccagcgccgtggccagaagcaacagctggatgggcagccagggccccatgagccagagaagagagaactacggcgtgccccccagaagagccaccatcagcagctggagaaacgacagaatgagcaccagacacgacggctacgccaccaacgacggcaaccaccccagctgccaggagaccagagactacgccccccccagcagaggctacgcctacagagacaacggccacagcaacagagacgagcacagcagcagaggctacagaaaccacagaagcagcagagagaccagagactacgccccccccagcagaggccacgcctacagagactacggccacagcagaagagacgagagctacagcagaggctacagaaaccacagaagcagcagagagaccagagagtacgccccccccagcagaggccacggctacagagactacggccacagcagaagacacgagagctacagcagaggctacagaaaccaccccagcagcagagagaccagagactacgcccccccccacagagactacgcctacagagactacggccacagcagctgggacgagcacagcagcagaggctacagctaccacgacggctacggcgaggccctgggcagagaccacagcgagcacctgagcggcagcagctacagagacgccctgcagagatacggcaccagccacggcgccccccccgccagaggccccagaatgagctacggcggcagcacctgccacgcctacagcaacaccagagacagatacggcagaagctgggagagctacagcagctgcggcgacttccactactgcgacagagagcacgtgtgcagaaaggaccagagaaacccccccagcctgggcagagtgctgcccgaccccagagaggcctacggcagcagcagctacgtggccagcatcgtggacggcggcgagagcagaagcgagaagggcgacagcagcagatactag

SEQ ID NO: 9398 - DNA, 1380 bp, Artificial Sequence
  Description of Artificial Sequence: Synthetic coding sequence
atggtggaggccgaccaccccggcaagctgttcatcggcggcctgaacagagagaccaacgagaagatgctgaaggccgtgttcggcaagcacggccccatcagcgaggtgctgctgatcaaggacagaaccagcaagagcagaggcttcgccttcatcaccttcgagaaccccgccgacgccaagaacgccgccaaggacatgaacggcaccagcctgcacggcaaggccatcaaggtggagcaggccaagaagcccagcttccagagcggcggcagaagaagaccccccgccagcagcagaaacagaagccccagcggcagcctgagaagcgccagaggcagcagcggcggcaccagaggctggctgcccagccacgagggccacctggacgacggcggctacacccccgacctgaagatgagctacagcagaggcctgatccccgtgaagagaggccccagcagcagaagcggcggccccccccccaagaagagcgcccccagcgccgtggccagaagcaacagctggatgggcagccagggccccatgagccagagaagagagaactacggcgtgccccccagaagagccaccatcagcagctggagaaacgacagaatgagcaccagacacgacggctacgccaccaacgacggcaaccaccccagctgccaggagaccagagactacgccccccccagcagaggctacgcctacagagacaacggccacagcaacagagacgagcacagcagcagaggctacagaaaccacagaagcagcagagagaccagagactacgccccccccagcagaggccacgcctacagagactacggccacagcagaagagacgagagctacagcagaggctacagaaaccacagaagcagcagagagaccagagagtacgccccccccagcagaggccacggctacagagactacggccacagcagaagacacgagagctacagcagaggctacagctaccacgacggctacggcgaggccctgggcagagaccacagcgagcacctgagcggcagcagctacagagacgccctgcagagatacggcaccagccacggcgccccccccgccagaggccccagaatgagctacggcggcagcacctgccacgcctacagcaacaccagagacagatacggcagaagctgggagagctacagcagctgcggcgacttccactactgcgacagagagcacgtgtgcagaaaggaccagagaaacccccccagcctgggcagagtgctgcccgaccccagagaggcctacggcagcagcagctacgtggccagcatcgtggacggcggcgagagcagaagcgagaagggcgacagcagcagatactag

SEQ ID NO: 9399 - DNA, 1491 bp, Artificial Sequence; identical to SEQ ID NO: 9397
  Description of Artificial Sequence: Synthetic coding sequence

SEQ ID NO: 9400 - DNA, 1491 bp, Artificial Sequence; identical to SEQ ID NO: 9397
  Description of Artificial Sequence: Synthetic coding sequence

SEQ ID NO: 9401 - DNA, 1380 bp, Artificial Sequence; identical to SEQ ID NO: 9398
  Description of Artificial Sequence: Synthetic coding sequence

SEQ ID NO: 9402 - DNA, 1221 bp, Artificial Sequence
  Description of Artificial Sequence: Synthetic coding sequence
atgggcaaggtgtggaagcagcagatgtacccccagtacgccacctactactacccccagtacctgcaggccaagcagagcctggtgcccgcccaccccatggccccccccagccccagcaccaccagcagcaacaacaacagcagcagcagcagcaacagcggctgggaccagctgagcaagaccaacctgtacatcagaggcctgcccccccacaccaccgaccaggacctggtgaagctgtgccagccctacggcaagatcgtgagcaccaaggccatcctggacaagaccaccaacaagtgcaagggctacggcttcgtggacttcgacagccccgccgccgcccagaaggccgtgagcgccctgaaggccagcggcgtgcaggcccagatggccaagcagcaggagcaggaccccaccaacctgtacatcagcaacctgcccctgagcatggacgagcaggagctggagaacatgctgaagcccttcggccaggtgatcagcaccagaatcctgagagacagcagcggcaccagcagaggcgtgggcttcgccagaatggagagcaccgagaagtgcgaggccgtgatcggccacttcaacggcaagttcatcaagaccccccccggcgtgagcgcccccaccgagcccctgctgtgcaagttcgccgacggcggccagaagaagagacagaaccccaacaagtacatccccaacggcagaccctggcacagagagggcgaggtgagactggccggcatgaccctgacctacgaccccaccaccgccgccatccagaacggcttctaccccagcccctacagcatcgccaccaacagaatgatcacccagaccagcatcaccccctacatcgccagccccgtgagcgcctaccaggtgcagagccccagctggatgcagccccagccctacatcctgcagcaccccggcgccgtgctgacccccagcatggagcacaccatgagcctgcagcccgccagcatgatcagccccctggcccagcagatgagccacctgagcctgggcagcaccggcacctacatgcccgccaccagcgccatgcagggcgcctacctgccccagtacgcccacatgcagaccaccgccgtgcccgtggaggaggccagcggccagcagcaggtggccgtggagaccagcaacgaccacagcccctacaccttccagcccaacaagtag

SEQ ID NO: 9403 - DNA, 1260 bp, Artificial Sequence
  Description of Artificial Sequence: Synthetic coding sequence
atgggcaaggtgtggaagcagcagatgtacccccagtacgccacctactactacccccagtacctgcaggccaagcagagcctggtgcccgcccaccccatggccccccccagccccagcaccaccagcagcaacaacaacagcagcagcagcagcaacagcggctgggaccagctgagcaagaccaacctgtacatcagaggcctgcccccccacaccaccgaccaggacctggtgaagctgtgccagccctacggcaagatcgtgagcaccaaggccatcctggacaagaccaccaacaagtgcaagggctacggcttcgtggacttcgacagccccgccgccgcccagaaggccgtgagcgccctgaaggccagcggcgtgcaggcccagatggccaagcagcaggagcaggaccccaccaacctgtacatcagcaacctgcccctgagcatggacgagcaggagctggagaacatgctgaagcccttcggccaggtgatcagcaccagaatcctgagagacagcagcggcaccagcagaggcgtgggcttcgccagaatggagagcaccgagaagtgcgaggccgtgatcggccacttcaacggcaagttcatcaagaccccccccggcgtgagcgcccccaccgagcccctgctgtgcaagttcgccgacggcggccagaagaagagacagaaccccaacaagtacatccccaacggcagaccctggcacagagagggcgaggccggcatgaccctgacctacgaccccaccaccgccgccatccagaacggcttctaccccagcccctacagcatcgccaccaacagaatgatcacccagaccagcatcaccccctacatcgccagccccgtgagcgcctaccaggtggccaaggagaccagagagaacaagtacagaggcagcgccatcaaggtgcagagccccagctggatgcagccccagccctacatcctgcagcaccccggcgccgtgctgacccccagcatggagcacaccatgagcctgcagcccgccagcatgatcagccccctggcccagcagatgagccacctgagcctgggcagcaccggcacctacatgcccgccaccagcgccatgcagggcgcctacctgccccagtacgcccacatgcagaccaccgccgtgcccgtggaggaggccagcggccagcagcaggtggccgtggagaccagcaacgaccacagcccctacaccttccagcccaacaagtag

SEQ ID NO: 9404 - DNA, 1113 bp, Artificial Sequence
  Description of Artificial Sequence: Synthetic coding sequence
atggccccccccagccccagcaccaccagcagcaacaacaacagcagcagcagcagcaacagcggctgggaccagctgagcaagaccaacctgtacatcagaggcctgcccccccacaccaccgaccaggacctggtgaagctgtgccagccctacggcaagatcgtgagcaccaaggccatcctggacaagaccaccaacaagtgcaagggctacggcttcgtggacttcgacagccccgccgccgcccagaaggccgtgagcgccctgaaggccagcggcgtgcaggcccagatggccaagcagcaggagcaggaccccaccaacctgtacatcagcaacctgcccctgagcatggacgagcaggagctggagaacatgctgaagcccttcggccaggtgatcagcaccagaatcctgagagacagcagcggcaccagcagaggcgtgggcttcgccagaatggagagcaccgagaagtgcgaggccgtgatcggccacttcaacggcaagttcatcaagaccccccccggcgtgagcgcccccaccgagcccctgctgtgcaagttcgccgacggcggccagaagaagagacagaaccccaacaagtacatccccaacggcagaccctggcacagagagggcgaggccggcatgaccctgacctacgaccccaccaccgccgccatccagaacggcttctaccccagcccctacagcatcgccaccaacagaatgatcacccagaccagcatcaccccctacatcgccagccccgtgagcgcctaccaggtgcagagccccagctggatgcagccccagccctacatcctgcagcaccccggcgccgtgctgacccccagcatggagcacaccatgagcctgcagcccgccagcatgatcagccccctggcccagcagatgagccacctgagcctgggcagcaccggcacctacatgcccgccaccagcgccatgcagggcgcctacctgccccagtacgcccacatgcagaccaccgccgtgcccgtggaggaggccagcggccagcagcaggtggccgtggagaccagcaacgaccacagcccctacaccttccagcccaacaagtag

SEQ ID NO: 9405 - DNA, 1113 bp, Artificial Sequence; identical to SEQ ID NO: 9404
  Description of Artificial Sequence: Synthetic coding sequence

SEQ ID NO: 9406 - DNA, 1113 bp, Artificial Sequence; identical to SEQ ID NO: 9404
  Description of Artificial Sequence: Synthetic coding sequence

SEQ ID NO: 9407 - DNA, 387 bp, Artificial Sequence
  Description of Artificial Sequence: Synthetic coding sequence
atggccccccccagccccagcaccaccagcagcaacaacaacagcagcagcagcagcaacagcggctgggaccagctgagcaagaccaacctgtacatcagaggcctgcccccccacaccaccgaccaggacctggtgaagctgtgccagccctacggcaagatcgtgagcaccaaggccatcctggacaagaccaccaacaagtgcaagggctacggcttcgtggacttcgacagccccgccgccgcccagaaggccgtgagcgccctgaaggccagcggcgtgcaggcccagatggccaagcagcaggagcaggaccccaccaacctgtacatcagcaacctgcccctgagcatggacgagcaggagctggagaacatgctgtag

SEQ ID NO: 9408 - DNA, 1224 bp, Artificial Sequence
  Description of Artificial Sequence: Synthetic coding sequence
atgctgctgagcgtgaccagcagacccggcatcagcaccttcggctacaacagaaacaacaagaagccctacgtgagcctggcccagcagatggccccccccagccccagcaacagcacccccaacagcagcagcggcagcaacggcaacgaccagctgagcaagaccaacctgtacatcagaggcctgcagcccggcaccaccgaccaggacctggtgaagctgtgccagccctacggcaagatcgtgagcaccaaggccatcctggacaagaccaccaacaagtgcaagggctacggcttcgtggacttcgacagccccagcgccgcccagaaggccgtgaccgccctgaaggccagcggcgtgcaggcccagatggccaagcagcaggagcaggaccccaccaacctgtacatcagcaacctgcccctgagcatggacgagcaggagctggagggcatgctgaagcccttcggccaggtgatcagcaccagaatcctgagagacaccagcggcaccagcagaggcgtgggcttcgccagaatggagagcaccgagaagtgcgaggccatcatcacccacttcaacggcaagtacatcaagaccccccccggcgtgcccgcccccagcgaccccctgctgtgcaagttcgccgacggcggccccaagaagagacagaaccagggcaagttcgtgcagaacggcagagcctggcccagaaacgccgacatgggcgtgatggccctgacctacgaccccaccaccgccctgcagaacggcttctaccccgccccctacaacatcacccccaacagaatgctggcccagagcgccctgagcccctacctgagcagccccgtgagcagctaccagagagtgacccagaccagccccctgcaggtgcccaaccccagctggatgcaccaccacagctacctgatgcagcccagcggcagcgtgctgacccccggcatggaccaccccatcagcctgcagcccgccagcatgatgggccccctgacccagcagctgggccacctgagcctgagcagcaccggcacctacatgcccaccgccgccgccatgcagggcgcctacatcagccagtacacccccgtgcccagcagcagcgtgagcgtggaggagagcagcggccagcagaaccaggtggccgtggacgcccccagcgagcacggcgtgtacagcttccagttcaacaagtag

SEQ ID NO: 9409 - DNA, 921 bp, Artificial Sequence
  Description of Artificial Sequence: Synthetic coding sequence
atgagcctgaagctgcaggccagcaacgtgaccaacaagaacgaccccaagagcatcaacagcagagtgttcatcggcaacctgaacaccgccctggtgaagaagagcgacgtggagaccatcttcagcaagtacggcagagtggccggctgcagcgtgcacaagggctacgccttcgtgcagtacagcaacgagagacacgccagagccgccgtgctgggcgagaacggcagagtgctggccggccagaccctggacatcaacatggccggcgagcccaagcccgacagacccaagggcctgaagagagccgccagcgccatctacagcggctacatcttcgactacgactactacagagacgacttctacgacagactgttcgactacagaggcagactgagccccgtgcccgtgcccagagccgtgcccgtgaagagacccagagtgaccgtgcccctggtgagaagagtgaagaccaacgtgcccgtgaagctgttcgccagaagcaccgccgtgaccaccagcagcgccaagatcaagctgaagagcagcgagctgcaggccatcaagaccgagctgacccagatcaagagcaacatcgacgccctgctgagcagactggagcagatcgccgccgagcagaaggccaaccccgacggcaagaagaagggcgacggcggcggcgccggcggcggcggcggcggcggcggcagcggcggcggcggcagcggcggcggcggcggcggcggcagcagcagaccccccgccccccaggagaacaccaccagcgaggccggcctgccccagggcgaggccagaaccagagacgacggcgacgaggagggcctgctgacccacagcgaggaggagctggagcacagccaggacaccgacgccgacgacggcgccctgcagtag

SEQ ID NO: 9410 - DNA, 873 bp, Artificial Sequence
  Description of Artificial Sequence: Synthetic coding sequence
atgagcctgaagctgcaggccagcaacgtgaccaacaagaacgaccccaagagcatcaacagcagagtgttcatcggcaacctgaacaccgccctggtgaagaagagcgacgtggagaccatcttcagcaagtacggcagagtggccggctgcagcgtgcacaagggctacgccttcgtgcagtacagcaacgagagacacgccagagccgccgtgctgggcgagaacggcagagtgctggccggccagaccctggacatcaacatggccggcgagcccaagcccgacagacccaagggcctgaagagagccgccagcgccatctacagactgttcgactacagaggcagactgagccccgtgcccgtgcccagagccgtgcccgtgaagagacccagagtgaccgtgcccctggtgagaagagtgaagaccaacgtgcccgtgaagctgttcgccagaagcaccgccgtgaccaccagcagcgccaagatcaagctgaagagcagcgagctgcaggccatcaagaccgagctgacccagatcaagagcaacatcgacgccctgctgagcagactggagcagatcgccgccgagcagaaggccaaccccgacggcaagaagaagggcgacggcggcggcgccggcggcggcggcggcggcggcggcagcggcggcggcggcagcggcggcggcggcggcggcggcagcagcagaccccccgccccccaggagaacaccaccagcgaggccggcctgccccagggcgaggccagaaccagagacgacggcgacgaggagggcctgctgacccacagcgaggaggagctggagcacagccaggacaccgacgccgacgacggcgccctgcagtag

SEQ ID NO: 9411 - DNA, 270 bp, Artificial Sequence
  Description of Artificial Sequence: Synthetic coding sequence
atgagcctgaagctgcaggccagcaacgtgaccaacaagaacgaccccaagagcatcaacagcagagtgttcatcggcaacctgaacaccgccctggtgaagaagagcgacgtggagaccatcttcagcaagtacggcagagtggccggctgcagcgtgcacaagggctacgccttcgtgcagtacagcaacgagagacacgccagagccgccgtgctgggcgagaacggcagagtgctggccggccagaccctggacatcaacatgtag

SEQ ID NO: 9412 - DNA, 714 bp, Artificial Sequence
  Description of Artificial Sequence: Synthetic coding sequence
atgagcctgaagctgcaggccagcaacgtgaccaacaagaacgaccccaagagcatcaacagcagagtgttcatcggcaacctgaacaccgccctggtgaagaagagcgacgtggagaccatcttcagcaagtacggcagagtggccggctgcagcgtgcacaagggctacgccttcgtgcagtacagcaacgagagacacgccagagccgccgtgctgggcgagaacggcagagtgctggccggccagaccctggacatcaacatggccggcgagcccaagcccgacagacccaagggcctgaagagagccgccagcgccatctacagactgttcgactacagaggcagactgagccccgtgcccgtgcccagagccgtgcccgtgaagagacccagagtgaccgtgcccctggtgagaagagtgaagaccaacgtgcccgtgaagctgttcgccagaagcaccgccgtgaccaccagcagcgccaagatcaagctgaagagcagcgagctgcaggccatcaagaccgagctgacccagatcaagagcaacatcgacgccctgctgagcagactggagcagatcgccgccgagcagaaggccaaccccgacggcaagaagaagggcgacggcggcggcgccggcggcggcggcggcggcggcggcagcggcggcggcggcagcggcggcggcggcggcggcggcagcagctag

SEQ ID NO: 9413 - DNA, 546 bp, Artificial Sequence
  Description of Artificial Sequence: Synthetic coding sequence
atgagcctgaagctgcaggccagcaacgtgaccaacaagaacgaccccaagagcatcaacagcagagtgttcatcggcaacctgaacaccgccctggtgaagaagagcgacgtggagaccatcttcagcaagtacggcagagtggccggctgcagcgtgcacaagggctacgccttcgtgcagtacagcaacgagagacacgccagagccgccgtgctgggcgagaacggcagagtgctggccggccagaccctggacatcaacatggccggcgagcccaagcccgacagacccaagggcctgaagagagccgccagcgccatctacagcggctacatcttcgactacgactactacagagacgacttctacgacagactgttcgactacagaggcagactgagccccgtgcccgtgcccagagccgtgcccgtgaagagacccagagtgaccgtgcccctggtgagaagagtgaagaccaacgtgcccgtgaagctgttcgccagaagcaccgccgtgaccaccagcagcgccaagatcaagtag

SEQ ID NO: 9414 - DNA, 564 bp, Artificial Sequence
  Description of Artificial Sequence: Synthetic coding sequence
atgaccagcctgacccccggctgcagatacagcgtgagagtgagcccccagatggccaacagaatcgtggacagcgccagaagcatcctgaacaagttcatccccgacatctacatctacaccgaccacatgaagggcgtgaacagcggcaagagccccggcttcggcctgagcctggtggccgagaccaccagcggcaccttcctgagcgccgagctggccagcaacccccagggccagggcgccgccgtgctgcccgaggacctgggcagaaactgcgccagactgctgctggaggagatctacagaggcggctgcgtggacagcaccaaccagagcctggccctgctgctgatgaccctgggccagcaggacgtgagcaaggtgctgctgggccccctgagcccctacaccatcgagttcctgagacacctgaagagcttcttccagatcatgttcaagatcgagaccaagccctgcggcgaggagctgaagggcggcgacaaggtgctgatgacctgcgtgggcatcggcttcagcaacctgagcaagaccctgaagtag

SEQ ID NO: 9415 - DNA, 564 bp, Artificial Sequence; identical to SEQ ID NO: 9414
  Description of Artificial Sequence: Synthetic coding sequence

SEQ ID NO: 9416 - DNA, 528 bp, Artificial Sequence
  Description of Artificial Sequence: Synthetic coding sequence
atggccacccaggcccacagcctgagctacgccggctgcaacttcctgagacagagactggtgctgagcaccctgagcggcagacccgtgaagatcagaaagatcagagccagagacgacaaccccggcctgagagacttcgaggccagcttcatcagactgctggacaagatcaccaacggcagcagaatcgagatcaaccagaccggcaccaccctgtactaccagcccggcctgctgtacggcggcagcgtggagcacgactgcagcgtgctgagaggcatcggctactacctggagagcctgctgtgcctggcccccttcatgaagcaccccctgaagatcgtgctgagaggcgtgaccaacgaccaggtggaccccagcgtgagcatcgagaacaagccctggtgcggcttctgcttcgtgagctgccacaaccccacctgcgagaagaaggtgccctacaaggcccagttctactacaagtgcatcctgctgctgctgttcaccctgagattcagaggctag

SEQ ID NO: 9417 - DNA, 1122 bp, Artificial Sequence
  Description of Artificial Sequence: Synthetic coding sequence
atggccacccaggcccacagcctgagctacgccggctgcaacttcctgagacagagactggtgctgagcaccctgagcggcagacccgtgaagatcagaaagatcagagccagagacgacaaccccggcctgagagacttcgaggccagcttcatcagactgctggacaagatcaccaacggcagcagaatcgagatcaaccagaccggcaccaccctgtactaccagcccggcctgctgtacggcggcagcgtggagcacgactgcagcgtgctgagaggcatcggctactacctggagagcctgctgtgcctggcccccttcatgaagcaccccctgaagatcgtgctgagaggcgtgaccaacgaccaggtggaccccagcgtggacgtgctgaaggccaccgccctgcccctgctgaagcagttcggcatcgacggcgagagcttcgagctgaagatcgtgagaagaggcatgccccccggcggcggcggcgaggtggtgttcagctgccccgtgagaaaggtgctgaagcccatccagctgaccgaccccggcaagatcaagagaatcagaggcatggcctacagcgtgagagtgagcccccagatggccaacagaatcgtggacagcgccagaagcatcctgaacaagttcatccccgacatctacatctacaccgaccacatgaagggcgtgaacagcggcaagagccccggcttcggcctgagcctggtggccgagaccaccagcggcaccttcctgagcgccgagctggccagcaacccccagggccagggcgccgccgtgctgcccgaggacctgggcagaaactgcgccagactgctgctggaggagatctacagaggcggctgcgtggacagcaccaaccagagcctggccctgctgctgatgaccctgggccagcaggacgtgagcaaggtgctgctgggccccctgagcccctacaccatcgagttcctgagacacctgaagagcttcttccagatcatgttcaagatcgagaccaagccctgcggcgaggagctgaagggcggcgacaaggtgctgatgacctgcgtgggcatcggcttcagcaacctgagcaagaccctgaagtag

SEQ ID NO: 9418 - DNA, 417 bp, Artificial Sequence
  Description of Artificial Sequence: Synthetic coding sequence
atgaccagcctgacccccggctgcagatacagcgtgagagtgagcccccagatggccaacagaatcgtggacagcgccagaagcatcctgaacaagttcatccccgacatctacatctacaccgaccacatgaagggcgtgaacagcggcaagagccccggcttcggcctgagcctggtggccgagaccaccagcggcaccttcctgagcgccgagctggccagcaacccccagggccagggcgccgccgtgctgcccgaggacctgggcagaaactgcgccagactgctgctggaggagatctacagaggcggctgcgtggacagcaccaaccagagcctggccctgctgctgatgaccctgggccagcaggacgtgagcaaggtgctgctgggccccctgagcccctacacctag

SEQ ID NO: 9419 - DNA, 549 bp, Artificial Sequence
  Description of Artificial Sequence: Synthetic coding sequence
atgccccccggcggcggcggcgaggtggtgttcagctgccccgtgagaaaggtgctgaagcccatccagctgaccgaccccggcaagatcaagagaatcagaggcatggcctacagcgtgagagtgagcccccagatggccaacagaatcgtggacagcgccagaagcatcctgaacaagttcatccccgacatctacatctacaccgaccacatgaagggcgtgaacagcggcaagagccccggcttcggcctgagcctggtggccgagaccaccagcggcaccttcctgagcgccgagctggccagcaacccccagggccagggcgccgccgtgctgcccgaggacctgggcagaaactgcgccagactgctgctggaggagatctacagaggcggctgcgtggacagcaccaaccagagcctggccctgctgctgatgaccctgggccagcaggacgtgagcaaggtgctgctgggccccctgagcccctacaccatcgagttcctgagacacctgaagagcttcttccagatcatgttcaagtag

SEQ ID NO: 9420 - DNA, 564 bp, Artificial Sequence; identical to SEQ ID NO: 9414
  Description of Artificial Sequence: Synthetic coding sequence

SEQ ID NO: 9421 - DNA, 1554 bp, Artificial Sequence
  Description of Artificial Sequence: Synthetic coding sequence
atggccgcccccgagcagcccctggccatcagcagaggctgcaccagcagcagcagcctgagcccccccagaggcgacagaaccctgctggtgagacacctgcccgccgagctgaccgccgaggagaaggaggacctgctgaagtacttcggcgcccagagcgtgagagtgctgagcgacaagggcagactgaagcacaccgccttcgccaccttccccaacgagaaggccgccatcaaggccctgaccagactgcaccagctgaagctgctgggccacaccctggtggtggagttcgccaaggagcaggacagagtgcacagcccctgccccaccagcggcagcgagaagaagaagagaagcgacgaccccgtggaggacgacaaggagaagaaggagctgggctacctgaccgtggagaacggcatcgcccccaaccacggcctgaccttccccctgaacagctgcctgaagtacatgtaccccccccccagcagcaccatcctggccaacatcgtgaacgccctggccagcgtgcccaagttctacgtgcaggtgctgcacctgatgaacaagatgaacctgcccacccccttcggccccatcaccgccagaccccccatgtacgaggactacatgcccctgcacgcccccctgccccccaccagcccccagccccccgaggagccccccctgcccgacgaggacgaggagctgagcagcgaggagagcgagtacgagagcaccgacgacgaggacagacagagaatgaacaagctgatggagctggccaacctgcagcccaagagacccaagaccatcaagcagagacacgtgagaaagaagagaaagatcaaggacatgctgaacacccccctgtgccccagccacagcagcctgcaccccgtgctgctgcccagcgacgtgttcgaccagccccagcccgtgggcaacaagagaatcgagttccacatcagcaccgacatgcccgccgccttcaagaaggacctggagaaggagcagaactgcgaggagaagaaccacgacctgcccgccaccgaggtggacgccagcaacatcggcttcggcaagatcttccccaagcccaacctggacatcaccgaggagatcaaggaggacagcgacgagatgcccagcgagtgcatcagcagaagagagctggagaagggcagaatcagcagagaggagatggagaccctgagcgtgttcagaagctacgagcccggcgagcccaactgcagaatctacgtgaagaacctggccaagcacgtgcaggagaaggacctgaagtacatcttcggcagatacgtggacttcagcagcgagacccagagaatcatgttcgacatcagactgatgaaggagggcagaatgaagggccaggccttcatcggcctgcccaacgagaaggccgccgccaaggccctgaaggaggccaacggctacgtgctgttcggcaagcccatggtggtgcagttcgccagaagcgccagacccaagcaggaccccaaggagggcaagagaaagtgctag

SEQ ID NO: 9422 - DNA, 387 bp, Artificial Sequence
  Description of Artificial Sequence: Synthetic coding sequence
tgaagaagagagctggagaagggcagaatcagcagagaggagatggagaccctgagcgtgttcagaagctacgagcccggcgagcccaactgcagaatctacgtgaagaacctggccaagcacgtgcaggagaaggacctgaagtacatcttcggcagatacgtggacttcagcagcgagacccagagaatcatgttcgacatcagactgatgaaggagggcagaatgaagggccaggccttcatcggcctgcccaacgagaaggccgccgccaaggccctgaaggaggccaacggctacgtgctgttcggcaagcccatggtggtgcagttcgccagaagcgccagacccaagcaggaccccaaggagggcaagagaaagtgctag

SEQ ID NO: 9423 - DNA, 558 bp, Artificial Sequence
  Description of Artificial Sequence: Synthetic coding sequence
atggccgcccccgagcagcccctggccatcagcagaggctgcaccagcagcagcagcctgagcccccccagaggcgacagaaccctgctggtgagacacctgcccgccgagctgaccgccgaggagaaggaggacctgctgaagtacttcggcgcccagagcgtgagagtgctgagcgacaagggcagactgaagcacaccgccttcgccaccttccccaacgagaaggccgccatcaaggccctgaccagactgcaccagctgaagctgctgggccacaccctggtggtggagttcgccaaggagcaggacagagtgcacagcccctgccccaccagcggcagcgagaagaagaagagaagcgacgaccccgtggaggacgacaaggagaagaaggagctgggctacctgaccgtggagaacggcatcgcccccaaccacggcctgaccttccccctgaacagctgcctgaagtacatgtaccccccccccagcagcaccatcctggccaacatcgtgaacgccctggccagcgtgcccaagttctacgtgcagtag

SEQ ID NO: 9424 - DNA, 1554 bp, Artificial Sequence; identical to SEQ ID NO: 9421
  Description of Artificial Sequence: Synthetic coding sequence

SEQ ID NO: 9425 - DNA, 2409 bp, Artificial Sequence
  Description of Artificial Sequence: Synthetic coding sequence
atgttcatcagcggcagaagaaccgccgacaagtggagagccgaggagagactgcagtgccccgccggcagcgccagagccgccctggccagatgcgccgacggcggcgccgtgggccccttcaagtgcgtgttcgtgggcgagatggccgcccaggtgggcgccgtgagagtggtgagagccgtggccgcccaggaggagcccgacaaggagggcaaggagaagccccacgccggcgtgagccccagaggcgtgaagagacagagaagaagcagcagcggcggcagccaggagaagagaggcagacccagccaggagccccccctggcccccccccacagaagaagaagaagcagacagcaccccggccccctgccccccaccaacgccgcccccaccgtgcccggccccgtggagcccctgctgctgccccccccccccccccccagcctggcccccgccggccccgccgtggccgcccccctgcccgcccccagcaccagcgccctgttcaccttcagccccctgaccgtgagcgccgccggccccaagcacaagggccacaaggagagacacaagcaccaccaccacagaggccccgacggcgaccccagcagctgcggcaccgacctgaagcacaaggacaagcaggagaacggcgagagaaccggcggcgtgcccctgatcaaggcccccaagagagagacccccgacgagaacggcaagacccagagagccgacgacttcgtgctgaagaagatcaagaagaagaagaagaagaagcacagagaggacatgagaggcagaagactgaagatgtacaacaaggaggtgcagaccgtgtgcgccggcctgaccagaatcagcaaggagatcctgacccagggccagatcaacagcaccagcggcctgaacaaggagagcttcagatacctgaaggacgagcagctgtgcagactgaacctgggcatgcaggagtacagagtgccccagggcgtgcagacccccttcatgacccaccaggagcacagcatcagaagaaacttcctgaagaccggcaccaagttcagcaacttcatccacgaggagcaccagagcaacggcggcgccctggtgctgcacgcctacatggacgagctgagcttcctgagccccatggagatggagagattcagcgaggagttcctggccctgaccttcagcgagaacgagaagaacgccgcctactacgccctggccatcgtgcacggcgccgccgcctacctgcccgacttcctggactacttcgccttcaacttccccaacacccccgtgaagatggagatcctgggcaagaaggacatcgagaccaccaccatcagcaacttccacacccaggtgaacagaacctactgctgcggcacctacagagccggccccatgagacagatcagcctggtgggcgccgtggacgaggaggtgggcgactacttccccgagttcctggacatgctggaggagagccccttcctgaagatgaccctgccctggggcaccctgagcagcctgagactgcagtgcagaagccagagcgacgacggccccatcatgtgggtgagacccggcgagcagatgatccccaccgccgacatgcccaagagccccttcaagagaagaagaagcatgaacgagatcaagaacctgcagtacctgcccagaaccagcgagcccagagaggtgctgttcgaggacagaaccagagcccacgccgaccacgtgggccagggcttcgactggcagagcaccgccgccgtgggcgtgctgaaggccgtgcagttcggcgagtggagcgaccagcccagaatcaccaaggacgtgatctgcttccacgccgaggacttcaccgacgtggtgcagagactgcagctggacctgcacgagccccccgtgagccagtgcgtgcagtgggtggacgaggccaagctgaaccagatgagaagagagggcatcagatacgccagaatccagctgtgcgacaacgacatctacttcatccccagaaacgtgatccaccagttcaagaccgtgagcgccgtgtgcagcctggcctggcacatcagactgaagcagtaccaccccgtggtggaggccacccagaacaccgagagcaacagcaacatggactgcggcctgaccggcaagagagagctggaggtggacagccagtgcgtgagaatcaagaccgagagcgaggaggcctgcaccgagatccagctgctgaccaccgccagcagcagcttcccccccgccagcgagctgaacctgcagcaggaccagaagacccagcccatccccgtgctgaaggtggagagcagactggacagcgaccagcagcacaacctgcaggagcacagcaccaccagcgtgtag

SEQ ID NO: 9426 - DNA, 2541 bp, Artificial Sequence
  Description of Artificial Sequence: Synthetic coding sequence
atggccgagccccccagccccgtgcactgcgtggccgccgccgcccccaccgccaccgtgagcgagaaggagcccttcggcaagctgcagctgagcagcagagacccccccggcagcctgagcgccaagaaggtgagaaccgaggagaagaaggcccccagaagagtgaacggcgagggcggcagcggcggcaacagcagacagctgcagccccccgccgcccccagcccccagagctacggcagccccgccagctggagcttcgcccccctgagcgccgcccccagccccagcagcagcagaagcagcttcagcttcagcgccggcaccgccgtgcccagcagcgccagcgccagcctgagccagcccgtgcccagaaagctgctggtgccccccaccctgctgcacgcccagccccaccacctgctgctgcccgccgccgccgccgccgccagcgccaacgccaagagcagaagacccaaggagaagagagagaaggagagaagaagacacggcctgggcggcgccagagaggccggcggcgccagcagagaggagaacggcgaggtgaagcccctgcccagagacaagatcaaggacaagatcaaggagagagacaaggagaaggagagagagaagaagaagcacaaggtgatgaacgagatcaagaaggagaacggcgaggtgaagatcctgctgaagagcggcaaggagaagcccaagaccaacatcgaggacctgcagatcaagaaggtgaagaagaagaagaagaagaagcacaaggagaacgagaagagaaagagacccaagatgtacagcaagagcatccagaccatctgcagcggcctgctgaccgacgtggaggaccaggccgccaagggcatcctgaacgacaacatcaaggactacgtgggcaagaacctggacaccaagaactacgacagcaagatccccgagaacagcgagttccccttcgtgagcctgaaggagcccagagtgcagaacaacctgaagagactggacaccctggagttcaagcagctgatccacatcgagcaccagcccaacggcggcgccagcgtgatccacgcctacagcaacgagctgagccacctgagccccatggagatggagagattcgccgaggagttcgtgggcctggtgttcagcgagaacgagaacagcgccgccttctacgtgatgggcatcgtgcacggcgccgccacctacctgcccgacttcctggactacttcagcttcaacttccccaacagccccgtgaagatggagatcctgggcaagaaggacatcgagaccaccaccatgagcaacttccacgcccaggtgaagagaacctacagccacggcacctacagagccggccccatgagacagatcagcctggtgggcgccgtggacgaggaggtgggcgactacttccccgagttcctggacatgctggaggagagccccttcctgaagtgcaccctgccctggggcaccctgagcagcctgaagctgcagagcagaaaggacagcgacgacggccccatcatgtgggtgagacccggcgagcagatgatccccgtggccgacatgcccaagagccccttcaagagaaagagaaccaccaacgagatcaagaacctgcagtacctgcccagaaccagcgagcccagagagatgctgttcgaggacagaaccagagcccacgccgaccacatcggccagggcttcgagagacagaccaccgccgccgtgggcgtgctgaaggccgtgcactgcggcgagtggcccgaccagcccagaatcaccaaggacgtgatctgcttccacgccgaggacttcctggaggtggtgcagagaatgcagctggacctgcacgagccccccctgagccagtgcgtgcagtgggtggacgacgccaagctgaaccagctgagaagagagggcatcagatacgccagaatccagctgtacgacaacgacatctacttcatccccagaaacgtggtgcaccagttcaagaccgtgagcgccgtgtgcagcctggcctggcacatcagactgaagctgtaccacagcgaggaggacaccagccagaacaccgccacccacgagaccggcaccagcagcgacagcaccagcagcgtgctgggcccccacaccgacaacatgatctgcgccgtgagcaaggccagcctggacagcgtgttcagcgacaagctgcacagcaagtacgagctgcagcagatcaagcacgagcccatcgccagcgtgagaatcaaggaggagcccgtgaacgtgaacatccccgagaagaccaccgccctgaacaacatggacggcaagaacgtgaaggccaagctggaccacgtgcagttcgccgagttcaagatcgacatggacagcaagttcgagaacagcaacaaggacctgaaggaggagctgtgccccggcaacctgagcctggtggacaccagacagcacagcagcgcccacagcaaccaggacaagaaggacgacgacatcctgtgctag

SEQ ID NO: 9427 - DNA, 1731 bp, Artificial Sequence
  Description of Artificial Sequence: Synthetic coding sequence
atgtacagcaagagcatccagaccatctgcagcggcctgctgaccgacgtggaggaccaggccgccaagggcatcctgaacgacaacatcaaggactacgtgggcaagaacctggacaccaagaactacgacagcaagatccccgagaacagcgagttccccttcgtgagcctgaaggagcccagagtgcagaacaacctgaagagactggacaccctggagttcaagcagctgatccacatcgagcaccagcccaacggcggcgccagcgtgatccacgcctacagcaacgagctgagccacctgagccccatggagatggagagattcgccgaggagttcgtgggcctggtgttcagcgagaacgagaacagcgccgccttctacgtgatgggcatcgtgcacggcgccgccacctacctgcccgacttcctggactacttcagcttcaacttccccaacagccccgtgaagatggagatcctgggcaagaaggacatcgagaccaccaccatgagcaacttccacgcccaggtgaagagaacctacagccacggcacctacagagccggccccatgagacagatcagcctggtgggcgccgtggacgaggaggtgggcgactacttccccgagttcctggacatgctggaggagagccccttcctgaagtgcaccctgccctggggcaccctgagcagcctgaagctgcagagcagaaaggacagcgacgacggccccatcatgtgggtgagacccggcgagcagatgatccccgtggccgacatgcccaagagccccttcaagagaaagagaaccaccaacgagatcaagaacctgcagtacctgcccagaaccagcgagcccagagagatgctgttcgaggacagaaccagagcccacgccgaccacatcggccagggcttcgagagacagaccaccgccgccgtgggcgtgctgaaggccgtgcactgcggcgagtggcccgaccagcccagaatcaccaaggacgtgatctgcttccacgccgaggacttcctggaggtggtgcagagaatgcagctggacctgcacgagccccccctgagccagtgcgtgcagtgggtggacgacgccaagctgaaccagctgagaagagagggcatcagatacgccagaatccagctgtacgacaacgacatctacttcatccccagaaacgtggtgcaccagttcaagaccgtgagcgccgtgtgcagcctggcctggcacatcagactgaagctgtaccacagcgaggaggacaccagccagaacaccgccacccacgagaccggcaccagcagcgacagcaccagcagcgtgctgggcccccacaccgacaacatgatctgcgccgtgagcaaggccagcctggacagcgtgttcagcgacaagctgcacagcaagtacgagctgcagcagatcaagcacgagcccatcgccagcgtgagaatcaaggaggagcccgtgaacgtgaacatccccgagaagaccaccgccctgaacaacatggacggcaagaacgtgaaggccaagctggaccacgtgcagttcgccgagttcaagatcgacatggacagcaagttcgagaacagcaacaaggacctgaaggaggagctgtgccccggcaacctgagcctggtggacaccagacagcacagcagcgcccacagcaaccaggacaagaaggacgacgacatcctgtgctag

SEQ ID NO: 9428 - DNA, 1815 bp, Artificial Sequence
  Description of Artificial Sequence: Synthetic coding sequence
atgatcagcgtgaagagaaacacctggagagccctgagcctggtgatcggcgactgcagaaagaagggcaacttcgagtactgccaggacagaaccgagaagcacagcaccatgcccgacagccccgtggacgtgaagacccagagcagactgaccccccccaccatgccccccccccccaccacccagggcgcccccagaaccagcagcttcacccccaccaccctgaccaacggcaccagccacagccccaccgccctgaacggcgcccccagcccccccaacggcttcagcaacggccccagcagcagcagcagcagcagcctggccaaccagcagctgccccccgcctgcggcgccagacagctgagcaagctgaagagattcctgaccaccctgcagcagttcggcaacgacatcagccccgagatcggcgagagagtgagaaccctggtgctgggcctggtgaacagcaccctgaccatcgaggagttccacagcaagctgcaggaggccaccaacttccccctgagacccttcgtgatccccttcctgaaggccaacctgcccctgctgcagagagagctgctgcactgcgccagactggccaagcagaaccccgcccagtacctggcccagcacgagcagctgctgctggacgccagcaccaccagccccgtggacagcagcgagctgctgctggacgtgaacgagaacggcaagagaagaacccccgacagaaccaaggagaacggcttcgacagagagcccctgcacagcgagcaccccagcaagagaccctgcaccatcagccccggccagagatacagccccaacaacggcctgagctaccagcccaacggcctgccccaccccacccccccccccccccagcactacagactggacgacatggccatcgcccaccactacagagacagctacagacaccccagccacagagacctgagagacagaaacagacccatgggcctgcacggcaccagacaggaggagatgatcgaccacagactgaccgacagagagtgggccgaggagtggaagcacctggaccacctgctgaactgcatcatggacatggtggagaagaccagaagaagcctgaccgtgctgagaagatgccaggaggccgacagagaggagctgaactactggatcagaagatacagcgacgccgaggacctgaagaagggcggcggcagcagcagcagccacagcagacagcagagccccgtgaaccccgaccccgtggccctggacgcccacagagagttcctgcacagacccgccagcggctacgtgcccgaggagatctggaagaaggccgaggaggccgtgaacgaggtgaagagacaggccatgaccgagctgcagaaggccgtgagcgaggccgagagaaaggcccacgacatgatcaccaccgagagagccaagatggagagaaccgtggccgaggccaagagacaggccgccgaggacgccctggccgtgatcaaccagcaggaggacagcagcgagagctgctggaactgcggcagaaaggccagcgagacctgcagcggctgcaacaccgccagatactgcggcagcttctgccagcacaaggactgggagaagcaccaccacatctgcggccagaccctgcaggcccagcagcagggcgacacccccgccgtgagcagcagcgtgacccccaacagcggcgccggcagccccatggacaccccccccgccgccacccccagaagcaccacccccggcacccccagcaccatcgagaccacccccagatag

SEQ ID NO: 9429 - DNA, 1704 bp, Artificial Sequence
  Description of Artificial Sequence: Synthetic coding sequence
atgcccgacagccccgtggacgtgaagacccagagcagactgaccccccccaccatgccccccccccccaccacccagggcgcccccagaaccagcagcttcacccccaccaccctgaccaacggcaccagccacagccccaccgccctgaacggcgcccccagcccccccaacggcttcagcaacggccccagcagcagcagcagcagcagcctggccaaccagcagctgccccccgcctgcggcgccagacagctgagcaagctgaagagattcctgaccaccctgcagcagttcggcaacgacatcagccccgagatcggcgagagagtgagaaccctggtgctgggcctggtgaacagcaccctgaccatcgaggagttccacagcaagctgcaggaggccaccaacttccccctgagacccttcgtgatccccttcctgaaggccaacctgcccctgctgcagagagagctgctgcactgcgccagactggccaagcagaaccccgcccagtacctggcccagcacgagcagctgctgctggacgccagcaccaccagccccgtggacagcagcgagctgctgctggacgtgaacgagaacggcaagagaagaacccccgacagaaccaaggagaacggcttcgacagagagcccctgcacagcgagcaccccagcaagagaccctgcaccatcagccccggccagagatacagccccaacaacggcctgagctaccagcccaacggcctgccccaccccacccccccccccccccagcactacagactggacgacatggccatcgcccaccactacagagacagctacagacaccccagccacagagacctgagagacagaaacagacccatgggcctgcacggcaccagacaggaggagatgatcgaccacagactgaccgacagagagtgggccgaggagtggaagcacctggaccacctgctgaactgcatcatggacatggtggagaagaccagaagaagcctgaccgtgctgagaagatgccaggaggccgacagagaggagctgaactactggatcagaagatacagcgacgccgaggacctgaagaagggcggcggcagcagcagcagccacagcagacagcagagccccgtgaaccccgaccccgtggccctggacgcccacagagagttcctgcacagacccgccagcggctacgtgcccgaggagatctggaagaaggccgaggaggccgtgaacgaggtgaagagacaggccatgaccgagctgcagaaggccgtgagcgaggccgagagaaaggcccacgacatgatcaccaccgagagagccaagatggagagaaccgtggccgaggccaagagacaggccgccgaggacgccctggccgtgatcaaccagcaggaggacagcagcgagagctgctggaactgcggcagaaaggccagcgagacctgcagcggctgcaacaccgccagatactgcggcagcttctgccagcacaaggactgggagaagcaccaccacatctgcggccagaccctgcaggcccagcagcagggcgacacccccgccgtgagcagcagcgtgacccccaacagcggcgccggcagccccatggacaccccccccgccgccacccccagaagcaccacccccggcacccccagcaccatcgagaccacccccagatag

SEQ ID NO: 9430 - DNA, 1734 bp, Artificial Sequence
  Description of Artificial Sequence: Synthetic coding sequence
atgcccgacagaaccgagaagcacagcaccatgcccgacagccccgtggacgtgaagacccagagcagactgaccccccccaccatgccccccccccccaccacccagggcgcccccagaaccagcagcttcacccccaccaccctgaccaacggcaccagccacagccccaccgccctgaacggcgcccccagcccccccaacggcttcagcaacggccccagcagcagcagcagcagcagcctggccaaccagcagctgccccccgcctgcggcgccagacagctgagcaagctgaagagattcctgaccaccctgcagcagttcggcaacgacatcagccccgagatcggcgagagagtgagaaccctggtgctgggcctggtgaacagcaccctgaccatcgaggagttccacagcaagctgcaggaggccaccaacttccccctgagacccttcgtgatccccttcctgaaggccaacctgcccctgctgcagagagagctgctgcactgcgccagactggccaagcagaaccccgcccagtacctggcccagcacgagcagctgctgctggacgccagcaccaccagccccgtggacagcagcgagctgctgctggacgtgaacgagaacggcaagagaagaacccccgacagaaccaaggagaacggcttcgacagagagcccctgcacagcgagcaccccagcaagagaccctgcaccatcagccccggccagagatacagccccaacaacggcctgagctaccagcccaacggcctgccccaccccacccccccccccccccagcactacagactggacgacatggccatcgcccaccactacagagacagctacagacaccccagccacagagacctgagagacagaaacagacccatgggcctgcacggcaccagacaggaggagatgatcgaccacagactgaccgacagagagtgggccgaggagtggaagcacctggaccacctgctgaactgcatcatggacatggtggagaagaccagaagaagcctgaccgtgctgagaagatgccaggaggccgacagagaggagctgaactactggatcagaagatacagcgacgccgaggacctgaagaagggcggcggcagcagcagcagccacagcagacagcagagccccgtgaaccccgaccccgtggccctggacgcccacagagagttcctgcacagacccgccagcggctacgtgcccgaggagatctggaagaaggccgaggaggccgtgaacgaggtgaagagacaggccatgaccgagctgcagaaggccgtgagcgaggccgagagaaaggcccacgacatgatcaccaccgagagagccaagatggagagaaccgtggccgaggccaagagacaggccgccgaggacgccctggccgtgatcaaccagcaggaggacagcagcgagagctgctggaactgcggcagaaaggccagcgagacctgcagcggctgcaacaccgccagatactgcggcagcttctgccagcacaaggactgggagaagcaccaccacatctgcggccagaccctgcaggcccagcagcagggcgacacccccgccgtgagcagcagcgtgacccccaacagcggcgccggcagccccatggacaccccccccgccgccacccccagaagcaccacccccggcacccccagcaccatcgagaccacccccagatag

SEQ ID NO: 9431 - DNA, 1704 bp, Artificial Sequence; identical to SEQ ID NO: 9429
  Description of Artificial Sequence: Synthetic coding sequence

SEQ ID NO: 9432 - DNA, 1848 bp, Artificial Sequence
  Description of Artificial Sequence: Synthetic coding sequence
atgtgccaccccgacaaggccttcaccagcgacaagctgcagtgcgtgttcaacgagtacaaggccgccgtgtgggtgccccccagacccagacccctgagcagagcccccctgcccgaggacagaaccgagaagcacagcaccatgcccgacagccccgtggacgtgaagacccagagcagactgaccccccccaccatgccccccccccccaccacccagggcgcccccagaaccagcagcttcacccccaccaccctgaccaacggcaccagccacagccccaccgccctgaacggcgcccccagcccccccaacggcttcagcaacggccccagcagcagcagcagcagcagcctggccaaccagcagctgccccccgcctgcggcgccagacagctgagcaagctgaagagattcctgaccaccctgcagcagttcggcaacgacatcagccccgagatcggcgagagagtgagaaccctggtgctgggcctggtgaacagcaccctgaccatcgaggagttccacagcaagctgcaggaggccaccaacttccccctgagacccttcgtgatccccttcctgaaggccaacctgcccctgctgcagagagagctgctgcactgcgccagactggccaagcagaaccccgcccagtacctggcccagcacgagcagctgctgctggacgccagcaccaccagccccgtggacagcagcgagctgctgctggacgtgaacgagaacggcaagagaagaacccccgacagaaccaaggagaacggcttcgacagagagcccctgcacagcgagcaccccagcaagagaccctgcaccatcagccccggccagagatacagccccaacaacggcctgagctaccagcccaacggcctgccccaccccacccccccccccccccagcactacagactggacgacatggccatcgcccaccactacagagacagctacagacaccccagccacagagacctgagagacagaaacagacccatgggcctgcacggcaccagacaggaggagatgatcgaccacagactgaccgacagagagtgggccgaggagtggaagcacctggaccacctgctgaactgcatcatggacatggtggagaagaccagaagaagcctgaccgtgctgagaagatgccaggaggccgacagagaggagctgaactactggatcagaagatacagcgacgccgaggacctgaagaagggcggcggcagcagcagcagccacagcagacagcagagccccgtgaaccccgaccccgtggccctggacgcccacagagagttcctgcacagacccgccagcggctacgtgcccgaggagatctggaagaaggccgaggaggccgtgaacgaggtgaagagacaggccatgaccgagctgcagaaggccgtgagcgaggccgagagaaaggcccacgacatgatcaccaccgagagagccaagatggagagaaccgtggccgaggccaagagacaggccgccgaggacgccctggccgtgatcaaccagcaggaggacagcagcgagagctgctggaactgcggcagaaaggccagcgagacctgcagcggctgcaacaccgccagatactgcggcagcttctgccagcacaaggactgggagaagcaccaccacatctgcggccagaccctgcaggcccagcagcagggcgacacccccgccgtgagcagcagcgtgacccccaacagcggcgccggcagccccatggacaccccccccgccgccacccccagaagcaccacccccggcacccccagcaccatcgagaccacccccagatag

SEQ ID NO: 9433 - DNA, 363 bp, Artificial Sequence
  Description of Artificial Sequence: Synthetic coding sequence
atgcccgacagccccgtggacgtgaagacccagagcagactgaccccccccaccatgccccccccccccaccacccagggcgcccccagaaccagcagcttcacccccaccaccctgaccaacggcaccagccacagccccaccgccctgaacggcgcccccagcccccccaacggcttcagcaacggccccagcagcagcagcagcagcagcctggccaaccagcagctgccccccgcctgcggcgccagacagctgagcaagctgaagagattcctgaccaccctgcagcagttcggcaacgacatcagccccgagatcggcgagagagtgagaaccctggtgctgggcctggtgaactag

SEQ ID NO: 9434 - DNA, 408 bp, Artificial Sequence
  Description of Artificial Sequence: Synthetic coding sequence
atgatcagcgtgaagagaaacacctggagagccctgagcctggtgatcggcgactgcagaaagaagggcaacttcgagtactgccaggacagaaccgagaagcacagcaccatgcccgacagccccgtggacgtgaagacccagagcagactgaccccccccaccatgccccccccccccaccacccagggcgcccccagaaccagcagcttcacccccaccaccctgaccaacggcaccagccacagccccaccgccctgaacggcgcccccagcccccccaacggcttcagcaacggccccagcagcagcagcagcagcagcctggccaaccagcagctgccccccgcctgcggcgccagacagctgagcaagctgaagagattcctgaccaccctgcagcagtag

SEQ ID NO: 9435 - DNA, 210 bp, Artificial Sequence
  Description of Artificial Sequence: Synthetic coding sequence
atgcccgacagaaccgagaagcacagcaccatgcccgacagccccgtggacgtgaagacccagagcagactgaccccccccaccatgccccccccccccaccacccagggcgcccccagaaccagcagcttcacccccaccaccctgaccaacggcaccagccacagccccaccgccctgaacggcgcccccagcccccccaacggctag

SEQ ID NO: 9436 - DNA, 177 bp, Artificial Sequence
  Description of Artificial Sequence: Synthetic coding sequence
atgatcagcgtgaagagaaacacctggagagccctgagcctggtgatcggcgactgcagaaagaagggcaacttcgagtactgccagggcgccagagcccagcaccccgccagcggcgacgccgcccccgcccccctgatggccctgctgagcgccgccacccacagcagaacctag

SEQ ID NO: 9437 - DNA, 240 bp, Artificial Sequence
  Description of Artificial Sequence: Synthetic coding sequence
atgcccgacagaaccgagaagcacagcaccatgcccgacagccccgtggacgtgaagacccagagcagactgaccccccccaccatgccccccccccccaccacccagggcgcccccagaaccagcagcttcacccccaccaccctgaccaacggcaccagccacagccccaccgccctgaacggcgcccccagcccccccaacggcttcagcaacggccccagcagcagcagcagctag

SEQ ID NO: 9438 - DNA, 141 bp, Artificial Sequence
  Description of Artificial Sequence: Synthetic coding sequence
atgcccgacagccccgtggacgtgaagacccagagcagactgaccccccccaccatgccccccccccccaccacccagggcgcccccagaaccagcagcttcacccccaccaccctgaccaacggcaccagccacagctag

SEQ ID NO: 9439 - DNA, 1734 bp, Artificial Sequence; identical to SEQ ID NO: 9430
  Description of Artificial Sequence: Synthetic coding sequence

SEQ ID NO: 9440 - DNA, 165 bp, Artificial Sequence
  Description of Artificial Sequence: Synthetic coding sequence
atgatcagcgtgaagagaaacacctggagagccctgagcctggtgatcggcgactgcagaaagaagggcaacttcgagtactgccaggacagaaccgagaagcacagcaccatgcccgacagccccgtggacgtgaagacccagagcagactgacccccccctag

SEQ ID NO: 9441 - DNA, 690 bp, Artificial Sequence
  Description of Artificial Sequence: Synthetic coding sequence
atgatcagcgtgaagagaaacacctggagagccctgagcctggtgatcggcgactgcagaaagaagggcaacttcgagtactgccaggacagaaccgagaagcacagcaccatgcccgacagccccgtggacgtgaagacccagagcagactgaccccccccaccatgccccccccccccaccacccagggcgcccccagaaccagcagcttcacccccaccaccctgaccaacggcaccagccacagccccaccgccctgaacggcgcccccagcccccccaacggcttcagcaacggccccagcagcagcagcagcagcagcctggccaaccagcagctgccccccgcctgcggcgccagacagctgagcaagctgaagagattcctgaccaccctgcagcagttcggcaacgacatcagccccgagatcggcgagagagtgagaaccctggtgctgggcctggtgaacagcaccctgaccatcgaggagttccacagcaagctgcaggaggccaccaacttccccctgagacccttcgtgatccccttcctgaaggccaacctgcccctgctgcagagagagctgctgcactgcgccagactggccaagcagaaccccgcccagtacctggcccagcacgagcagctgctgctggacgccagcaccaccagccccgtggacagctag

SEQ ID NO: 9442 - DNA, 81 bp, Artificial Sequence
  Description of Artificial Sequence: Synthetic coding sequence
atgcccgacagaaccgagaagcacagcaccatgcccgacagccccgtggacgtgaagacccagagcagactgaccccctag

SEQ ID NO: 9443 - DNA, 510 bp, Artificial Sequence
  Description of Artificial Sequence: Synthetic coding sequence
atgatcagcgtgaagagaaacacctggagagccctgagcctggtgatcggcgactgcagaaagaagggcaacttcgagtactgccaggacagaaccgagaagcacagcaccatgcccgacagccccgtggacgtgaagacccagagcagactgaccccccccaccatgccccccccccccaccacccagggcgcccccagaaccagcagcttcacccccaccaccctgaccaacggcaccagccacagccccaccgccctgaacggcgcccccagcccccccaacggcttcagcaacggccccagcagcagcagcagcagcagcctggccaaccagcagctgccccccgcctgcggcgccagacagctgagcaagctgaagagattcctgaccaccctgcagcagttcggcaacgacatcagccccgagatcggcgagagagtgagaaccctggtgctgggcctggtgaacagcaccctgaccatcgaggagttccacagcaagctgtag

SEQ ID NO: 9444 - DNA, 147 bp, Artificial Sequence
  Description of Artificial Sequence: Synthetic coding sequence
atgatcagcgtgaagagaaacacctggagagccctgagcctggtgatcggcgactgcagaaagaagggcaacttcgagtactgccaggacagaaccgagaagcacagcaccatgcccgacagccccgtggacgtgaagacccagtag

SEQ ID NO: 9445 - DNA, 276 bp, Artificial Sequence
  Description of Artificial Sequence: Synthetic coding sequence
atgcccgacagccccgtggacgtgaagacccagagcagactgaccccccccaccatgccccccccccccaccacccagggcgcccccagaaccagcagcttcacccccaccaccctgaccaacggcaccagccacagccccaccgccctgaacggcgcccccagcccccccaacggcttcagcaacggccccagcagcagcagcagcagcagcctggccaaccagcagctgccccccgcctgcggcgccagacagctgagcaagctgaagagatag

SEQ ID NO: 9446 - DNA, 363 bp, Artificial Sequence
  Description of Artificial Sequence: Synthetic coding sequence
atgatcagcgtgaagagaaacacctggagagccctgagcctggtgatcggcgactgcagaaagaagggcaacttcgagtactgccaggacagaaccgagaagcacagcaccatgcccgacagccccgtggacgtgaagacccagagcagactgaccccccccaccatgccccccccccccaccacccagggcgcccccagaaccagcagcttcacccccaccaccctgaccaacggcaccagccacagccccaccgccctgaacggcgcccccagcccccccaacggcttcagcaacggccccagcagcagcagcagcagcagcctggccaaccagcagctgccccccgcctgcggcgcctag

SEQ ID NO: 9447 - DNA, 1704 bp, Artificial Sequence; identical to SEQ ID NO: 9429
  Description of Artificial Sequence: Synthetic coding sequence

SEQ ID NO: 9448 - DNA, 258 bp, Artificial Sequence
  Description of Artificial Sequence: Synthetic coding sequence
atgatcagcgtgaagagaaacacctggagagccctgagcctggtgatcggcgactgcagaaagaagggcaacttcgagtactgccaggacagaaccgagaagcacagcaccatgcccgacagccccgtggacgtgaagacccagagcagactgaccccccccaccatgccccccccccccaccacccagggcgcccccagaaccagcagcttcacccccaccaccctgaccaacggcaccagccacagccccacctag

SEQ ID NO: 9449 - DNA, 516 bp, Artificial Sequence
  Description of Artificial Sequence: Synthetic coding sequence
atgcccgacagccccgtggacgtgaagacccagagcagactgaccccccccaccatgccccccccccccaccacccagggcgcccccagaaccagcagcttcacccccaccaccctgaccaacggcaccagccacagccccaccgccctgaacggcgcccccagcccccccaacggcttcagcaacggccccagcagcagcagcagcagcagcctggccaaccagcagctgccccccgcctgcggcgccagacagctgagcaagctgaagagattcctgaccaccctgcagcagttcggcaacgacatcagccccgagatcggcgagagagtgagaaccctggtgctgggcctggtgaacagcaccctgaccatcgaggagttccacagcaagctgcaggaggccaccaacttccccctgagacccttcgtgatccccttcctgaaggccaacctgcccctgctgcagagagagctgctgcactgcgccagactggccaagcagaaccccgcctag

SEQ ID NO: 9450 - DNA, 270 bp, Artificial Sequence
  Description of Artificial Sequence: Synthetic coding sequence
atgcccgacagccccgtggacgtgaagacccagagcagactgaccccccccaccatgccccccccccccaccacccagggcgcccccagaaccagcagcttcacccccaccaccctgaccaacggcaccagccacagccccaccgccctgaacggcgcccccagcccccccaacggcttcagcaacggccccagcagcagcagcagcagcagcctggccaaccagcagctgccccccgcctgcggcgccagacagctgagcaagctgtag

SEQ ID NO: 9451 - DNA, 285 bp, Artificial Sequence
  Description of Artificial Sequence: Synthetic coding sequence
atgatcagcgtgaagagaaacacctggagagccctgagcctggtgatcggcgactgcagaaagaagggcaacttcgagtactgccaggacagaaccgagaagcacagcaccatgcccgacagccccgtggacgtgaagacccagagcagactgaccccccccaccatgccccccccccccaccacccagggcgcccccagaaccagcagcttcacccccaccaccctgaccaacggcaccagccacagccccaccgccctgaacggcgcccccagccccccctag

SEQ ID NO: 9452 - DNA, 306 bp, Artificial Sequence
  Description of Artificial Sequence: Synthetic coding sequence
atgcccgacagaaccgagaagcacagcaccatgcccgacagccccgtggacgtgaagacccagagcagactgaccccccccaccatgccccccccccccaccacccagggcgcccccagaaccagcagcttcacccccaccaccctgaccaacggcaccagccacagccccaccgccctgaacggcgcccccagcccccccaacggcttcagcaacggccccagcagcagcagcagcagcagcctggccaaccagcagctgccccccgcctgcggcgccagacagctgagcaagctgaagagatag

SEQ ID NO: 9453 - DNA, 471 bp, Artificial Sequence
  Description of Artificial Sequence: Synthetic coding sequence
atgatcagcgtgaagagaaacacctggagagccctgagcctggtgatcggcgactgcagaaagaagggcaacttcgagtactgccaggacagaaccgagaagcacagcaccatgcccgacagccccgtggacgtgaagacccagagcagactgaccccccccaccatgccccccccccccaccacccagggcgcccccagaaccagcagcttcacccccaccaccctgaccaacggcaccagccacagccccaccgccctgaacggcgcccccagcccccccaacggcttcagcaacggccccagcagcagcagcagcagcagcctggccaaccagcagctgccccccgcctgcggcgccagacagctgagcaagctgaagagattcctgaccaccctgcagcagttcggcaacgacatcagccccgagatcggcgagagagtgagaaccctggtgctgggcctggtgtag

SEQ ID NO: 9454 - DNA, 363 bp, Artificial Sequence; identical to SEQ ID NO: 9446
  Description of Artificial Sequence: Synthetic coding sequence

SEQ ID NO: 9455 - DNA, 1815 bp, Artificial Sequence; identical to SEQ ID NO: 9428
  Description of Artificial Sequence: Synthetic coding sequence

SEQ ID NO: 9456 - DNA, 3105 bp, Artificial Sequence
  Description of Artificial Sequence: Synthetic coding sequence
atggccgccgccaccggcgccgtggccgccagcgccgccagcggccaggccgagggcaagaagatcaccgacctgagagtgatcgacctgaagagcgagctgaagagaagaaacctggacatcaccggcgtgaagaccgtgctgatcagcagactgaagcaggccatcgaggaggagggcggcgaccccgacaacatcgagctgaccgtgagcaccgacacccccaacaagaagcccaccaagggcaagggcaagaagcacgaggccgacgagctgagcggcgacgccagcgtggaggacgacgccttcatcaaggactgcgagctggagaaccaggaggcccacgagcaggacggcaacgacgagctgaaggacagcgaggagttcggcgagaacgaggaggagaacgtgcacagcaaggagctgctgagcgccgaggagaacaagagagcccacgagctgatcgaggccgagggcatcgaggacatcgagaaggaggacatcgagagccaggagatcgaggcccaggagggcgaggacgacaccttcctgaccgcccaggacggcgaggaggaggagaacgagaaggacatcgccggcagcggcgacggcacccaggaggtgagcaagcccctgcccagcgagggcagcctggccgaggccgaccacaccgcccacgaggagatggaggcccacaccaccgtgaaggaggccgaggacgacaacatcagcgtgaccatccaggccgaggacgccatcaccctggacttcgacggcgacgacctgctggagaccggcaagaacgtgaagatcaccgacagcgaggccagcaagcccaaggacggccaggacgccatcgcccagagccccgagaaggagagcaaggactacgagatgaacgccaaccacaaggacggcaagaaggaggactgcgtgaagggcgaccccgtggagaaggaggccagagagagcagcaagaaggccgagagcggcgacaaggagaaggacaccctgaagaagggccccagcagcaccggcgccagcggccaggccaagagcagcagcaaggagagcaaggacagcaagaccagcagcaaggacgacaagggcagcaccagcagcaccagcggcagcagcggcagcagcaccaagaacatctgggtgagcggcctgagcagcaacaccaaggccgccgacctgaagaacctgttcggcaagtacggcaaggtgctgagcgccaaggtggtgaccaacgccagaagccccggcgccaagtgctacggcatcgtgaccatgagcagcagcaccgaggtgagcagatgcatcgcccacctgcacagaaccgagctgcacggccagctgatcagcgtggagaaggtgaagggcgaccccagcaagaaggagatgaagaaggagaacgacgagaagagcagcagcagaagcagcggcgacaagaagaacaccagcgacagaagcagcaagacccaggccagcgtgaagaaggaggagaagagaagcagcgagaagagcgagaagaaggagagcaaggacaccaagaagatcgagggcaaggacgagaagaacgacaacggcgccagcggccagaccagcgagagcatcaagaagagcgaggagaagaagagaatcagcagcaagagccccggccacatggtgatcctggaccagaccaagggcgaccactgcagacccagcagaagaggcagatacgagaagatccacggcagaagcaaggagaaggagagagccagcctggacaagaagagagacaaggactacagaagaaaggagatcctgcccttcgagaagatgaaggagcagagactgagagagcacctggtgagattcgagagactgagaagagccatggagctgagaagaagaagagagatcgccgagagagagagaagagagagagagagaatcagaatcatcagagagagagaggagagagagagactgcagagagagagagagagactggagatcgagagacagaagctggagagagagagaatggagagagagagactggagagagagagaatcagaatcgagcaggagagaagaaaggaggccgagagaatcgccagagagagagaggagctgagaagacagcagcagcagctgagatacgagcaggagaagagaaacagcctgaagagacccagagacgtggaccacagaagagacgacccctactggagcgagaacaagaagctgagcctggacaccgacgccagattcggccacggcagcgactacagcagacagcagaacagattcaacgacttcgaccacagagagagaggcagattccccgagagcagcgccgtgcagagcagcagcttcgagagaagagacagattcgtgggccagagcgagggcaagaaggccagacccaccgccagaagagaggaccccagcttcgagagataccccaagaacttcagcgacagcagaagaaacgagccccccccccccagaaacgagctgagagagagcgacagaagagaggtgagaggcgagagagacgagagaagaaccgtgatcatccacgacagacccgacatcacccaccccagacaccccagagaggccggccccaaccccagcagacccaccagctggaagagcgagggcagcatgagcaccgacaagagagagaccagagtggagagacccgagagaagcggcagagaggtgagcggccacagcgtgagaggcgccccccccggcaacagaagcagcgccagcggctacggcagcagagagggcgacagaggcgtgatcaccgacagaggcggcggcagccagcactaccccgaggagagacacgtggtggagagacacggcagagacaccagcggccccagaaaggagtggcacggcccccccagccagggccccagctaccacgacaccagaagaatgggcgacggcagagccggcgccggcatgatcacccagcacagcagcaacgccagccccatcaacagaatcgtgcagatcagcggcaacagcatgcccagaggcagcggcagcggcttcaagcccttcaagggcggcccccccagaagattctag

SEQ ID NO: 9457 - DNA, 1812 bp, Artificial Sequence
  Description of Artificial Sequence: Synthetic coding sequence
atgagcagcagcaccgaggtgagcagatgcatcgcccacctgcacagaaccgagctgcacggccagctgatcagcgtggagaaggtgaagggcgaccccagcaagaaggagatgaagaaggagaacgacgagaagagcagcagcagaagcagcggcgacaagaagaacaccagcgacagaagcagcaagacccaggccagcgtgaagaaggaggagaagagaagcagcgagaagagcgagaagaaggagagcaaggacaccaagaagatcgagggcaaggacgagaagaacgacaacggcgccagcggccagaccagcgagagcatcaagaagagcgaggagaagaagagaatcagcagcaagagccccggccacatggtgatcctggaccagaccaagggcgaccactgcagacccagcagaagaggcagatacgagaagatccacggcagaagcaaggagaaggagagagccagcctggacaagaagagagacaaggactacagaagaaaggagatcctgcccttcgagaagatgaaggagcagagactgagagagcacctggtgagattcgagagactgagaagagccatggagctgagaagaagaagagagatcgccgagagagagagaagagagagagagagaatcagaatcatcagagagagagaggagagagagagactgcagagagagagagagagactggagatcgagagacagaagctggagagagagagaatggagagagagagactggagagagagagaatcagaatcgagcaggagagaagaaaggaggccgagagaatcgccagagagagagaggagctgagaagacagcagcagcagctgagatacgagcaggagaagagaaacagcctgaagagacccagagacgtggaccacagaagagacgacccctactggagcgagaacaagaagctgagcctggacaccgacgccagattcggccacggcagcgactacagcagacagcagaacagattcaacgacttcgaccacagagagagaggcagattccccgagagcagcgccgtgcagagcagcagcttcgagagaagagacagattcgtgggccagagcgagggcaagaaggccagacccaccgccagaagagaggaccccagcttcgagagataccccaagaacttcagcgacagcagaagaaacgagccccccccccccagaaacgagctgagagagagcgacagaagagaggtgagaggcgagagagacgagagaagaaccgtgatcatccacgacagacccgacatcacccaccccagacaccccagagaggccggccccaaccccagcagacccaccagctggaagagcgagggcagcatgagcaccgacaagagagagaccagagtggagagacccgagagaagcggcagagaggtgagcggccacagcgtgagaggcgccccccccggcaacagaagcagcgccagcggctacggcagcagagagggcgacagaggcgtgatcaccgacagaggcggcggcagccagcactaccccgaggagagacacgtggtggagagacacggcagagacaccagcggccccagaaaggagtggcacggcccccccagccagggccccagctaccacgacaccagaagaatgggcgacggcagagccggcgccggcatgatcacccagcacagcagcaacgccagccccatcaacagaatcgtgcagatcagcggcaacagcatgcccagaggcagcggcagcggcttcaagcccttcaagggcggcccccccagaagattctag

SEQ ID NO: 9458 - DNA, 303 bp, Artificial Sequence
  Description of Artificial Sequence: Synthetic coding sequence
ggcgtgatcaccgacagaggcggcggcagccagcactaccccgaggagagacacgtggtggagagacacggcagagacaccagcggccccagaaaggagtggcacggcccccccagccagggccccagctaccacgacaccagaagaatgggcgacggcagagccggcgccggcatgatcacccagcacagcagcaacgccagccccatcaacagaatcgtgcagatcagcggcaacagcatgcccagaggcagcggcagcggcttcaagcccttcaagggcggcccccccagaagattctag

SEQ ID NO: 9459 - DNA, 552 bp, Artificial Sequence
  Description of Artificial Sequence: Synthetic coding sequence
atgaacggcttcagcaccgaggaggacagcagagagggcccccccgccgcccccgccgccgccgcccccggctacggccagagctgctgcctgatcgaggacggcgagagatgcgtgagacccgccggcaacgccagcttcagcaagagagtgcagaagagcatcagccagaagaagctgaagctggacatcgacaagagcgtgagacacctgtacatctgcgacttccacaagaacttcatccagagcgtgagaaacaagagaaagagaaagaccagcgacgacggcggcgacagccccgagcacgacaccgacatccccgaggtggacctgttccagctgcaggtgaacaccctgagaagatacaagagacactacaagctgcagaccagacccggcttcaacaaggcccagctggccgagaccgtgagcagacacttcagaaacatccccgtgaacgagaaggagaccctggcctacttcatctacatggtgaagagcaacaagagcagactggaccagaagagcgagggcggcaagcagctggagtag

SEQ ID NO: 9460 - DNA, 414 bp, Artificial Sequence
  Description of Artificial Sequence: Synthetic coding sequence
atgaacggcttcagcaccgaggaggacagcagagagggcccccccgccgcccccgccgccgccgcccccggctacggccagagctgctgcctgatcgaggacggcgagagatgcgtgagacccgccggcaacgccagcttcagcaagagagtgcagaagagcatcagccagaagaagctgaagctggacatcgacaagagcctgcaggtgaacaccctgagaagatacaagagacactacaagctgcagaccagacccggcttcaacaaggcccagctggccgagaccgtgagcagacacttcagaaacatccccgtgaacgagaaggagaccctggcctacttcatctacatggtgaagagcaacaagagcagactggaccagaagagcgagggcggcaagcagctggagtag

SEQ ID NO: 9461 - DNA, 429 bp, Artificial Sequence
  Description of Artificial Sequence: Synthetic coding sequence
atgaacggcttcagcaccgaggaggacagcagagagggcccccccgccgcccccgccgccgccgcccccggctacggccagagctgctgcctgatcgaggacggcgagagatgcgtgagacccgccggcaacgccagcttcagcaagagagtgcagaagagcatcagccagaagaagctgaagctggacatcgacaagagcgtggacctgttccagctgcaggtgaacaccctgagaagatacaagagacactacaagctgcagaccagacccggcttcaacaaggcccagctggccgagaccgtgagcagacacttcagaaacatccccgtgaacgagaaggagaccctggcctacttcatctacatggtgaagagcaacaagagcagactggaccagaagagcgagggcggcaagcagctggagtag

SEQ ID NO: 9462 - DNA, 540 bp, Artificial Sequence
  Description of Artificial Sequence: Synthetic coding sequence
atggccgccaccgagcccatcctggccgccaccggcagccccgccgccgtgccccccgagaagctggagggcgccggcagcagcagcgcccccgagagaaactgcgtgggcagcagcctgcccgaggccagcccccccgcccccgagcccagcagccccaacgccgccgtgcccgaggccatccccacccccagagccgccgccagcgccgccctggagctgcccctgggccccgcccccgtgagcgtggccccccaggccgaggccgaggccagaagcacccccggccccgccggcagcagactgggccccgagaccttcagacagagattcagacagttcagataccaggacgccgccggccccagagaggccttcagacagctgagagagctgagcagacagtggctgagacccgacatcagaaccaaggagcagatcgtggagatgctggtgcaggagcagctgctggccatcctgcccgaggccgccagagccagaagaatcagaagaagaaccgacgtgagaatcaccggctag

SEQ ID NO: 9463 - DNA, 540 bp, Artificial Sequence; identical to SEQ ID NO: 9462
  Description of Artificial Sequence: Synthetic coding sequence

SEQ ID NO: 9464 - DNA, 3978 bp, Artificial Sequence
  Description of Artificial Sequence: Synthetic coding sequence
atggaggccgtgagcagagtgttccccgccctggccggccaggcccccgaggagcagggcgagatcatcaaggtgaaggtgaaggaggaggaccacacctgggaccaggagagcgccctgagaagaaacctgagctacaccagagagctgagcagacagagattcagacagttctgctaccaggagacccccggccccagagaggccctgagccagctgagagagctgtgcagacagtggctgaaccccgagatccacaccaaggagcagatcctggagctgctggtgctggagcagttcctgaccatcctgcccgaggagctgcagagctgggtgagagagcacaaccccgagagcggcgaggaggtggtgaccctgctggaggacctggagagagagctggacgagcccagacagcaggtgagccagggcacctacggccaggaggtgagcatggaggagatgatccccctggacagcgccaaggagagcctgggcacccagctgcagagcatggaggacagaatggagtgcgagagccccgagccccaccccctgcaggacaacggcagcttcctgtggttcagcatgatgagccagagcatgggcggcgacaacctgagcagcctggacaccaacgaggccgagatcgagcccgagaacatgagagagaagttcttcagaagcctggccagactgctggagaacaagagcaacaacaccaagatcttcagcaaggccaagtactgccagctgatcaaggaggtgaaggaggccaaggccaaggccaagaaggagagcgtggactacagaagactggccagattcgacgtgatcctggtgcagggcaacgagaagctgatcgaggccgtgaacggcgagaccgacaagatcagatactacctgcacagcgaggacctgttcgacatcctgcacaacacccacctgagcatcggccacggcggcagaaccagaatggagaaggagctgcaggccaagtacaagaacatcaccaaggaggtgatcatgctgtacctgaccctgtgcaagccctgccagcagaagaacagcaagctgaagaaggtgctgaccagcaagagcatcaaggaggtgagcagcagatgccaggtggacctgatcgacatgcagctgaaccccgacggcgagtacagattcatcctgcactaccaggacctgtgcaccaagctgaccttcctgagaagcctgaagagcaagagacccaccgaggtggcccacgccctgctggacatcttcaccatcatcggcgcccccagcgtgctgcagagcgacaacggcagagagttcagcagccaggtggtgagcgagctgagcaacatctggcccgagctgaagatcgtgcacggcaagagccagacctgccagagccagagcagcgccgagcagaccgaggacatcagaaagagaatcttcagctggatgcagaccaacaacagcagccactggaccgagttcctgtggttcatccagatgagccagaaccagccctaccacagaagcatgcagcagaccccctgcgagagcgccttcagcagcgaggccaagctgggcctgagccacagccagctgaccgaggagctggtggccagcctgcacaccgagaacgagctggaccaggccgacaaggagctggagaacaccctgagagcccagtacgaggagaacatcgagaccggcaccgacagcagcgacatcgaggagaacctgagcgtgacccccaaggtggccgagaagagcccccccgagagcagactgagattcctgagctgcgtggtgtgcgagaaggagtgcaccggcgtgaacagctgcatcagctgcgacggcaacatccacgccatctgcggcgtgcccagccagcacggcaccgagggctgcggcagacagatcacctgcagcctgtgctacgagaccagcaccatgaagagaaagcacgacgagatccagagaagcctgcccgtgaagcccagcaagatgctgaagcccagcggcacccccttcagccccgacaaggtgggcgactggatggccaagcaggccagcctggacttcttcgtgaagaagagacacgccttcagcgagcacagcagcagcaacaagagaaacgtgaacaacagaagctaccccgaggagggcaagaccaagagagtgcacgccagcttcaccagaaagtacgaccccagctacatcgagttcggcttcgtggccgtgatcgacggcgaggtgctgaagccccagtgcatcatctgcggcgacgtgctggccaacgaggccatgaagcccagcaagctgaagagacacctgtacagcaagcacaaggagatcagcagccagcccaaggagttcttcgagagaaagagcagcgagctgaagagccagcccaagcaggtgttcaacgtgagccacatcaacatcagcgccctgagagccagctacaaggtggccctgcccgtggccaagagcaagaccccctacaccatcgccgagaccctggtgaaggactgcatcaaggaggtgtgcctggagatgctgggcgagagcgccgccaagaaggtggcccaggtgcccctgagcaacgacaccatcgccagaagaatccaggagctggccaacgacatggaggaccagctgatcgagcagatcaagctggccaagtacttcagcctgcagctggacgagtgcagagacatcgccaacatgatcatcctgctggtgtacgtgagattcgagcacgacgacgacatcaaggaggagttcttcttcagcgccagcctgcccaccaacaccaccagcagcgagctgtacgaggccgtgaagaactacatcgtgaacaagtgcggcctggagttcaagttctgcgtgggcgtgtgcagcgacggcgccgccagcatgaccggcaagcacagcgaggtggtgacccagatcaaggagctggcccccgagtgcaagaccacccactgcttcatccacagagagagcctggccatgaagaagatcagcgccgagctgaacagcgtgctgaacgacatcgtgaagatcgtgaactacatcaagagcaacagcctgaacagcagactgttcagcctgctgtgcgacaacatggaggccgaccacaagcagctgctgctgcacgccgagatcagatggctgagcagaggcaaggtgctgagcagaatgttcgagatcagaaacgagctgctggtgttcctgcagggcaagaagcccatgtggagccagctgttcaaggacgtgaactggaccgccagactggcctacctgagcgacatcttcagcatcttcaacgacctgaacgccagcatgcagggcaagaacgccacctacttcagcatggccgacaaggtggagggccagaagcagaagctggaggcctggaagaacagaatcagcaccgactgctacgacatgttccacaacctgaccaccatcatcaacgaggtgggcaacgacctggacatcgcccacctgagaaaggtgatcagcgagcacctgaccaacctgctggagtgcttcgagttctacttccccagcaaggaggaccccagaatcggcaacctgtggatccagaaccccttcctgagcagcaaggacaacctgaacctgaccgtgaccctgcaggacaagctgctgaagctggccaccgacgagggcctgaagatcagcttcgagaacaccgccagcctgcccagcttctggatcaaggccaagaacgactaccccgagctggccgagatcgccctgaagctgctgctgctgttccccagcacctacctgtgcgagaccggcttcagcaccctgagcgtgatcaagaccaagcacagaaacagcctgaacatccactaccccctgagagtggccctgagcagcatccagcccagactggacaagctgaccagcaagaagcaggcccacctgagccactag

SEQ ID NO: 9465 - DNA, 2706 bp, Artificial Sequence
  Description of Artificial Sequence: Synthetic coding sequence
atggaggccaaccagtgccccctggtggtggagcccagctaccccgacctggtgatcaacgtgggcgaggtgaccctgggcgaggagaacagaaagaagctgcagaagatccagagagaccaggagaaggagagagtgatgagagccgcctgcgccctgctgaacagcggcggcggcgtgatcagaatggccaagaaggtggagcaccccgtggagatgggcctggacctggagcagagcctgagagagctgatccagagcagcgacctgcaggccttcttcgagaccaagcagcagggcagatgcttctacatcttcgtgaagagctggagcagcggccccttccccgaggacagaagcgtgaagcccagactgtgcagcctgagcagcagcctgtacagaagaagcgagaccagcgtgagaagcatggacagcagagaggccttctgcttcctgaagaccaagagaaagcccaagatcctggaggagggccccttccacaagatccacaagggcgtgtaccaggagctgcccaacagcgaccccgccgaccccaacagcgaccccgccgacctgatcttccagaaggactacctggagtacggcgagatcctgcccttccccgagagccagctggtggagttcaagcagttcagcaccaagcacttccaggagtacgtgaagagaaccatccccgagtacgtgcccgccttcgccaacaccggcggcggctacctgttcatcggcgtggacgacaagagcagagaggtgctgggctgcgccaaggagaacgtggaccccgacagcctgagaagaaagatcgagcaggccatctacaagctgccctgcgtgcacttctgccagccccagagacccatcaccttcaccctgaagatcgtgaacgtgctgaagagaggcgagctgtacggctacgcctgcatgatcagagtgaaccccttctgctgcgccgtgttcagcgaggcccccaacagctggatcgtggaggacaagtacgtgtgcagcctgaccaccgagaagtgggtgggcatgatgaccgacaccgaccccgacctgctgcagctgagcgaggacttcgagtgccagctgagcctgagcagcggcccccccctgagcagacccgtgtacagcaagaagggcctggagcacaagaaggagctgcagcagctgctgttcagcgtgccccccggctacctgagatacacccccgagagcctgtggagagacctgatcagcgagcacagaggcctggaggagctgatcaacaagcagatgcagcccttcttcagaggcatcctgatcttcagcagaagctgggccgtggacctgaacctgcaggagaagcccggcgtgatctgcgacgccctgctgatcgcccagaacagcacccccatcctgtacaccatcctgagagagcaggacgccgagggccaggactactgcaccagaaccgccttcaccctgaagcagaagctggtgaacatgggcggctacaccggcaaggtgtgcgtgagagccaaggtgctgtgcctgagccccgagagcagcgccgaggccctggaggccgccgtgagccccatggactaccccgccagctacagcctggccggcacccagcacatggaggccctgctgcagagcctggtgatcgtgctgctgggcttcagaagcctgctgagcgaccagctgggctgcgaggtgctgaacctgctgaccgcccagcagtacgagatcttcagcagaagcctgagaaagaacagagagctgttcgtgcacggcctgcccggcagcggcaagaccatcatggccatgaagatcatggagaagatcagaaacgtgttccactgcgaggcccacagaatcctgtacgtgtgcgagaaccagcccctgagaaacttcatcagcgacagaaacatctgcagagccgagaccagaaagaccttcctgagagagaacttcgagcacatccagcacatcgtgatcgacgaggcccagaacttcagaaccgaggacggcgactggtacggcaaggccaagagcatcaccagaagagccaagggcggccccggcatcctgtggatcttcctggactacttccagaccagccacctggactgcagcggcctgccccccctgagcgaccagtaccccagagaggagctgaccagaatcgtgagaaacgccgaccccatcgccaagtacctgcagaaggagatgcaggtgatcagaagcaaccccagcttcaacatccccaccggctgcctggaggtgttccccgaggccgagtggagccagggcgtgcagggcaccctgagaatcaagaagtacctgaccgtggagcagatcatgacctgcgtggccgacacctgcagaagattcttcgacagaggctacagccccaaggacgtggccgtgctggtgagcaccgccaaggaggtggagcactacaagtacgagctgctgaaggccatgagaaagaagagagtggtgcagctgagcgacgcctgcgacatgctgggcgaccacatcgtgctggacagcgtgagaagattcagcggcctggagagaagcatcgtgttcggcatccaccccagaaccgccgaccccgccatcctgcccaacgtgctgatctgcctggccagcagagccaagcagcacctgtacatcttcccctggggcggccactag

SEQ ID NO: 9466 - DNA, 2706 bp, Artificial Sequence; identical to SEQ ID NO: 9465
  Description of Artificial Sequence: Synthetic coding sequence

SEQ ID NO: 9467 - DNA, 273 bp, Artificial Sequence
  Description of Artificial Sequence: Synthetic coding sequence
atggaggccaaccagtgccccctggtggtggagcccagctaccccgacctggtgatcaacgtgggcgaggtgaccctgggcgaggagaacagaaagaagctgcagaagatccagagagaccaggagaaggagagagtgatgagagccgcctgcgccctgctgaacagcggcggcggcgtgatcagaatggccaagaaggtggagcaccccgtggagatgggcctggacctggagcagagcctgagagagctgatccagagcagcgacctgtag

SEQ ID NO: 9468 - DNA, 273 bp, Artificial Sequence; identical to SEQ ID NO: 9467
  Description of Artificial Sequence: Synthetic coding sequence

SEQ ID NO: 9469 - DNA, 273 bp, Artificial Sequence; identical to SEQ ID NO: 9467
  Description of Artificial Sequence: Synthetic coding sequence

SEQ ID NO: 9470 - DNA, 606 bp, Artificial Sequence
  Description of Artificial Sequence: Synthetic coding sequence
atgagcttcgccaccctgagacccgccccccccggcagatacctgtaccccgaggtgagccccctgagcgaggacgaggacagaggcagcgacagcagcggcagcgacgagaagccctgcagagtgcacgccgccagatgcggcctgcagggcgccagaagaagagccggcggcagaagagccggcggcggcggccccggcggcagacccggcagagagcccagacagagacacaccgccaacgccagagagagagacagaaccaacagcgtgaacaccgccttcaccgccctgagaaccctgatccccaccgagcccgccgacagaaagctgagcaagatcgagaccctgagactggccagcagctacatcagccacctgggcaacgtgctgctggccggcgaggcctgcggcgacggccagccctgccacagcggccccgccttcttccacgccgccagagccggcagccccccccccccccccccccccccccccgccagagacggcgagaacacccagcccaagcagatctgcaccttctgcctgagcaaccagagaaagctgagcaaggacagagacagaaagaccgccatcagaagctag

SEQ ID NO: 9471 - DNA, 2472 bp, Artificial Sequence
  Description of Artificial Sequence: Synthetic coding sequence
atgaacggcgagcagcagctggacgccgacgccggcagcggcatggaggaggtggagctgagctgggaggactacctggaggagaccggcagcaccgccgtgccctacggcagcttcaagcacgtggacaccagactgcagaacggcttcgcccccggcatgaagctggaggtggccgtgagaaccgaccccgagacctactgggtggccaccgtgatcaccacctgcgagcagctgctgctgctgagatacgacggctacggcgaggacagaagagccgacttctggtgcgacatcagaaaggccgacctgtaccccatcggctggtgcgagcagaacaagaagaccctggaggcccccgagggcatcagagacaaggtgagcgactgggacgagttcctgagacagaccctgatcggcgcctgcagcccccccgtgcccctgctggagggcctgagaaacggcagaaaccccctggacctgatcgcccccggcagcagactggagtgccaggccttccaggacagcctgagcacctggatcgtgaccgtggtggagaacatcggcggcagactgaagctgagatacgagggcctggagagcagcgacaactacgagcactggctgtactacctggaccccttcctgcaccacgtgggctgggccgcccagcagggctacgagctgcagccccccagcgccatcagacacctgaagaacgaggccgagtggcaggagatcctggccaaggtgaaggaggaggaggaggagcccctgcccagctacctgttcaaggacaagcaggtgatcggcatccacaccttcagcgtgaacatgaagctggaggccgtggacccctggagccccttcggcatcagccccgccaccgtggtgaaggtgttcgacgagaagtacttcctggtggagatggacgacctgagacccgagaaccacgccagaagaagcttcgtgtgccacgccgacagccccggcatcttccccgtgcagtggagcctgaagaacggcctgcacatcagccccccccccggctaccccagccaggacttcgactgggccgactacctgaagcagtgcggcgccgaggccgccccccagagatgcttcccccccctgatcagcgagcacgagttcaaggagaacatgaagctggaggccgtgaaccccatcctgcccgaggaggtgtgcgtggccaccatcaccgccgtgagaggcagctacctgtggctgcagctggagggcagcaagaagcccatccccgagtgcatcgtgagcgtggagagcatggacatcttccccctgggctggtgcgagaccaacggccaccccctgagcacccccagaagagccagagtgtacaagcagagaaagatcgccgtggtgcagcccgagaagcaggtgcccagcagcagaaccgtgcacgagggcctgagaaaccaggagctgaacagcaccgagagcgtgatgatcaacggcaagtactgctgccccaagatctacttcaaccacagatgcttcagcggcccctacctgaacaagggcagaatcgccgagctgccccagtgcgtgggccccggcaactgcgtgctggtgctgagagaggtgctgaccctgctgatcaacgccgcctacaagcccagcagagtgctgagagagctgcagctggacaaggacagcgtgtggcacggctgcggcgaggtgctgaaggccaagtacaagggcaagagctacagagccaccgtggagatcgtgaagaccgccgacagagtgaccgagttctgcagacagacctgcatcaagctggagtgctgccccaacctgttcggccccagaatggtgctggacaagtgcagcgagaactgcagcgtgctgaccaagaccaagtacacccactactacggcaagaagaagaacaagagaatcggcagaccccccggcggccacagcaacctggcctgcgccctgaagaaggccagcaagagaagaaagagaagaaagaacgtgttcgtgcacaagaagaagagaagcagcgccagcgtggacaacacccccgccggcagcccccagggcagcggcggcgaggacgaggacgaccccgacgagggcgacgacgacagcctgagcgagggcagcaccagcgagcagcaggacgagctgcaggaggagagcgagatgagcgagaagaagagctgcagcagcagccccacccagagcgagatcagcaccagcctgccccccgacagacagagaagaaagagagagctgagaaccttcagcttcagcgacgacgagaacaagccccccagccccaaggagatcgacggccaggccctgctgctgctgaccctgcccaccgtgcaggagtgcatggacctgaagctgggccccgccatcaagctgtgccaccacatcgagagaatcaagttcgccttctacgagcagttcgccaactag

SEQ ID NO: 9472 - DNA, 2601 bp, Artificial Sequence
  Description of Artificial Sequence: Synthetic coding sequence
atgaacggcgagcagcagctggacgccgacgccggcagcggcatggaggaggtggagctgagctgggaggactacctggaggagaccggcagcaccgccgtgccctacggcagcttcaagcacgtggacaccagactgcagaacggcttcgcccccggcatgaagctggaggtggccgtgagaaccgaccccgagacctactgggtggccaccgtgatcaccacctgcgagcagctgctgctgctgagatacgacggctacggcgaggacagaagagccgacttctggtgcgacatcagaaaggccgacctgtaccccatcggctggtgcgagcagaacaagaagaccctggaggcccccgagggcatcagagacaaggtgagcgactgggacgagttcctgagacagaccctgatcggcgcctgcagcccccccgtgcccctgctggagggcctgagaaacggcagaaaccccctggacctgatcgcccccggcagcagactggagtgccaggccttccaggacagcctgagcacctggatcgtgaccgtggtggagaacatcggcggcagactgaagctgagatacgagggcctggagagcagcgacaactacgagcactggctgtactacctggaccccttcctgcaccacgtgggctgggccgcccagcagggctacgagctgcagccccccagcgccatcagacacctgaagaacgaggccgagtggcaggagatcctggccaaggtgaaggaggaggaggaggagcccctgcccagctacctgttcaaggacaagcaggtgatcggcatccacaccttcagcgtgaacatgaagctggaggccgtggacccctggagccccttcggcatcagccccgccaccgtggtgaaggtgttcgacgagaagtacttcctggtggagatggacgacctgagacccgagaaccacgccagaagaagcttcgtgtgccacgccgacagccccggcatcttccccgtgcagtggagcctgaagaacggcctgcacatcagccccccccccggctaccccagccaggacttcgactgggccgactacctgaagcagtgcggcgccgaggccgccccccagagatgcttcccccccctgatcagcgagcacgagttcaaggagaacatgaagctggaggccgtgaaccccatcctgcccgaggaggtgtgcgtggccaccatcaccgccgtgagaggcagctacctgtggctgcagctggagggcagcaagaagcccatccccgagtgcatcgtgagcgtggagagcatggacatcttccccctgggctggtgcgagaccaacggccaccccctgagcacccccagaagagccagagtgtacaagcagagaaagatcgccgtggtgcagcccgagaagcaggtgcccagcagcagaaccgtgcacgagggcctgagaaaccaggagctgaacagcaccgagagcgtgatgatcaacggcaagtactgctgccccaagatctacttcaaccacagatgcttcagcggcccctacctgaacaagggcagaatcgccgagctgccccagtgcgtgggccccggcaactgcgtgctggtgctgagagaggtgctgaccctgctgatcaacgccgcctacaagcccagcagagtgctgagagagctgcagctggacaaggacagcgtgtggcacggctgcggcgaggtgctgaaggccaagtacaagggcaagagctacagagccaccgtggagatcgtgaagaccgccgacagagtgaccgagttctgcagacagacctgcatcaagctggagtgctgccccaacctgttcggccccagaatggtgctggacaagtgcagcgagaactgcagcgtgctgaccaagaccaagtacacccactactacggcaagaagaagaacaagagaatcggcagaccccccggcggccacagcaacctggcctgcgccctgaagaaggccagcaagagaagaaagagaagaaagaacgtgttcgtgcacaagaagaagagaagcagcgccagcgtggacaacacccccgccggcagcccccagggcagcggcggcgaggacgaggacgaccccgacgagggcgacgacgacagcctgagcgagggcagcaccagcgagcagcaggacgagctgcaggaggagagcgagatgagcgagaagaagagctgcagcagcagccccacccagagcgagatcagcaccagcctgccccccgacagacagagaagaaagagagagctgagaaccttcagcttcagcgacgacgagaacaagccccccagccccaaggagatcagaatcgaggtggccgagagactgcacctggacagcaaccccctgaagtggagcgtggccgacgtggtgagattcatcagaagcaccgactgcgcccccctggccagaatcttcctggaccaggagatcgacggccaggccctgctgctgctgaccctgcccaccgtgcaggagtgcatggacctgaagctgggccccgccatcaagctgtgccaccacatcgagagaatcaagttcgccttctacgagcagttcgccaactag

SEQ ID NO: 9473 - DNA, 2601 bp, Artificial Sequence; identical to SEQ ID NO: 9472
  Description of Artificial Sequence: Synthetic coding sequence

SEQ ID NO: 9474 - DNA, 2601 bp, Artificial Sequence; identical to SEQ ID NO: 9472
  Description of Artificial Sequence: Synthetic coding sequence

SEQ ID NO: 9475 - DNA, 366 bp, Artificial Sequence
  Description of Artificial Sequence: Synthetic coding sequence
atgaacggcgagcagcagctggacgccgacgccggcagcggcatggaggaggtggagctgagctgggaggactacctggaggagaccggcagcaccgccgtgccctacggcagcttcaagcacgtggacaccagactgcagaacggcttcgcccccggcatgaagctggaggtggccgtgagaaccgaccccgagacctactgggtggccaccgtgatcaccacctgcgagcagctgctgctgctgagatacgacggctacggcgaggacagaagagccgacttctggtgcgacatcagaaaggccgacctgtaccccatcggctggtgcgagcagaacaagaagaccctggaggcccccgagtag

SEQ ID NO: 9476 - DNA, 285 bp, Artificial Sequence
  Description of Artificial Sequence: Synthetic coding sequence
atgaacggcgagcagcagctggacgccgacgccggcagcggcatggaggaggtggagctgagctgggaggactacctggaggagaccggcagcaccgccgtgccctacggcagcttcaagcacgtggacaccagactgcagaacggcttcgcccccggcatgaagctggaggtggccgtgagaaccgaccccgagacctactgggtggccaccgtgatcaccacctgcgagcagctgctgctgctgagatacgacggctacggcgaggacagaagagccgactag

SEQ ID NO: 9477 - DNA, 153 bp, Artificial Sequence
  Description of Artificial Sequence: Synthetic coding sequence
atgaacggcgagcagcagctggacgccgacgccggcagcggcatggaggaggtggagctgagctgggaggactacctggaggagaccggcagcaccgccgtgccctacggcagcttcaagcacgtggacaccagactgcagaacggcttctag

SEQ ID NO: 9478 - DNA, 2685 bp, Artificial Sequence
  Description of Artificial Sequence: Synthetic coding sequence
atggagagcaccctgagcgccagcaacatgcaggaccccagcagcagccccctggagaagtgcctgggcagcgccaacggcaacggcgacctggacagcgaggagggcagcagcctggaggagaccggcttcaactggggcgagtacctggaggagaccggcgccagcgccgccccccacaccagcttcaagcacgtggagatcagcatccagagcaacttccagcccggcatgaagctggaggtggccaacaagaacaaccccgacacctactgggtggccaccatcatcaccacctgcggccagctgctgctgctgagatactgcggctacggcgaggacagaagagccgacttctggtgcgacgtggtgatcgccgacctgcaccccgtgggctggtgcacccagaacaacaaggtgctgatgccccccgacgccatcaaggagaagtacaccgactggaccgagttcctgatcagagacctgaccggcagcagaaccgcccccgccaacctgctggagggccccctgagaggcaagggccccatcgacctgatcaccgtgggcagcctgatcgagctgcaggacagccagaaccccttccagtactggatcgtgagcgtgatcgagaacgtgggcggcagactgagactgagatacgtgggcctggaggacaccgagagctacgaccagtggctgttctacctggactacagactgagacccgtgggctggtgccaggagaacaagtacagaatggacccccccagcgagatctaccccctgaagatggccagcgagtggaagtgcaccctggagaagagcctgatcgacgccgccaagttccccctgcccatggaggtgttcaaggaccacgccgacctgagaagccacttcttcaccgtgggcatgaagctggagaccgtgaacatgtgcgagcccttctacatcagccccgccagcgtgaccaaggtgttcaacaaccacttcttccaggtgaccatcgacgacctgagacccgagcccagcaagctgagcatgctgtgccacgccgacagcctgggcatcctgcccgtgcagtggtgcctgaagaacggcgtgagcctgaccccccccaagggctacagcggccaggacttcgactgggccgactaccacaagcagcacggcgcccaggaggccccccccttctgcttcagaaacaccagcttcagcagaggcttcaccaagaacatgaagctggaggccgtgaaccccagaaaccccggcgagctgtgcgtggccagcgtggtgagcgtgaagggcagactgatgtggctgcacctggagggcctgcagacccccgtgcccgaggtgatcgtggacgtggagagcatggacatcttccccgtgggctggtgcgaggccaacagctaccccctgaccgccccccacaagaccgtgagccagaagaagagaaagatcgccgtggtgcagcccgagaagcagctgccccccaccgtgcccgtgaagaagatcccccacgacctgtgcctgttcccccacctggacaccaccggcaccgtgaacggcaagtactgctgcccccagctgttcatcaaccacagatgcttcagcggcccctacctgaacaagggcagaatcgccgagctgccccagagcgtgggccccggcaagtgcgtgctggtgctgaaggaggtgctgagcatgatcatcaacgccgcctacaagcccggcagagtgctgagagagctgcagctggtggaggacccccactggaacttccaggaggagaccctgaaggccaagtacagaggcaagacctacagagccgtggtgaagatcgtgagaaccagcgaccaggtggccaacttctgcagaagagtgtgcgccaagctggagtgctgccccaacctgttcagccccgtgctgatcagcgagaactgccccgagaactgcagcatccacaccaagaccaagtacacctactactacggcaagagaaagaagatcagcaagccccccatcggcgagagcaaccccgacagcggccaccccaagcccgccagaagaagaaagagaagaaagagcatcttcgtgcagaagaagagaagaagcagcgccgtggacttcaccgccggcagcggcgaggagagcgaggaggaggacgccgacgccatggacgacgacaccgccagcgaggagaccggcagcgagctgagagacgaccagaccgacaccagcagcgccgaggtgcccagcgccagacccagaagagccgtgaccctgagaagcggcagcgagcccgtgagaagacccccccccgagagaaccagaagaggcagaggcgcccccgccgccagcagcgccgaggagggcgagaagtgcccccccaccaagcccgagggcaccgaggacaccaagcaggaggaggaggagagactggtgctggagagcaaccccctggagtggaccgtgaccgacgtggtgagattcatcaagctgaccgactgcgcccccctggccaagatcttccaggagcaggacatcgacggccaggccctgctgctgctgaccctgcccaccgtgcaggagtgcatggagctgaagctgggccccgccatcaagctgtgccaccagatcgagagagtgaaggtggccttctacgcccagtacgccaactag

SEQ ID NO: 9479 - DNA, 483 bp, Artificial Sequence
  Description of Artificial Sequence: Synthetic coding sequence
atggagagcaccctgagcgccagcaacatgcaggaccccagcagcagccccctggagaagtgcctgggcagcgccaacggcaacggcgacctggacagcgaggagggcagcagcctggaggagaccggcttcaactggggcgagtacctggaggagaccggcgccagcgccgccccccacaccagcttcaagcacgtggagatcagcatccagagcaacttccagcccggcatgaagctggaggtggccaacaagaacaaccccgacacctactgggtggccaccatcatcaccacctgcggccagctgctgctgctgagatactgcggctacggcgaggacagaagagccgacttctggtgcgacgtggtgatcgccgacctgcaccccgtgggctggtgcacccagaacaacaaggtgctgatgccccccgacgtggagagcgacgtgaagcccagcgccagcgtgcagcacatcagctag

SEQ ID NO: 9480 - DNA, 561 bp, Artificial Sequence
  Description of Artificial Sequence: Synthetic coding sequence
atggagagcaccctgagcgccagcaacatgcaggaccccagcagcagccccctggagaagtgcctgggcagcgccaacggcaacggcgacctggacagcgaggagggcagcagcctggaggagaccggcttcaactggggcgagtacctggaggagaccggcgccagcgccgccccccacaccagcttcaagcacgtggagatcagcatccagagcaacttccagcccggcatgaagctggaggtggccaacaagaacaaccccgacacctactgggtggccaccatcatcaccacctgcggccagctgctgctgctgagatactgcggctacggcgaggacagaagagccgacttctggtgcgacgtggtgatcgccgacctgcaccccgtgggctggtgcacccagaacaacaaggtgctgatgccccccgacgccatcaaggagaagtacaccgactggaccgagttcctgatcagagacctgaccggcagcagaaccgcccccgccaacctgctggagggcgtgtgcatcgtggtgatccacctgatgtacctgtag

SEQ ID NO: 9481 - DNA, 483 bp, Artificial Sequence; identical to SEQ ID NO: 9479
  Description of Artificial Sequence: Synthetic coding sequence

SEQ ID NO: 9482 - DNA, 2685 bp, Artificial Sequence; identical to SEQ ID NO: 9478
  Description of Artificial Sequence: Synthetic coding sequence

SEQ ID NO: 9483 - DNA, 924 bp, Artificial Sequence
  Description of Artificial Sequence: Synthetic coding sequence
atgcccagaagcttcctggtgaagaagatcaagggcgacggcttccagtgcagcggcgtgcccgcccccacctaccaccccctggagaccgcctacgtgctgcccggcgccagaggcccccccggcgacaacggctacgccccccacagactgccccccagcagctacgacgccgaccagaagcccggcctggagctggcccccgccgagcccgcctacccccccgccgcccccgaggagtacagcgaccccgagagcccccagagcagcctgagcgccagatacttcagaggcgaggccgccgtgaccgacagctacagcatggacgccttcttcatcagcgacggcagaagcagaagaagaagaggcggcggcggcggcgacgccggcggcagcggcgacgccggcggcgccggcggcagagccggcagagccggcgcccaggccggcggcggccacagacacgcctgcgccgagtgcggcaagacctacgccaccagcagcaacctgagcagacacaagcagacccacagaagcctggacagccagctggccagaaagtgccccacctgcggcaaggcctacgtgagcatgcccgccctggccatgcacctgctgacccacaacctgagacacaagtgcggcgtgtgcggcaaggccttcagcagaccctggctgctgcagggccacatgagaagccacaccggcgagaagcccttcggctgcgcccactgcggcaaggccttcgccgacagaagcaacctgagagcccacatgcagacccacagcgccttcaagcactacagatgcagacagtgcgacaagagcttcgccctgaagagctacctgcacaagcactgcgaggccgcctgcgccaaggccgccgagccccccccccccacccccgccggccccgccagctag

SEQ ID NO: 9484 - DNA, 2064 bp, Artificial Sequence
  Description of Artificial Sequence: Synthetic coding sequence
atgagcaacagaaacaacaacaagctgcccagcaacctgccccagctgcagaacctgatcaagagagacccccccgcctacatcgaggagttcctgcagcagtacaaccactacaagagcaacgtggagatcttcaagctgcagcccaacaagcccagcaaggagctggccgagctggtgatgttcatggcccagatcagccactgctaccccgagtacctgagcaacttcccccaggaggtgaaggacctgctgagctgcaaccacaccgtgctggaccccgacctgagaatgaccttctgcaaggccctgatcctgctgagaaacaagaacctgatcaaccccagcagcctgctggagctgttcttcgagctgttcagatgccacgacaagctgctgagaaagaccctgtacacccacatcgtgaccgacatcaagaacatcaacgccaagcacaagaacaacaaggtgaacgtggtgctgcagaacttcatgtacaccatgctgagagacagcaacgccaccgccgccaagatgagcctggacgtgatgatcgagctgtacagaagaaacatctggaacgacgccaagaccgtgaacgtgatcaccaccgcctgcttcagcaaggtgaccaagatcctggtggccgccctgaccttcttcctgggcaaggacgaggacgagaagcaggacagcgacagcgagagcgaggacgacggccccaccgccagagacctgctggtgcagtacgccaccggcaagaagagcagcaagaacaagaagaagctggagaaggccatgaaggtgctgaagaagcagaagaagaagaagaagcccgaggtgttcaacttcagcgccatccacctgatccacgacccccaggacttcgccgagaagctgctgaagcagctggagtgctgcaaggagagattcgaggtgaagatgatgctgatgaacctgatcagcagactggtgggcatccacgagctgttcctgttcaacttctaccccttcctgcagagattcctgcagccccaccagagagaggtgaccaagatcctgctgttcgccgcccaggccagccaccacctggtgccccccgagatcatccagagcctgctgatgaccgtggccaacaacttcgtgaccgacaagaacagcggcgaggtgatgaccgtgggcatcaacgccatcaaggagatcaccgccagatgccccctggccatgaccgaggagctgctgcaggacctggcccagtacaagacccacaaggacaagaacgtgatgatgagcgccagaaccctgatccacctgttcagaaccctgaacccccagatgctgcagaagaagttcagaggcaagcccaccgaggccagcatcgaggccagagtgcaggagtacggcgagctggacgccaaggactacatccccggcgccgaggtgctggaggtggagaaggaggagaacgccgagaacgacgaggacggctgggagagcaccagcctgagcgaggaggaggacgccgacggcgagtggatcgacgtgcagcacagcagcgacgaggagcagcaggagatcagcaagaagctgaacagcatgcccatggaggagagaaaggccaaggccgccgccatcagcaccagcagagtgctgacccaggaggacttccagaagatcagaatggcccagatgagaaaggagctggacgccgcccccggcaagagccagaagagaaagtacatcgagatcgacagcgacgaggagcccagaggcgagctgctgagcctgagagacatcgagagactgcacaagaagcccaagagcgacaaggagaccagactggccaccgccatggccggcaagaccgacagaaaggagttcgtgagaaagaagaccaagaccaaccccttcagcagcagcaccaacaaggagaagaagaagcagaagaacttcatgatgatgagatacagccagaacgtgagaagcaagaacaagagaagcttcagagagaagcagctggccctgagagacgccctgctgaagaagagaaagagaatgaagtag

SEQ ID NO: 9485 - DNA, 786 bp, Artificial Sequence
  Description of Artificial Sequence: Synthetic coding sequence
atgagcagatacaccagaccccccaacaccagcctgttcatcagaaacgtggccgacgccaccagacccgaggacctgagaagagagttcggcagatacggccccatcgtggacgtgtacatccccctggacttctacaccagaagacccagaggcttcgcctacgtgcagttcgaggacgtgagagacgccgaggacgccctgtacaacctgaacagaaagtgggtgtgcggcagacagatcgagatccagttcgcccagggcgacagaaagacccccggccagatgaagagcaaggagagacacccctgcagccccagcgaccacagaagaagcagaagccccagccagagaagaaccagaagcagaagcagcagctggggcagaaacagaagaagaagcgacagcctgaaggagagcagacacagaagattcagctacagccagagcaagagcagaagcaagagcctgcccagaagaagcaccagcgccagacagagcagaacccccagaagaaacttcggcagcagaggcagaagcagaagcaagagcctgcagaagagaagcaagagcatcggcaagagccagagcagcagcccccagaagcagaccagcagcggcaccaagagcagaagccacggcagacacagcgacagcatcgccagaagcccctgcaagagccccaagggctacaccaacagcgagaccaaggtgcagaccgccaagcacagccacttcagaagccacagcagaagcagaagctacagacacaagaacagctggtag

SEQ ID NO: 9486 - DNA, 1245 bp, Artificial Sequence
  Description of Artificial Sequence: Synthetic coding sequence
atgatccccctggagaagcccggcagcggcggcagcagccccggcgccaccagcggcagcggcagagccggcagaggcctgagcggcccctgcagaccccccccccccccccaggccagaggcctgctgaccgagatcagagccgtggtgagaaccgagcccttccaggacggctacagcctgtgccccggcagagagctgggcagaggcaagttcgccgtggtgagaaagtgcatcaagaaggacagcggcaaggagttcgccgccaagttcatgagaaagagaagaaagggccaggactgcagaatggagatcatccacgagatcgccgtgctggagctggcccaggacaacccctgggtgatcaacctgcacgaggtgtacgagaccgccagcgagatgatcctggtgctggagtacgccgccggcggcgagatcttcgaccagtgcgtggccgacagagaggaggccttcaaggagaaggacgtgcagagactgatgagacagatcctggagggcgtgcacttcctgcacaccagagacgtggtgcacctggacctgaagccccagaacatcctgctgaccagcgagagccccctgggcgacatcaagatcgtggacttcggcctgagcagaatcctgaagaacagcgaggagctgagagagatcatgggcacccccgagtacgtggcccccgagatcctgagctacgaccccatcagcatggccaccgacatgtggagcatcggcgtgctgacctacgtgatgctgaccggcatcagccccttcctgggcaacgacaagcaggagaccttcctgaacatcagccagatgaacctgagctacagcgaggaggagttcgacgtgctgagcgagagcgccgtggacttcatcagaaccctgctggtgaagaagcccgaggacagagccaccgccgaggagtgcctgaagcacccctggctgacccagagcagcatccaggagcccagcttcagaatggagaaggccctggaggaggccaacgccctgcaggagggccacagcgtgcccgagatcaacagcgacaccgacaagagcgagaccaaggagagcatcgtgaccgaggagctgatcgtggtgaccagctacaccctgggccagtgcagacagagcgagaaggagaagatggagcagaaggccatcagcaagagattcaagttcgaggagcccctgctgcaggagatccccggcgagttcatctactag

SEQ ID NO: 9487 - DNA, 1062 bp, Artificial Sequence
  Description of Artificial Sequence: Synthetic coding sequence
atgagcctgcacacccagtacctggagagcttcctgagaagccagttctacatgctgagaatggacggccccctgcccctgccctacagacactacatcgccatcatgaagctggtgaagaccggcgagaacaactggagcctgcccgagctggtgcacgccgtggtgctgctggcccactaccacgccctggccagcttcgtgttcggcagcggcatcaaccccgagagagaccccgagatcagcaacggcttcagactgatcagcgtgaacaacttctgcgtgtgcgacctggccaacgacaacaacatcgagaacgccagcctgagcggcagcaacttcggcatcgtggacagcctgagcgagctggaggccctgatggagagaatgaagagactgcaggaggagagagaggacgaggaggccagccaggaggagatgagcaccagattcgagaaggagaagaaggagagcctgttcgtggtgagcggcgacaccttccacagcttcccccacagcgacttcgaggacgacatgatcatcaccagcgacgtgagcagatacatcgaggaccccggcttcggctacgaggacttcgccagaagaggcgaggagcacctgcccaccttcagagcccaggactacacctgggagaaccacggcttcagcctggtgaacagactgtacagcgacatcggccacctgctggacgagaagttcagaatggtgtacaacctgacctacaacaccatggccacccacgaggacgtggacaccaccatgctgagaagagccctgttcaactacgtgcactgcatgttcggcatcagatacgacgactacgactacggcgaggtgaaccagctgctggagagaagcctgaaggtgtacatcaagaccgtgacctgctaccccgagagaaccaccaagagaatgtacgacagctactggagacagttcaagcacagcgagaaggtgcacgtgaacctgctgctgatggaggccagaatgcaggccgagctgctgtacgccctgagagccatcaccagacacctgacctag

SEQ ID NO: 9488 - DNA, 954 bp, Artificial Sequence
  Description of Artificial Sequence: Synthetic coding sequence
atgaacagaggcggcggcagccccagcgccgccgccaactacctgctgtgcaccaactgcagaaaggtgctgagaaaggacaagagaatcagagtgagccagcccctgaccagaggccccagcgccttcatccccgagaaggaggtggtgcaggccaacaccgtggacgagagaaccaacttcctggtggaggagtacagcaccagcggcagactggacaacatcacccaggtgatgagcctgcacacccagtacctggagagcttcctgagaagccagttctacatgctgagaatggacggccccctgcccctgccctacagacactacatcgccatcatggccgccgccagacaccagtgcagctacctgatcaacatgcacgtggacgagttcctgaagaccggcggcatcgccgagtggctgaacggcctggagtacgtgccccagagactgaagaacctgaacgagatcaacaagctgctggcccacagaccctggctgatcaccaaggagcacatccagaagctggtgaagaccggcgagaacaactggagcctgcccgagctggtgcacgccgtggtgctgctggcccactaccacgccctggccagcttcgtgttcggcagcggcatcaaccccgagagagaccccgagatcagcaacggcttcagactgatcagcgtgaacaacttctgcgtgtgcgacctggccaacgacaacaacatcgagaacgccagcctgagcggcagcaacttcggcatcgtggacagcctgagcgagctggaggccctgatggagagaatgaagagactgcaggaggagagagaggacgaggaggccagccaggaggagatgagcaccagattcgagaaggagaagaaggagagcctgttcgtggtgagcggcgacaccttccacagcttcccccacagcggcctgctgaagtactag

SEQ ID NO: 9489 - DNA, 966 bp, Artificial Sequence
  Description of Artificial Sequence: Synthetic coding sequence
atgaacagaggcggcggcagccccagcgccgccgccaactacctgctgtgcaccaactgcagaaaggtgctgagaaaggacaagagaatcagagtgagccagcccctgaccagaggccccagcgccttcatccccgagaaggaggtggtgcaggccaacaccgtggacgagagaaccaacttcctggtggaggagtacagcaccagcggcagactggacaacatcacccaggtgatgagcctgcacacccagtacctggagagcttcctgagaagccagttctacatgctgagaatggacggccccctgcccctgccctacagacactacatcgccatcatggccgccgccagacaccagtgcagctacctgatcaacatgcacgtggacgagttcctgaagaccggcggcatcgccgagtggctgaacggcctggagtacgtgccccagagactgaagaacctgaacgagatcaacaagctgctggcccacagaccctggctgatcaccaaggagcacatccagaagctggtgaagaccggcgagaacaactggagcctgcccgagctggtgcacgccgtggtgctgctggcccactaccacgccctggccagcttcgtgttcggcagcggcatcaaccccgagagagaccccgagatcagcaacggcttcagactgatcagcgtgaacaacttctgcgtgtgcgacctggccaacgacaacaacatcgagaacgccagcctgagcggcagcaacttcggcatcgtggacagcctgagcgagctggaggccctgatggagagaatgaagagactgcaggaggagagagaggacgaggaggccagccaggaggagatgagcaccagattcgagaaggagaagaaggagagcctgttcgtggtgagcggcgacaccttccacagcttcccccacagcggcgccttcctgcacttcttcgccttctag

SEQ ID NO: 9490 - DNA, 1479 bp, Artificial Sequence
  Description of Artificial Sequence: Synthetic coding sequence
atgaacagaggcggcggcagccccagcgccgccgccaactacctgctgtgcaccaactgcagaaaggtgctgagaaaggacaagagaatcagagtgagccagcccctgaccagaggccccagcgccttcatccccgagaaggaggtggtgcaggccaacaccgtggacgagagaaccaacttcctggtggaggagtacagcaccagcggcagactggacaacatcacccaggtgatgagcctgcacacccagtacctggagagcttcctgagaagccagttctacatgctgagaatggacggccccctgcccctgccctacagacactacatcgccatcatggccgccgccagacaccagtgcagctacctgatcaacatgcacgtggacgagttcctgaagaccggcggcatcgccgagtggctgaacggcctggagtacgtgccccagagactgaagaacctgaacgagatcaacaagctgctggcccacagaccctggctgatcaccaaggagcacatccagaagctggtgaagaccggcgagaacaactggagcctgcccgagctggtgcacgccgtggtgctgctggcccactaccacgccctggccagcttcgtgttcggcagcggcatcaaccccgagagagaccccgagatcagcaacggcttcagactgatcagcgtgaacaacttctgcgtgtgcgacctggccaacgacaacaacatcgagaacgccagcctgagcggcagcaacttcggcatcgtggacagcctgagcgagctggaggccctgatggagagaatgaagagactgcaggaggagagagaggacgaggaggccagccaggaggagatgagcaccagattcgagaaggagaagaaggagagcctgttcgtggtgagcggcgacaccttccacagcttcccccacagcgacttcgaggacgacatgatcatcaccagcgacgtgagcagatacatcgaggaccccggcttcggctacgaggacttcgccagaagaggcgaggagcacctgcccaccttcagagcccaggactacacctgggagaaccacggcttcagcctggtgaacagactgtacagcgacatcggccacctgctggacgagaagttcagaatggtgtacaacctgacctacaacaccatggccacccacgaggacgtggacaccaccatgctgagaagagccctgttcaactacgtgcactgcatgttcggcatcagatacgacgactacgactacggcgaggtgaaccagctgctggagagaagcctgaaggtgtacatcaagaccgtgacctgctaccccgagagaaccaccaagagaatgtacgacagctactggagacagttcaagcacagcgagaaggtgcacgtgaacctgctgctgatggaggccagaatgcaggccgagctgctgtacgccctgagagccatcaccagacacctgacctag

SEQ ID NO: 9491 - DNA, 891 bp, Artificial Sequence
  Description of Artificial Sequence: Synthetic coding sequence
atgggcaagaagagcagagtgaagacccagaagagcggcaccggcgccaccgccaccgtgagccccaaggagatcctgaacctgaccagcgagctgctgcagaagtgcagcagccccgcccccggccccggcaaggagtgggaggagtacgtgcagatcagaaccctggtggagaagatcagaaagaagcagaagggcctgagcgtgaccttcgacggcaagagagaggactacttccccgacctgatgaagtgggccagcgagaacggcgccagcgtggagggcttcgagatggtgaacttcaaggaggagggcttcggcctgagagccaccagagacatcaaggccgaggagctgttcctgtgggtgcccagaaagctgctgatgaccgtggagagcgccaagaacagcgtgctgggccccctgtacagccaggacagaatcctgcaggccatgggcaacatcgccctggccttccacctgctgtgcgagagagccagccccaacagcttctggcagccctacatccagaccctgcccagcgagtacgacacccccctgtacttcgaggaggacgaggtgagatacctgcagagcacccaggccatccacgacgtgttcagccagtacaagaacaccgccagacagtacgcctacttctacaaggtgatccagacccacccccacgccaacaagctgcccctgaaggacagcttcacctacgaggactacagatgggccgtgagcagcgtgatgaccagacagaaccagatccccaccgaggacggcagcagagtgaccctggccctgatccccctgtgggacatgtgcaaccacaccaacggcctgacccccgaggacagcttcgccctggccgtggccagcgcctag

SEQ ID NO: 9492 - DNA, 1785 bp, Artificial Sequence
  Description of Artificial Sequence: Synthetic coding sequence
atgggcaagaagagcagagtgaagacccagaagagcggcaccggcgccaccgccaccgtgagccccaaggagatcctgaacctgaccagcgagctgctgcagaagtgcagcagccccgcccccggccccggcaaggagtgggaggagtacgtgcagatcagaaccctggtggagaagatcagaaagaagcagaagggcctgagcgtgaccttcgacggcaagagagaggactacttccccgacctgatgaagtgggccagcgagaacggcgccagcgtggagggcttcgagatggtgaacttcaaggaggagggcttcggcctgagagccaccagagacatcaaggccgaggagctgttcctgtgggtgcccagaaagctgctgatgaccgtggagagcgccaagaacagcgtgctgggccccctgtacagccaggacagaatcctgcaggccatgggcaacatcgccctggccttccacctgctgtgcgagagagccagccccaacagcttctggcagccctacatccagaccctgcccagcgagtacgacacccccctgtacttcgaggaggacgaggtgagatacctgcagagcacccaggccatccacgacgtgttcagccagtacaagaacaccgccagacagtacgcctacttctacaaggtgatccagacccacccccacgccaacaagctgcccctgaaggacagcttcacctacgaggactacagatgggccgtgagcagcgtgatgaccagacagaaccagatccccaccgaggacggcagcagagtgaccctggccctgatccccctgtgggacatgtgcaaccacaccaacggcctgatcaccaccggctacaacctggaggacgacagatgcgagtgcgtggccctgcaggacttcagagccggcgagcagatctacatcttctacggcaccagaagcaacgccgagttcgtgatccacagcggcttcttcttcgacaacaacagccacgacagagtgaagatcaagctgggcgtgagcaagagcgacagactgtacgccatgaaggccgaggtgctggccagagccggcatccccaccagcagcgtgttcgccctgcacttcaccgagccccccatcagcgcccagctgctggccttcctgagagtgttctgcatgaccgaggaggagctgaaggagcacctgctgggcgacagcgccatcgacagaatcttcaccctgggcaacagcgagttccccgtgagctgggacaacgaggtgaagctgtggaccttcctggaggacagagccagcctgctgctgaagacctacaagaccaccatcgaggaggacaagagcgtgctgaagaaccacgacctgagcgtgagagccaagatggccatcaagctgagactgggcgagaaggagatcctggagaaggccgtgaagagcgccgccgtgaacagagagtactacagacagcagatggaggagaaggcccccctgcccaagtacgaggagagcaacctgggcctgctggagagcagcgtgggcgacagcagactgcccctggtgctgagaaacctggaggaggaggccggcgtgcaggacgccctgaacatcagagaggccatcagcaaggccaaggccaccgagaacggcctggtgaacggcgagaacagcatccccaacggcaccagaagcgagaacgagagcctgaaccaggagagcaagagagccgtggaggacgccaagggcagcagcagcgacagcaccgccggcgtgaaggagtag

SEQ ID NO: 9493 - DNA, 975 bp, Artificial Sequence
  Description of Artificial Sequence: Synthetic coding sequence
atgcccgagctggccgtgcagaaggtggtggtgcaccccctggtgctgctgagcgtggtggaccacttcaacagaatcggcaaggtgggcaaccagaagagagtggtgggcgtgctgctgggcagctggcagaagaaggtgctggacgtgagcaacagcttcgccgtgcccttcgacgaggacgacaaggacgacagcgtgtggttcctggaccacgactacctggagaacatgtacggcatgttcaagaaggtgaacgccagagagagaatcgtgggctggtaccacaccggccccaagctgcacaagaacgacatcgccatcaacgagctgatgaagagatactgccccaacagcgtgctggtgatcatcgacgtgaagcccaaggacctgggcctgcccaccgaggcctacatcagcgtggaggaggtgcacgacgacggcacccccaccagcaagaccttcgagcacgtgaccagcgagatcggcgccgaggaggccgaggaggtgggcgtggagcacctgctgagagacatcaaggacaccaccgtgggcaccctgagccagagaatcaccaaccaggtgcacggcctgaagggcctgaacagcaagctgctggacatcagaagctacctggagaaggtggccaccggcaagctgcccatcaaccaccagatcatctaccagctgcaggacgtgttcaacctgctgcccgacgtgagcctgcaggagttcgtgaaggccttctacctgaagaccaacgaccagatggtggtggtgtacctggccagcctgatcagaagcgtggtggccctgcacaacctgatcaacaacaagatcgccaacagagacgccgagaagaaggagggccaggagaaggaggagagcaagaaggacagaaaggaggacaaggagaaggacaaggacaaggagaagagcgacgtgaagaaggaggagaagaaggagaagaagtag

SEQ ID NO: 9494 - DNA, 1350 bp, Artificial Sequence
  Description of Artificial Sequence: Synthetic coding sequence
atggccacccaggccaagagacccagagtggccggccccgtggacggcggcgacctggaccccgtggcctgcttcctgagctggtgcagaagagtgggcctggagctgagccccaaggtggccgtgagcagacagggcaccgtggccggctacggcatggtggccagagagagcgtgcaggccggcgagctgctgttcgtggtgcccagagccgccctgctgagccagcacacctgcagcatcggcggcctgctggagagagagagagtggccctgcagagccagagcggctgggtgcccctgctgctggccctgctgcacgagctgcaggcccccgccagcagatggagaccctacttcgccctgtggcccgagctgggcagactggagcaccccatgttctggcccgaggaggagagaagatgcctgctgcagggcaccggcgtgcccgaggccgtggagaaggacctggccaacatcagaagcgagtaccagagcatcgtgctgcccttcatggaggcccaccccgacctgttcagcctgagagtgagaagcctggagctgtaccaccagctggtggccctggtgatggcctacagcttccaggagcccctggaggaggaggaggacgagaaggagcccaacagccccgtgatggtgcccgccgccgacatcctgaaccacctggccaaccacaacgccaacctggagtacagcgccaactgcctgagaatggtggccacccagcccatccccaagggccacgagatcttcaacacctacggccagatggccaactggcagctgatccacatgtacggcttcgtggagccctaccccgacaacaccgacgacaccgccgacatccagatggtgaccgtgagagaggccgccctgcagggcaccaagaccgaggccgagagacacctggtgtacgagagatgggacttcctgtgcaagctggagatggtgggcgaggagggcgccttcgtgatcggcagagaggaggtgctgaccgaggaggagctgaccaccaccctgaaggtgctgtgcatgcccgccgaggagttcagagagctgaaggaccaggacggcggcggcgacgacaagagagaggagggcagcctgaccatcaccaacatccccaagctgaaggccagctggagacagctgctgcagaacagcgtgctgctgaccctgcagacctacgccaccgacctgaagaccgaccagggcctgctgagcaacaaggaggtgtacgccaagctgagctggagagagcagcaggccctgcaggtgagatacggccagaagatgatcctgcaccagctgctggagctgaccagctag

SEQ ID NO: 9495 - DNA, 372 bp, Artificial Sequence
  Description of Artificial Sequence: Synthetic coding sequence
atggccacccaggccaagagacccagagtggccggccccgtggacggcggcgacctggaccccgtggcctgcttcctgagctggtgcagaagagtgggcctggagctgagccccaaggtgagcgagagagccgccggcagagcccccgtggccgcccacctgctgcacagaagacccgccggcgccagagccagctgcgccgccgagcccgtgggcctgggcgccaccgccgccggcgccgcccccagagccgccggccccggcctgaccctggaggccctgctgtgcgccctggccagagccggccccctgggcgcccccgacgtgctggtgagagccctgggcggcgtgggcgagagactgcacagatag

SEQ ID NO: 9496 - DNA, 810 bp, Artificial Sequence
  Description of Artificial Sequence: Synthetic coding sequence
atgctgttcttcacccagtgcttcggcgccgtgctggacctgatccacctgagattccagcactacaaggccaagagagtgttcagcgccgccggccagctggtgtgcgtggtgaaccccacccacaacctgaagtacgtgagcagcagaagagccgtgacccagagcgcccccgagcagggcagcttccacccccaccacctgagccaccaccactgccaccacagacaccaccaccacctgagacaccacgcccacccccaccacctgcaccaccaggaggccggcctgcacgccaaccccgtgaccccctgcctgtgcatgtgccccctgttcagctgccagtgggagggcagactggaggtggtggtgccccacctgagacagatccacagagtggacatcctgcagggcgccgagatcgtgttcctggccaccgacatgcacctgcccgcccccgccgactggatcatcatgcacagctgcctgggccaccacttcctgctggtgctgagaaagcaggagagacacgagggccacccccagttcttcgccaccatgatgctgatcggcacccccacccaggccgactgcttcacctacagactggagctgaacagaaaccacagaagactgaagtgggaggccacccccagaagcgtgctggagtgcgtggacagcgtgatcaccgacggcgactgcctggtgctgaacaccagcctggcccagctgttcagcgacaacggcagcctggccatcggcatcgccatcaccgccaccgaggtgctgcccagcgaggccgagatgtag

SEQ ID NO: 9497 - DNA, 1983 bp, Artificial Sequence
  Description of Artificial Sequence: Synthetic coding sequence
atgctggtgtgctacagcgtgctggcctgcgagatcctgtgggacctgccctgcagcatcatgggcagccccctgggccacttcacctgggacaagtacctgaaggagacctgcagcgtgcccgcccccgtgcactgcttcaagcagagctacaccccccccagcaacgagttcaagatcagcatgaagctggaggcccaggaccccagaaacaccaccagcacctgcatcgccaccgtggtgggcctgaccggcgccagactgagactgagactggacggcagcgacaacaagaacgacttctggagactggtggacagcgccgagatccagcccatcggcaactgcgagaagaacggcggcatgctgcagccccccctgggcttcagactgaacgccagcagctggcccatgttcctgctgaagaccctgaacggcgccgagatggcccccatcagaatcttccacaaggagccccccagccccagccacaacttcttcaagatgggcatgaagctggaggccgtggacagaaagaacccccacttcatctgccccgccaccatcggcgaggtgagaggcagcgaggtgctggtgaccttcgacggctggagaggcgccttcgactactggtgcagattcgacagcagagacatcttccccgtgggctggtgcagcctgaccggcgacaacctgcagccccccggcaccaaggtggtgatccccaagaacccctaccccgccagcgacgtgaacaccgagaagcccagcatccacagcagcaccaagaccgtgctggagcaccagcccggccagagaggcagaaagcccggcaagaagagaggcagaacccccaagaccctgatcagccaccccatcagcgcccccagcaagaccgccgagcccctgaagttccccaagaagagaggccccaagcccggcagcaagagaaagcccagaaccctgctgaaccccccccccgccagccccaccaccagcacccccgagcccgacaccagcaccgtgccccaggacgccgccaccatccccagcagcgccatgcaggcccccaccgtgtgcatctacctgaacaagaacggcagcaccggcccccacctggacaagaagaaggtgcagcagctgcccgaccacttcggccccgccagagccagcgtggtgctgcagcaggccgtgcaggcctgcatcgactgcgcctaccaccagaagaccgtgttcagcttcctgaagcagggccacggcggcgaggtgatcagcgccgtgttcgacagagagcagcacaccctgaacctgcccgccgtgaacagcatcacctacgtgctgagattcctggagaagctgtgccacaacctgagaagcgacaacctgttcggcaaccagcccttcacccagacccacctgagcctgaccgccatcgagtacagccacagccacgacagatacctgcccggcgagaccttcgtgctgggcaacagcctggccagaagcctggagccccacagcgacagcatggacagcgccagcaaccccaccaacctggtgagcaccagccagagacacagacccctgctgagcagctgcggcctgccccccagcaccgccagcgccgtgagaagactgtgcagcagaggcgtgctgaagggcagcaacgagagaagagacatggagagcttctggaagctgaacagaagccccggcagcgacagatacctggagagcagagacgccagcagactgagcggcagagaccccagcagctggaccgtggaggacgtgatgcagttcgtgagagaggccgacccccagctgggcccccacgccgacctgttcagaaagcacgagatcgacggcaaggccctgctgctgctgagaagcgacatgatgatgaagtacatgggcctgaagctgggccccgccctgaagctgagctaccacatcgacagactgaagcagggcaagttctag

SEQ ID NO: 9498 - DNA, 1947 bp, Artificial Sequence
  Description of Artificial Sequence: Synthetic coding sequence
atgcagcccaacgtgatcgactggagcgacgtgagaaagcacaagtacggccacctgagcgagagcgccagccagtaccaggaggccgccgacatcctggacctgggccacttcacctgggacaagtacctgaaggagacctgcagcgtgcccgcccccgtgcactgcttcaagcagagctacaccccccccagcaacgagttcaagatcagcatgaagctggaggcccaggaccccagaaacaccaccagcacctgcatcgccaccgtggtgggcctgaccggcgccagactgagactgagactggacggcagcgacaacaagaacgacttctggagactggtggacagcgccgagatccagcccatcggcaactgcgagaagaacggcggcatgctgcagccccccctgggcttcagactgaacgccagcagctggcccatgttcctgctgaagaccctgaacggcgccgagatggcccccatcagaatcttccacaaggagccccccagccccagccacaacttcttcaagatgggcatgaagctggaggccgtggacagaaagaacccccacttcatctgccccgccaccatcggcgaggtgagaggcagcgaggtgctggtgaccttcgacggctggagaggcgccttcgactactggtgcagattcgacagcagagacatcttccccgtgggctggtgcagcctgaccggcgacaacctgcagccccccggcaccaaggtggtgatccccaagaacccctaccccgccagcgacgtgaacaccgagaagcccagcatccacagcagcaccaagaccgtgctggagcaccagcccggccagagaggcagaaagcccggcaagaagagaggcagaacccccaagaccctgatcagccaccccatcagcgcccccagcaagaccgccgagcccctgaagttccccaagaagagaggccccaagcccggcagcaagagaaagcccagaaccctgctgaaccccccccccgccagccccaccaccagcacccccgagcccgacaccagcaccgtgccccaggacgccgccaccatccccagcagcgccatgcaggcccccaccgtgtgcatctacctgaacaagaacggcagcaccggcccccacctggacaagaagaaggtgcagcagctgcccgaccacttcggccccgccagagccagcgtggtgctgcagcaggccgtgcaggcctgcatcgactgcgcctaccaccagaagaccgtgttcagcttcctgaagcagggccacggcggcgaggtgatcagcgccgtgttcgacagagagcagcacaccctgaacctgcccgccgtgaacagcatcacctacgtgctgagattcctggagaagctgtgccacaacctgagaagcgacaacctgttcggcaaccagcccttcacccagacccacctgagcctgaccgccatcgagtacagccacagccacgacagatacctgcccggcgagaccttcgtgctgggcaacagcctggccagaagcctggagccccacagcgacagcatggacagcgccagcaaccccaccaacctggtgagcaccagccagagacacagacccctgctgagcagctgcggcctgccccccagcaccgccagcgccgtgagaagactgtgcagcagaggcagcgacagatacctggagagcagagacgccagcagactgagcggcagagaccccagcagctggaccgtggaggacgtgatgcagttcgtgagagaggccgacccccagctgggcccccacgccgacctgttcagaaagcacgagatcgacggcaaggccctgctgctgctgagaagcgacatgatgatgaagtacatgggcctgaagctgggccccgccctgaagctgagctaccacatcgacagactgaagcagggcaagttctag

SEQ ID NO: 9499 - DNA, 1734 bp, Artificial Sequence
  Description of Artificial Sequence: Synthetic coding sequence
atgaagctggaggcccaggaccccagaaacaccaccagcacctgcatcgccaccgtggtgggcctgaccggcgccagactgagactgagactggacggcagcgacaacaagaacgacttctggagactggtggacagcgccgagatccagcccatcggcaactgcgagaagaacggcggcatgctgcagccccccctgggcttcagactgaacgccagcagctggcccatgttcctgctgaagaccctgaacggcgccgagatggcccccatcagaatcttccacaaggagccccccagccccagccacaacttcttcaagatgggcatgaagctggaggccgtggacagaaagaacccccacttcatctgccccgccaccatcggcgaggtgagaggcagcgaggtgctggtgaccttcgacggctggagaggcgccttcgactactggtgcagattcgacagcagagacatcttccccgtgggctggtgcagcctgaccggcgacaacctgcagccccccggcaccaaggtggtgatccccaagaacccctaccccgccagcgacgtgaacaccgagaagcccagcatccacagcagcaccaagaccgtgctggagcaccagcccggccagagaggcagaaagcccggcaagaagagaggcagaacccccaagaccctgatcagccaccccatcagcgcccccagcaagaccgccgagcccctgaagttccccaagaagagaggccccaagcccggcagcaagagaaagcccagaaccctgctgaaccccccccccgccagccccaccaccagcacccccgagcccgacaccagcaccgtgccccaggacgccgccaccatccccagcagcgccatgcaggcccccaccgtgtgcatctacctgaacaagaacggcagcaccggcccccacctggacaagaagaaggtgcagcagctgcccgaccacttcggccccgccagagccagcgtggtgctgcagcaggccgtgcaggcctgcatcgactgcgcctaccaccagaagaccgtgttcagcttcctgaagcagggccacggcggcgaggtgatcagcgccgtgttcgacagagagcagcacaccctgaacctgcccgccgtgaacagcatcacctacgtgctgagattcctggagaagctgtgccacaacctgagaagcgacaacctgttcggcaaccagcccttcacccagacccacctgagcctgaccgccatcgagtacagccacagccacgacagatacctgcccggcgagaccttcgtgctgggcaacagcctggccagaagcctggagccccacagcgacagcatggacagcgccagcaaccccaccaacctggtgagcaccagccagagacacagacccctgctgagcagctgcggcctgccccccagcaccgccagcgccgtgagaagactgtgcagcagaggcagcgacagatacctggagagcagagacgccagcagactgagcggcagagaccccagcagctggaccgtggaggacgtgatgcagttcgtgagagaggccgacccccagctgggcccccacgccgacctgttcagaaagcacgagatcgacggcaaggccctgctgctgctgagaagcgacatgatgatgaagtacatgggcctgaagctgggccccgccctgaagctgagctaccacatcgacagactgaagcagggcaagttctag

SEQ ID NO: 9500 - DNA, 1776 bp, Artificial Sequence
  Description of Artificial Sequence: Synthetic coding sequence
atgcagagctacaccccccccagcaacgagttcaagatcagcatgaagctggaggcccaggaccccagaaacaccaccagcacctgcatcgccaccgtggtgggcctgaccggcgccagactgagactgagactggacggcagcgacaacaagaacgacttctggagactggtggacagcgccgagatccagcccatcggcaactgcgagaagaacggcggcatgctgcagccccccctgggcttcagactgaacgccagcagctggcccatgttcctgctgaagaccctgaacggcgccgagatggcccccatcagaatcttccacaaggagccccccagccccagccacaacttcttcaagatgggcatgaagctggaggccgtggacagaaagaacccccacttcatctgccccgccaccatcggcgaggtgagaggcagcgaggtgctggtgaccttcgacggctggagaggcgccttcgactactggtgcagattcgacagcagagacatcttccccgtgggctggtgcagcctgaccggcgacaacctgcagccccccggcaccaaggtggtgatccccaagaacccctaccccgccagcgacgtgaacaccgagaagcccagcatccacagcagcaccaagaccgtgctggagcaccagcccggccagagaggcagaaagcccggcaagaagagaggcagaacccccaagaccctgatcagccaccccatcagcgcccccagcaagaccgccgagcccctgaagttccccaagaagagaggccccaagcccggcagcaagagaaagcccagaaccctgctgaaccccccccccgccagccccaccaccagcacccccgagcccgacaccagcaccgtgccccaggacgccgccaccatccccagcagcgccatgcaggcccccaccgtgtgcatctacctgaacaagaacggcagcaccggcccccacctggacaagaagaaggtgcagcagctgcccgaccacttcggccccgccagagccagcgtggtgctgcagcaggccgtgcaggcctgcatcgactgcgcctaccaccagaagaccgtgttcagcttcctgaagcagggccacggcggcgaggtgatcagcgccgtgttcgacagagagcagcacaccctgaacctgcccgccgtgaacagcatcacctacgtgctgagattcctggagaagctgtgccacaacctgagaagcgacaacctgttcggcaaccagcccttcacccagacccacctgagcctgaccgccatcgagtacagccacagccacgacagatacctgcccggcgagaccttcgtgctgggcaacagcctggccagaagcctggagccccacagcgacagcatggacagcgccagcaaccccaccaacctggtgagcaccagccagagacacagacccctgctgagcagctgcggcctgccccccagcaccgccagcgccgtgagaagactgtgcagcagaggcagcgacagatacctggagagcagagacgccagcagactgagcggcagagaccccagcagctggaccgtggaggacgtgatgcagttcgtgagagaggccgacccccagctgggcccccacgccgacctgttcagaaagcacgagatcgacggcaaggccctgctgctgctgagaagcgacatgatgatgaagtacatgggcctgaagctgggccccgccctgaagctgagctaccacatcgacagactgaagcagggcaagttctag

SEQ ID NO: 9501 - DNA, 1800 bp, Artificial Sequence
  Description of Artificial Sequence: Synthetic coding sequence
atgaagctggaggcccaggaccccagaaacaccaccagcacctgcatcgccaccgtggtgggcctgaccggcgccagactgagactgagactggacggcagcgacaacaagaacgacttctggagactggtggacagcgccgagatccagcccatcggcaactgcgagaagaacggcggcatgctgcagccccccctgggcttcagactgaacgccagcagctggcccatgttcctgctgaagaccctgaacggcgccgagatggcccccatcagaatcttccacaaggagccccccagccccagccacaacttcttcaagatgggcatgaagctggaggccgtggacagaaagaacccccacttcatctgccccgccaccatcggcgaggtgagaggcagcgaggtgctggtgaccttcgacggctggagaggcgccttcgactactggtgcagattcgacagcagagacatcttccccgtgggctggtgcagcctgaccggcgacaacctgcagccccccggcaccaaggtggtgatccccaagaacccctaccccgccagcgacgtgaacaccgagaagcccagcatccacagcagcaccaagaccgtgctggagcaccagcccggccagagaggcagaaagcccggcaagaagagaggcagaacccccaagaccctgatcagccaccccatcagcgcccccagcaagaccgccgagcccctgaagttccccaagaagagaggccccaagcccggcagcaagagaaagcccagaaccctgctgaaccccccccccgccagccccaccaccagcacccccgagcccgacaccagcaccgtgccccaggacgccgccaccatccccagcagcgccatgcaggcccccaccgtgtgcatctacctgaacaagaacggcagcaccggcccccacctggacaagaagaaggtgcagcagctgcccgaccacttcggccccgccagagccagcgtggtgctgcagcaggccgtgcaggcctgcatcgactgcgcctaccaccagaagaccgtgttcagcttcctgaagcagggccacggcggcgaggtgatcagcgccgtgttcgacagagagcagcacaccctgaacctgcccgccgtgaacagcatcacctacgtgctgagattcctggagaagctgtgccacaacctgagaagcgacaacctgttcggcaaccagcccttcacccagacccacctgagcctgaccgccatcgagtacagccacagccacgacagatacctgcccggcgagaccttcgtgctgggcaacagcctggccagaagcctggagccccacagcgacagcatggacagcgccagcaaccccaccaacctggtgagcaccagccagagacacagacccctgctgagcagctgcggcctgccccccagcaccgccagcgccgtgagaagactgtgcagcagaggcgtgctgaagggcagcaacgagagaagagacatggagagcttctggaagctgaacagaagccccggcagcgacagatacctggagagcagagacgccagcagactgagcggcagagaccccagcagctggaccgtggaggacgtgatgcagttcgtgagagaggccgacccccagctgggcccccacgccgacctgttcagaaagcacgagatcgacggcaaggccctgctgctgctgagaagcgacatgatgatgaagtacatgggcctgaagctgggccccgccctgaagctgagctaccacatcgacagactgaagcagggcaagttctag

SEQ ID NO: 9502 - DNA, 1734 bp, Artificial Sequence; identical to SEQ ID NO: 9499
  Description of Artificial Sequence: Synthetic coding sequence

SEQ ID NO: 9503 - DNA, 1776 bp, Artificial Sequence; identical to SEQ ID NO: 9500
  Description of Artificial Sequence: Synthetic coding sequence

SEQ ID NO: 9504 - DNA, 1734 bp, Artificial Sequence; identical to SEQ ID NO: 9499
  Description of Artificial Sequence: Synthetic coding sequence

SEQ ID NO: 9505 - DNA, 1857 bp, Artificial Sequence
  Description of Artificial Sequence: Synthetic coding sequence
atgggcagccccctgggccacttcacctgggacaagtacctgaaggagacctgcagcgtgcccgcccccgtgcactgcttcaagcagagctacaccccccccagcaacgagttcaagatcagcatgaagctggaggcccaggaccccagaaacaccaccagcacctgcatcgccaccgtggtgggcctgaccggcgccagactgagactgagactggacggcagcgacaacaagaacgacttctggagactggtggacagcgccgagatccagcccatcggcaactgcgagaagaacggcggcatgctgcagccccccctgggcttcagactgaacgccagcagctggcccatgttcctgctgaagaccctgaacggcgccgagatggcccccatcagaatcttccacaaggagccccccagccccagccacaacttcttcaagatgggcatgaagctggaggccgtggacagaaagaacccccacttcatctgccccgccaccatcggcgaggtgagaggcagcgaggtgctggtgaccttcgacggctggagaggcgccttcgactactggtgcagattcgacagcagagacatcttccccgtgggctggtgcagcctgaccggcgacaacctgcagccccccggcaccaaggtggtgatccccaagaacccctaccccgccagcgacgtgaacaccgagaagcccagcatccacagcagcaccaagaccgtgctggagcaccagcccggccagagaggcagaaagcccggcaagaagagaggcagaacccccaagaccctgatcagccaccccatcagcgcccccagcaagaccgccgagcccctgaagttccccaagaagagaggccccaagcccggcagcaagagaaagcccagaaccctgctgaaccccccccccgccagccccaccaccagcacccccgagcccgacaccagcaccgtgccccaggacgccgccaccatccccagcagcgccatgcaggcccccaccgtgtgcatctacctgaacaagaacggcagcaccggcccccacctggacaagaagaaggtgcagcagctgcccgaccacttcggccccgccagagccagcgtggtgctgcagcaggccgtgcaggcctgcatcgactgcgcctaccaccagaagaccgtgttcagcttcctgaagcagggccacggcggcgaggtgatcagcgccgtgttcgacagagagcagcacaccctgaacctgcccgccgtgaacagcatcacctacgtgctgagattcctggagaagctgtgccacaacctgagaagcgacaacctgttcggcaaccagcccttcacccagacccacctgagcctgaccgccatcgagtacagccacagccacgacagatacctgcccggcgagaccttcgtgctgggcaacagcctggccagaagcctggagccccacagcgacagcatggacagcgccagcaaccccaccaacctggtgagcaccagccagagacacagacccctgctgagcagctgcggcctgccccccagcaccgccagcgccgtgagaagactgtgcagcagaggcagcgacagatacctggagagcagagacgccagcagactgagcggcagagaccccagcagctggaccgtggaggacgtgatgcagttcgtgagagaggccgacccccagctgggcccccacgccgacctgttcagaaagcacgagatcgacggcaaggccctgctgctgctgagaagcgacatgatgatgaagtacatgggcctgaagctgggccccgccctgaagctgagctaccacatcgacagactgaagcagggcaagttctag

SEQ ID NO: 9506 - DNA, 1983 bp, Artificial Sequence; identical to SEQ ID NO: 9497
  Description of Artificial Sequence: Synthetic coding sequence

SEQ ID NO: 9507 - DNA, 1443 bp, Artificial Sequence
  Description of Artificial Sequence: Synthetic coding sequence
atgcagagctacaccccccccagcaacgagttcaagatcagcatgaagctggaggcccaggaccccagaaacaccaccagcacctgcatcgccaccgtggtgggcctgaccggcgccagactgagactgagactggacggcagcgacaacaagaacgacttctggagactggtggacagcgccgagatccagcccatcggcaactgcgagaagaacggcggcatgctgcagccccccctggtggtgatccccaagaacccctaccccgccagcgacgtgaacaccgagaagcccagcatccacagcagcaccaagaccgtgctggagcaccagcccggccagagaggcagaaagcccggcaagaagagaggcagaacccccaagaccctgatcagccaccccatcagcgcccccagcaagaccgccgagcccctgaagttccccaagaagagaggccccaagcccggcagcaagagaaagcccagaaccctgctgaaccccccccccgccagccccaccaccagcacccccgagcccgacaccagcaccgtgccccaggacgccgccaccatccccagcagcgccatgcaggcccccaccgtgtgcatctacctgaacaagaacggcagcaccggcccccacctggacaagaagaaggtgcagcagctgcccgaccacttcggccccgccagagccagcgtggtgctgcagcaggccgtgcaggcctgcatcgactgcgcctaccaccagaagaccgtgttcagcttcctgaagcagggccacggcggcgaggtgatcagcgccgtgttcgacagagagcagcacaccctgaacctgcccgccgtgaacagcatcacctacgtgctgagattcctggagaagctgtgccacaacctgagaagcgacaacctgttcggcaaccagcccttcacccagacccacctgagcctgaccgccatcgagtacagccacagccacgacagatacctgcccggcgagaccttcgtgctgggcaacagcctggccagaagcctggagccccacagcgacagcatggacagcgccagcaaccccaccaacctggtgagcaccagccagagacacagacccctgctgagcagctgcggcctgccccccagcaccgccagcgccgtgagaagactgtgcagcagaggcagcgacagatacctggagagcagagacgccagcagactgagcggcagagaccccagcagctggaccgtggaggacgtgatgcagttcgtgagagaggccgacccccagctgggcccccacgccgacctgttcagaaagcacgagatcgacggcaaggccctgctgctgctgagaagcgacatgatgatgaagtacatgggcctgaagctgggccccgccctgaagctgagctaccacatcgacagactgaagcagggcaagttctag

SEQ ID NO: 9508 - DNA, 1245 bp, Artificial Sequence
  Description of Artificial Sequence: Synthetic coding sequence
atgcagagccagagaatccccggcagaaagagaggcagacccagcctgcacagcacccccatgaagatggccgtgcacaacctgtacagcgccagcgccggcagcctgcccgccgtgaagatccccaagaagagaggcagaaagcccggctacaagatcaagagcagagtgctgatgacccccctggccctgagcccccccagaagcacccccgagcccgacctgagcagcatcccccaggacgccgccaccgtgcccagcctggccgccccccaggccctgaccgtgtgcctgtacatcaacaagcaggccaacgccggcccctacctggagagaaagaaggtgcagcagctgcccgagcacttcggccccgagagacccagcgccgtgctgcagcaggccgtgcaggcctgcatcgactgcgcccaccagcagaagctggtgttcagcctggtgaagcagggctacggcggcgagatggtgagcgtgagcgccagcttcgacggcaagcagcacctgagaagcctgcccgtggtgaacagcatcggctacgtgctgagattcctggccaagctgtgcagaagcctgctgtgcgacgacctgttcagccaccagcccttccccagaggctgcagcgccagcgagaaggtgcaggagaaggaggagggcagaatggagagcgtgaagaccgtgaccaccgaggagtacctggtgaaccccgtgggcatgaacagatacagcgtggacaccagcgccagcaccttcaaccacagaggcagcctgcaccccagcagcagcctgtactgcaagagacagaacagcggcgacagccacctgggcggcggccccgccgccaccgccggcggccccagaaccagccccatgagcagcggcggccccagcgcccccggcctgagaccccccgccagcagccccaagagaaacaccaccagcctggagggcaacagatgcgccagcagccccagccaggacgcccaggacgccagaagacccagaagcagaaaccccagcgcctggaccgtggaggacgtggtgtggttcgtgaaggacgccgacccccaggccctgggcccccacgtggagctgttcagaaagcacgagatcgacggcaacgccctgctgctgctgaagagcgacatggtgatgaagtacctgggcctgaagctgggccccgccctgaagctgtgctaccacatcgacaagctgaagcaggccaagttctag

SEQ ID NO: 9509 - DNA, 918 bp, Artificial Sequence
  Description of Artificial Sequence: Synthetic coding sequence
atgccctgccagagaaccgcctggatcggctgcgacagacagagaaccccccccttccactggagagagatcaagagcagagtgctgatgacccccctggccctgagcccccccagaagcacccccgagcccgacctgagcagcatcccccaggacgccgccaccgtgcccagcctggccgccccccaggccctgaccgtgtgcctgtacatcaacaagcaggccaacgccggcccctacctggagagaaagaaggtgcagcagctgcccgagcacttcggccccgagagacccagcgccgtgctgcagcaggccgtgcaggcctgcatcgactgcgcccaccagcagaagctggtgttcagcctggtgaagcagggctacggcggcgagatggtgagcgtgagcgccagcttcgacggcaagcagcacctgagaagcctgcccgtggtgaacagcatcggctacgtgctgagattcctggccaagctgtgcagaagcctgctgtgcgacgacctgttcagccaccagcccttccccagaggctgcagcgccagcgagaaggtgcaggagaaggaggagggcagaatggagagcgtgaagaccgtgaccaccgaggagtacctggtgaaccccgtgggcatgaacagatacagcgtggacaccagcgccagcaccttcaaccacagaggcagcctgcaccccagcagcagcctgtactgcaagagacagaacagcggcgacagccacctgggcggcggccccgccgccaccgccggcggccccagaaccagccccatgagcagcggcggccccagcgcccccggcctgagaccccccgccagcagccccaagagaaacaccaccagcctggagggcaacagatgcggcaacgtgatgcacgccagcgccagccactag

SEQ ID NO: 9510 - DNA, 324 bp, Artificial Sequence
  Description of Artificial Sequence: Synthetic coding sequence
atggtgatcagagtgttcatcgccagcagcagcggcttcgtggccatcaagaagaagcagcaggacgtggtgagattcctggaggccaacaagatcgagttcgaggaggtggacatcaccatgagcgaggagcagagacagtggatgtacaagaacgtgccccccgagaagaagcccacccagggcaaccccctgcccccccagatcttcaacggcgacagatactgcggcgactacgacagcttcttcgagagcaaggagagcaacaccgtgttcagcttcctgggcctgaagcccagactggccagcaaggccgagccctag

SEQ ID NO: 9511 - DNA, 960 bp, Artificial Sequence
  Description of Artificial Sequence: Synthetic coding sequence
atggaggagctgaccgccttcgtgagcaagagcttcgaccagaaggtgaaggagaagaaggaggccatcacctacagagaggtgctggagagcggccccctgagaggcgccaaggagcccaccggctgcaccgaggccggcagagacgacagaagcagccccgccgtgagagccgccggcggcggcggcggcggcggcggcggcggcggcggcggcggcggcggcggcggcgtgggcggcggcggcgccggcggcggcgccggcggcggcagaagccccgtgagagagctggacatgggcgccgccgagagaagcagagagcccggcagccccagactgaccgaggtgagccccgagctgaaggacagaaaggaggacgccaagggcatggaggacgagggccagaccaagatcaagcagagaagaagcagaaccaacttcaccctggagcagctgaacgagctggagagactgttcgacgagacccactaccccgacgccttcatgagagaggagctgagccagagactgggcctgagcgaggccagagtgcaggtgtggttccagaacagaagagccaagtgcagaaagcaggagaaccagctgcacaagggcgtgctgatcggcgccgccagccagttcgaggcctgcagagtggccccctacgtgaacgtgggcgccctgagaatgcccttccagcaggtgcaggcccagctgcagctggacagcgccgtggcccacgcccaccaccacctgcacccccacctggccgcccacgccccctacatgatgttccccgccccccccttcggcctgcccctggccaccctggccgccgacagcgccagcgccgccagcgtggtggccgccgccgccgccgccaagaccaccagcaagaacagcagcatcgccgacctgagactgaaggccaagaagcacgccgccgccctgggcctgtag

SEQ ID NO: 9512 - DNA, 663 bp, Artificial Sequence
  Description of Artificial Sequence: Synthetic coding sequence
atgaacggcttcacccccgacgagatgagcagaggcggcgacgccgccgccgccgtggccgccgtggtggccgccgccgccgccgccgccagcgccggcaacggcaccggcgccggcaccggcgccgaggtgcccggcgccggcgccgtgagcgccgccggcccccccggcgccgccggccccggccccggccagctgtgctgcctgagagaggacggcgagagatgcggcagagccgccggcaacgccagcttcagcaagagaatccagaagagcatcagccagaagaaggtgaagatcgagctggacaagagcgccagacacctgtacatctgcgactaccacaagaacctgatccagagcgtgagaaacagaagaaagagaaagggcagcgacgacgacggcggcgacagccccgtgcaggacatcgacacccccgaggtggacctgtaccagctgcaggtgaacaccctgagaagatacaagagacacttcaagctgcccaccagacccggcctgaacaaggcccagctggtggagatcgtgggctgccacttcagaagcatccccgtgaacgagaaggacaccctgacctacttcatctacagcgtgaagaacgacaagaacaagagcgacctgaaggtggacagcggcgtgcactag

SEQ ID NO: 9513 - DNA, 828 bp, Artificial Sequence
  Description of Artificial Sequence: Synthetic coding sequence
atgggccccgccggcgtggccgccagacccggcagattcttcggcgtgtacctgctgtactgcctgaaccccagatacagaggcagagtgtacgtgggcttcaccgtgaacaccgccagaagagtgcagcagcacaacggcggcagaaagaagggcggcgcctggagaaccagcggcagaggcccctgggagatggtgctggtggtgcacggcttccccagcagcgtggccgccctgagattcgagtgggcctggcagcacccccacgccagcagaagactggcccacgtgggccccagactgagaggcgagaccgccttcgccttccacctgagagtgctggcccacatgctgagagcccccccctgggccagactgcccctgaccctgagatgggtgagacccgacctgagacaggacctgtgcctgcccccccccccccacgtgcccctggccttcggccccccccccccccaggcccccgcccccagaagaagagccggccccttcgacgacgccgagcccgagcccgaccagggcgaccccggcgcctgctgcagcctgtgcgcccagaccatccaggacgaggagggccccctgtgctgcccccaccccggctgcctgctgagagcccacgtgatctgcctggccgaggagttcctgcaggaggagcccggccagctgctgcccctggagggccagtgcccctgctgcgagaagagcctgctgtggggcgacctgatctggctgtgccagatggacaccgagaaggaggtggaggacagcgagctggaggaggcccactggaccgacctgctggagacctag

SEQ ID NO: 9514 - DNA, 486 bp, Artificial Sequence
  Description of Artificial Sequence: Synthetic coding sequence
atgggccccgccggcgtggccgccagacccggcagattcttcggcgtgtacctgctgtactgcctgaaccccagatacagaggcagagtgtacgtgggcttcaccgtgaacaccgccagaagagtgcagcagcacaacggcggcagaaagaagggcggcgcctggagaaccagcggcagaggcccctgggagatggtgctggtggtgcacggcttccccagcagcgtggccgccctgagagacgaggagggccccctgtgctgcccccaccccggctgcctgctgagagcccacgtgatctgcctggccgaggagttcctgcaggaggagcccggccagctgctgcccctggagggccagtgcccctgctgcgagaagagcctgctgtggggcgacctgatctggctgtgccagatggacaccgagaaggaggtggaggacagcgagctggaggaggcccactggaccgacctgctggagacctag

SEQ ID NO: 9515 - DNA, 765 bp, Artificial Sequence
  Description of Artificial Sequence: Synthetic coding sequence
atgggccccgccggcgtggccgccagacccggcagattcttcggcgtgtacctgctgtactgcctgaaccccagatacagaggcagagtgtacgtgggcttcaccgtgaacaccgccagaagagtgcagcagcacaacggcggcagaaagaagggcggcgcctggagaaccagcggcagaggcccctgggagatggtgctggtggtgcacggcttccccagcagcgtggccgccctgagattcgagtgggcctggcagcacccccacgccagcagaagactggcccacgtgggccccagactgagaggcgagaccgccttcgccttccacctgagagtgctggcccacatgctgagagcccccccctgggccagactgcccctgaccctgagatgggtgagacccgacctgagacaggacctgtgcctgcccccccccccccacgtgcccctggccttcggccccccccccccccaggcccccgcccccagaagaagagccggccccttcgacgacgccgagcccgagcccgaccagggcgaccccggcgcctgctgcagcctgtgcgcccagaccatccaggacgaggagggccccctgtgctgcccccaccccggctgcctgctgagagcccacgtgatctgcctggccgaggagttcctgcaggaggagcccggccagctgctgcccctggagggccagtgcccctgctgcgagaagagcgccctgggcagacccgacctggccgtgcccgacggccactag

SEQ ID NO: 9516 - DNA, 828 bp, Artificial Sequence; identical to SEQ ID NO: 9513
  Description of Artificial Sequence: Synthetic coding sequence

SEQ ID NO: 9517 - DNA, 486 bp, Artificial Sequence; identical to SEQ ID NO: 9514
  Description of Artificial Sequence: Synthetic coding sequence

SEQ ID NO: 9518 - DNA, 765 bp, Artificial Sequence; identical to SEQ ID NO: 9515
  Description of Artificial Sequence: Synthetic coding sequence

SEQ ID NO: 9519 - DNA, 372 bp, Artificial Sequence
  Description of Artificial Sequence: Synthetic coding sequence
atggtggtgcaggaccccctgctgtgcgacctgcccatccaggtgaccctggaggaggtgaacagccagatcgccctggagtacggccaggccatgaccgtgagagtgtgcaagatggacggcgaggtgatgcccgtggtggtggtgcagagcgccaccgtgctggacctgaagaaggccatccagagatacgtgcagctgaagcaggagagagagggcggcatccagcacatcagctggagctacgtgtggagaacctaccacctgaccagcgccggcgagaagctgaccgaggacagaaagaagctgagagactacggcatcagaaacagagacgaggtgagcttcatcaagaagctgagacagaagtag

SEQ ID NO: 9520 - DNA, 399 bp, Artificial Sequence
  Description of Artificial Sequence: Synthetic coding sequence
atggacgtgttccaggagggcctggccatggtggtgcaggaccccctgctgtgcgacctgcccatccaggtgaccctggaggaggtgaacagccagatcgccctggagtacggccaggccatgaccgtgagagtgtgcaagatggacggcgaggtgatgcccgtggtggtggtgcagagcgccaccgtgctggacctgaagaaggccatccagagatacgtgcagctgaagcaggagagagagggcggcatccagcacatcagctggagctacgtgtggagaacctaccacctgaccagcgccggcgagaagctgaccgaggacagaaagaagctgagagactacggcatcagaaacagagacgaggtgagcttcatcaagaagctgagacagaagtag

SEQ ID NO: 9521 - DNA, 468 bp, Artificial Sequence
  Description of Artificial Sequence: Synthetic coding sequence
atgggcagaagcagaagcagaagccccagaagagagagaagaagaagcagaagcaccagcagagagagagagagaagaagaagagagagaagcagaagcagagagagagacagaagaagaagcagaagcagaagcccccacagaagaagaagcagaagccccagaagacacagaagcaccagccccagccccagcagactgaaggagagaagagacgaggagaagaaggagaccaaggagaccaagagcaaggagagacagatcaccgaggaggacctggagggcaagaccgaggaggagatcgagatgatgaagctgatgggcttcgccagcttcgacagcaccaagggcaagaaggtggacggcagcgtgaacgcctacgccatcaacgtgagccagaagagaaagtacagacagtacatgaacagaaagggcggcttcaacagacccctggacttcatcgcctag

SEQ ID NO: 9522 - DNA, 468 bp, Artificial Sequence; identical to SEQ ID NO: 9521
  Description of Artificial Sequence: Synthetic coding sequence

SEQ ID NO: 9523 - DNA, 741 bp, Artificial Sequence
  Description of Artificial Sequence: Synthetic coding sequence
atgaacgactggatgcccatcgccaaggagtacgaccccctgaaggccggcagcatcgacggcaccgacgaggacccccacgacagagccgtgtggagagccatgctggccagatacgtgcccaacaagggcgtgatcggcgaccccctgctgaccctgttcgtggccagactgaacctgcagaccaaggaggacaagctgaaggaggtgttcagcagatacggcgacatcagaagactgagactggtgagagacctggtgaccggcttcagcaagggctacgccttcatcgagtacaaggaggagagagccgtgatcaaggcctacagagacgccgacggcctggtgatcgaccagcacgagatcttcgtggactacgagctggagagaaccctgaagggctggatccccagaagactgggcggcggcctgggcggcaagaaggagagcggccagctgagattcggcggcagagacagacccttcagaaagcccatcaacctgcccgtggtgaagaacgacctgtacagagagggcaagagagagagaagagagagaagcagaagcagagagagacactgggacagcagaaccagagacagagaccacgacagaggcagagagaagagatggcaggagagagagcccaccagagtgtggcccgacaacgactgggagagagagagagacttcagagacgacagaatcaagggcagagagaagaaggagagaggcaagtag

SEQ ID NO: 9524 - DNA, 756 bp, Artificial Sequence
  Description of Artificial Sequence: Synthetic coding sequence
atgaagcccgccaacatgaacgactggatgcccatcgccaaggagtacgaccccctgaaggccggcagcatcgacggcaccgacgaggacccccacgacagagccgtgtggagagccatgctggccagatacgtgcccaacaagggcgtgatcggcgaccccctgctgaccctgttcgtggccagactgaacctgcagaccaaggaggacaagctgaaggaggtgttcagcagatacggcgacatcagaagactgagactggtgagagacctggtgaccggcttcagcaagggctacgccttcatcgagtacaaggaggagagagccgtgatcaaggcctacagagacgccgacggcctggtgatcgaccagcacgagatcttcgtggactacgagctggagagaaccctgaagggctggatccccagaagactgggcggcggcctgggcggcaagaaggagagcggccagctgagattcggcggcagagacagacccttcagaaagcccatcaacctgcccgtggtgaagaacgacctgtacagagagggcaagagagagagaagagagagaagcagaagcagagagagacactgggacagcagaaccagagacagagaccacgacagaggcagagagaagagatggcaggagagagagcccaccagagtgtggcccgacaacgactgggagagagagagagacttcagagacgacagaatcaagggcagagagaagaaggagagaggcaagtag

SEQ ID NO: 9525 - DNA, 741 bp, Artificial Sequence; identical to SEQ ID NO: 9523
  Description of Artificial Sequence: Synthetic coding sequence

SEQ ID NO: 9526 - DNA, 1371 bp, Artificial Sequence
  Description of Artificial Sequence: Synthetic coding sequence
atggagcccagatgcccccccccctgcggctgctgcgagagactggtgctgaacgtggccggcctgagattcgagaccagagccagaaccctgggcagattccccgacaccctgctgggcgaccccgccagaagaggcagattctacgacgacgccagaagagagtacttcttcgacagacacagacccagcttcgacgccgtgctgtactactaccagagcggcggcagactgagaagacccgcccacgtgcccctggacgtgttcctggaggaggtggccttctacggcctgggcgccgccgccctggccagactgagagaggacgagggctgccccgtgccccccgagagacccctgcccagaagagccttcgccagacagctgtggctgctgttcgagttccccgagagcagccaggccgccagagtgctggccgtggtgagcgtgctggtgatcctggtgagcatcgtggtgttctgcctggagaccctgcccgacttcagagacgacagagacggcaccggcctggccgccgccgccgccgccggccccttccccgcccccctgaacggcagcagccagatgcccggcaacccccccagactgcccttcaacgaccccttcttcgtggtggagaccctgtgcatctgctggttcagcttcgagctgctggtgagactgctggtgtgccccagcaaggccatcttcttcaagaacgtgatgaacctgatcgacttcgtggccatcctgccctacttcgtggccctgggcaccgagctggccagacagagaggcgtgggccagcaggccatgagcctggccatcctgagagtgatcagactggtgagagtgttcagaatcttcaagctgagcagacacagcaagggcctgcagatcctgggccagaccctgagagccagcatgagagagctgggcctgctgatcttcttcctgttcatcggcgtggtgctgttcagcagcgccgtgtacttcgccgaggtggacagagtggacagccacttcaccagcatccccgagagcttctggtgggccgtggtgaccatgaccaccgtgggctacggcgacatggcccccgtgaccgtgggcggcaagatcgtgggcagcctgtgcgccatcgccggcgtgctgaccatcagcctgcccgtgcccgtgatcgtgagcaacttcagctacttctaccacagagagaccgagggcgaggaggccggcatgttcagccacgtggacatgcagccctgcggccccctggagggcaaggccaacggcggcctggtggacggcgaggtgcccgagctgcccccccccctgtgggccccccccggcaagcacctggtgaccgaggtgtag

SEQ ID NO: 9527 - DNA, 501 bp, Artificial Sequence
  Description of Artificial Sequence: Synthetic coding sequence
atgacccagttcctgccccccaacctgctggccctgttcgcccccagagaccccatcccctacctgccccccctggagaagctgccccacgagaagcaccacaaccagccctactgcggcatcgccccctacatcagagagttcgaggaccccagagacgcccccccccccaccagagccgagaccagagaggagagaatggagagaaagagaagagagaagatcgagagaagacagcaggaggtggagaccgagctgaagatgtgggacccccacaacgaccccaacgcccagggcgacgccttcaagaccctgttcgtggccagagtgaactacgacaccaccgagagcaagctgagaagagagttcgaggtgtacggccccatcaagagaatccacatggtgtacagcaagagaagcggcaagcccagaggctacgccttcatcgagtacgagcacgagagagacatgcacagcaccacccagctggcctgcagctag

SEQ ID NO: 9528 - DNA, 114 bp, Artificial Sequence
  Description of Artificial Sequence: Synthetic coding sequence
gccgccgccgccgccgccagcctgagaaccgacgccagagccagaagatacgccacctggcaggacgaccccgtgcccgccgcccagcccagcggccccctgtgccccccctag

SEQ ID NO: 9529 - DNA, 1026 bp, Artificial Sequence
  Description of Artificial Sequence: Synthetic coding sequence
atggagcaggccctgcacagattcggcagaggcctggtgtggctgagcgtggcctggctgagcgtgggcagagtgagagtgagagacgacggcgacaccggcagaggcttctgcagagccggccccgtgctgaccagaggccccagcggcgacagcagccccctgcccctgcccaccagcgtgaccgccgcctacaagcacgccgacggcaagaagatcgacggcagaagagtgctggtggacgtggagagaggcagaaccgtgaagggctggagacccagaagactgggcggcggcctgggcggcaccagaagaggcggcgccgacgtgaacatcagacacagcggcagagacgacaccagcagatacgacgagagacccggccccagccccctgccccacagagacagagacagagacagagagagagagagaagagagagaagcagagagagagacaaggagagagagagaagaagaagcagaagcagagacagaagaagaagaagcagaagcagagacaaggaggagagaagaagaagcagagagagaagcaaggacaaggacagagacagaaagagaagaagcagcagaagcagagagagagccagaagagagagagagagaaaggaggagctgagaggcggcggcggcgacatggccgagcccagcgaggccggcgacgccccccccgacgacggcccccccggcgagctgggccccgacggccccgacggccccgaggagaagggcagagacagagacagagagagaagaagaagccacagaagcgagagagagagaagaagagacagagacagagacagagacagagacagagagcacaagagaggcgagagaggcagcgagagaggcagagacgaggccagaggcggcggcggcggccaggacaacggcctggagggcctgggcaacgacagcagagacatgtacatggagagcgagggcggcgacggctacctggcccccgagaacggctacctgatggaggccgcccccgagtag

SEQ ID NO: 9530 - DNA, 1314 bp, Artificial Sequence
  Description of Artificial Sequence: Synthetic coding sequence
atgacccagttcctgccccccaacctgctggccctgttcgcccccagagaccccatcccctacctgccccccctggagaagctgccccacgagaagcaccacaaccagccctactgcggcatcgccccctacatcagagagttcgaggaccccagagacgcccccccccccaccagagccgagaccagagaggagagaatggagagaaagagaagagagaagatcgagagaagacagcaggaggtggagaccgagctgaagatgtgggacccccacaacgaccccaacgcccagggcgacgccttcaagaccctgttcgtggccagagtgaactacgacaccaccgagagcaagctgagaagagagttcgaggtgtacggccccatcaagagaatccacatggtgtacagcaagagaagcggcaagcccagaggctacgccttcatcgagtacgagcacgagagagacatgcacagcgcctacaagcacgccgacggcaagaagatcgacggcagaagagtgctggtggacgtggagagaggcagaaccgtgaagggctggagacccagaagactgggcggcggcctgggcggcaccagaagaggcggcgccgacgtgaacatcagacacagcggcagagacgacaccagcagatacgacgagagacccggccccagccccctgccccacagagacagagacagagacagagagagagagagaagagagagaagcagagagagagacaaggagagagagagaagaagaagcagaagcagagacagaagaagaagaagcagaagcagagacaaggaggagagaagaagaagcagagagagaagcaaggacaaggacagagacagaaagagaagaagcagcagaagcagagagagagccagaagagagagagagagaaaggaggagctgagaggcggcggcggcgacatggccgagcccagcgaggccggcgacgccccccccgacgacggcccccccggcgagctgggccccgacggccccgacggccccgaggagaagggcagagacagagacagagagagaagaagaagccacagaagcgagagagagagaagaagagacagagacagagacagagacagagacagagagcacaagagaggcgagagaggcagcgagagaggcagagacgaggccagaggcggcggcggcggccaggacaacggcctggagggcctgggcaacgacagcagagacatgtacatggagagcgagggcggcgacggctacctggcccccgagaacggctacctgatggaggccgcccccgagtag

SEQ ID NO: 9531 - DNA, 678 bp, Artificial Sequence
  Description of Artificial Sequence: Synthetic coding sequence
atggacatcagacccaaccacaccatctacatcaacaacatgaacgacaagatcaagaaggaggagctgaagagaagcctgtacgccctgttcagccagttcggccacgtggtggacatcgtggccctgaagaccatgaagatgagaggccaggccttcgtgatcttcaaggagctgggcagcagcaccaacgccctgagacagctgcagggcttccccttctacggcaagcccatgagaatccagtacgccaagaccgacagcgacatcatcagcaagatgagaggcaccttcgccgacaaggagaagaagaaggagaagaagaaggccaagaccgtggagcagaccgccaccaccaccaacaagaagcccggccagggcacccccaacagcgccaacacccagggcaacagcacccccaacccccaggtgcccgactacccccccaactacatcctgttcctgaacaacctgcccgaggagaccaacgagatgatgctgagcatgctgttcaaccagttccccggcttcaaggaggtgagactggtgcccggcagacacgacatcgccttcgtggagttcgagaacgacggccaggccggcgccgccagagacgccctgcagggcttcaagatcacccccagccacgccatgaagatcacctacgccaagaagtag

SEQ ID NO: 9532 - DNA, 678 bp, Artificial Sequence; identical to SEQ ID NO: 9531
  Description of Artificial Sequence: Synthetic coding sequence

SEQ ID NO: 9533 - DNA, 2142 bp, Artificial Sequence
  Description of Artificial Sequence: Synthetic coding sequence
atgagcaccagaacccccctgcccaccgtgaacgagagagacaccgagaaccacaccagccacggcgacggcagacaggaggtgaccagcagaaccagcagaagcggcgccagatgcagaaacagcatcgccagctgcgccgacgagcagccccacatcggcaactacagactgctgaagaccatcggcaagggcaacttcgccaaggtgaagctggccagacacatcctgaccggcagagaggtggccatcaagatcatcgacaagacccagctgaaccccaccagcctgcagaagctgttcagagaggtgagaatcatgaagatcctgaaccaccccaacatcgtgaagctgttcgaggtgatcgagaccgagaagaccctgtacctgatcatggagtacgccagcggcggcgaggtgttcgactacctggtggcccacggcagaatgaaggagaaggaggccagaagcaagttcagacagatcgtgagcgccgtgcagtactgccaccagaagagaatcgtgcacagagacctgaaggccgagaacctgctgctggacgccgacatgaacatcaagatcgccgacttcggcttcagcaacgagttcaccgtgggcggcaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagagattcctggtgctgaaccccatcaagagaggcaccctggagcagatcatgaaggacagatggatcaacgccggccacgaggaggacgagctgaagcccttcgtggagcccgagctggacatcagcgaccagaagagaatcgacatcatggtgggcatgggctacagccaggaggagatccaggagagcctgagcaagatgaagtacgacgagatcaccgccacctacctgctgctgggcagaaagagcagcgaggtgagacccagcagcgacctgaacaacagcaccggccagagcccccaccacaaggtgcagagaagcgtgttcagcagccagaagcagagaagatacagcgaccacgccggccccgccatccccagcgtggtggcctaccccaagagaagccagaccagcaccgccgacagcgacctgaaggaggacggcatcagcagcagaaagagcagcggcagcgccgtgggcggcaagggcatcgcccccgccagccccatgctgggcaacgccagcaaccccaacaaggccgacatccccgagagaaagaagagcagcaccgtgcccagcagcaacaccgccagcggcggcatgaccagaagaaacacctacgtgtgcagcgagagaaccaccgccgacagacacagcgtgatccagaacggcaaggagaacagcaccatccccgaccagagaacccccgtggccagcacccacagcatcagcagcgccgccacccccgacagaatcagattccccagaggcaccgccagcagaagcaccttccacggccagcccagagagagaagaaccgccacctacaacggcccccccgccagccccagcctgagccacgaggccacccccctgagccagaccagaagcagaggcagcaccaacctgttcagcaagctgaccagcaagctgaccagaagcagaaacgtgagcgccgagcagaaggacgagaacaaggaggccaagcccagaagcctgagattcacctggagcatgaagaccaccagcagcatggaccccggcgacatgatgagagagatcagaaaggtgctggacgccaacaactgcgactacgagcagagagagagattcctgctgttctgcgtgcacggcgacggccacgccgagaacctggtgcagtgggagatggaggtgtgcaagctgcccagactgagcctgaacggcgtgagattcaagagaatcagcggcaccagcatcgccttcaagaacatcgccagcaagatcgccaacgagctgaagctgtag

SEQ ID NO: 9534 - DNA, 1059 bp, Artificial Sequence
  Description of Artificial Sequence: Synthetic coding sequence
atggcccccaagctgatcaccgtgctgtgcctgggcttctgcctgaaccagaagatctgcccccacgccggcgcccaggacaagttcagcctgagcgcctggcccagccccgtggtgcccctgggcggcagagtgaccctgagctgccacagccacctgagattcgtgatctggaccatcttccagaccaccggcaccagaagccacgagctgcacaccggcctgagcaacaacatcaccatcagccccgtgacccccgagcacgccggcacctacagatgcgtgggcatctacaagcacgccagcaagtggagcgccgagagcaacagcctgaagatcatcgtgaccggcctgttcaccaagcccagcatcagcgcccaccccagcagcctggtgcacgccggcgccagagtgagcctgagatgccacagcgagctggccttcgacgagttcatcctgtacaaggagggccacatccagcacagccagcagctggaccagggcatggaggccggcatccactacgtggaggccgtgttcagcatgggccccgtgacccccgcccacgccggcgcctacagatgctgcggctgcttcagccacagcagatacgagtggagcgcccccagcgaccccctggacatcgtgatcaccggcaagtacaagaagcccagcctgagcacccaggtggaccccatgatgagactgggcgagaagctgaccctgttctgcagcagcgagatcagcttcgaccagtaccacctgttcagacacggcgtggcccacggccagtggctgagcggcggccagagacacagagaggccttccaggccaacttcagcgtgggcagagccacccccgtgcccggcggcacctacagatgctacggcagcttcaacgacagcccctacaagccccccgtgaccagatgcaacttcaccccccaggagaccctgagagtgctgctgtgccacagccagaacccccccctgaacctgacccacctggccctgaaggacagccccgccacctgcatctgcagcctggacagccagtag

SEQ ID NO: 9535 - DNA, 75 bp, Artificial Sequence
  Description of Artificial Sequence: Synthetic coding sequence
ctggccagcagctgggacctgagccccgagcccgtgcccgagagcctgggcccccccgtgggccccggcctgtag

SEQ ID NO: 9536 - DNA, 375 bp, Artificial Sequence
  Description of Artificial Sequence: Synthetic coding sequence
atgctggtgctgggcagccagaagctgacccagctgagagacagcatcagatgcgtgagcgacctgcagatcggcggcgagttcagcaacacccccgaccaggcccccgagcacatcagcaaggacctgtacaagagcgccttcttctacttcgagggcaccttctacaacgacaagagataccccgagtgcagagacctgagcagaaccatcatcgagtggagcgagagccacgacagaggctacggcaagttccagaccgccagaatggaggacttcaccttcaacgacctgtgcatcaagctgggcttcccctacctgtactgccaccagggcgactgcgagcacgtgatcgtgatcaccgacatcagatag

SEQ ID NO: 9537 - DNA, 732 bp, Artificial Sequence
  Description of Artificial Sequence: Synthetic coding sequence
atggccgagggcagcagaggcggccccacctgcagcggcgtgggcggcagacaggaccccgtgagcggcagcggcggctgcaacttccccgagtacgagctgcccgagctgaacaccagagccttccacgtgggcgccttcggcgagctgtggagaggcagactgagaggcgccggcgacctgagcctgagagagccccccgccagcgccctgcccggcagccaggccgccgacagcgacagagaggacgccgccgtggccagagacctggactgcagcctggaggccgccgccgagctgagagccgtgtgcggcctggacaagctgaagtgcctggaggacggcgaggaccccgaggtgatccccgagaacaccgacctggtgaccctgggcgtgagaaagagattcctggagcacagagaggagaccatcaccatcgacagagcctgcagacaggagaccttcgtgtacgagatggagagccacgccatcggcaagaagcccgagaacagcgccgacatgatcgaggagggcgagctgatcctgagcgtgaacatcctgtaccccgtgatcttccacaaggacctgtacaagagcgccttcttctacttcgagggcaccttctacaacgacaagagataccccgagtgcagagacctgagcagaaccatcatcgagtggagcgagagccacgacagaggctacggcaagttccagaccgccagaatgtag

SEQ ID NO: 9538 - DNA, 1236 bp, Artificial Sequence
  Description of Artificial Sequence: Synthetic coding sequence
atggccgagggcagcagaggcggccccacctgcagcggcgtgggcggcagacaggaccccgtgagcggcagcggcggctgcaacttccccgagtacgagctgcccgagctgaacaccagagccttccacgtgggcgccttcggcgagctgtggagaggcagactgagaggcgccggcgacctgagcctgagagagccccccgccagcgccctgcccggcagccaggccgccgacagcgacagagaggacgccgccgtggccagagacctggactgcagcctggaggccgccgccgagctgagagccgtgtgcggcctggacaagctgaagtgcctggaggacggcgaggaccccgaggtgatccccgagaacaccgacctggtgaccctgggcgtgagaaagagattcctggagcacagagaggagaccatcaccatcgacagagcctgcagacaggagaccttcgtgtacgagatggagagccacgccatcggcaagaagcccgagaacagcgccgacatgatcgaggagggcgagctgatcctgagcgtgaacatcctgtaccccgtgatcttccacaagcacaaggagcacaagccctaccagaccatgctggtgctgggcagccagaagctgacccagctgagagacagcatcagatgcgtgagcgacctgcagatcggcggcgagttcagcaacacccccgaccaggcccccgagcacatcagcaaggacctgtacaagagcgccttcttctacttcgagggcaccttctacaacgacaagagataccccgagtgcagagacctgagcagaaccatcatcgagtggagcgagagccacgacagaggctacggcaagttccagaccgccagaatggaggacttcaccttcaacgacctgtgcatcaagctgggcttcccctacctgtactgccaccagggcgactgcgagcacgtgatcgtgatcaccgacatcagactggtgcaccacgacgactgcctggacagaaccctgtaccccctgctgatcaagaagcactggctgtggaccagaaagtgcttcgtgtgcaagatgtacaccgccagatgggtgaccaacaacgacagcttcgcccccgaggacccctgcttcttctgcgacgtgtgcttcagaatgctgcactacgacagcgagggcaacaagctgggcgagttcctggcctacccctacgtggaccccggcaccttcaactag

SEQ ID NO: 9539 - DNA, 732 bp, Artificial Sequence; identical to SEQ ID NO: 9537
  Description of Artificial Sequence: Synthetic coding sequence

SEQ ID NO: 9540 - DNA, 657 bp, Artificial Sequence
  Description of Artificial Sequence: Synthetic coding sequence
atggccgagggcagcagaggcggccccacctgcagcggcgtgggcggcagacaggaccccgtgagcggcagcggcggctgcaacttccccgagtacgagctgcccgagctgaacaccagagccttccacgtgggcgccttcggcgagctgtggagaggcagactgagaggcgccagagacctggactgcagcctggaggccgccgccgagctgagagccgtgtgcggcctggacaagctgaagtgcctggaggacggcgaggaccccgaggtgatccccgagaacaccgacctggtgaccctgggcgtgagaaagagattcctggagcacagagaggagaccatcaccatcgacagagcctgcagacaggagaccttcgtgtacgagatggagagccacgccatcggcaagaagcccgagaacagcgccgacatgatcgaggagggcgagctgatcctgagcgtgaacatcctgtaccccgtgatcttccacaagcacaaggagcacaagccctaccagaccatgctggtgctgggcagccagaagctgacccagctgagagacagcatcagatgcgtgagcgacctgcagatcggcggcgagttcagcaacacccccgaccaggcccccgagcacatcagcaagaactaccactag

SEQ ID NO: 9541 - DNA, 1236 bp, Artificial Sequence; identical to SEQ ID NO: 9538
  Description of Artificial Sequence: Synthetic coding sequence

SEQ ID NO: 9542 - DNA, 1236 bp, Artificial Sequence; identical to SEQ ID NO: 9538
  Description of Artificial Sequence: Synthetic coding sequence

SEQ ID NO: 9543 - DNA, 4410 bp, Artificial Sequence
  Description of Artificial Sequence: Synthetic coding sequence
atggacgtggacgccgagagagagaagatcacccaggagatcaaggagctggagagaatcctggaccccggcagcagcggcagccacgtggagatcagcgagagcagcctggagagcgacagcgaggccgacagcctgcccagcgaggacctggaccccgccgacccccccatcagcgaggaggagagatggggcgaggccagcaacgacgaggacgaccccaaggacaagaccctgcccgaggaccccgagacctgcctgcagctgaacatggtgtaccaggaggtgatccaggagaagctggccgaggccaacctgctgctggcccagaacagagagcagcaggaggagctgatgagagacctggccggcagcaagggcaccaaggtgaaggacggcaagagcctgccccccagcacctacatgggccacttcatgaagccctacttcaaggacaaggtgaccggcgtgggcccccccgccaacgaggacaccagagagaaggccgcccagggcatcaaggccttcgaggagctgctggtgaccaagtggaagaactgggagaaggccctgctgagaaagagcgtggtgagcgacagactgcagagactgctgcagcccaagctgctgaagctggagtacctgcaccagaagcagagcaaggtgagcagcgagctggagagacaggccctggagaagcagggcagagaggccgagaaggagatccaggacatcaaccagctgcccgaggaggccctgctgggcaacagactggacagccacgactgggagaagatcagcaacatcaacttcgagggcagcagaagcgccgaggagatcagaaagttctggcagaacagcgagcaccccagcatcaacaagcaggagtggagcagagaggaggaggagagactgcaggccatcgccgccgcccacggccacctggagtggcagaagatcgccgaggagctgggcaccagcagaagcgccttccagtgcctgcagaagttccagcagcacaacaaggccctgaagagaaaggagtggaccgaggaggaggacagaatgctgacccagctggtgcaggagatgagagtgggcagccacatcccctacagaagaatcgtgtactacatggagggcagagacagcatgcagctgatctacagatggaccaagagcctggaccccggcctgaagaagggctactgggcccccgaggaggacgccaagctgctgcaggccgtggccaagtacggcgagcaggactggttcaagatcagagaggaggtgcccggcagaagcgacgcccagtgcagagacagatacctgagaagactgcacttcagcctgaagaagggcagatggaacctgaaggaggaggagcagctgatcgagctgatcgagaagtacggcgtgggccactgggccaagatcgccagcgagctgccccacagaagcggcagccagtgcctgagcaagtggaagatcatgatgggcaagaagcagggcctgagaagaagaagaagaagagccagacacagcgtgagatggagcagcaccagcagcagcggcagcagcagcggcagcagcggcggcagcagcagcagcagcagcagcagcagcgaggaggacgagcccgagcaggcccaggccggcgagggcgacagagccctgctgagcccccagtacatggtgcccgacatggacctgtgggtgcccgccagacagagcaccagccagccctggagaggcggcgccggcgcctggctgggcggccccgccgccagcctgagcccccccaagggcagcagcgccagccagggcggcagcaaggaggccagcaccaccgccgccgcccccggcgaggagaccagccccgtgcaggtgcccgccagagcccacggccccgtgcccagaagcgcccaggccagccacagcgccgacaccagacccgccggcgccgagaagcaggccctggagggcggcagaagactgctgaccgtgcccgtggagaccgtgctgagagtgctgagagccaacaccgccgccagaagctgcacccagaaggagcagctgagacagccccccctgcccaccagcagccccggcgtgagcagcggcgacagcgtggccagaagccacgtgcagtggctgagacacagagccacccagagcggccagagaagatggagacacgccctgcacagaagactgctgaacagaagactgctgctggccgtgaccccctgggtgggcgacgtggtggtgccctgcacccaggccagccagagacccgccgtggtgcagacccaggccgacggcctgagagagcagctgcagcaggccagactggccagcacccccgtgttcaccctgttcacccagctgttccacatcgacaccgccggctgcctggaggtggtgagagagagaaaggccctgccccccagactgccccaggccggcgccagagacccccccgtgcacctgctgcaggccagcagcagcgcccagagcacccccggccacctgttccccaacgtgcccgcccaggaggccagcaagagcgccagccacaagggcagcagaagactggccagcagcagagtggagagaaccctgccccaggccagcctgctggccagcaccggccccagacccaagcccaagaccgtgagcgagctgctgcaggagaagagactgcaggaggccagagccagagaggccaccagaggccccgtggtgctgcccagccagctgctggtgagcagcagcgtgatcctgcagccccccctgccccacaccccccacggcagacccgcccccggccccaccgtgctgaacgtgcccctgagcggccccggcgcccccgccgccgccaagcccggcaccagcggcagctggcaggaggccggcaccagcgccaaggacaagagactgagcaccatgcaggccctgcccctggcccccgtgttcagcgaggccgagggcaccgcccccgccgccagccaggcccccgccctgggccccggccagatcagcgtgagctgccccgagagcggcctgggccagagccaggcccccgccgccagcagaaagcagggcctgcccgaggccccccccttcctgcccgccgcccccagccccacccccctgcccgtgcagcccctgagcctgacccacatcggcggcccccacgtggccaccagcgtgcccctgcccgtgacctgggtgctgaccgcccagggcctgctgcccgtgcccgtgcccgccgtggtgagcctgcccagacccgccggcacccccggccccgccggcctgctggccaccctgctgccccccctgaccgagaccagagccgcccagggccccagagcccccgccctgagcagcagctggcagccccccgccaacatgaacagagagcccgagcccagctgcagaaccgacacccccgccccccccacccacgccctgagccagagccccgccgaggccgacggcagcgtggccttcgtgcccggcgaggcccaggtggccagagagatccccgagcccagaaccagcagccacgccgacccccccgaggccgagcccccctggagcggcagactgcccgccttcggcggcgtgatccccgccaccgagcccagaggcacccccggcagccccagcggcacccaggagcccagaggccccctgggcctggagaagctgcccctgagacagcccggccccgagaagggcgccctggacctggagaagccccccctgccccagcccggccccgagaagggcgccctggacctgggcctgctgagccaggagggcgaggccgccacccagcagtggctgggcggccagagaggcgtgagagtgcccctgctgggcagcagactgccctaccagccccccgccctgtgcagcctgagagccctgagcggcctgctgctgcacaagaaggccctggagcacaaggccaccagcctggtggtgggcggcgaggccgagagacccgccggcgccctgcaggccagcctgggcctggtgagaggccagctgcaggacaaccccgcctacctgctgctgagagccagattcctggccgccttcaccctgcccgccctgctggccaccctggccccccagggcgtgagaaccaccctgagcgtgcccagcagagtgggcagcgagagcgaggacgaggacctgctgagcgagctggagctggccgacagagacggccagcccggctgcaccaccgccacctgccccatccagggcgcccccgacagcggcaagtgcagcgccagcagctgcctggacaccagcaacgaccccgacgacctggacgtgctgagaaccagacacgccagacacaccagaaagagaagaagactggtgtag

SEQ ID NO: 9544 - DNA, 207 bp, Artificial Sequence
  Description of Artificial Sequence: Synthetic coding sequence
atgctgagcagactgcaggagctgagaaaggaggaggagaccctgctgagactgaaggccgccctgcacgaccagctgaacagactgaagatgctggtgcacgtggacaacgaggccagcatcaaccagaccaccctggagctgagcaccaagagccacgtgaccgaggaggaggaggaggaggaggaggaggagagcgacagctag

SEQ ID NO: 9545 - DNA, 297 bp, Artificial Sequence
  Description of Artificial Sequence: Synthetic coding sequence
atgctgagcagactgcaggagctgagaaaggaggaggagaccctgctgagactgaaggccgccctgcacgaccagctgaacagactgaaggtggaggagctggccctgcagagcatgatcagcagcagaagaggcgacgagatgctgagcagccacaccgtgcccgagcagagccacgacatgctggtgcacgtggacaacgaggccagcatcaaccagaccaccctggagctgagcaccaagagccacgtgaccgaggaggaggaggaggaggaggaggaggagagcgacagctag

SEQ ID NO: 9546 - DNA, 297 bp, Artificial Sequence; identical to SEQ ID NO: 9545
  Description of Artificial Sequence: Synthetic coding sequence

SEQ ID NO: 9547 - DNA, 5052 bp, Artificial Sequence
  Description of Artificial Sequence: Synthetic coding sequence
atgagcagcagaagaaagagagccccccccgtgagagtggacgaggagaagagacagcagctgcactggaacatgcacgaggacagaagaaacgagcccatcatcatcagcgacgacgacgagcagccctgccccggcagcgacaccagcagcgcccactacatcatcctgagcgacagcctgaaggaggaggtggcccacagagacaagaagagatgcagcaaggtggtgagcttcagcaagcccatcgagaaggaggagaccgtgggcatcttcagccccctgagcgtgaagctgaacatcgtgatcagcccctaccacttcgacaacagctggaaggccttcctgggcgagctgaccctgcagctgctgcccgcccagagcctgatcgagaacttcagcgagagaagcatcaccctgatgagcagcgagagcagcaaccagttcctgatctacgtgcacagcaagggcgaggacgtggagaagcagaagaaggagcccatgagcatctgcgacaagggcatcctggtggagagcagcttcagcggcgagatgctggaggacctgggctggctgcagaagaagagaagaatcaagctgtaccagaagcccgagggcaaccacatcatcaaggtgggcatctacctgctggaggccggcctggccaagctggacttcctgagcgacgccaacagcagaatgaagaagttcaaccagctgatgaagaaggtgatggagaagctgcacaacagcatcatccccgacgtgctggaggaggacgaggacgaccccgagagcgagcccgagggccaggacatcgacgagctgtaccacttcgtgaagcagacccaccagcaggagacccagagcatccaggtggacgtgcagcaccccgccctgatccccgtgctgagaccctaccagagagaggccgtgaactggatgctgcagcaggagtgcttcagaagcagccccgccaccgagagcgccctgcacttcctgtggagagagatcgtgaccagcgagggcctgaagctgtactacaacccctacaccggctgcatcatcagagagtaccccaacagcggcccccagctgctgggcggcatcctggccgacgagatgggcctgggcaagaccgtggaggtgctggccctgatcctgacccacaccagacaggacgtgaagcaggacgccctgaccctgcccgagggcaaggtggtgaactacttcatccccagccactacttcggcggcaagctgaagaagaccgagatccagaacatcgagttcgagcccaaggagaaggtgcagtgcccccccaccagagtgatgatcctgaccgccgtgaaggagatgaacggcaagaagggcgtgagcatcctgagcatctacaagtacgtgagcagcatctacagatacgacgtgcagagaaacagaagcctgctgaagagaatgctgaagtgcctgatcttcgagggcctggtgaagcagatcaagggccacggcttcagcggcaccttcaccctgggcaagaactacaaggaggaggacatctgcgacaagaccaagaagcaggccgtgggcagccccagaaagatccagaaggagaccagaaagagcggcaacaaggacaccgacagcgagtacctgcccagcgacaccagcgacgacgacgacgacccctactactactactacaagagcagaagaaacagaagcaagctgagaaagaagctggtgcccagcaccaagaagggcaagagccagcccttcatcaaccccgacagccagggccactgccccgccaccagcgacagcggcatcaccgacgtggccatgagcaagagcacctgcatcagcgagttcaaccaggagcacgagaccgaggactgcgccgagagcctgaaccacgccgacagcgacgtgccccccagcaacaccatgagccccttcaacaccagcgactacagattcgagtgcatctgcggcgagctggaccagatcgacagaaagcccagagtgcagtgcctgaagtgccacctgtggcagcacgccaagtgcgtgaactacgacgagaagaacctgaagatcaagcccttctactgcccccactgcctggtggccatggagcccgtgagcaccagagccaccctgatcatcagccccagcagcatctgccaccagtgggtggacgagatcaacagacacgtgagaagcagcagcctgagagtgctggtgtaccagggcgtgaagaaggacggcttcctgcagccccacttcctggccgagcaggacatcgtgatcatcacctacgacgtgctgagaagcgagctgaactacgtggacatcccccacagcaacagcgaggacggcagaagactgagaaaccagaagagatacatggccatccccagccccctggtggccgtggagtggtggagaatctgcctggacgaggcccagatggtggagtgccccaccgtgaaggccgccgagatggcccagagactgagcggcatcaacagatggtgcatcagcggcacccccgtgcagagaggcctggaggacctgttcggcctggtggtgttcctgggcatcgagccctactgcgtgaagcactggtgggtgagactgctgtacagaccctactgcaagaagaacccccagcacctgtacagcttcatcgccaagatcctgtggagaagcgccaagaaggacgtgatcgaccagatccagatccccccccagaccgaggagatccactggctgcacttcagccccgtggagagacacttctaccacagacagcacgaggtgtgctgccaggacgtggtggtgaagctgagaaagatcagcgactgggccctgaagctgagcagcctggacagaagaaccgtgaccagcatcctgtaccccctgctgagactgagacaggcctgctgccacccccaggccgtgagaggcgagttcctgcccctgcagaagagcaccatgaccatggaggagctgctgaccagcctgcagaagaagtgcggcaccgagtgcgaggaggcccacagacagctggtgtgcgccctgaacggcctggccggcatccacatcatcaagggcgagtacgccctggccgccgagctgtacagagaggtgctgagaagcagcgaggagcacaagggcaagctgaagaccgacagcctgcagagactgcacgccacccacaacctgatggagctgctgatcgccagacaccccggcatcccccccaccctgagagacggcagactggaggaggaggccaagcagctgagagagcactacatgagcaagtgcaacaccgaggtggccgaggcccagcaggccctgtaccccgtgcagcagaccatccacgagctgcagagaaagatccacagcaacagcccctggtggctgaacgtgatccacagagccatcgagttcaccatcgacgaggagctggtgcagagagtgagaaacgagatcaccagcaactacaagcagcagaccggcaagctgagcatgagcgagaagttcagagactgcagaggcctgcagttcctgctgaccacccagatggaggagctgaacaagtgccagaagctggtgagagaggccgtgaagaacctggagggcccccccagcagaaacgtgatcgagagcgccaccgtgtgccacctgagacccgccagactgcccctgaactgctgcgtgttctgcaaggccgacgagctgttcaccgagtacgagagcaagctgttcagcaacaccgtgaagggccagaccgccatcttcgaggagatgatcgaggacgaggagggcctggtggacgacagagcccccaccaccaccagaggcctgtgggccatcagcgagaccgagagaagcatgaaggccatcctgagcttcgccaagagccacagattcgacgtggagttcgtggacgagggcagcaccagcatggacctgttcgaggcctggaagaaggagtacaagctgctgcacgagtactggatggccctgagaaacagagtgagcgccgtggacgagctggccatggccaccgagagactgagagtgagagaccccagagagcccaagcccaacccccccgtgctgcacatcatcgagccccacgaggtggagcagaacagaatcaagctgctgaacgacaaggccgtggccaccagccagctgcagaagaagctgggccagctgctgtacctgaccaacctggagaagagccaggacaagaccagcggcggcgtgaaccccgagccctgccccatctgcgccagacagctgggcaagcagtgggccgtgctgacctgcggccactgcttctgcaacgagtgcatcagcatcatcatcgagcagtacagcgtgggcagccacagaagcagcatcaagtgcgccatctgcagacagaccaccagccacaaggagatcagctacgtgttcaccagcgagaaggccaaccaggaggaggacatccccgtgaagggcagccacagcaccaaggtggaggccgtggtgagaaccctgatgaagatccagctgagagaccccggcgccaaggccctggtgttcagcacctggcaggacgtgctggacatcatcagcaaggccctgaccgacaacaacatggagttcgcccagatcagcagagtgaagaccttccaggagaacctgagcgccttcaagagagacccccagatcaacatcctgctgctgcccctgcacaccggcagcaacggcctgaccatcatcgaggccacccacgtgctgctggtggagcccatcctgaaccccgcccacgagctgcaggccatcggcagagtgcacagaatcggccagaccaagcccaccatcgtgcacagattcctgatcaaggccaccatcgaggagagaatgcaggccatgctgaagaccgccgagagaagccacaccaacagcagcgccaagcacagcgaggccagcgtgctgaccgtggccgacctggccgacctgttcaccaaggagaccgaggagctggagtag

SEQ ID NO: 9548 - DNA, 5064 bp, Artificial Sequence
  Description of Artificial Sequence: Synthetic coding sequence
atgagcagcagaagaaagagagccccccccgtgagagtggacgaggagaagagacagcagctgcactggaacatgcacgaggacagaagaaacgagcccatcatcatcagcgacgacgacgagcagccctgccccggcagcgacaccagcagcgcccactacatcatcctgagcgacagcctgaaggaggaggtggcccacagagacaagaagagatgcagcaaggtggtgagcttcagcaagcccatcgagaaggaggagaccgtgggcatcttcagccccctgagcgtgaagctgaacatcgtgatcagcccctaccacttcgacaacagctggaaggccttcctgggcgagctgaccctgcagctgctgcccgcccagagcctgatcgagaacttcagcgagagaagcatcaccctgatgagcagcgagagcagcaaccagttcctgatctacgtgcacagcaagggcgaggacgtggagaagcagaagaaggagcccatgagcatctgcgacaagggcatcctggtggagagcagcttcagcggcgagatgctggaggacctgggctggctgcagaagaagagaagaatcaagctgtaccagaagcccgagggcaaccacatcatcaaggtgggcatctacctgctggaggccggcctggccaagctggacttcctgagcgacgccaacagcagaatgaagaagttcaaccagctgatgaagaaggtgatggagaagctgcacaacagcatcatccccgacgtgctggaggaggacgaggacgaccccgagagcgagcccgagggccaggacatcgacgagctgtaccacttcgtgaagcagacccaccagcaggagacccagagcatccaggtggacgtgcagcaccccgccctgatccccgtgctgagaccctaccagagagaggccgtgaactggatgctgcagcaggagtgcttcagaagcagccccgccaccgagagcgccctgcacttcctgtggagagagatcgtgaccagcgagggcctgaagctgtactacaacccctacaccggctgcatcatcagagagtaccccaacagcggcccccagctgctgggcggcatcctggccgacgagatgggcctgggcaagaccgtggaggtgctggccctgatcctgacccacaccagacaggacgtgaagcaggacgccctgaccctgcccgagggcaaggtggtgaactacttcatccccagccactacttcggcggcaagctgaagaagaccgagatccagaacatcgagttcgagcccaaggagaaggtgcagtgcccccccaccagagtgatgatcctgaccgccgtgaaggagatgaacggcaagaagggcgtgagcatcctgagcatctacaagtacgtgagcagcatctacagatacgacgtgcagagaaacagaagcctgctgaagagaatgctgaagtgcctgatcttcgagggcctggtgaagcagatcaagggccacggcttcagcggcaccttcaccctgggcaagaactacaaggaggaggacatctgcgacaagaccaagaagcaggccgtgggcagccccagaaagatccagaaggagaccagaaagagcggcaacaaggacaccgacagcgagtacctgcccagcgacaccagcgacgacgacgacgacccctactactactactacaagagcagaagaaacagaagcaagctgagaaagaagctggtgcccagcaccaagaagggcaagagccagcccttcatcaaccccgacagccagggccactgccccgccaccagcgacagcggcatcaccgacgtggccatgagcaagagcacctgcatcagcgagttcaaccaggagcacgagaccgaggactgcgccgagagcctgaaccacgccgacagcgacgtgccccccagcaacaccatgagccccttcaacaccagcgactacagattcgagtgcatctgcggcgagctggaccagatcgacagaaagcccagagtgcagtgcctgaagtgccacctgtggcagcacgccaagtgcgtgaactacgacgagaagaacctgaagatcaagcccttctactgcccccactgcctggtggccatggagcccgtgagcaccagagccaccctgatcatcagccccagcagcatctgccaccagtgggtggacgagatcaacagacacgtgagaagcagcagcctgagagtgctggtgtaccagggcgtgaagaaggacggcttcctgcagccccacttcctggccgagcaggacatcgtgatcatcacctacgacgtgctgagaagcgagctgaactacgtggacatcccccacagcaacagcgaggacggcagaagactgagaaaccagaagagatacatggccatccccagccccctggtggccgtggagtggtggagaatctgcctggacgaggcccagatggtggagtgccccaccgtgaaggccgccgagatggcccagagactgagcggcatcaacagatggtgcatcagcggcacccccgtgcagagaggcctggaggacctgttcggcctggtggtgttcctgggcatcgagccctactgcgtgaagcactggtgggtgagactgctgtacagaccctactgcaagaagaacccccagcacctgtacagcttcatcgccaagatcctgtggagaagcgccaagaaggacgtgatcgaccagatccagatccccccccagaccgaggagatccactggctgcacttcagccccgtggagagacacttctaccacagacagcacgaggtgtgctgccaggacgtggtggtgaagctgagaaagatcagcgactgggccctgaagctgagcagcctggacagaagaaccgtgaccagcatcctgtaccccctgctgagactgagacaggcctgctgccacccccaggccgtgagaggcgagttcctgcccctgcagaagagcttcgagcagagcaccttcagcttcagcaccatgaccatggaggagctgctgaccagcctgcagaagaagtgcggcaccgagtgcgaggaggcccacagacagctggtgtgcgccctgaacggcctggccggcatccacatcatcaagggcgagtacgccctggccgccgagctgtacagagaggtgctgagaagcagcgaggagcacaagggcaagctgaagaccgacagcctgcagagactgcacgccacccacaacctgatggagctgctgatcgccagacaccccggcatcccccccaccctgagagacggcagactggaggaggaggccaagcagctgagagagcactacatgagcaagtgcaacaccgaggtggccgaggcccagcaggccctgtaccccgtgcagcagaccatccacgagctgcagagaaagatccacagcaacagcccctggtggctgaacgtgatccacagagccatcgagttcaccatcgacgaggagctggtgcagagagtgagaaacgagatcaccagcaactacaagcagcagaccggcaagctgagcatgagcgagaagggcctgcagttcctgctgaccacccagatggaggagctgaacaagtgccagaagctggtgagagaggccgtgaagaacctggagggcccccccagcagaaacgtgatcgagagcgccaccgtgtgccacctgagacccgccagactgcccctgaactgctgcgtgttctgcaaggccgacgagctgttcaccgagtacgagagcaagctgttcagcaacaccgtgaagggccagaccgccatcttcgaggagatgatcgaggacgaggagggcctggtggacgacagagcccccaccaccaccagaggcctgtgggccatcagcgagaccgagagaagcatgaaggccatcctgagcttcgccaagagccacagattcgacgtggagttcgtggacgagggcagcaccagcatggacctgttcgaggcctggaagaaggagtacaagctgctgcacgagtactggatggccctgagaaacagagtgagcgccgtggacgagctggccatggccaccgagagactgagagtgagagaccccagagagcccaagcccaacccccccgtgctgcacatcatcgagccccacgaggtggagcagaacagaatcaagctgctgaacgacaaggccgtggccaccagccagctgcagaagaagctgggccagctgctgtacctgaccaacctggagaagagccaggacaagaccagcggcggcgtgaaccccgagccctgccccatctgcgccagacagctgggcaagcagtgggccgtgctgacctgcggccactgcttctgcaacgagtgcatcagcatcatcatcgagcagtacagcgtgggcagccacagaagcagcatcaagtgcgccatctgcagacagaccaccagccacaaggagatcagctacgtgttcaccagcgagaaggccaaccaggaggaggacatccccgtgaagggcagccacagcaccaaggtggaggccgtggtgagaaccctgatgaagatccagctgagagaccccggcgccaaggccctggtgttcagcacctggcaggacgtgctggacatcatcagcaaggccctgaccgacaacaacatggagttcgcccagatcagcagagtgaagaccttccaggagaacctgagcgccttcaagagagacccccagatcaacatcctgctgctgcccctgcacaccggcagcaacggcctgaccatcatcgaggccacccacgtgctgctggtggagcccatcctgaaccccgcccacgagctgcaggccatcggcagagtgcacagaatcggccagaccaagcccaccatcgtgcacagattcctgatcaaggccaccatcgaggagagaatgcaggccatgctgaagaccgccgagagaagccacaccaacagcagcgccaagcacagcgaggccagcgtgctgaccgtggccgacctggccgacctgttcaccaaggagaccgaggagctggagtag

SEQ ID NO: 9549 - DNA, 5052 bp, Artificial Sequence; identical to SEQ ID NO: 9547
  Description of Artificial Sequence: Synthetic coding sequence

SEQ ID NO: 9550 - DNA, 468 bp, Artificial Sequence
  Description of Artificial Sequence: Synthetic coding sequence
atggagttcgcccagatcagcagagtgaagaccttccaggagaacctgagcgccttcaagagagacccccagatcaacatcctgctgctgcccctgcacaccggcagcaacggcctgaccatcatcgaggccacccacgtgctgctggtggagcccatcctgaaccccgcccacgagctgcaggccatcggcagagtgcacagaatcggccagaccaagcccaccatcgtgcacagattcctgatcaaggccaccatcgaggagagaatgcaggccatgctgaagaccgccgagagaagattcttcgaggagcaggccctgttctgcttccacgacatcacccccttcagccacccctggagcctgaccaccgccatcctgcagctgagagacctggtgatctgcgagctgttcttcatctacttcaagaacttcctgatctgcttcctgagcagcttcagcatctag

SEQ ID NO: 9551 - DNA, 4980 bp, Artificial Sequence
  Description of Artificial Sequence: Synthetic coding sequence
atgagcagcagaagaaagagagccccccccgtgagagtggacgaggagaagagacagcagctgcactggaacatgcacgaggacagaagaaacgagcccatcatcatcagcgacgacgacgagcagccctgccccggcagcgacaccagcagcgcccactacatcatcctgagcgacagcctgaaggaggaggtggcccacagagacaagaagagatgcagcaaggtggtgagcttcagcaagcccatcgagaaggaggagaccgtgggcatcttcagccccctgagcgtgaagctgaacatcgtgatcagcccctaccacttcgacaacagctggaaggccttcctgggcgagctgaccctgcagctgctgcccgcccagagcctgatcgagaacttcagcgagagaagcatcaccctgatgagcagcgagagcagcaaccagttcctgatctacgtgcacagcaagggcgaggacgtggagaagcagaagaaggagcccatgagcatctgcgacaagggcatcctggtggagagcagcttcagcggcgagatgctggaggacctgggctggctgcagaagaagagaagaatcaagctgtaccagaagcccgagggcaaccacatcatcaaggtgggcatctacctgctggaggccggcctggccaagctggacttcctgagcgacgccaacagcagaatgaagaagttcaaccagctgatgaagaaggtgatggagaagctgcacaacagcatcatccccgacgtgctggaggaggacgaggacgaccccgagagcgagcccgagggccaggacatcgacgagctgtaccacttcgtgaagcagacccaccagcaggagacccagagcatccaggtggacgtgcagcaccccgccctgatccccgtgctgagaccctaccagagagaggccgtgaactggatgctgcagcaggagtgcttcagaagcagccccgccaccgagagcgccctgcacttcctgtggagagagatcgtgaccagcgagggcctgaagctgtactacaacccctacaccggctgcatcatcagagagtaccccaacagcggcccccagctgctgggcggcatcctggccgacgagatgggcctgggcaagaccgtggaggtgctggccctgatcctgacccacaccagacaggacgtgaagcaggacgccctgaccctgcccgagggcaaggtggtgaactacttcatccccagccactacttcggcggcaagctgaagaagaccgagatccagaacatcgagttcgagcccaaggagaaggtgcagtgcccccccaccagagtgatgatcctgaccgccgtgaaggagatgaacggcaagaagggcgtgagcatcctgagcatctacaagtacgtgagcagcatctacagatacgacgtgcagagaaacagaagcctgctgaagagaatgctgaagtgcctgatcttcgagggcctggtgaagcagatcaagggccacggcttcagcggcaccttcaccctgggcaagaactacaaggaggaggacatctgcgacaagaccaagaagcaggccgtgggcagccccagaaagatccagaaggagaccagaaagagcggcaacaaggacaccgacagcgagtacctgcccagcgacaccagcgacgacgacgacgacccctactactactactacaagagcagaagaaacagaagcaagctgagaaagaagctggtgcccagcaccaagaagggcaagagccagcccttcatcaaccccgacagccagggccactgccccgccaccagcgacagcggcatcaccgacgtggccatgagcaagagcacctgcatcagcgagttcaaccaggagcacgagaccgaggactgcgccgagagcctgaaccacgccgacagcgacgtgccccccagcaacaccatgagccccttcaacaccagcgactacagattcgagtgcatctgcggcgagctggaccagatcgacagaaagcccagagtgcagtgcctgaagtgccacctgtggcagcacgccaagtgcgtgaactacgacgagaagaacctgaagatcaagcccttctactgcccccactgcctggtggccatggagcccgtgagcaccagagccaccctgatcatcagccccagcagcatctgccaccagtgggtggacgagatcaacagacacgtgagaagcagcagcctgagagtgctggtgtaccagggcgtgaagaaggacggcttcctgcagccccacttcctggccgagcaggacatcgtgatcatcacctacgacgtgctgagaagcgagctgaactacgtggacatcccccacagcaacagcgaggacggcagaagactgagaaaccagaagagatacatggccatccccagccccctggtggccgtggagtggtggagaatctgcctggacgaggcccagatggtggagtgccccaccgtgaaggccgccgagatggcccagagactgagcggcatcaacagatggtgcatcagcggcacccccgtgcagagaggcctggaggacctgttcggcctggtggtgttcctgggcatcgagccctactgcgtgaagcactggtgggtgagactgctgtacagaccctactgcaagaagaacccccagcacctgtacagcttcatcgccaagatcctgtggagaagcgccaagaaggacgtgatcgaccagatccagatccccccccagaccgaggagatccactggctgcacttcagccccgtggagagacacttctaccacagacagcacgaggtgtgctgccaggacgtggtggtgaagctgagaaagatcagcgactgggccctgaagctgagcagcctggacagaagaaccgtgaccagcatcctgtaccccctgctgagactgagacaggcctgctgccacccccaggccgtgagaggcgagttcctgcccctgcagaagagcttcgagcagagcaccttcagcttcagcaccatgaccatggaggagctgctgaccagcctgcagaagaagtgcggcaccgagtgcgaggaggcccacagacagctggtgtgcgccctgaacggcctggccggcatccacatcatcaagggcgagtacgccctggccgccgagctgtacagagaggtgctgagaagcagcgaggagcacaagggcaagctgaagaccgacagcctgcagagactgcacgccacccacaacctgatggagctgctgatcgccagacaccccggcatcccccccaccctgagagacggcagactggaggaggaggccaagcagctgagagagcactacatgagcaagtgcaacaccgaggtggccgaggcccagcaggccctgtaccccgtgcagcagaccatccacgagctgcagagaaagatccacagcaacagcccctggtggctgaacgtgatccacagagccatcgagttcaccatcgacgaggagctggtgcagagagtgagaaacgagatcaccagcaactacaagcagcagaccggcaagctgagcatgagcgagaagggcctgcagttcctgctgaccacccagatggaggagctgaacaagtgccagaagctggtgagagaggccgtgaagaacctggagggcccccccagcagaaacgtgatcgagagcgccaccgtgtgccacctgagacccgccagactgcccctgaactgctgcgtgttctgcaaggccgacgagctgttcaccgagtacgagagcaagctgttcagcaacaccgtgaagggccagaccgccatcttcgaggagatgatcgaggacgaggagggcctggtggacgacagagcccccaccaccaccagaggcctgtgggccatcagcgagaccgagagaagcatgaaggccatcctgagcttcgccaagagccacagattcgacgtggagttcgtggacgagggcagcaccagcatggacctgttcgaggcctggaagaaggagtacaagctgctgcacgagtactggatggccctgagaaacagagtgagcgccgtggacgagctggccatggccaccgagagactgagagtgagagaccccagagagcccaagcccaacccccccgtgctgcacatcatcgagccccacgaggtggagcagaacagaatcaagctgctgaacgacaaggccgtggccaccagccagctgcagaagaagctgggccagctgctgtacctgaccaacctggagaagagccaggacaagaccagcggcggcgtgaaccccgagccctgccccatctgcgccagacagctgggcaagcagtgggccgtgctgacctgcggccactgcttctgcaacgagtgcatcagcatcatcatcgagcagtacagcgtgggcagccacagaagcagcatcaagtgcgccatctgcagacagaccaccagccacaaggagatcagctacgtgttcaccagcgagaaggccaaccaggaggaggacatccccgtgaagggcagccacagcaccaaggtggaggccgtggtgagaaccctgatgaagatccagctgagagaccccggcgccaaggccctggtgttcagcacctggcaggacgtgctggacatcatcagcaaggccctgaccgacaacaacatggagttcgcccagatcagcagagtgaagaccttccaggagaacctgagcgccttcaagagagacccccagatcaacatcctgctgctgcccctgcacaccggcagcaacggcctgaccatcatcgaggccacccacgtgctgctggtggagcccatcctgaaccccgcccacgagctgcaggccatcggcagagtgcacagaatcggccagaccaagcccaccatcgtgcacagattcctgatcaaggccaccatcgaggagagaatgcaggccatgctgaagaccgccgagagaagcatctacatctag

SEQ ID NO: 9552 - DNA, 1983 bp, Artificial Sequence
  Description of Artificial Sequence: Synthetic coding sequence
atgagcagcagaagaaagagagccccccccgtgagagtggacgaggagaagagacagcagctgcactggaacatgcacgaggacagaagaaacgagcccatcatcatcagcgacgacgacgagcagccctgccccggcgaggacgtggagaagcagaagaaggagcccatgagcatctgcgacaagggcatcctggtggagagcagcttcagcggcgagatgctggaggacctgggctggctgcagaagaagagaagaatcaagctgtaccagaagcccgagggcaaccacatcatcaaggtgggcatctacctgctggaggccggcctggccaagctggacttcctgagcgacgccaacagcagaatgaagaagttcaaccagctgatgaagaaggtgatggagaagctgcacaacagcatcatccccgacgtgctggaggaggacgaggacgaccccgagagcgagcccgagggccaggacatcgacgagctgtaccacttcgtgaagcagacccaccagcaggagacccagagcatccaggtggacgtgcagcaccccgccctgatccccgtgctgagaccctaccagagagaggccgtgaactggatgctgcagcaggagtgcttcagaagcagccccgccaccgagagcgccctgcacttcctgtggagagagatcgtgaccagcgagggcctgaagctgtactacaacccctacaccggctgcatcatcagagagtaccccaacagcggcccccagctgctgggcggcatcctggccgacgagatgggcctgggcaagaccgtggaggtgctggccctgatcctgacccacaccagacaggacgtgaagcaggacgccctgaccctgcccgagggcaaggtggtgaactacttcatccccagccactacttcggcggcaagctgaagaagaccgagatccagaacatcgagttcgagcccaaggagaaggtgcagtgcccccccaccagagtgatgatcctgaccgccgtgaaggagatgaacggcaagaagggcgtgagcatcctgagcatctacaagtacgtgagcagcatctacagatacgacgtgcagagaaacagaagcctgctgaagagaatgctgaagtgcctgatcttcgagggcctggtgaagcagatcaagggccacggcttcagcggcaccttcaccctgggcaagaactacaaggaggaggacatctgcgacaagaccaagaagcaggccgtgggcagccccagaaagatccagaaggagaccagaaagagcggcaacaaggacaccgacagcgagtacctgcccagcgacaccagcgacgacgacgacgacccctactactactactacaagagcagaagaaacagaagcaagctgagaaagaagctggtgcccagcaccaagaagggcaagagccagcccttcatcaaccccgacagccagggccactgccccgccaccagcgacagcggcatcaccgacgtggccatgagcaagagcacctgcatcagcgagttcaaccaggagcacgagaccgaggactgcgccgagagcctgaaccacgccgacagcgacgtgccccccagcaacaccatgagccccttcaacaccagcgactacagattcgagtgcatctgcggcgagctggaccagatcgacagaaagcccagagtgcagtgcctgaagtgccacctgtggcagcacgccaagtgcgtgaactacgacgagaagaacctgaagatcaagcccttctactgcccccactgcctggtggccatggagcccgtgagcaccagagccaccctgatcatcagccccagcagcatctgccaccagtgggtggacgagatcaacagacacgtgagaagcagcagcctgagagtgctggtgtaccagggcgtgaagaaggacggcttcctgcagccccacttcggcagaaccggctacagctaccactacctgtag

SEQ ID NO: 9553 - DNA, 216 bp, Artificial Sequence
  Description of Artificial Sequence: Synthetic coding sequence
atggagagagccagagacagactgcacctgagaagaaccaccgagcagcacgtgcccgaggtggaggtgcaggtgaagagaagaagaaccgccagcctgagcaaccaggagtgccagctgtaccccagaagaagccagcagcagcaggtgcccgtggtggacttccaggccgagctgagacaggccttcctggccgagacccccagaggcggctag

SEQ ID NO: 9554 - DNA, 216 bp, Artificial Sequence; identical to SEQ ID NO: 9553
  Description of Artificial Sequence: Synthetic coding sequence

SEQ ID NO: 9555 - DNA, 375 bp, Artificial Sequence
  Description of Artificial Sequence: Synthetic coding sequence
atgaccccccagggcagaggcaccgtggccgccgccgccgtggccgccaccgccagcatcgccggcgcccccacccagtacccccccggcagaggcaccccccccccccccgtgggcagagccacccccccccccggcatcatggcccccccccccggcatgagaccccccatgggcccccccatcggcctgccccccgccagaggcacccccatcggcatgcccccccccggcatgagaccccccccccccggcatcagaggcgaggccttcctgctggccctggtgtgctggtacggctggcccctggacttcggcatgagcgactacgccgcctacctgaagaagacctgcttccaggacctgttcaactag

SEQ ID NO: 9556 - DNA, 216 bp, Artificial Sequence; identical to SEQ ID NO: 9553
  Description of Artificial Sequence: Synthetic coding sequence

SEQ ID NO: 9557 - DNA, 1611 bp, Artificial Sequence
  Description of Artificial Sequence: Synthetic coding sequence
atggccctgaccagcttcctgcccgcccccacccagctgagccaggaccagctggaggccgaggagaaggccagaagccagagaagcagacagaccagcctggtgagcagcagaagagagccccccccctacggctacagaaagggctggatccccagactgctggaggacttcggcgacggcggcgccttccccgagatccacgtggcccagtaccccctggacatgggcagaaagaagaagatgagcaacgccctggccatccaggtggacagcgagggcaagatcaagtacgacgccatcgccagacagggccagagcaaggacaaggtgatctacagcaagtacaccgacctggtgcccaaggaggtgatgaacgccgacgaccccgacctgcagagacccgacgaggaggccatcaaggagatcaccgagaagaccagagtggccctggagaagagcgtgagccagaaggtggccgccgccatgcccgtgagagccgccgacaagctggcccccgcccagtacatcagatacacccccagccagcagggcgtggccttcaacagcggcgccaagcagagagtgatcagaatggtggagatgcagaaggaccccatggagccccccagattcaagatcaacaagaagatccccagaggcccccccagcccccccgcccccgtgatgcacagccccagcagaaagatgaccgtgaaggagcagcaggagtggaagatccccccctgcatcagcaactggaagaacgccaagggctacaccatccccctggacaagagactggccgccgacggcagaggcctgcagaccgtgcacatcaacgagaacttcgccaagctggccgaggccctgtacatcgccgacagaaaggccagagaggccgtggagatgagagcccaggtggagagaaagatggcccagaaggagaaggagaagcacgaggagaagctgagagagatggcccagaaggccagagagagaagagccggcatcaagacccacgtggagaaggaggacggcgaggccagagagagagacgagatcagacacgacagaagaaaggagagacagcacgacagaaacctgagcagagccgcccccgacaagagaagcaagctgcagagaaacgagaacagagacatcagcgaggtgatcgccctgggcgtgcccaaccccagaaccagcaacgaggtgcagtacgaccagagactgttcaaccagagcaagggcatggacagcggcttcgccggcggcgaggacgagatctacaacgtgtacgaccaggcctggagaggcggcaaggacatggcccagagcatctacagacccagcaagaacctggacaaggacatgtacggcgacgacctggaggccagaatcaagaccaacagattcgtgcccgacaaggagttcagcggcagcgacagaagacagagaggcagagagggccccgtgcagttcgaggaggaccccttcggcctggacaagttcctggaggaggccaagcagcacggcggcagcaagagacccagcgacagcagcagacccaaggagcacgagcacgagggcaagaagagaagaaaggagtag

SEQ ID NO: 9558 - DNA, 867 bp, Artificial Sequence
  Description of Artificial Sequence: Synthetic coding sequence
atggccctgaccagcttcctgcccgcccccacccagctgagccaggaccagctggaggccgaggagaaggccagaagccagagaagcagacagaccagcctggtgagcagcagaagagagccccccccctacggctacagaaagggctggatccccagactgctggaggacttcggcgacggcggcgccttccccgagatccacgtggcccagtaccccctggacatgggcagaaagaagaagatgagcaacgccctggccatccaggtggacagcgagggcaagatcaagtacgacgccatcgccagacagggccagagcaaggacaaggtgatctacagcaagtacaccgacctggtgcccaaggaggtgatgaacgccgacgaccccgacctgcagagacccgacgaggaggccatcaaggagatcaccgagaagaccagagtggccctggagaagagcgtgagccagaaggtggccgccgccatgcccgtgagagccgccgacaagctggcccccgcccagtacatcagatacacccccagccagcagggcgtggccttcaacagcggcgccaagcagagagtgatcagaatggtggagatgcagaaggaccccatggagccccccagattcaagatcaacaagaagatccccagaggcccccccagcccccccgcccccgtgatgcacagccccagcagaaagatgaccgtgaaggagcagcaggagtggaagatccccccctgcatcagcaactggaagaacgccaagggctacaccatccccctggacaagagactggccgccgacggcagaggcctgcagaccgtgcacaagaagaagaagaagaagaagagaaagtag

SEQ ID NO: 9559 - DNA, 558 bp, Artificial Sequence
  Description of Artificial Sequence: Synthetic coding sequence
atggccctgaccagcttcctgcccgcccccacccagctgagccaggaccagctggaggccgaggagaaggccagaagccagagaagcagacagaccagcctggtgagcagcagaagagagccccccccctacggctacagaaagggctggatccccagactgctggaggacttcggcgacggcggcgccttccccgagatccacgtggcccagtaccccctggacatgggcagaaagaagaagatgagcaacgccctggccatccaggtggacagcgagggcaagatcaagtacgacgccatcgccagacagggccagagcaaggacaaggtgatctacagcaagtacaccgacctggtgcccaaggaggtgatgaacgccgacgaccccgacctgcagagacccgacgaggaggccatcaaggagatgaccgtgaaggagcagcaggagtggaagatccccccctgcatcagcaactggaagaacgccaagggctacaccatccccctggacaagagactggccgccgacggcagaggcctgcagaccgtgcactag

SEQ ID NO: 9560 - DNA, 2211 bp, Artificial Sequence
  Description of Artificial Sequence: Synthetic coding sequence
atggtggccgagatccagaacgtggagggccagaacctgcaggagcaggtgtgccccgagcccatcttcagattcttcagagagaacaaggtggagatcgccagcgccatcaccagacccttccccttcctgatgggcctgagagacagaagcttcatcagcgagcagatgtacgagcacttccaggaggccttcagaaacctggtgcccgtgaccagagtgatgtactgcgtgctgagcgagctggagaagaccttcggctggagccacctggaggccctgttcagcagaatcaacctgatggcctaccccgacctgaacgagatctacagaagcttccagaacgtgtgctacgagcacagccccctgcagatgaacaacgtgaacgacctggaggacagacccagactgctgccctacggcaagcaggagaacagcaacgcctgccacgagatggacgacatcgccgtgccccaggaggccctgagcagcagccccagatgcgagcccggcttcagcagcgagagctgcgagcagctggccctgcccaaggccggcggcggcgacgccgaggacgcccccagcctgctgcccggcggcggcgtgagctgcaagctggccatccagatcgacgagggcgagagcgaggagatgcccaagctgctgccctacgacaccgaggagaccttcgacctgaagaccccccaggtgaccaacgagggcgagcccgagaagggcctgtgcctgctgcccggcgagggcgaggagggcagcgacgactgcagcgagatgtgcgacggcgaggagagacaggaggccagcagcagcctggccagaagaggcagcgtgagcagcgagctggagaaccaccccatgaacgaggagggcgagagcgaggagctggccagcagcctgctgtacgacaacgtgcccggcgccgagcagagcgcctacgagaacgagaagtgcagctgcgtgatgtgcttcagcgaggaggtgcccggcagccccgaggccagaaccgagagcgaccaggcctgcggcaccatggacaccgtggacatcgccaacaacagcaccctgggcaagcccaagagaaagagaagaaagaagagaggccacggctggagcagaatgagaatgagaagacaggagaacagccagcagaacgacaacagcaaggccgacggccaggtggtgagcagcgagaagaaggccaacgtgaacctgaaggacctgagcaagatcagaggcagaaagagaggcaagcccggcaccagattcacccagagcgacagagccgcccagaagagagtgagaagcagagccagcagaaagcacaaggacgagaccgtggacttcaaggcccccctgctgcccgtgacctgcggcggcgtgaagggcatcctgcacaagaagaagctgcagcagggcatcctggtgaagtgcatccagaccgaggacggcaagtggttcacccccaccgagttcgagatcaagggcggccacgccagaagcaagaactggagactgagcgtgagatgcggcggctggcccctgagatggctgatggagaacggcttcctgcccgacccccccagaatcagatacagaaagaagaagagaatcctgaagagccagaacaacagcagcgtggacccctgcatgagaaacctggacgagtgcgaggtgtgcagagacggcggcgagctgttctgctgcgacacctgcagcagagtgttccacgaggactgccacatcccccccgtggaggccgagagaaccccctggaactgcatcttctgcagaatgaaggagagccccggcagccagcagtgctgccaggagagcgaggtgctggagagacagatgtgccccgaggagcagctgaagtgcgagttcctgctgctgaaggtgtactgctgcagcgagagcagcttcttcgccaagatcccctactactactacatcagagaggcctgccagggcctgaaggagcccatgtggctggacaagatcaagaagagactgaacgagcacggctacccccaggtggagggcttcgtgcaggacatgagactgatcttccagaaccacagagccagctacaagtacaaggacttcggccagatgggcttcagactggaggccgagttcgagaagaacttcaaggaggtgttcgccatccaggagaccaacggcaacaactag

SEQ ID NO: 9561 - DNA, 519 bp, Artificial Sequence
  Description of Artificial Sequence: Synthetic coding sequence
atggcccagcagggccagcagggccagatggccagcggcgacagcaacctgaacttcagaatggtggccgagatccagaacgtggagggccagaacctgcaggagcaggtgtgccccgagcccatcttcagattcttcagagagaacaaggtggagatcgccagcgccatcaccagacccttccccttcctgatgggcctgagagacagaagcttcatcagcgagcagatgtacgagcacttccaggaggccttcagaaacctggtgcccgtgaccagagtgatgtactgcgtgctgagcgagctggagaagaccttcggctggagccacctggaggccctgttcagcagaatcaacctgatggcctaccccgacctgaacgagatctacagaagcttccagaacgagaacctgagcagcagcgccgtgctgtgccagctggtgagccccaacaaggactggagaagccacgaggagagcctggcccacaccggcaccctgagaagaagctgcatgtag

SEQ ID NO: 9562 - DNA, 1218 bp, Artificial Sequence
  Description of Artificial Sequence: Synthetic coding sequence
atggcccagcagggccagcagggccagatggccagcggcgacagcaacctgaacttcagaatggtggccgagatccagaacgtggagggccagaacctgcaggagcaggtgtgccccgagcccatcttcagattcttcagagagaacaaggtggagatcgccagcgccatcaccagacccttccccttcctgatgggcctgagagacagaagcttcatcagcgagcagatgtacgagcacttccaggaggccttcagaaacctggtgcccgtgaccagagtgatgtactgcgtgctgagcgagctggagaagaccttcggctggagccacctggaggccctgttcagcagaatcaacctgatggcctaccccgacctgaacgagatctacagaagcttccagaacgtgtgctacgagcacagccccctgcagatgaacaacgtgaacgacctggaggacagacccagactgctgccctacggcaagcaggagaacagcaacgcctgccacgagatggacgacatcgccgtgccccaggaggccctgagcagcagccccagatgcgagcccggcttcagcagcgagagctgcgagcagctggccctgcccaaggccggcggcggcgacgccgaggacgcccccagcctgctgcccggcggcggcgtgagctgcaagctggccatccagatcgacgagggcgagagcgaggagatgcccaagctgctgccctacgacaccgaggtgctggagagcaacggcatgatcgacgccgccagaacctacagcaccgcccccggcgagaagcagggcgaggaggagggcagaaacagccccagaaagagaaaccaggacaaggagaagtaccaggagagccccgagggcagagacaaggagaccttcgacctgaagaccccccaggtgaccaacgagggcgagcccgagaagggcctgtgcctgctgcccggcgagggcgaggagggcagcgacgactgcagcgagatgtgcgacggcgaggagccccaggaggccagcagcagcctggccagatgcggcagcgagggcagcgacgactgcagcgagatgtgcgacggcgaggagagacaggaggcccagaagcagggcagaaaggtgatcaagagagtggcccagtggatcctgtggatcctgcagaccacccccctgtgggagaaccccagaggcaaggaggacaagagatag

SEQ ID NO: 9563 - DNA, 2604 bp, Artificial Sequence
  Description of Artificial Sequence: Synthetic coding sequence
atggcccagcagggccagcagggccagatggccagcggcgacagcaacctgaacttcagaatggtggccgagatccagaacgtggagggccagaacctgcaggagcaggtgtgccccgagcccatcttcagattcttcagagagaacaaggtggagatcgccagcgccatcaccagacccttccccttcctgatgggcctgagagacagaagcttcatcagcgagcagatgtacgagcacttccaggaggccttcagaaacctggtgcccgtgaccagagtgatgtactgcgtgctgagcgagctggagaagaccttcggctggagccacctggaggccctgttcagcagaatcaacctgatggcctaccccgacctgaacgagatctacagaagcttccagaacgtgtgctacgagcacagccccctgcagatgaacaacgtgaacgacctggaggacagacccagactgctgccctacggcaagcaggagaacagcaacgcctgccacgagatggacgacatcgccgtgccccaggaggccctgagcagcagccccagatgcgagcccggcttcagcagcgagagctgcgagcagctggccctgcccaaggccggcggcggcgacgccgaggacgcccccagcctgctgcccggcggcggcgtgagctgcaagctggccatccagatcgacgagggcgagagcgaggagatgcccaagctgctgccctacgacaccgaggtgctggagagcaacggcatgatcgacgccgccagaacctacagcaccgcccccggcgagaagcagggcgaggaggagggcagaaacagccccagaaagagaaaccaggacaaggagaagtaccaggagagccccgagggcagagacaaggagaccttcgacctgaagaccccccaggtgaccaacgagggcgagcccgagaagggcctgtgcctgctgcccggcgagggcgaggagggcagcgacgactgcagcgagatgtgcgacggcgaggagccccaggaggccagcagcagcctggccagatgcggcagcgtgagctgcctgagcgccgagaccttcgacctgaagaccccccaggtgaccaacgagggcgagcccgagaaggagctgagcctgctgcccggcgagggcgaggagggcagcgacgactgcagcgagatgtgcgacggcgaggagagacaggaggccagcagcagcctggccagaagaggcagcgtgagcagcgagctggagaaccaccccatgaacgaggagggcgagagcgaggagctggccagcagcctgctgtacgacaacgtgcccggcgccgagcagagcgcctacgagaacgagaagtgcagctgcgtgatgtgcttcagcgaggaggtgcccggcagccccgaggccagaaccgagagcgaccaggcctgcggcaccatggacaccgtggacatcgccaacaacagcaccctgggcaagcccaagagaaagagaagaaagaagagaggccacggctggagcagaatgagaatgagaagacaggagaacagccagcagaacgacaacagcaaggccgacggccaggtggtgagcagcgagaagaaggccaacgtgaacctgaaggacctgagcaagatcagaggcagaaagagaggcaagcccggcaccagattcacccagagcgacagagccgcccagaagagagtgagaagcagagccagcagaaagcacaaggacgagaccgtggacttcaaggcccccctgctgcccgtgacctgcggcggcgtgaagggcatcctgcacaagaagaagctgcagcagggcatcctggtgaagtgcatccagaccgaggacggcaagtggttcacccccaccgagttcgagatcaagggcggccacgccagaagcaagaactggagactgagcgtgagatgcggcggctggcccctgagatggctgatggagaacggcttcctgcccgacccccccagaatcagatacagaaagaagaagagaatcctgaagagccagaacaacagcagcgtggacccctgcatgagaaacctggacgagtgcgaggtgtgcagagacggcggcgagctgttctgctgcgacacctgcagcagagtgttccacgaggactgccacatcccccccgtggaggccgagagaaccccctggaactgcatcttctgcagaatgaaggagagccccggcagccagcagtgctgccaggagagcgaggtgctggagagacagatgtgccccgaggagcagctgaagtgcgagttcctgctgctgaaggtgtactgctgcagcgagagcagcttcttcgccaagatcccctactactactacatcagagaggcctgccagggcctgaaggagcccatgtggctggacaagatcaagaagagactgaacgagcacggctacccccaggtggagggcttcgtgcaggacatgagactgatcttccagaaccacagagccagctacaagtacaaggacttcggccagatgggcttcagactggaggccgagttcgagaagaacttcaaggaggtgttcgccatccaggagaccaacggcaacaactag

SEQ ID NO: 9564 - DNA, 2523 bp, Artificial Sequence
  Description of Artificial Sequence: Synthetic coding sequence
atggcccagcagggccagcagggccagatggccagcggcgacagcaacctgaacttcagaatggtggccgagatccagaacgtggagggccagaacctgcaggagcaggtgtgccccgagcccatcttcagattcttcagagagaacaaggtggagatcgccagcgccatcaccagacccttccccttcctgatgggcctgagagacagaagcttcatcagcgagcagatgtacgagcacttccaggaggccttcagaaacctggtgcccgtgaccagagtgatgtactgcgtgctgagcgagctggagaagaccttcggctggagccacctggaggccctgttcagcagaatcaacctgatggcctaccccgacctgaacgagatctacagaagcttccagaacgtgtgctacgagcacagccccctgcagatgaacaacgtgaacgacctggaggacagacccagactgctgccctacggcaagcaggagaacagcaacgcctgccacgagatggacgacatcgccgtgccccaggaggccctgagcagcagccccagatgcgagcccggcttcagcagcgagagctgcgagcagctggccctgcccaaggccggcggcggcgacgccgaggacgcccccagcctgctgcccggcggcggcgtgagctgcaagctggccatccagatcgacgagggcgagagcgaggagatgcccaagctgctgccctacgacaccgaggtgctggagagcaacggcatgatcgacgccgccagaacctacagcaccgcccccggcgagaagcagggcgaggaggagggcagaaacagccccagaaagagaaaccaggacaaggagaagtaccaggagagccccgagggcagagacaaggagaccttcgacctgaagaccccccaggtgaccaacgagggcgagcccgagaagggcctgtgcctgctgcccggcgagggcgaggagggcagcgacgactgcagcgagatgtgcgacggcgaggagccccaggaggccagcagcagcctggccagatgcggcagcgtgagctgcctgagcgccgagaccttcgacctgaagaccccccaggtgaccaacgagggcgagcccgagaaggagctgagcctgctgcccggcgagggcgaggtgagcagcgagctggagaaccaccccatgaacgaggagggcgagagcgaggagctggccagcagcctgctgtacgacaacgtgcccggcgccgagcagagcgcctacgagaacgagaagtgcagctgcgtgatgtgcttcagcgaggaggtgcccggcagccccgaggccagaaccgagagcgaccaggcctgcggcaccatggacaccgtggacatcgccaacaacagcaccctgggcaagcccaagagaaagagaagaaagaagagaggccacggctggagcagaatgagaatgagaagacaggagaacagccagcagaacgacaacagcaaggccgacggccaggtggtgagcagcgagaagaaggccaacgtgaacctgaaggacctgagcaagatcagaggcagaaagagaggcaagcccggcaccagattcacccagagcgacagagccgcccagaagagagtgagaagcagagccagcagaaagcacaaggacgagaccgtggacttcaaggcccccctgctgcccgtgacctgcggcggcgtgaagggcatcctgcacaagaagaagctgcagcagggcatcctggtgaagtgcatccagaccgaggacggcaagtggttcacccccaccgagttcgagatcaagggcggccacgccagaagcaagaactggagactgagcgtgagatgcggcggctggcccctgagatggctgatggagaacggcttcctgcccgacccccccagaatcagatacagaaagaagaagagaatcctgaagagccagaacaacagcagcgtggacccctgcatgagaaacctggacgagtgcgaggtgtgcagagacggcggcgagctgttctgctgcgacacctgcagcagagtgttccacgaggactgccacatcccccccgtggaggccgagagaaccccctggaactgcatcttctgcagaatgaaggagagccccggcagccagcagtgctgccaggagagcgaggtgctggagagacagatgtgccccgaggagcagctgaagtgcgagttcctgctgctgaaggtgtactgctgcagcgagagcagcttcttcgccaagatcccctactactactacatcagagaggcctgccagggcctgaaggagcccatgtggctggacaagatcaagaagagactgaacgagcacggctacccccaggtggagggcttcgtgcaggacatgagactgatcttccagaaccacagagccagctacaagtacaaggacttcggccagatgggcttcagactggaggccgagttcgagaagaacttcaaggaggtgttcgccatccaggagaccaacggcaacaactag

SEQ ID NO: 9565 - DNA, 2307 bp, Artificial Sequence
  Description of Artificial Sequence: Synthetic coding sequence
atggcccagcagggccagcagggccagatggccagcggcgacagcaacctgaacttcagaatggtggccgagatccagaacgtggagggccagaacctgcaggagcaggtgtgccccgagcccatcttcagattcttcagagagaacaaggtggagatcgccagcgccatcaccagacccttccccttcctgatgggcctgagagacagaagcttcatcagcgagcagatgtacgagcacttccaggaggccttcagaaacctggtgcccgtgaccagagtgatgtactgcgtgctgagcgagctggagaagaccttcggctggagccacctggaggccctgttcagcagaatcaacctgatggcctaccccgacctgaacgagatctacagaagcttccagaacgtgtgctacgagcacagccccctgcagatgaacaacgtgaacgacctggaggacagacccagactgctgccctacggcaagcaggagaacagcaacgcctgccacgagatggacgacatcgccgtgccccaggaggccctgagcagcagccccagatgcgagcccggcttcagcagcgagagctgcgagcagctggccctgcccaaggccggcggcggcgacgccgaggacgcccccagcctgctgcccggcggcggcgagaccttcgacctgaagaccccccaggtgaccaacgagggcgagcccgagaagggcctgtgcctgctgcccggcgagggcgaggagggcagcgacgactgcagcgagatgtgcgacggcgaggagccccaggaggccagcagcagcctggccagatgcggcagcgtgagctgcctgagcgccgagaccttcgacctgaagaccccccaggtgaccaacgagggcgagcccgagaaggagctgagcctgctgcccggcgagggcgaggagggcagcgacgactgcagcgagatgtgcgacggcgaggagagacaggaggccagcagcagcctggccagaagaggcagcgtgagcagcgagctggagaaccaccccatgaacgaggagggcgagagcgaggagctggccagcagcctgctgtacgacaacgtgcccggcgccgagcagagcgcctacgagaacgagaagtgcagctgcgtgatgtgcttcagcgaggaggtgcccggcagccccgaggccagaaccgagagcgaccaggcctgcggcaccatggacaccgtggacatcgccaacaacagcaccctgggcaagcccaagagaaagagaagaaagaagagaggccacggctggagcagaatgagaatgagaagacaggagaacagccagcagaacgacaacagcaaggccgacggccaggtggtgagcagcgagaagaaggccaacgtgaacctgaaggacctgagcaagatcagaggcagaaagagaggcaagcccggcaccagattcacccagagcgacagagccgcccagaagagagtgagaagcagagccagcagaaagcacaaggacgagaccgtggacttcaaggcccccctgctgcccgtgacctgcggcggcgtgaagggcatcctgcacaagaagaagctgcagcagggcatcctggtgaagtgcatccagaccgaggacggcaagtggttcacccccaccgagttcgagatcaagggcggccacgccagaagcaagaactggagactgagcgtgagatgcggcggctggcccctgagatggctgatggagaacggcttcctgcccgacccccccagaatcagatacagaaagaagaagagaatcctgaagagccagaacaacagcagcgtggacccctgcatgagaaacctggacgagtgcgaggtgtgcagagacggcggcgagctgttctgctgcgacacctgcagcagagtgttccacgaggactgccacatcccccccgtggaggccgagagaaccccctggaactgcatcttctgcagaatgaaggagagccccggcagccagcagtgctgccaggagagcgaggtgctggagagacagatgtgccccgaggagcagctgaagtgcgagttcctgctgctgaaggtgtactgctgcagcgagagcagcttcttcgccaagatcccctactactactacatcagagaggcctgccagggcctgaaggagcccatgtggctggacaagatcaagaagagactgaacgagcacggctacccccaggtggagggcttcgtgcaggacatgagactgatcttccagaaccacagagccagctacaaggccgtgcacggcagacccggctgcagatag

SEQ ID NO: 9566 - DNA, 570 bp, Artificial Sequence
  Description of Artificial Sequence: Synthetic coding sequence
atggcccagcagggccagcagggccagatggccagcggcgacagcaacctgaacttcagaatggtggccgagatccagaacgtggagggccagaacctgcaggagcaggtgtgccccgagcccatcttcagattcttcagagagaacaaggtggagatcgccagcgccatcaccagacccttccccttcctgatgggcctgagagacagaagcttcatcagcgagcagatgtacgagcacttccaggaggccttcagaaacctggtgcccgtgaccagagtgatgtactgcgtgctgagcgagctggagaagaccttcggctggagccacctggaggccctgttcagcagaatcaacctgatggcctaccccgacctgaacgagatctacagaagcttccagaacgtgtgctacgagcacagccccctgcagatgaacaacgtgaacgacctggaggacagacccagactgctgccctacggcaagcaggagaacagcaacgcctgccacgagatggacttctgcctgatcctgcaggagtacgtgaccggcaagaagagagagtactag

SEQ ID NO: 9567 - DNA, 1317 bp, Artificial Sequence
  Description of Artificial Sequence: Synthetic coding sequence
atggccggcggcggcagcgacctgagcaccagaggcctgaacggcggcgtgagccaggtggccaacgagatgaaccacctgcccgcccacagccagagcctgcagagactgttcaccgaggaccaggacgtggacgagggcctggtgtacgacaccgtgttcaagcacttcaagagacacaagctggagatcagcaacgccatcaagaagaccttccccttcctggagggcctgagagacagagagctgatcaccaacaagatgttcgaggacagcgaggacagctgcagaaacctggtgcccgtgcagagagtggtgtacaacgtgctgagcgagctggagaagaccttcaacctgagcgtgctggaggccctgttcagcgaggtgaacatgcaggagtaccccgacctgatccacatctacaagagcttcaagaacgccatccaggacaagctgagcttccaggagagcgacagaaaggagagagaggagagacccgacatcaagctgagcctgaagcagggcgaggtgcccgagagccccgaggccagaaaggagagcgaccaggcctgcggcaagatggacaccgtggacatcgccaacaacagcaccctgggcaagcccaagagaaagagaagaaagaagaagggccacggctggagcagaatgggcaccagaacccagaagaacaaccagcagaacgacaacagcaaggccgacggccagctggtgagcagcgagaagaaggccaacatgaacctgaaggacctgagcaagatcagaggcagaaagagaggcaagcccggcacccacttcacccagagcgacagagccccccagaagagagtgagaagcagagccagcagaaagcacaaggacgagaccgtggacttccaggcccccctgctgcccgtgacctgcggcggcgtgaagggcatcctgcacaaggagaagctggagcagggcaccctggccaagtgcatccagaccgaggacggcaagtggttcacccccatggagttcgagatcaagggcggctacgccagaagcaagaactggagactgagcgtgagatgcggcggctggcccctgagaagactgatggaggagggcagcctgcccaacccccccagaatctactacagaaacaagaagagaatcctgaagagccagaacaacagcagcgtggacccctgcatgagaaacctggacgagtgcgaggtgtgcagagacggcggcgagctgttctgctgcgacacctgcagcagagtgttccacgaggactgccacatcccccccgtggagagcgagaagtag

SEQ ID NO: 9568 - DNA, 1212 bp, Artificial Sequence
  Description of Artificial Sequence: Synthetic coding sequence
atggccggcggcggcagcgacctgagcaccagaggcctgaacggcggcgtgagccaggtggccaacgagatgaaccacctgcccgcccacagccagagcctgcagagactgttcaccgaggaccaggacgtggacgagggcctggtgtacgacaccgtgttcaagcacttcaagagacacaagctggagatcagcaacgccatcaagaagaccttccccttcctggagggcctgagagacagagagctgatcaccaacaagatgttcgaggacagcgaggacagctgcagaaacctggtgcccgtgcagagagtggtgtacaacgtgctgagcgagctggagaagaccttcaacctgagcgtgctggaggccctgttcagcgaggtgaacatgcaggagtaccccgacctgatccacatctacaagagcttcaagaacgccatccaggacaagctgagcttccaggagagcgacagaaaggagagagaggagagacccgacatcaagctgagcctgaagcagggcgaggtgcccgagagccccgaggccagaaaggagagcgaccaggcctgcggcaagatggacaccgtggacatcgccaacaacagcaccctgggcaagcccaagagaaagagaagaaagaagaagggccacggctggagcagaatgggcaccagaacccagaagaacaaccagcagaacgacaacagcaaggccgacggccagctggtgagcagcgagaagaaggccaacatgaacctgaaggacctgagcaagatcagaggcagaaagagaggcaagcccggcacccacttcacccagagcgacagagccccccagaagagagtgagaagcagaggcaccctggccaagtgcatccagaccgaggacggcaagtggttcacccccatggagttcgagatcaagggcggctacgccagaagcaagaactggagactgagcgtgagatgcggcggctggcccctgagaagactgatggaggagggcagcctgcccaacccccccagaatctactacagaaacaagaagagaatcctgaagagccagaacaacagcagcgtggacccctgcatgagaaacctggacgagtgcgaggtgtgcagagacggcggcgagctgttctgctgcgacacctgcagcagagtgttccacgaggactgccacatcccccccgtggagagcgagaagtag

SEQ ID NO: 9569 - DNA, 1743 bp, Artificial Sequence
  Description of Artificial Sequence: Synthetic coding sequence
atggccggcggcggcagcgacctgagcaccagaggcctgaacggcggcgtgagccaggtggccaacgagatgaaccacctgcccgcccacagccagagcctgcagagactgttcaccgaggaccaggacgtggacgagggcctggtgtacgacaccgtgttcaagcacttcaagagacacaagctggagatcagcaacgccatcaagaagaccttccccttcctggagggcctgagagacagagagctgatcaccaacaagatgttcgaggacagcgaggacagctgcagaaacctggtgcccgtgcagagagtggtgtacaacgtgctgagcgagctggagaagaccttcaacctgagcgtgctggaggccctgttcagcgaggtgaacatgcaggagtaccccgacctgatccacatctacaagagcttcaagaacgccatccaggacaagctgagcttccaggagagcgacagaaaggagagagaggagagacccgacatcaagctgagcctgaagcagggcgaggtgcccgagagccccgaggccagaaaggagagcgaccaggcctgcggcaagatggacaccgtggacatcgccaacaacagcaccctgggcaagcccaagagaaagagaagaaagaagaagggccacggctggagcagaatgggcaccagaacccagaagaacaaccagcagaacgacaacagcaaggccgacggccagctggtgagcagcgagaagaaggccaacatgaacctgaaggacctgagcaagatcagaggcagaaagagaggcaagcccggcacccacttcacccagagcgacagagccccccagaagagagtgagaagcagagccagcagaaagcacaaggacgagaccgtggacttccaggcccccctgctgcccgtgacctgcggcggcgtgaagggcatcctgcacaaggagaagctggagcagggcaccctggccaagtgcatccagaccgaggacggcaagtggttcacccccatggagttcgagatcaagggcggctacgccagaagcaagaactggagactgagcgtgagatgcggcggctggcccctgagaagactgatggaggagggcagcctgcccaacccccccagaatctactacagaaacaagaagagaatcctgaagagccagaacaacagcagcgtggacccctgcatgagaaacctggacgagtgcgaggtgtgcagagacggcggcgagctgttctgctgcgacacctgcagcagagtgttccacgaggactgccacatcccccccgtggagagcgagaagaccccctggaactgcatcttctgcagaatgaaggagagccccggcagccagcagtgctgccaggagagcgaggtgctggagagacagatgtgccccgaggagcagctgaagtgcgagttcctgctgctgaaggtgtactgctgcagcgagagcagcttcttcgccaagatcccctactactactacatcagagaggcctgccagggcctgaaggagcccatgtggctggacaagatcaagaagagactgaacgagcacggctacccccaggtggagggcttcgtgcaggacatgagactgatcttccagaaccacagagccagctacaagtacaaggacttcggccagatgggcctgagactggaggccgagttcgagaaggacttcaaggaggtgttcgccatccaggagaccaacggcaacagctag

SEQ ID NO: 9570 - DNA, 1317 bp, Artificial Sequence; identical to SEQ ID NO: 9567
  Description of Artificial Sequence: Synthetic coding sequence

SEQ ID NO: 9571 - DNA, 390 bp, Artificial Sequence
  Description of Artificial Sequence: Synthetic coding sequence
atgttcgaggacagcgaggacagctgcagaaacctggtgcccgtgcagagagtggtgtacaacgtgctgagcgagctggagaagaccttcaacctgagcgtgctggaggccctgttcagcgaggtgaacatgcaggagtaccccgacctgatccacatctacaagagcttcaagaacgccatccaggacaagctgagcttccaggagagcgacagaaaggagagagaggagagacccgacatcaagctgagcctgaagcagggcgaggtgcccgagagccccgaggccagaaaggagagcgaccaggcctgcggcaagatggacaccgtggacatcgccaacaacagcaccctgggcaagcccaagagaaagagaagcaagaacaagtag

SEQ ID NO: 9572 - DNA, 750 bp, Artificial Sequence
  Description of Artificial Sequence: Synthetic coding sequence
atggccgccaccgccgccgtgagccccagcgactacctgcagcccgccgccagcaccacccaggacagccagcccagccccctggccctgctggccgccacctgcagcaagatcggcccccccgccgtggaggccgccgtgaccccccccgcccccccccagcccacccccagaaagctggtgcccatcaagcccgcccccctgcccctgagccccggcaagaacagcttcggcatcctgagcagcaagggcaacatcctgcagatccagggcagccagctgagcgccagctaccccggcggccagctggtgttcgccatccagaaccccaccatgatcaacaagggcaccagaagcaacgccaacatccagtaccaggccgtgccccagatccaggccagcaacagccagaccatccaggtgcagcccaacctgaccaaccagatccagatcatccccggcaccaaccaggccatcatcacccccagccccagcagccacaagcccgtgcccatcaagcccgcccccatccagaagagcagcaccaccaccacccccgtgcagagcggcgccaacgtggtgaagctgaccggcggcggcggcaacgtgaccctgaccctgcccgtgaacaacctggtgaacgccagcgacaccggcgcccccacccagctgctgaccgccagctgccagaccggcatgctgaacagcaccagaatgttcctgttcctggccttcatcaacgtgctgtag

SEQ ID NO: 9573 - DNA, 1842 bp, Artificial Sequence
  Description of Artificial Sequence: Synthetic coding sequence
atgagcgacccccagaccagcatggccgccaccgccgccgtgagccccagcgactacctgcagcccgccgccagcaccacccaggacagccagcccagccccctggccctgctggccgccacctgcagcaagatcggcccccccgccgtggaggccgccgtgaccccccccgcccccccccagcccacccccagaaagctggtgcccatcaagcccgcccccctgcccctgagccccggcaagaacagcttcggcatcctgagcagcaagggcaacatcctgcagatccagggcagccagctgagcgccagctaccccggcggccagctggtgttcgccatccagaaccccaccatgatcaacaagggcaccagaagcaacgccaacatccagtaccaggccgtgccccagatccaggccagcaacagccagaccatccaggtgcagcccaacctgaccaaccagatccagatcatccccggcaccaaccaggccatcatcacccccagccccagcagccacaagcccgtgcccatcaagcccgcccccatccagaagagcagcaccaccaccacccccgtgcagagcggcgccaacgtggtgaagctgaccggcggcggcggcaacgtgaccctgaccctgcccgtgaacaacctggtgaacgccagcgacaccggcgcccccacccagctgctgaccgagagcccccccacccccctgagcaagaccaacaagaaggccagaaagaagagcctgcccgccagccagccccccgtggccgtggccgagcaggtggagaccgtgctgatcgagaccaccgccgacaacatcatccaggccggcaacaacctgctgatcgtgcagagccccggcggcggccagcccgccgtggtgcagcaggtgcaggtggtgccccccaaggccgagcagcagcaggtggtgcagatcccccagcaggccctgagagtggtgcaggccgccagcgccaccctgcccaccgtgccccagaagcccagccagaacttccagatccaggccgccgagcccacccccacccaggtgtacatcagaacccccagcggcgaggtgcagaccgtgctggtgcaggacagcccccccgccaccgccgccgccaccagcaacaccacctgcagcagccccgccagcagagccccccacctgagcggcaccagcaagaagcacagcgccgccatcctgagaaaggagagacccctgcccaagatcgcccccgccggcagcatcatcagcctgaacgccgcccagctggccgccgccgcccaggccatgcagaccatcaacatcaacggcgtgcaggtgcagggcgtgcccgtgaccatcaccaacaccggcggccagcagcagctgaccgtgcagaacgtgagcggcaacaacctgaccatcagcggcctgagccccacccagatccagctgcagatggagcaggccctggccggcgagacccagcccggcgagaagagaagaagaatggcctgcacctgccccaactgcaaggacggcgagaagagaagcggcgagcagggcaagaagaagcacgtgtgccacatccccgactgcggcaagaccttcagaaagaccagcctgctgagagcccacgtgagactgcacaccggcgagagacccttcgtgtgcaactggttcttctgcggcaagagattcaccagaagcgacgagctgcagagacacgccagaacccacaccggcgacaagagattcgagtgcgcccagtgccagaagagattcatgagaagcgaccacctgaccaagcactacaagacccacctggtgaccaagaacctgtag

SEQ ID NO: 9574 - DNA, 1197 bp, Artificial Sequence
  Description of Artificial Sequence: Synthetic coding sequence
atggccgccgtggccgtgctgagaaacgacagcctgcaggccttcctgcaggacagaacccccagcgccagccccgacctgggcaagcacagccccctggccctgctggccgccacctgcagcagaatcggccagcccggcgccgccgccccccccgacttcctgcaggtgccctacgaccccgccctgggcagccccagcagactgttccacccctggaccgccgacatgcccgcccacagccccggcgccctgccccccccccaccccagcctgggcctgaccccccagaagacccacctgcagcccagcttcggcgccgcccacgagctgcccctgaccccccccgccgaccccagctacccctacgagttcagccccgtgaagatgctgcccagcagcatggccgccctgcccgccagctgcgcccccgcctacgtgccctacgccgcccaggccgccctgccccccggctacagcaacctgctgccccccccccccccccccccccccccccccacctgcagacagctgagccccaaccccgcccccgacgacctgccctggtggagcatcccccaggccggcgccggccccggcgccagcggcgtgcccggcagcggcctgagcggcgcctgcgccggcgccccccacgcccccagattccccgccagcgccgccgccgccgccgccgccgccgccgccctgcagagaggcctggtgctgggccccagcgacttcgcccagtaccagagccagatcgccgccctgctgcagaccaaggcccccctggccgccaccgccagaagatgcagaagatgcagatgccccaactgccaggccgccggcggcgcccccgaggccgagcccggcaagaagaagcagcacgtgtgccacgtgcccggctgcggcaaggtgtacggcaagaccagccacctgaaggcccacctgagatggcacaccggcgagagacccttcgtgtgcaactggctgttctgcggcaagagcttcaccagaagcgacgagctgcagagacacctgagaacccacaccggcgagaagagattcgcctgccccgagtgcggcaagagattcatgagaagcgaccacctggccaagcacgtgaagacccaccagaacaagaagctgaaggtggccgaggccggcgtgaagagagaggacgccagagacctgtag

SEQ ID NO: 9575 - DNA, 1131 bp, Artificial Sequence
  Description of Artificial Sequence: Synthetic coding sequence
atgctgaccgccgtgtgcggcagcctgggcagccagcacaccgaggccccccacgccagcccccccagactggacctgcagcccctgcagacctaccagggccacaccagccccgaggccggcgactaccccagccccctgcagcccggcgagctgcagagcctgcccctgggccccgaggtggacttcagccagggctacgagctgcccggcgccagcagcagagtgacctgcgaggacctggagagcgacagccccctggcccccggccccttcagcaagctgctgcagcccgacatgagccaccactacgagagctggttcagacccacccaccccggcgccgaggacggcagctggtgggacctgcaccccggcaccagctggatggacctgccccacacccagggcgccctgaccagccccggccaccccggcgccctgcaggccggcctgggcggctacgtgggcgaccaccagctgtgcgccccccccccccacccccacgcccaccacctgctgcccgccgccggcggccagcacctgctgggcccccccgacggcgccaaggccctggaggtggccgcccccgagagccagggcctggacagcagcctggacggcgccgccagacccaagggcagcagaagaagcgtgcccagaagcagcggccagaccgtgtgcagatgccccaactgcctggaggccgagagactgggcgccccctgcggccccgacggcggcaagaagaagcacctgcacaactgccacatccccggctgcggcaaggcctacgccaagaccagccacctgaaggcccacctgagatggcacagcggcgacagacccttcgtgtgcaactggctgttctgcggcaagagattcaccagaagcgacgagctgcagagacacctgcagacccacaccggcaccaagaagttcccctgcgccgtgtgcagcagagtgttcatgagaagcgaccacctggccaagcacatgaagacccacgagggcgccaaggaggaggccgccggcgccgccagcggcgagggcaaggccggcggcgccgtggagccccccggcggcaagggcaagagagaggccgagggcagcgtggcccccagcaactag

SEQ ID NO: 9576 - DNA, 1131 bp, Artificial Sequence; identical to SEQ ID NO: 9575
  Description of Artificial Sequence: Synthetic coding sequence

SEQ ID NO: 9577 - DNA, 1455 bp, Artificial Sequence
  Description of Artificial Sequence: Synthetic coding sequence
atggccaccagcatcctgggcgaggagcccagattcggcaccacccccctggccatgctggccgccacctgcaacaagatcggcaacaccagccccctgaccaccctgcccgagagcagcgccttcgccaagggcggcttccacccctggaagagaagcagcagcagctgcaacctgggcagcagcctgagcggcttcgccgtggccaccggcggcagaggcagcggcggcctggccggcggcagcggcgccgccaacagcgccttctgcctggccagcaccagccccaccagcagcgccttcagcagcgactacggcggcctgttcagcaacagcgccgccgccgccgccgccgccgccggcgtgagcccccaggaggccggcggccagagcgccttcatcagcaaggtgcacaccaccgccgccgacggcctgtaccccagagtgggcatggcccacccctacgagagctggtacaagagcggcttccacagcaccctggccgccggcgaggtgaccaacggcgccgccagcagctggtgggacgtgcacagcagccccggcagctggctggaggtgcagaaccccgccggcggcctgcagagcagcctgcacagcggcgccccccaggccagcctgcacagccagctgggcacctacaaccccgacttcagcagcctgacccacagcgccttcagcagcaccggcctgggcagcagcgccgccgccgccagccacctgctgagcaccagccagcacctgctggcccaggacggcttcaagcccgtgctgcccagctacagcgacagcagcgccgccgtggccgccgccgccgccagcgccatgatcagcggcgccgccgccgccgccgccggcggcagcagcgccagaagcgccagaagatacagcggcagagccacctgcgactgccccaactgccaggaggccgagagactgggccccgccggcgccagcctgagaagaaagggcctgcacagctgccacatccccggctgcggcaaggtgtacggcaagaccagccacctgaaggcccacctgagatggcacaccggcgagagacccttcgtgtgcaactggctgttctgcggcaagagattcaccagaagcgacgagctgcagagacacctgagaacccacaccggcgagaagagattcgcctgccccgtgtgcaacaagagattcatgagaagcgaccacctgagcaagcacatcaagacccacaacggcggcggcggcggcaagaagggcagcgacagcgacaccgacgccagcaacctggagacccccagaagcgagagccccgacctgatcctgcacgacagcggcgtgagcgccgccagagccgccgccgccgccgccgccgccgccgccgccgccgccgccgccgccagcgccggcggcaaggaggccgccagcggccccaacgacagctag

SEQ ID NO: 9578 - DNA, 1125 bp, Artificial Sequence
  Description of Artificial Sequence: Synthetic coding sequence
atgagcagagtgcccagcccccccccccccgccgagatgagcagcggccccgtggccgagagctggtgctacacccagatcaaggtggtgaagttcagctacatgtggaccatcaacaacttcagcttctgcagagaggagatgggcgaggtgatcaagagcagcaccttcagcagcggcgccaacgacaagctgaagtggtgcctgagagtgaaccccaagggcctggacgaggagagcaaggactacctgagcctgtacctgctgctggtgagctgccccaagagcgaggtgagagccaagttcaagttcagcatcctgaacgccaagggcgaggagaccaaggccatggagagccagagagcctacagattcgtgcagggcaaggactggggcttcaagaagttcatcagaagagacttcctgctggacgaggccaacggcctgctgcccgacgacaagctgaccctgttctgcgaggtgagcgtggtgcaggacagcgtgaacatcagcggccagaacaccatgaacatggtgaaggtgcccgagtgcagactggccgacgagctgggcggcctgtgggagaacagcagattcaccgactgctgcctgtgcgtggccggccaggagttccaggcccacaaggccatcctggccgccagaagccccgtgttcagcgccatgttcgagcacgagatggaggagagcaagaagaacagagtggagatcaacgacgtggagcccgaggtgttcaaggagatgatgtgcttcatctacaccggcaaggcccccaacctggacaagatggccgacgacctgctggccgccgccgacaagtacgccctggagagactgaaggtgatgtgcgaggacgccctgtgcagcaacctgagcgtggagaacgccgccgagatcctgatcctggccgacctgcacagcgccgaccagctgaagacccaggccgtggacttcatcaactaccacgccagcgacgtgctggagaccagcggctggaagagcatggtggtgagccacccccacctggtggccgaggcctacagaagcctggccagcgcccagtgccccttcctgggcccccccagaaagagactgaagcagagctag

SEQ ID NO: 9579 - DNA, 1125 bp, Artificial Sequence; identical to SEQ ID NO: 9578
  Description of Artificial Sequence: Synthetic coding sequence

SEQ ID NO: 9580 - DNA, 1125 bp, Artificial Sequence; identical to SEQ ID NO: 9578
  Description of Artificial Sequence: Synthetic coding sequence

SEQ ID NO: 9581 - DNA, 99 bp, Artificial Sequence
  Description of Artificial Sequence: Synthetic coding sequence
atgagcagagtgcccagcccccccccccccgccgagatgagcagcggccccgtggccgagagctggtgctacacccagatcaaggtggtgaagttctag

SEQ ID NO: 9582 - DNA, 777 bp, Artificial Sequence
  Description of Artificial Sequence: Synthetic coding sequence
atggagagccagagagcctacagattcgtgcagggcaaggactggggcttcaagaagttcatcagaagagacttcctgctggacgaggccaacggcctgctgcccgacgacaagctgaccctgttctgcgaggtgagcgtggtgcaggacagcgtgaacatcagcggccagaacaccatgaacatggtgaaggtgcccgagtgcagactggccgacgagctgggcggcctgtgggagaacagcagattcaccgactgctgcctgtgcgtggccggccaggagttccaggcccacaaggccatcctggccgccagaagccccgtgttcagcgccatgttcgagcacgagatggaggagagcaagaagaacagagtggagatcaacgacgtggagcccgaggtgttcaaggagatgatgtgcttcatctacaccggcaaggcccccaacctggacaagatggccgacgacctgctggccgccgccgacaagtacgccctggagagactgaaggtgatgtgcgaggacgccctgtgcagcaacctgagcgtggagaacgccgccgagatcctgatcctggccgacctgcacagcgccgaccagctgaagacccaggccgtggacttcatcaactaccacgccagcgacgtgctggagaccagcggctggaagagcatggtggtgagccacccccacctggtggccgaggcctacagaagcctggccagcgcccagtgccccttcctgggcccccccagaaagagactgaagcagagctag

SEQ ID NO: 9583 - DNA, 1125 bp, Artificial Sequence; identical to SEQ ID NO: 9578
  Description of Artificial Sequence: Synthetic coding sequence

SEQ ID NO: 9584 - DNA, 1125 bp, Artificial Sequence; identical to SEQ ID NO: 9578
  Description of Artificial Sequence: Synthetic coding sequence

SEQ ID NO: 9585 - DNA, 717 bp, Artificial Sequence
  Description of Artificial Sequence: Synthetic coding sequence
atgagcagagtgcccagcccccccccccccgccgagatgagcagcggccccgtggccgagagctggtgctacacccagatcaaggtggtgaagttcagctacatgtggaccatcaacaacttcagcttctgcagagaggagatgggcgaggtgatcaagagcagcaccttcagcagcggcgccaacgacaagctgaagtggtgcctgagagtgaaccccaagggcctggacgaggagagcaaggactacctgagcctgtacctgctgctggtgagctgccccaagagcgaggtgagagccaagttcaagttcagcatcctgaacgccaagggcgaggagaccaaggccatggagagccagagagcctacagattcgtgcagggcaaggactggggcttcaagaagttcatcagaagagacttcctgctggacgaggccaacggcctgctgcccgacgacaagctgaccctgttctgcgaggtgagcgtggtgcaggacagcgtgaacatcagcggccagaacaccatgaacatggtgaaggtgcccgagtgcagactggccgacgagctgggcggcctgtgggagaacagcagattcaccgactgctgcctgtgcgtggccggccaggagttccaggcccacaaggccatcctggccgccagaagccccgtgttcagcgccatgttcgagcacgagatggaggagagcaagaagtag

SEQ ID NO: 9586 - DNA, 561 bp, Artificial Sequence
  Description of Artificial Sequence: Synthetic coding sequence
atgagcagagtgcccagcccccccccccccgccgagatgagcagcggccccgtggccgagagctggtgctacacccagatcaaggtggtgaagttcagctacatgtggaccatcaacaacttcagcttctgcagagaggagatgggcgaggtgatcaagagcagcaccttcagcagcggcgccaacgacaagctgaagtggtgcctgagagtgaaccccaagggcctggacgaggagagcaaggactacctgagcctgtacctgctgctggtgagctgccccaagagcgaggtgagagccaagttcaagttcagcatcctgaacgccaagggcgaggagaccaaggccatggagagccagagagcctacagattcgtgcagggcaaggactggggcttcaagaagttcatcagaagagacttcctgctggacgaggccaacggcctgctgcccgacgacaagctgaccctgttctgcgaggtgagcgtggtgcaggacagcgtgaacatcagcggccagaacaccatgaacatggtgaaggtgcccgagtgcagactgtag

SEQ ID NO: 9587 - DNA, 123 bp, Artificial Sequence
  Description of Artificial Sequence: Synthetic coding sequence
atgagcagagtgcccagcccccccccccccgccgagatgagcagcggccccgtggccgagagctggtgctacacccagatcaaggtggtgaagttcagctacatgtggaccatcaacaactag

SEQ ID NO: 9588 - DNA, 789 bp, Artificial Sequence
  Description of Artificial Sequence: Synthetic coding sequence
atgagcagagtgcccagcccccccccccccgccgagatgagcagcggccccgtggccgagagctggtgctacacccagatcaaggtggtgaagttcagctacatgtggaccatcaacaacttcagcttctgcagagaggagatgggcgaggtgatcaagagcagcaccttcagcagcggcgccaacgacaagctgaagtggtgcctgagagtgaaccccaagggcctggacgaggagagcaaggactacctgagcctgtacctgctgctggtgagctgccccaagagcgaggtgagagccaagttcaagttcagcatcctgaacgccaagggcgaggagaccaaggccatggagagccagagagcctacagattcgtgcagggcaaggactggggcttcaagaagttcatcagaagagacttcctgctggacgaggccaacggcctgctgcccgacgacaagctgaccctgttctgcgaggtgagcgtggtgcaggacagcgtgaacatcagcggccagaacaccatgaacatggtgaaggtgcccgagtgcagactggccgacgagctgggcggcctgtgggagaacagcagattcaccgactgctgcctgtgcgtggccggccaggagttccaggcccacaaggccatcctggccgccagaagccccgtgttcagcgccatgttcgagcacgagatggaggagagcaagaagaacagagtggagatcaacgacgtggagcccgaggtgttcaaggagatgatgtgcttcatctacaccggcaagtag

SEQ ID NO: 9589 - DNA, 201 bp, Artificial Sequence
  Description of Artificial Sequence: Synthetic coding sequence
atgagcagagtgcccagcccccccccccccgccgagatgagcagcggccccgtggccgagagctggtgctacacccagatcaaggtggtgaagttcagctacatgtggaccatcaacaacttcagcttctgcagagaggagatgggcgaggtgatcaagagcagcaccttcagcagcggcgccaacgacaagctgaagtag

SEQ ID NO: 9590 - DNA, 984 bp, Artificial Sequence
  Description of Artificial Sequence: Synthetic coding sequence
atgggcgaggtgatcaagagcagcaccttcagcagcggcgccaacgacaagctgaagtggtgcctgagagtgaaccccaagggcctggacgaggagagcaaggactacctgagcctgtacctgctgctggtgagctgccccaagagcgaggtgagagccaagttcaagttcagcatcctgaacgccaagggcgaggagaccaaggccatggagagccagagagcctacagattcgtgcagggcaaggactggggcttcaagaagttcatcagaagagacttcctgctggacgaggccaacggcctgctgcccgacgacaagctgaccctgttctgcgaggtgagcgtggtgcaggacagcgtgaacatcagcggccagaacaccatgaacatggtgaaggtgcccgagtgcagactggccgacgagctgggcggcctgtgggagaacagcagattcaccgactgctgcctgtgcgtggccggccaggagttccaggcccacaaggccatcctggccgccagaagccccgtgttcagcgccatgttcgagcacgagatggaggagagcaagaagaacagagtggagatcaacgacgtggagcccgaggtgttcaaggagatgatgtgcttcatctacaccggcaaggcccccaacctggacaagatggccgacgacctgctggccgccgccgacaagtacgccctggagagactgaaggtgatgtgcgaggacgccctgtgcagcaacctgagcgtggagaacgccgccgagatcctgatcctggccgacctgcacagcgccgaccagctgaagacccaggccgtggacttcatcaactaccacgccagcgacgtgctggagaccagcggctggaagagcatggtggtgagccacccccacctggtggccgaggcctacagaagcctggccagcgcccagtgccccttcctgggcccccccagaaagagactgaagcagagctag

SEQ ID NO: 9591 - DNA, 417 bp, Artificial Sequence
  Description of Artificial Sequence: Synthetic coding sequence
atgagcagagtgcccagcccccccccccccgccgagatgagcagcggccccgtggccgagagctggtgctacacccagatcaaggtggtgaagttcagctacatgtggaccatcaacaacttcagcttctgcagagaggagatgggcgaggtgatcaagagcagcaccttcagcagcggcgccaacgacaagctgaagtggtgcctgagagtgaaccccaagggcctggacgaggagagcaaggactacctgagcctgtacctgctgctggtgagctgccccaagagcgaggtgagagccaagttcaagttcagcatcctgaacgccaagggcgaggagaccaaggccatggagagccagagagcctacagattcgtgcagggcaaggactggggcttcaagaagttcatcagatag

SEQ ID NO: 9592 - DNA, 354 bp, Artificial Sequence
  Description of Artificial Sequence: Synthetic coding sequence
atgagcagagtgcccagcccccccccccccgccgagatgagcagcggccccgtggccgagagctggtgctacacccagatcaaggtggtgaagttcagctacatgtggaccatcaacaacttcagcttctgcagagaggagatgggcgaggtgatcaagagcagcaccttcagcagcggcgccaacgacaagctgaagtggtgcctgagagtgaaccccaagggcctggacgaggagagcaaggactacctgagcctgtacctgctgctggtgagctgccccaagagcgaggtgagagccaagttcaagttcagcatcctgaacgccaagggcgaggagaccaaggccatgtag

SEQ ID NO: 9593 - DNA, 1179 bp, Artificial Sequence
  Description of Artificial Sequence: Synthetic coding sequence
atgagcagagagcccaccccccccctgcccggcgacatgagcaccggccccatcgccgagagctggtgctacacccaggtgaaggtggtgaagttcagctacatgtggaccatcaacaacttcagcttctgcagagaggagatgggcgaggtgctgaagagcagcaccttcagcagcggccccagcgacaagatgaagtggtgcctgagagtgaaccccaagggcctggacgacgagagcaaggactacctgagcctgtacctgctgctggtgagctgccccaagagcgaggtgagagccaagttcaagttcagcctgctgaacgccaagagagaggagaccaaggccatggagagccagagagcctacagattcgtgcagggcaaggactggggcttcaagaagttcatcagaagagacttcctgctggacgaggccaacggcctgctgcccgacgacaagctgaccctgttctgcgaggtgagcgtggtgcaggacagcgtgaacatcagcggccacaccaacaccaacaccctgaaggtgcccgagtgcagactggccgaggacctgggcaacctgtgggagaacaccagattcaccgactgcagcttcttcgtgagaggccaggagttcaaggcccacaagagcgtgctggccgccagaagccccgtgttcaacgccatgttcgagcacgagatggaggagagcaagaagaacagagtggagatcaacgacctggaccccgaggtgttcaaggagatgatgagattcatctacaccggcagagcccccaacctggacaagatggccgacaacctgctggccgccgccgacaagtacgccctggagagactgaaggtgatgtgcgaggaggccctgtgcagcaacctgagcgtggagaacgtggccgacaccctggtgctggccgacctgcacagcgccgagcagctgaaggcccaggccatcgacttcatcaacagatgcagcgtgctgagacagctgggctgcaaggacggcaagaactggaacagcaaccaggccaccgacatcatggagaccagcggctggaagagcatgatccagagccacccccacctggtggccgaggccttcagagccctggccagcgcccagtgcccccagttcggcatccccagaaagagactgaagcagagctag

SEQ ID NO: 9594 - DNA, 9675 bp, Artificial Sequence
  Description of Artificial Sequence: Synthetic coding sequence
atgcagaaggccagaggcaccagaggcgaggacgccggcaccagagccccccccagccccggcgtgccccccaagagagccaaggtgggcgccggcggcggcgcccccgtggccgtggccggcgcccccgtgttcctgagacccctgaagaacgccgccgtgtgcgccggcagcgacgtgagactgagagtggtggtgagcggcaccccccagcccagcctgagatggttcagagacggccagctgctgcccgcccccgcccccgagcccagctgcctgtggctgagaagatgcggcgcccaggacgccggcgtgtacagctgcatggcccagaacgagagaggcagagccagctgcgaggccgtgctgaccgtgctggaggtgggcgacagcgagaccgccgaggacgacatcagcgacgtgcagggcacccagagactggagctgagagacgacggcgccttcagcacccccaccggcggcagcgacaccctggtgggcaccagcctggacaccccccccaccagcgtgaccggcaccagcgaggagcaggtgagctggtggggcagcggccagaccgtgctggagcaggaggccggcagcggcggcggcaccagaagactgcccggcagccccagacaggcccaggccaccggcgccggccccagacacctgggcgtggagcccctggtgagagccagcagagccaacctggtgggcgccagctggggcagcgaggacagcctgagcgtggccagcgacctgtacggcagcgccttcagcctgtacagaggcagagccctgagcatccacgtgagcgtgccccagagcggcctgagaagagaggagcccgacctgcagccccagctggccagcgaggcccccagaagacccgcccagcccccccccagcaagagcgccctgctgcccccccccagccccagagtgggcaagagaagcccccccggcccccccgcccagcccgccgccacccccaccagcccccacagaagaacccaggagcccgtgctgcccgaggacaccaccaccgaggagaagagaggcaagaagagcaagagcagcggccccagcctggccggcaccgccgagagcagaccccagacccccctgagcgaggccagcggcagactgagcgccctgggcagaagccccagactggtgagagccggcagcagaatcctggacaagctgcagttcttcgaggagagaagaagaagcctggagagaagcgacagcccccccgcccccctgagaccctgggtgcccctgagaaaggccagaagcctggagcagcccaagagcgagagaggcgccccctggggcacccccggcgccagccaggaggagctgagagcccccggcagcgtggccgagagaagaagactgttccagcagaaggccgccagcctggacgagagaaccagacagagaagccccgccagcgacctggagctgagattcgcccaggagctgggcagaatcagaagaagcaccagcagagaggagctggtgagaagccacgagagcctgagagccaccctgcagagagcccccagccccagagagcccggcgagccccccctgttcagcagacccagcacccccaagaccagcagagccgtgagccccgccgccgcccagccccccagccccagcagcgccgagaagcccggcgacgagcccggcagacccagaagcagaggccccgccggcagaaccgagcccggcgagggcccccagcaggaggtgagaagaagagaccagttccccctgaccagaagcagagccatccaggagtgcagaagccccgtgcccccccccgccgccgacccccccgaggccagaaccaaggccccccccggcagaaagagagagccccccgcccaggccgtgagattcctgccctgggccacccccggcctggagggcgccgccgtgccccagaccctggagaagaacagagccggccccgaggccgagaagagactgagaagaggccccgaggaggacggcccctggggcccctgggacagaagaggcgccagaagccagggcaagggcagaagagccagacccaccagccccgagctggagagcagcgacgacagctacgtgagcgccggcgaggagcccctggaggcccccgtgttcgagatccccctgcagaacgtggtggtggcccccggcgccgacgtgctgctgaagtgcatcatcaccgccaacccccccccccaggtgagctggcacaaggacggcagcgccctgagaagcgagggcagactgctgctgagagccgagggcgagagacacaccctgctgctgagagaggccagagccgccgacgccggcagctacatggccaccgccaccaacgagctgggccaggccacctgcgccgccagcctgaccgtgagacccggcggcagcaccagccccttcagcagccccatcaccagcgacgaggagtacctgagcccccccgaggagttccccgagcccggcgagacctggcccagaacccccaccatgaagcccagccccagccagaacagaagaagcagcgacaccggcagcaaggccccccccaccttcaaggtgagcctgatggaccagagcgtgagagagggccaggacgtgatcatgagcatcagagtgcagggcgagcccaagcccgtggtgagctggctgagaaacagacagcccgtgagacccgaccagagaagattcgccgaggaggccgagggcggcctgtgcagactgagaatcctggccgccgagagaggcgacgccggcttctacacctgcaaggccgtgaacgagtacggcgccagacagtgcgaggccagactggaggtgagagcccaccccgagagcagaagcctggccgtgctggcccccctgcaggacgtggacgtgggcgccggcgagatggccctgttcgagtgcctggtggccggccccaccgacgtggaggtggactggctgtgcagaggcagactgctgcagcccgccctgctgaagtgcaagatgcacttcgacggcagaaagtgcaagctgctgctgaccagcgtgcacgaggacgacagcggcgtgtacacctgcaagctgagcaccgccaaggacgagctgacctgcagcgccagactgaccgtgagacccagcctggcccccctgttcaccagactgctggaggacgtggaggtgctggagggcagagccgccagattcgactgcaagatcagcggcacccccccccccgtggtgacctggacccacttcggctgccccatggaggagagcgagaacctgagactgagacaggacggcggcctgcacagcctgcacatcgcccacgtgggcagcgaggacgagggcctgtacgccgtgagcgccgtgaacacccacggccaggcccactgcagcgcccagctgtacgtggaggagcccagaaccgccgccagcggccccagcagcaagctggagaagatgcccagcatccccgaggagcccgagcagggcgagctggagagactgagcatccccgacttcctgagacccctgcaggacctggaggtgggcctggccaaggaggccatgctggagtgccaggtgaccggcctgccctaccccaccatcagctggttccacaacggccacagaatccagagcagcgacgacagaagaatgacccagtacagagacgtgcacagactggtgttccccgccgtgggcccccagcacgccggcgtgtacaagagcgtgatcgccaacaagctgggcaaggccgcctgctacgcccacctgtacgtgaccgacgtggtgcccggcccccccgacggcgccccccaggtggtggccgtgaccggcagaatggtgaccctgacctggaacccccccagaagcctggacatggccatcgaccccgacagcctgacctacaccgtgcagcaccaggtgctgggcagcgaccagtggaccgccctggtgaccggcctgagagagcccggctgggccgccaccggcctgagaaagggcgtgcagcacatcttcagagtgctgagcaccaccgtgaagagcagcagcaagcccagcccccccagcgagcccgtgcagctgctggagcacggccccaccctggaggaggcccccgccatgctggacaagcccgacatcgtgtacgtggtggagggccagcccgccagcgtgaccgtgaccttcaaccacgtggaggcccaggtggtgtggagaagctgcagaggcgccctgctggaggccagagccggcgtgtacgagctgagccagcccgacgacgaccagtactgcctgagaatctgcagagtgagcagaagagacatgggcgccctgacctgcaccgccagaaacagacacggcacccagacctgcagcgtgaccctggagctggccgaggcccccagattcgagagcatcatggaggacgtggaggtgggcgccggcgagaccgccagattcgccgtggtggtggagggcaagcccctgcccgacatcatgtggtacaaggacgaggtgctgctgaccgagagcagccacgtgagcttcgtgtacgaggagaacgagtgcagcctggtggtgctgagcaccggcgcccaggacggcggcgtgtacacctgcaccgcccagaacctggccggcgaggtgagctgcaaggccgagctggccgtgcacagcgcccagaccgccatggaggtggagggcgtgggcgaggacgaggaccacagaggcagaagactgagcgacttctacgacatccaccaggagatcggcagaggcgccttcagctacctgagaagaatcgtggagagaagcagcggcctggagttcgccgccaagttcatccccagccaggccaagcccaaggccagcgccagaagagaggccagactgctggccagactgcagcacgactgcgtgctgtacttccacgaggccttcgagagaagaagaggcctggtgatcgtgaccgagctgtgcaccgaggagctgctggagagaatcgccagaaagcccaccgtgtgcgagagcgagatcagagcctacatgagacaggtgctggagggcatccactacctgcaccagagccacgtgctgcacctggacgtgaagcccgagaacctgctggtgtgggacggcgccgccggcgagcagcaggtgagaatctgcgacttcggcaacgcccaggagctgacccccggcgagccccagtactgccagtacggcacccccgagttcgtggcccccgagatcgtgaaccagagccccgtgagcggcgtgaccgacatctggcccgtgggcgtggtggccttcctgtgcctgaccggcatcagccccttcgtgggcgagaacgacagaaccaccctgatgaacatcagaaactacaacgtggccttcgaggagaccaccttcctgagcctgagcagagaggccagaggcttcctgatcaaggtgctggtgcaggacagactgagacccaccgccgaggagaccctggagcacccctggttcaagacccaggccaagggcgccgaggtgagcaccgaccacctgaagctgttcctgagcagaagaagatggcagagaagccagatcagctacaagtgccacctggtgctgagacccatccccgagctgctgagagccccccccgagagagtgtgggtgaccatgcccagaagacccccccccagcggcggcctgagcagcagcagcgacagcgaggaggaggagctggaggagctgcccagcgtgcccagacccctgcagcccgagttcagcggcagcagagtgagcctgaccgacatccccaccgaggacgaggccctgggcacccccgagaccggcgccgccacccccatggactggcaggagcagggcagagcccccagccaggaccaggaggcccccagccccgaggccctgcccagccccggccaggagcccgccgccggcgccagccccagaagaggcgagctgagaagaggcagcagcgccgagagcgccctgcccagagccggccccagagagctgggcagaggcctgcacaaggccgccagcgtggagctgccccagagaagaagccccagccccggcgccaccagactggccagaggcggcctgggcgagggcgagtacgcccagagactgcaggccctgagacagagactgctgagaggcggccccgaggacggcaaggtgagcggcctgagaggccccctgctggagagcctgggcggcagagccagagaccccagaatggccagagccgccagcagcgaggccgccccccaccaccagccccccctggagaacagaggcctgcagaagagcagcagcttcagccagggcgaggccgagcccagaggcagacacagaagagccggcgcccccctggagatccccgtggccagactgggcgccagaagactgcaggagagccccagcctgagcgccctgagcgaggcccagcccagcagccccgccagacccagcgcccccaagcccagcacccccaagagcgccgagcccagcgccaccacccccagcgacgccccccagccccccgccccccagcccgcccaggacaaggcccccgagcccagacccgagcccgtgagagccagcaagcccgccccccccccccaggccctgcagaccctggccctgcccctgaccccctacgcccagatcatccagagcctgcagctgagcggccacgcccagggccccagccagggccccgccgccccccccagcgagcccaagccccacgccgccgtgttcgccagagtggccagccccccccccggcgcccccgagaagagagtgcccagcgccggcggcccccccgtgctggccgagaaggccagagtgcccaccgtgccccccagacccggcagcagcctgagcagcagcatcgagaacctggagagcgaggccgtgttcgaggccaagttcaagagaagcagagagagccccctgagcctgggcctgagactgctgagcagaagcagaagcgaggagagaggccccttcagaggcgccgaggaggaggacggcatctacagacccagccccgccggcacccccctggagctggtgagaagacccgagagaagcagaagcgtgcaggacctgagagccgtgggcgagcccggcctggtgagaagactgagcctgagcctgagccagagactgagaagaaccccccccgcccagagacaccccgcctgggaggccagaggcggcgacggcgagagcagcgagggcggcagcagcgccagaggcagccccgtgctggccatgagaagaagactgagcttcaccctggagagactgagcagcagactgcagagaagcggcagcagcgaggacagcggcggcgccagcggcagaagcacccccctgttcggcagactgagaagagccaccagcgagggcgagagcctgagaagactgggcctgccccacaaccagctggccgcccaggccggcgccaccacccccagcgccgagagcctgggcagcgaggccagcgccaccagcggcagcagcgcccccggcgagagcagaagcagactgagatggggcttcagcagacccagaaaggacaagggcctgagcccccccaacctgagcgccagcgtgcaggaggagctgggccaccagtacgtgagaagcgagagcgacttcccccccgtgttccacatcaagctgaaggaccaggtgctgctggagggcgaggccgccaccctgctgtgcctgcccgccgcctgccccgccccccacatcagctggatgaaggacaagaagagcctgagaagcgagcccagcgtgatcatcgtgagctgcaaggacggcagacagctgctgagcatccccagagccggcaagagacacgccggcctgtacgagtgcagcgccaccaacgtgctgggcagcatcaccagcagctgcaccgtggccgtggccagagtgcccggcaagctggccccccccgaggtgccccagacctaccaggacaccgccctggtgctgtggaagcccggcgacagcagagccccctgcacctacaccctggagagaagagtggacggcgagagcgtgtggcaccccgtgagcagcggcatccccgactgctactacaacgtgacccacctgcccgtgggcgtgaccgtgagattcagagtggcctgcgccaacagagccggccagggccccttcagcaacagcagcgagaaggtgttcgtgagaggcacccaggacagcagcgccgtgcccagcgccgcccaccaggaggcccccgtgaccagcagacccgccagagccagaccccccgacagccccaccagcctggccccccccctggcccccgccgcccccaccccccccagcgtgaccgtgagccccagcagcccccccaccccccccagccaggccctgagcagcctgaaggccgtgggcccccccccccagaccccccccagaagacacagaggcctgcaggccgccagacccgccgagcccaccctgcccagcacccacgtgacccccagcgagcccaagcccttcgtgctggacaccggcacccccatccccgccagcaccccccagggcgtgaagcccgtgagcagcagcacccccgtgtacgtggtgaccagcttcgtgagcgccccccccgcccccgagccccccgcccccgagcccccccccgagcccaccaaggtgaccgtgcagagcctgagccccgccaaggaggtggtgagcagccccggcagcagccccagaagcagccccagacccgagggcaccaccctgagacagggccccccccagaagccctacaccttcctggaggagaaggccagaggcagattcggcgtggtgagagcctgcagagagaacgccaccggcagaaccttcgtggccaagatcgtgccctacgccgccgagggcaagagaagagtgctgcaggagtacgaggtgctgagaaccctgcaccacgagagaatcatgagcctgcacgaggcctacatcacccccagatacctggtgctgatcgccgagagctgcggcaacagagagctgctgtgcggcctgagcgacagattcagatacagcgaggacgacgtggccacctacatggtgcagctgctgcagggcctggactacctgcacggccaccacgtgctgcacctggacatcaagcccgacaacctgctgctggcccccgacaacgccctgaagatcgtggacttcggcagcgcccagccctacaacccccaggccctgagacccctgggccacagaaccggcaccctggagttcatggcccccgagatggtgaagggcgagcccatcggcagcgccaccgacatctggggcgccggcgtgctgacctacatcatgctgagcggcagaagccccttctacgagcccgacccccaggagaccgaggccagaatcgtgggcggcagattcgacgccttccagctgtaccccaacaccagccagagcgccaccctgttcctgagaaaggtgctgagcgtgcacccctggctgagcagacccagcagctgcctgagcgtgtgccacaaggagatcaagatggccagcagctag

SEQ ID NO: 9595 - DNA, 9804 bp, Artificial Sequence
  Description of Artificial Sequence: Synthetic coding sequence
atgcagaaggccagaggcaccagaggcgaggacgccggcaccagagccccccccagccccggcgtgccccccaagagagccaaggtgggcgccggcggcggcgcccccgtggccgtggccggcgcccccgtgttcctgagacccctgaagaacgccgccgtgtgcgccggcagcgacgtgagactgagagtggtggtgagcggcaccccccagcccagcctgagatggttcagagacggccagctgctgcccgcccccgcccccgagcccagctgcctgtggctgagaagatgcggcgcccaggacgccggcgtgtacagctgcatggcccagaacgagagaggcagagccagctgcgaggccgtgctgaccgtgctggaggtgggcgacagcgagaccgccgaggacgacatcagcgacgtgcagggcacccagagactggagctgagagacgacggcgccttcagcacccccaccggcggcagcgacaccctggtgggcaccagcctggacaccccccccaccagcgtgaccggcaccagcgaggagcaggtgagctggtggggcagcggccagaccgtgctggagcaggaggccggcagcggcggcggcaccagaagactgcccggcagccccagacaggcccaggccaccggcgccggccccagacacctgggcgtggagcccctggtgagagccagcagagccaacctggtgggcgccagctggggcagcgaggacagcctgagcgtggccagcgacctgtacggcagcgccttcagcctgtacagaggcagagccctgagcatccacgtgagcgtgccccagagcggcctgagaagagaggagcccgacctgcagccccagctggccagcgaggcccccagaagacccgcccagcccccccccagcaagagcgccctgctgcccccccccagccccagagtgggcaagagaagcccccccggcccccccgcccagcccgccgccacccccaccagcccccacagaagaacccaggagcccgtgctgcccgaggacaccaccaccgaggagaagagaggcaagaagagcaagagcagcggccccagcctggccggcaccgccgagagcagaccccagacccccctgagcgaggccagcggcagactgagcgccctgggcagaagccccagactggtgagagccggcagcagaatcctggacaagctgcagttcttcgaggagagaagaagaagcctggagagaagcgacagcccccccgcccccctgagaccctgggtgcccctgagaaaggccagaagcctggagcagcccaagagcgagagaggcgccccctggggcacccccggcgccagccaggaggagctgagagcccccggcagcgtggccgagagaagaagactgttccagcagaaggccgccagcctggacgagagaaccagacagagaagccccgccagcgacctggagctgagattcgcccaggagctgggcagaatcagaagaagcaccagcagagaggagctggtgagaagccacgagagcctgagagccaccctgcagagagcccccagccccagagagcccggcgagccccccctgttcagcagacccagcacccccaagaccagcagagccgtgagccccgccgccgcccagccccccagccccagcagcgccgagaagcccggcgacgagcccggcagacccagaagcagaggccccgccggcagaaccgagcccggcgagggcccccagcaggaggtgagaagaagagaccagttccccctgaccagaagcagagccatccaggagtgcagaagccccgtgcccccccccgccgccgacccccccgaggccagaaccaaggccccccccggcagaaagagagagccccccgcccaggccgtgagattcctgccctgggccacccccggcctggagggcgccgccgtgccccagaccctggagaagaacagagccggccccgaggccgagaagagactgagaagaggccccgaggaggacggcccctggggcccctgggacagaagaggcgccagaagccagggcaagggcagaagagccagacccaccagccccgagctggagagcagcgacgacagctacgtgagcgccggcgaggagcccctggaggcccccgtgttcgagatccccctgcagaacgtggtggtggcccccggcgccgacgtgctgctgaagtgcatcatcaccgccaacccccccccccaggtgagctggcacaaggacggcagcgccctgagaagcgagggcagactgctgctgagagccgagggcgagagacacaccctgctgctgagagaggccagagccgccgacgccggcagctacatggccaccgccaccaacgagctgggccaggccacctgcgccgccagcctgaccgtgagacccggcggcagcaccagccccttcagcagccccatcaccagcgacgaggagtacctgagcccccccgaggagttccccgagcccggcgagacctggcccagaacccccaccatgaagcccagccccagccagaacagaagaagcagcgacaccggcagcaaggccccccccaccttcaaggtgagcctgatggaccagagcgtgagagagggccaggacgtgatcatgagcatcagagtgcagggcgagcccaagcccgtggtgagctggctgagaaacagacagcccgtgagacccgaccagagaagattcgccgaggaggccgagggcggcctgtgcagactgagaatcctggccgccgagagaggcgacgccggcttctacacctgcaaggccgtgaacgagtacggcgccagacagtgcgaggccagactggaggtgagagcccaccccgagagcagaagcctggccgtgctggcccccctgcaggacgtggacgtgggcgccggcgagatggccctgttcgagtgcctggtggccggccccaccgacgtggaggtggactggctgtgcagaggcagactgctgcagcccgccctgctgaagtgcaagatgcacttcgacggcagaaagtgcaagctgctgctgaccagcgtgcacgaggacgacagcggcgtgtacacctgcaagctgagcaccgccaaggacgagctgacctgcagcgccagactgaccgtgagacccagcctggcccccctgttcaccagactgctggaggacgtggaggtgctggagggcagagccgccagattcgactgcaagatcagcggcacccccccccccgtggtgacctggacccacttcggctgccccatggaggagagcgagaacctgagactgagacaggacggcggcctgcacagcctgcacatcgcccacgtgggcagcgaggacgagggcctgtacgccgtgagcgccgtgaacacccacggccaggcccactgcagcgcccagctgtacgtggaggagcccagaaccgccgccagcggccccagcagcaagctggagaagatgcccagcatccccgaggagcccgagcagggcgagctggagagactgagcatccccgacttcctgagacccctgcaggacctggaggtgggcctggccaaggaggccatgctggagtgccaggtgaccggcctgccctaccccaccatcagctggttccacaacggccacagaatccagagcagcgacgacagaagaatgacccagtacagagacgtgcacagactggtgttccccgccgtgggcccccagcacgccggcgtgtacaagagcgtgatcgccaacaagctgggcaaggccgcctgctacgcccacctgtacgtgaccgacgtggtgcccggcccccccgacggcgccccccaggtggtggccgtgaccggcagaatggtgaccctgacctggaacccccccagaagcctggacatggccatcgaccccgacagcctgacctacaccgtgcagcaccaggtgctgggcagcgaccagtggaccgccctggtgaccggcctgagagagcccggctgggccgccaccggcctgagaaagggcgtgcagcacatcttcagagtgctgagcaccaccgtgaagagcagcagcaagcccagcccccccagcgagcccgtgcagctgctggagcacggccccaccctggaggaggcccccgccatgctggacaagcccgacatcgtgtacgtggtggagggccagcccgccagcgtgaccgtgaccttcaaccacgtggaggcccaggtggtgtggagaagctgcagaggcgccctgctggaggccagagccggcgtgtacgagctgagccagcccgacgacgaccagtactgcctgagaatctgcagagtgagcagaagagacatgggcgccctgacctgcaccgccagaaacagacacggcacccagacctgcagcgtgaccctggagctggccgaggcccccagattcgagagcatcatggaggacgtggaggtgggcgccggcgagaccgccagattcgccgtggtggtggagggcaagcccctgcccgacatcatgtggtacaaggacgaggtgctgctgaccgagagcagccacgtgagcttcgtgtacgaggagaacgagtgcagcctggtggtgctgagcaccggcgcccaggacggcggcgtgtacacctgcaccgcccagaacctggccggcgaggtgagctgcaaggccgagctggccgtgcacagcgcccagaccgccatggaggtggagggcgtgggcgaggacgaggaccacagaggcagaagactgagcgacttctacgacatccaccaggagatcggcagaggcgccttcagctacctgagaagaatcgtggagagaagcagcggcctggagttcgccgccaagttcatccccagccaggccaagcccaaggccagcgccagaagagaggccagactgctggccagactgcagcacgactgcgtgctgtacttccacgaggccttcgagagaagaagaggcctggtgatcgtgaccgagctgtgcaccgaggagctgctggagagaatcgccagaaagcccaccgtgtgcgagagcgagatcagagcctacatgagacaggtgctggagggcatccactacctgcaccagagccacgtgctgcacctggacgtgaagcccgagaacctgctggtgtgggacggcgccgccggcgagcagcaggtgagaatctgcgacttcggcaacgcccaggagctgacccccggcgagccccagtactgccagtacggcacccccgagttcgtggcccccgagatcgtgaaccagagccccgtgagcggcgtgaccgacatctggcccgtgggcgtggtggccttcctgtgcctgaccggcatcagccccttcgtgggcgagaacgacagaaccaccctgatgaacatcagaaactacaacgtggccttcgaggagaccaccttcctgagcctgagcagagaggccagaggcttcctgatcaaggtgctggtgcaggacagactgagacccaccgccgaggagaccctggagcacccctggttcaagacccaggccaagggcgccgaggtgagcaccgaccacctgaagctgttcctgagcagaagaagatggcagagaagccagatcagctacaagtgccacctggtgctgagacccatccccgagctgctgagagccccccccgagagagtgtgggtgaccatgcccagaagacccccccccagcggcggcctgagcagcagcagcgacagcgaggaggaggagctggaggagctgcccagcgtgcccagacccctgcagcccgagttcagcggcagcagagtgagcctgaccgacatccccaccgaggacgaggccctgggcacccccgagaccggcgccgccacccccatggactggcaggagcagggcagagcccccagccaggaccaggaggcccccagccccgaggccctgcccagccccggccaggagcccgccgccggcgccagccccagaagaggcgagctgagaagaggcagcagcgccgagagcgccctgcccagagccggccccagagagctgggcagaggcctgcacaaggccgccagcgtggagctgccccagagaagaagccccagccccggcgccaccagactggccagaggcggcctgggcgagggcgagtacgcccagagactgcaggccctgagacagagactgctgagaggcggccccgaggacggcaaggtgagcggcctgagaggccccctgctggagagcctgggcggcagagccagagaccccagaatggccagagccgccagcagcgaggccgccccccaccaccagccccccctggagaacagaggcctgcagaagagcagcagcttcagccagggcgaggccgagcccagaggcagacacagaagagccggcgcccccctggagatccccgtggccagactgggcgccagaagactgcaggagagccccagcctgagcgccctgagcgaggcccagcccagcagccccgccagacccagcgcccccaagcccagcacccccaagagcgccgagcccagcgccaccacccccagcgacgccccccagccccccgccccccagcccgcccaggacaaggcccccgagcccagacccgagcccgtgagagccagcaagcccgccccccccccccaggccctgcagaccctggccctgcccctgaccccctacgcccagatcatccagagcctgcagctgagcggccacgcccagggccccagccagggccccgccgccccccccagcgagcccaagccccacgccgccgtgttcgccagagtggccagccccccccccggcgcccccgagaagagagtgcccagcgccggcggcccccccgtgctggccgagaaggccagagtgcccaccgtgccccccagacccggcagcagcctgagcagcagcatcgagaacctggagagcgaggccgtgttcgaggccaagttcaagagaagcagagagagccccctgagcctgggcctgagactgctgagcagaagcagaagcgaggagagaggccccttcagaggcgccgaggaggaggacggcatctacagacccagccccgccggcacccccctggagctggtgagaagacccgagagaagcagaagcgtgcaggacctgagagccgtgggcgagcccggcctggtgagaagactgagcctgagcctgagccagagactgagaagaaccccccccgcccagagacaccccgcctgggaggccagaggcggcgacggcgagagcagcgagggcggcagcagcgccagaggcagccccgtgctggccatgagaagaagactgagcttcaccctggagagactgagcagcagactgcagagaagcggcagcagcgaggacagcggcggcgccagcggcagaagcacccccctgttcggcagactgagaagagccaccagcgagggcgagagcctgagaagactgggcctgccccacaaccagctggccgcccaggccggcgccaccacccccagcgccgagagcctgggcagcgaggccagcgccaccagcggcagcagcgcccccggcgagagcagaagcagactgagatggggcttcagcagacccagaaaggacaagggcctgagcccccccaacctgagcgccagcgtgcaggaggagctgggccaccagtacgtgagaagcgagagcgacttcccccccgtgttccacatcaagctgaaggaccaggtgctgctggagggcgaggccgccaccctgctgtgcctgcccgccgcctgccccgccccccacatcagctggatgaaggacaagaagagcctgagaagcgagcccagcgtgatcatcgtgagctgcaaggacggcagacagctgctgagcatccccagagccggcaagagacacgccggcctgtacgagtgcagcgccaccaacgtgctgggcagcatcaccagcagctgcaccgtggccgtggccagagtgcccggcaagctggccccccccgaggtgccccagacctaccaggacaccgccctggtgctgtggaagcccggcgacagcagagccccctgcacctacaccctggagagaagagtggacggcgagagcgtgtggcaccccgtgagcagcggcatccccgactgctactacaacgtgacccacctgcccgtgggcgtgaccgtgagattcagagtggcctgcgccaacagagccggccagggccccttcagcaacagcagcgagaaggtgttcgtgagaggcacccaggacagcagcgccgtgcccagcgccgcccaccaggaggcccccgtgaccagcagacccgccagagccagaccccccgacagccccaccagcctggccccccccctggcccccgccgcccccaccccccccagcgtgaccgtgagccccagcagcccccccaccccccccagccaggccctgagcagcctgaaggccgtgggcccccccccccagaccccccccagaagacacagaggcctgcaggccgccagacccgccgagcccaccctgcccagcacccacgtgacccccagcgagcccaagcccttcgtgctggacaccggcacccccatccccgccagcaccccccagggcgtgaagcccgtgagcagcagcacccccgtgtacgtggtgaccagcttcgtgagcgccccccccgcccccgagccccccgcccccgagcccccccccgagcccaccaaggtgaccgtgcagagcctgagccccgccaaggaggtggtgagcagccccggcagcagccccagaagcagccccagacccgagggcaccaccctgagacagggccccccccagaagccctacaccttcctggaggagaaggccagaggcagattcggcgtggtgagagcctgcagagagaacgccaccggcagaaccttcgtggccaagatcgtgccctacgccgccgagggcaagagaagagtgctgcaggagtacgaggtgctgagaaccctgcaccacgagagaatcatgagcctgcacgaggcctacatcacccccagatacctggtgctgatcgccgagagctgcggcaacagagagctgctgtgcggcctgagcgacagattcagatacagcgaggacgacgtggccacctacatggtgcagctgctgcagggcctggactacctgcacggccaccacgtgctgcacctggacatcaagcccgacaacctgctgctggcccccgacaacgccctgaagatcgtggacttcggcagcgcccagccctacaacccccaggccctgagacccctgggccacagaaccggcaccctggagttcatggcccccgagatggtgaagggcgagcccatcggcagcgccaccgacatctggggcgccggcgtgctgacctacatcatgctgagcggcagaagccccttctacgagcccgacccccaggagaccgaggccagaatcgtgggcggcagattcgacgccttccagctgtaccccaacaccagccagagcgccaccctgttcctgagaaaggtgctgagcgtgcacccctggagcagacccagcctgcaggactgcctggcccacccctggctgcaggacgcctacctgatgaagctgagaagacagaccctgaccttcaccaccaacagactgaaggagttcctgggcgagcagagaagaagaagagccgaggccgccaccagacacaaggtgctgctgagaagctaccccggcggcccctag

SEQ ID NO: 9596 - DNA, 342 bp, Artificial Sequence
  Description of Artificial Sequence: Synthetic coding sequence
atgaagcccagccccagccagaacagaagaagcagcgacaccggcagcaaggccccccccaccttcaaggtgagcctgatggaccagagcgtgagagagggccaggacgtgatcatgagcatcagagtgcagggcgagcccaagcccgtggtgagctggctgagaaacagacagcccgtgagacccgaccagagaagattcgccgaggaggccgagggcggcctgtgcagactgagaatcctggccgccgagagaggcgacgccggcttctacacctgcaaggccgtgaacgagtacggcgccagacagtgcgaggccagactggaggtgagaggcgagtag

SEQ ID NO: 9597 - DNA, 342 bp, Artificial Sequence; identical to SEQ ID NO: 9596
  Description of Artificial Sequence: Synthetic coding sequence

SEQ ID NO: 9598 - DNA, 342 bp, Artificial Sequence; identical to SEQ ID NO: 9596
  Description of Artificial Sequence: Synthetic coding sequence

SEQ ID NO: 9599 - DNA, 513 bp, Artificial Sequence
  Description of Artificial Sequence: Synthetic coding sequence
atggccaccgccaccaacgagctgggccaggccacctgcgccgccagcctgaccgtgagacccggcggcagcaccagccccttcagcagccccatcaccagcgacgaggagtacctgagcccccccgaggagttccccgagcccggcgagacctggcccagaacccccaccatgaagcccagccccagccagaacagaagaagcagcgacaccggcagcaaggccccccccaccttcaaggtgagcctgatggaccagagcgtgagagagggccaggacgtgatcatgagcatcagagtgcagggcgagcccaagcccgtggtgagctggctgagaaacagacagcccgtgagacccgaccagagaagattcgccgaggaggccgagggcggcctgtgcagactgagaatcctggccgccgagagaggcgacgccggcttctacacctgcaaggccgtgaacgagtacggcgccagacagtgcgaggccagactggaggtgagaggcgagtag

SEQ ID NO: 9600 - DNA, 1038 bp, Artificial Sequence
  Description of Artificial Sequence: Synthetic coding sequence
atgatcagccccgtgctgatcctgttcagcagcttcctgtgccacgtggccatcgccggcagaacctgccccaagcccgacgacctgcccttcagcaccgtggtgcccctgaagaccttctacgagcccggcgaggagatcacctacagctgcaagcccggctacgtgagcagaggcggcatgagaaagttcatctgccccctgaccggcctgtggcccatcaacaccctgaagtgcacccccagagtgtgccccttcgccggcatcctggagaacggcgccgtgagatacaccaccttcgagtaccccaacaccatcagcttcagctgcaacaccggcttctacctgaacggcgccgacagcgccaagtgcaccgaggagggcaagtggagccccgagctgcccgtgtgcgcccccatcatctgccccccccccagcatccccaccttcgccaccctgagagtgtacaagcccagcgccggcaacaacagcctgtacagagacaccgccgtgttcgagtgcctgccccagcacgccatgttcggcaacgacaccatcacctgcaccacccacggcaactggaccaagctgcccgagtgcagagaggtgaagtgccccttccccagcagacccgacaacggcttcgtgaactaccccgccaagcccaccctgtactacaaggacaaggccaccttcggctgccacgacggctacagcctggacggccccgaggagatcgagtgcaccaagctgggcaactggagcgccatgcccagctgcaaggccagctgcaaggtgcccgtgaagaaggccaccgtggtgtaccagggcgagagagtgaagatccaggagaagttcaagaacggcatgctgcacggcgacaaggtgagcttcttctgcaagaacaaggagaagaagtgcagctacaccgaggacgcccagtgcatcgacggcaccatcgaggtgcccaagtgcttcaaggagcacagcagcctggccttctggaagaccgacgccagcgacgtgaagccctgctag

SEQ ID NO: 9601 - DNA, 1278 bp, Artificial Sequence
  Description of Artificial Sequence: Synthetic coding sequence
atggccagcagcatcatctgccaggagcactgccagatcagcggccaggccaagatcgacatcctgctggtgggcgacgtgaccgtgggctacctggccgacaccgtgcagaagctgttcgccaacatcgccgaggtgaccatcaccatcagcgacaccaaggaggccgccgccctgctggacgactgcatcttcaacatggtgctgctgaaggtgcccagcagcctgagcgccgaggagctggaggccatcaagctgatcagattcggcaagaagaagaacacccacagcctgttcgtgttcatcatccccgagaacttcaagggctgcatcagcggccacggcatggacatcgccctgaccgagcccctgaccatggagaagatgagcaacgtggtgaagtactggaccacctgccccagcaacaccgtgaagaccgagaacgccaccggccccgaggagctgggcctgcccctgcagagaagctacagcgagcacctgggctacttccccaccgacctgttcgcctgcagcgagagcctgagaaacggcaacggcctggagctgaacgccagcctgagcgagttcgagaagaacaagaagatcagcctgctgcacagcagcaaggagaagctgagaagagagagaatcaagtactgctgcgagcagctgagaaccctgctgccctacgtgaagggcagaaagaacgacgccgccagcgtgctggaggccaccgtggactacgtgaagtacatcagagagaagatcagccccgccgtgatggcccagatcaccgaggccctgcagagcaacatgagattctgcaagaagcagcagacccccatcgagctgagcctgcccggcaccgtgatggcccagagagagaacagcgtgatgagcacctacagccccgagagaggcctgcagttcctgaccaacacctgctggaacggctgcagcacccccgacgccgagagcagcctggacgaggccgtgagagtgcccagcagcagcgccagcgagaacgccatcggcgacccctacaagacccacatcagcagcgccgccctgagcctgaacagcctgcacaccgtgagatactacagcaaggtgacccccagctacgacgccaccgccgtgaccaaccagaacatcagcatccacctgcccagcgccatgccccccgtgagcaagctgctgcccagacactgcaccagcggcctgggccagacctgcaccacccaccccaactgcctgcagcagttctgggcctactag

SEQ ID NO: 9602 - DNA, 1509 bp, Artificial Sequence; identical to SEQ ID NO: 7700
  Description of Artificial Sequence: Synthetic coding sequence

SEQ ID NO: 9603 - DNA, 777 bp, Artificial Sequence
  Description of Artificial Sequence: Synthetic coding sequence
atgaagacccccaacgcccaggaggccgagggccagcagaccagagccgccgccggcagagccaccggcagcgccaacatgaccaagaagaaggtgagccagaagaagcagagaggcagacccagcagccagcccagaagaaacatcgtgggctgcagaatcagccacggctggaaggagggcgacgagcccatcacccagtggaagggcaccgtgctggaccaggtgcccatcaaccccagcctgtacctggtgaagtacgacggcatcgactgcgtgtacggcctggagctgcacagagacgagagagtgctgagcctgaagatcctgagcgacagagtggccagcagccacatcagcgacgccaacctggccaacaccatcatcggcaaggccgtggagcacatgttcgagggcgagcacggcagcaaggacgagtggagaggcatggtgctggcccaggcccccatcatgaaggcctggttctacatcacctacgagaaggaccccgtgctgtacatgtaccagctgctggacgactacaaggagggcgacctgagaatcatgcccgagagcagcgagagcccccccaccgagagagagcccggcggcgtggtggacggcctgatcggcaagcacgtggagtacaccaaggaggacggcagcaagagaatcggcatggtgatccaccaggtggaggccaagcccagcgtgtacttcatcaagttcgacgacgacttccacatctacgtgtacgacctggtgaagaagagctag

SEQ ID NO: 9604 - DNA, 777 bp, Artificial Sequence; identical to SEQ ID NO: 9603
  Description of Artificial Sequence: Synthetic coding sequence

SEQ ID NO: 9605 - DNA, 474 bp, Artificial Sequence
  Description of Artificial Sequence: Synthetic coding sequence
atgaagacccccaacgcccaggaggccgagggccagcagaccagagccgccgccggcagagccaccggcagcgccaacatgaccaagaagaaggtgagccagaagaagcagagaggcagacccagcagccagcccagaagaaacatcgtgggctgcagaatcagccacggctggaaggagggcgacgagcccatcacccagtggaagggcaccgtgctggaccagctgctggacgactacaaggagggcgacctgagaatcatgcccgagagcagcgagagcccccccaccgagagagagcccggcggcgtggtggacggcctgatcggcaagcacgtggagtacaccaaggaggacggcagcaagagaatcggcatggtgatccaccaggtggaggccaagcccagcgtgtacttcatcaagttcgacgacgacttccacatctacgtgtacgacctggtgaagaagagctag

SEQ ID NO: 9606 - DNA, 777 bp, Artificial Sequence; identical to SEQ ID NO: 9603
  Description of Artificial Sequence: Synthetic coding sequence

SEQ ID NO: 9607 - DNA, 744 bp, Artificial Sequence
  Description of Artificial Sequence: Synthetic coding sequence
atgaagacccccaacgcccaggaggccgagggccagcagaccagagccgccgccggcagagccaccggcagcgccaacatgaccaagaagaaggtgagccagaagaagcagagaggcagacccagcagccagcccagaagaaacatcgtgggctgcagaatcagccacggctggaaggagggcgacgagcccatcacccagtggaagggcaccgtgctggaccaggtgcccatcaaccccagcctgtacctggtgaagtacgacggcatcgactgcgtgtacggcctggagctgcacagagacgagagagtgctgagcctgaagatcctgagcgacagagtggccagcagccacatcagcgacgccaacctggccaacaccatcatcggcaaggccgtggagcacatgttcgagggcgagcacggcagcaaggacgagtggagaggcatggtgctggcccaggcccccatcatgaaggcctggttctacatcacctacgagaaggaccccgtgctgtacatgtaccagctgctggacgactacaaggagggcgacctgagaatcatgcccgagagcagcgagagcccccccaccgagagagagcccggcggcgtggtggacggcctgatcggcaagcacgtggagtacaccaaggaggacggcagcaagagaatcggcatggtgatccaccaggtggaggccaagcccagcgtgtacttcatcaagttcgacgacgacttctag

SEQ ID NO: 9608 - DNA, 1506 bp, Artificial Sequence
  Description of Artificial Sequence: Synthetic coding sequence
atggagaccatcctggagcagcagagaagataccacgaggagaaggagagactgatggacgtgatggccaaggagatgctgaccaagaagagcaccctgagagaccagatcaacagcgaccacagaaccagagccatgcaggacagatacatggaggtgagcggcaacctgagagacctgtacgacgacaaggacggcctgagaaaggaggagctgaacgccatcagcggccccaacgagttcgccgagttctacaacagactgaagcagatcaaggagttccacagaaagcaccccaacgagatctgcgtgcccatgagcgtggagttcgaggagctgctgaaggccagagagaaccccagcgaggaggcccagaacctggtggagttcaccgacgaggagggctacggcagatacctggacctgcacgactgctacctgaagtacatcaacctgaaggccagcgagaagctggactacatcacctacctgagcatcttcgaccagctgttcgacatccccaaggagagaaagaacgccgagtacaagagatacctggagatgctgctggagtacctgcaggactacaccgacagagtgaagcccctgcaggaccagaacgagctgttcggcaagatccaggccgagttcgagaagaagtgggagaacggcaccttccccggctggcccaaggagaccagcagcgccctgacccacgccggcgcccacctggacctgagcgccttcagcagctgggaggagctggccagcctgggcctggacagactgaagagcgccctgctggccctgggcctgaagtgcggcggcaccctggaggagagagcccagagactgttcagcaccaagggcaagagcctggagagcctggacaccagcctgttcgccaagaaccccaagagcaagggcaccaagagagacaccgagagaaacaaggacatcgccttcctggaggcccagatctacgagtacgtggagatcctgggcgagcagagacacctgacccacgagaacgtgcagagaaagcaggccagaaccggcgaggagagagaggaggaggaggaggagcagatcagcgagagcgagagcgaggacgaggagaacgagatcatctacaaccccaagaacctgcccctgggctgggacggcaagcccatcccctactggctgtacaagctgcacggcctgaacatcaactacaactgcgagatctgcggcaactacacctacagaggccccaaggccttccagagacacttcgccgagtggagacacgcccacggcatgagatgcctgggcatccccaacaccgcccacttcgccaacgtgacccagatcgaggacgccgtgagcctgtgggccaagctgaagctgcagaaggccagcgagagatggcagcccgacaccgaggaggagtacgaggacagcagcggcaacgtggtgaacaagaagacctacgaggacctgaagagacagggcctgctgtag

SEQ ID NO: 9609 - DNA, 1347 bp, Artificial Sequence
  Description of Artificial Sequence: Synthetic coding sequence
atggagaccatcctggagcagcagagaagataccacgaggagaaggagagactgatggacgtgatggccaaggagatgctgaccaagaagagcaccctgagagaccagatcaacagcgaccacagaaccagagccatgcaggacatctgcgtgcccatgagcgtggagttcgaggagctgctgaaggccagagagaaccccagcgaggaggcccagaacctggtggagttcaccgacgaggagggctacggcagatacctggacctgcacgactgctacctgaagtacatcaacctgaaggccagcgagaagctggactacatcacctacctgagcatcttcgaccagctgttcgacatccccaaggagagaaagaacgccgagtacaagagatacctggagatgctgctggagtacctgcaggactacaccgacagagtgaagcccctgcaggaccagaacgagctgttcggcaagatccaggccgagttcgagaagaagtgggagaacggcaccttccccggctggcccaaggagaccagcagcgccctgacccacgccggcgcccacctggacctgagcgccttcagcagctgggaggagctggccagcctgggcctggacagactgaagagcgccctgctggccctgggcctgaagtgcggcggcaccctggaggagagagcccagagactgttcagcaccaagggcaagagcctggagagcctggacaccagcctgttcgccaagaaccccaagagcaagggcaccaagagagacaccgagagaaacaaggacatcgccttcctggaggcccagatctacgagtacgtggagatcctgggcgagcagagacacctgacccacgagaacgtgcagagaaagcaggccagaaccggcgaggagagagaggaggaggaggaggagcagatcagcgagagcgagagcgaggacgaggagaacgagatcatctacaaccccaagaacctgcccctgggctgggacggcaagcccatcccctactggctgtacaagctgcacggcctgaacatcaactacaactgcgagatctgcggcaactacacctacagaggccccaaggccttccagagacacttcgccgagtggagacacgcccacggcatgagatgcctgggcatccccaacaccgcccacttcgccaacgtgacccagatcgaggacgccgtgagcctgtgggccaagctgaagctgcagaaggccagcgagagatggcagcccgacaccgaggaggagtacgaggacagcagcggcaacgtggtgaacaagaagacctacgaggacctgaagagacagggcctgctgtag

SEQ ID NO: 9610 - DNA, 261 bp, Artificial Sequence
  Description of Artificial Sequence: Synthetic coding sequence
atgaccgacagatacaccatccacagccagctggagcacctgcagagcaagtacatcggcaccggccacgccgacaccaccaagtgggagtggctggtgaaccagcacagagacagctactgcagctacatgggccacttcgacctgctgaactacttcgccatcgccgagaacgagagcaaggccagagtgagattcaacctgatggagaagatgctgcagccctgcggcccccccgccgacaagcccgaggagaactag

SEQ ID NO: 9611 - DNA, 3012 bp, Artificial Sequence
  Description of Artificial Sequence: Synthetic coding sequence
atgtacggcgccagcggcggcagagccaagcccgagagaaagagcggcgccaaggaggaggccggccccggcggcgccggcggcggcggcagcagagtggagctgctggtgttcggctacgcctgcaagctgttcagagacgacgagagagccctggcccaggagcagggccagcacctgatcccctggatgggcgaccacaagatcctgatcgacagatacgacggcagaggccacctgcacgacctgagcgagtacgacgccgagtacagcacctggaacagagactaccagctgagcgaggaggaggccagaatcgaggccctgtgcgacgaggagagatacctggccctgcacaccgacctgctggaggaggaggccagacaggaggaggagtacaagagactgagcgaggccctggccgaggacggcagctacaacgccgtgggcttcacctacggcagcgactactacgaccccagcgagcccaccgaggaggaggagcccagcaagcagagagagaagaacgaggccgagaacctggaggagaacgaggagcccttcgtggcccccctgggcctgagcgtgcccagcgacgtggagctgccccccaccgccaagatgcacgccatcatcgagagaaccgccagcttcgtgtgcagacagggcgcccagttcgagatcatgctgaaggccaagcaggccagaaacagccagttcgacttcctgagattcgaccactacctgaacccctactacaagttcatccagaaggccatgaaggagggcagatacaccgtgctggccgagaacaagagcgacgagaagaagaagagcggcgtgagcagcgacaacgaggacgacgacgacgaggaggacggcaactacctgcaccccagcctgttcgccagcaagaagtgcaacagactggaggagctgatgaagcccctgaaggtggtggaccccgaccaccccctggccgccctggtgagaaaggcccaggccgacagcagcacccccaccccccacaacgccgacggcgcccccgtgcagcccagccaggtggagtacaccgccgacagcaccgtggccgccatgtactacagctactacatgctgcccgacggcacctactgcctggccccccccccccccggcatcgacgtgaccacctactacagcaccctgcccgccggcgtgaccgtgagcaacagccccggcgtgaccaccaccgccccccccccccccggcaccacccccctgcccccccccaccaccgccgagaccagcagcggcgccaccagcaccaccaccaccaccagcgccctggcccccgtggccgccatcatcccccccccccccgacgtgcagcccgtgatcgacaagctggccgagtacgtggccagaaacggcctgaagttcgagaccagcgtgagagccaagaacgaccagagattcgagttcctgcagccctggcaccagtacaacgcctactacgagttcaagaagcagttcttcctgcagaaggagggcggcgacagcatgcaggccgtgagcgcccccgaggaggcccccaccgacagcgcccccgagaagcccagcgacgccggcgaggacggcgcccccgaggacgccgccgaggtgggcgccagagccggcagcggcggcaagaaggaggccagcagcagcaagaccgtgcccgacggcaagctggtgaaggccagcttcgcccccatcagcttcgccatcaaggccaaggagaacgacctgctgcccctggagaagaacagagtgaagctggacgacgacagcgacgacgacgaggagagcaaggagggccaggagagcagcagcagcgccgccaacaccaaccccgccgtggcccccccctgcgtggtggtggaggagaagaagccccagctgacccaggaggagctggaggccaagcaggccaagcagaagctggaggacagactggccgccgccgccagagagaagctggcccaggccagcaaggagagcaaggagaagcagctgcaggccgagagaaagagaaaggccgccctgttcctgcagaccctgaagaaccccctgcccgaggccgaggccggcaagatcgaggagagccccttcagcgtggaggagagcagcaccaccccctgccccctgctgaccggcggcagacccctgcccaccctggaggtgaagccccccgacagacccagcagcaagagcaaggacccccccagagaggaggagaaggagaagaagaagaagaagcacaagaagagaagcagaaccagaagcagaagccccaagtaccacagcagcagcaagagcagaagcagaagccacagcaaggccaagcacagcctgcccagcgcctacagaaccgtgagaagaagcagagtgaccgccagccccggcaccctgagagccgagccctgccagagcagcgccagcgtgaccgccgccgccgagcccggcagctaccaggccgccagcaccaccaccagattcgacagcgccagcagcttcgagggcaagcccggcaagaccagcagaagcagaagcagaagccccagaagaagagcccacagccccgagagaagaagagaggagagaagcgtgcccaccgcctacagagtgagcagaagccccggcgccagcagaaagagaaccagaagcagaagcccccacgagaagaagaagaagagaagaagcagaagcagaaccaagagcaaggccagaagccagagcgtgagccccagcaagcaggccgcccccagacccgccgcccccgccgcccacagcgcccacagcgccagcgtgagccccgtggagagcagaggcagcagccaggagagaagcagaggcgtgagccaggagaaggaggcccagatcagcagcgccatcgtgagcagcgtgcagagcaagatcacccaggacctgatggccaaggtgagagccatgctggccgccagcaagaacctgcagaccagcgccagctag

SEQ ID NO: 9612 - DNA, 2856 bp, Artificial Sequence
  Description of Artificial Sequence: Synthetic coding sequence
atgtacggcgccagcggcggcagagccaagcccgagagaaagagcggcgccaaggaggaggccggccccggcggcgccggcggcggcggcagcagagtggagctgctggtgttcggctacgcctgcaagctgttcagagacgacgagagagccctggcccaggagcagggccagcacctgatcccctggatgggcgaccacaagatcctgatcgacagatacgacggcagaggccacctgcacgacctgagcgagtacgacgccgagtacagcacctggaacagagactaccagctgagcgaggaggaggccagaatcgaggccctgtgcgacgaggagagatacctggccctgcacaccgacctgctggaggaggaggccagacaggaggaggagtacaagagactgagcgaggccctggccgaggacggcagctacaacgccgtgggcttcacctacggcagcgactactacgaccccagcgagcccaccgaggaggaggagcccagcaagcagagagagaagaacgaggccgagaacctggaggagaacgaggagcccttcgtggcccccctgggcctgagcgtgcccagcgacgtggagctgccccccaccgccaagatgcacgccatcatcgagagaaccgccagcttcgtgtgcagacagggcgcccagttcgagatcatgctgaaggccaagcaggccagaaacagccagttcgacttcctgagattcgaccactacctgaacccctactacaagttcatccagaaggccatgaaggagggcagatacaccgtgctggccgagaacaagagcgacgagaagaagaagagcggcgtgagcagcgacaacgaggacgacgacgacgaggaggacggcaactacctgcaccccagcctgttcgccagcaagaagtgcaacagactggaggagctgatgaagcccctgaaggtggtggaccccgaccaccccctggccgccctggtgagaaaggcccaggccgacagcagcacccccaccccccacaacgccgacggcgcccccgtgcagcccagccaggtggagtacaccgccgacagcaccgtggccgccatgtactacagctactacatgctgcccgacggcacctactgcctggccccccccccccccggcatcgacgtgaccacctactacagcaccctgcccgccggcgtgaccgtgagcaacagccccggcgtgaccaccaccgccccccccccccccggcaccacccccctgcccccccccaccaccgccgagaccagcagcggcgccaccagcaccaccaccaccaccagcgccctggcccccgtggccgccatcatcccccccccccccgacgtgcagcccgtgatcgacaagctggccgagtacgtggccagaaacggcctgaagttcgagaccagcgtgagagccaagaacgaccagagattcgagttcctgcagccctggcaccagtacaacgcctactacgagttcaagaagcagttcttcctgcagaaggagggcggcgacagcatgcaggccgtgagcgcccccgaggaggcccccaccgacagcgcccccgagaagcccagcgacgccggcgaggacggcgcccccgaggacgccgccgaggtgggcgccagagccggcagcggcggcaagaaggaggccagcagcagcaagaccgtgcccgacggcaagctggtgaaggccagcttcgcccccatcagcttcgccatcaaggccaaggagaacgacctgctgcccctggagaagaacagagtgaagctggacgacgacagcgacgacgacgaggagagcaaggagggccaggagagcagcagcagcgccgccaacaccaaccccgccgtggcccccccctgcgtggtggtggaggagaagaagccccagctgacccaggaggagctggaggccaagcaggccaagcagaagctggaggacagactggccgccgccgccagagagaagctggcccaggccagcaaggagagcaaggagaagcagctgcaggccgagagaaagagaaaggccgccctgttcctgcagaccctgaagaaccccctgcccgaggccgaggccggcaagatcgaggagagccccttcagcgtggaggagagcagcaccaccccctgccccctgctgaccggcggcagacccctgcccaccctggaggtgaagccccccgacagacccagcagcaagagcaaggacccccccagagaggaggagaaggagaagaagaagaagaagcacaagaagagaagcagaaccagaagcagaagccccaagtaccacagcagcagcaagagcagaagcagaagccacagcaaggccaagcacagcctgcccagcgcctacagaaccgtgagaagaagcagaagcagaagcagaagccccagaagaagagcccacagccccgagagaagaagagaggagagaagcgtgcccaccgcctacagagtgagcagaagccccggcgccagcagaaagagaaccagaagcagaagcccccacgagaagaagaagaagagaagaagcagaagcagaaccaagagcaaggccagaagccagagcgtgagccccagcaagcaggccgcccccagacccgccgcccccgccgcccacagcgcccacagcgccagcgtgagccccgtggagagcagaggcagcagccaggagagaagcagaggcgtgagccaggagaaggaggcccagatcagcagcgccatcgtgagcagcgtgcagagcaagatcacccaggacctgatggccaaggtgagagccatgctggccgccagcaagaacctgcagaccagcgccagctag

SEQ ID NO: 9613 - DNA, 1644 bp, Artificial Sequence
  Description of Artificial Sequence: Synthetic coding sequence
atgggcgaccacaagatcctgatcgacagatacgacggcagaggccacctgcacgacctgagcgagtacgacgccgagtacagcacctggaacagagactaccagctgagcgaggaggaggccagaatcgaggccctgtgcgacgaggagagatacctggccctgcacaccgacctgctggaggaggaggccagacaggaggaggagtacaagagactgagcgaggccctggccgaggacggcagctacaacgccgtgggcttcacctacggcagcgactactacgaccccagcgagcccaccgaggaggaggagcccagcaagcagagagagaagaacgaggccgagaacctggaggagaacgaggagcccttcgtggcccccctgggcctgagcgtgcccagcgacgtggagctgccccccaccgccaagatgcacgccatcatcgagagaaccgccagcttcgtgtgcagacagggcgcccagttcgagatcatgctgaaggccaagcaggccagaaacagccagttcgacttcctgagattcgaccactacctgaacccctactacaagttcatccagaaggccatgaaggagggcagatacaccgtgctggccgagaacaagagcgacgagaagaagaagagcggcgtgagcagcgacaacgaggacgacgacgacgaggaggacggcaactacctgcaccccagcctgttcgccagcaagaagtgcaacagactggaggagctgatgaagcccctgaaggtggtggaccccgaccaccccctggccgccctggtgagaaaggcccaggccgacagcagcacccccaccccccacaacgccgacggcgcccccgtgcagcccagccaggtggagtacaccgccgacagcaccgtggccgccatgtactacagctactacatgctgcccgacggcacctactgcctggccccccccccccccggcatcgacgtgaccacctactacagcaccctgcccgccggcgtgaccgtgagcaacagccccggcgtgaccaccaccgccccccccccccccggcaccacccccctgcccccccccaccaccgccgagaccagcagcggcgccaccagcaccaccaccaccaccagcgccctggcccccgtggccgccatcatcccccccccccccgacgtgcagcccgtgatcgacaagctggccgagtacgtggccagaaacggcctgaagttcgagaccagcgtgagagccaagaacgaccagagattcgagttcctgcagccctggcaccagtacaacgcctactacgagttcaagaagcagttcttcctgcagaaggagggcggcgacagcatgcaggccgtgagcgcccccgaggaggcccccaccgacagcgcccccgagaagcccagcgacgccggcgaggacggcgcccccgaggacgccgccgaggtgggcgccagagccggcagcggcggcaagaaggaggccagcagcagcaagaccgtgcccgacggcaagctggtgaaggccagcttcgcccccatcagcttcgccatcaaggccaaggagaacgacctgctgcccctggagaagaacagaaagaagagaaagaagagaaagagaaagagcaccaagaagtag

SEQ ID NO: 9614 - DNA, 2091 bp, Artificial Sequence
  Description of Artificial Sequence: Synthetic coding sequence
atggaggtgagcagccccagccccgcccagagactgagaagaaagaagagacccatggtgcagggccccgccggctgccaggtgttccagcccagccccagcggcggcaccgccggcgaccccggcggcctgagcgaccccttctacccccccagaagcggcagcctggccctgggcgaccccagcagcgaccccgcctgcagccagagcggccccatggaggccgaggaggacagcctgcccgagcagcccgaggacagcgcccagctgcagcaggagaagcccagcctgtacatcggcgtgagaggcaccgtggtgagaagcatgcaggaggtgctgtggaccagactgagagagctgcccgaccccgtgctgagcgaggaggtggtggagggcatcgccgccggcatcgaggccgccctgtgggacctgacccagggcaccaacggcagatacaagaccaagtacagaagcctgctgttcaacctgagagaccccagaaacctggacctgttcctgaaggtggtgcacggcgacgtgaccccctacgacctggtgagaatgagcagcatgcagctggccccccaggagctggccagatggagagaccaggaggagaagagaggcctgaacatcatcgagcagcagcagaaggagccctgcagactgcccgccagcaagatgacccacaagggcgaggtggagatccagagagacatggaccagaccctgaccctggaggacctggtgggcccccagatgttcatggactgcagcccccaggccctgcccatcgccagcgaggacaccaccggccagcacgaccaccacttcctggaccccaactgccacatctgcaaggactgggagcccagcaacgagctgctgggcagcttcgaggccgccaagagctgcggcgacaacatcttccagaaggccctgagccagacccccatgcccgcccccgagatgcccaagaccagagagctgagccccaccgagccccaggacagagtgccccccagcggcctgcacgtgcccgccgcccccaccaaggccctgccctgcctgcccccctgggagggcgtgctggacatgttcagcatcaagagattcagagccagagcccagctggtgagcggccacagctgcagactggtgcaggccctgcccaccgtgatcagaagcgccggctgcatccccagcaacatcgtgtgggacctgctggccagcatctgccccgccaaggccaaggacgtgtgcgtggtgagactgtgcccccacggcgccagagacacccagaactgcagactgctgtacagctacctgaacgacagacagagacacggcctggccagcgtggagcacatgggcatggtgctgctgcccctgcccgccttccagcccctgcccaccagactgagacccctgggcggccccggcctggaggtgacccacagcagcctgctgctggccgtgctgctgcccaaggagggcctgcccgacaccgccggcagcagcccctggctgggcaaggtgcagaagatggtgagcttcaacagcaaggtggagaagagatactaccagcccgacgacagaagacccaacgtgcccctgaagggcacccccccccccggcggcgcctggcagcagagccagggcagaggcagcatcgcccccagaggcatcagcgcctggcagagaccccccagaggcagaggcagactgtggcccgagcccgagaactggcagcaccccggcagaggccagtggccccccgagcccggcctgagacagagccagcacccctacagcgtggcccccgccggccacggcttcggcagaggccagcacttccacagagacagctgcccccaccaggccctgctgagacacctggagagcctggccaccatgagccaccagctgcaggccctgctgtgcccccagaccaagagcagcatccccagacccctgcagagactgagcagcgccctggccgcccccgagccccccggccccgccagagacagcagcctgggccccaccgacgaggccggcagcgagtgccccttccccagaaaggcctag

SEQ ID NO: 9615 - DNA, 1032 bp, Artificial Sequence
  Description of Artificial Sequence: Synthetic coding sequence
ggcaccaagtgcctggagagcctgctgggcagcgtgccccccccctgccccggcctgcacagcctgagagagctgcccgaccccgtgctgagcgaggaggtggtggagggcatcgccgccggcatcgaggccgccctgtgggacctgacccagggcaccaacggcagatacaagaccaagtacagaagcctgctgttcaacctgagagaccccagaaacctggacctgttcctgaaggtggtgcacggcgacgtgaccccctacgacctggtgagaatgagcagcatgcagctggccccccaggagctggccagatggagagaccaggaggagaagagaggcctgaacatcatcgagcagcagcagaaggagccctgcagactgcccgccagcaagatgacccacaagggcgaggtggagatccagagagacatggaccagaccctgaccctggaggacctgggcccccagatgttcatggactgcagcccccaggccctgcccatcgccagcgaggacaccaccggccagcacgaccaccacttcctggaccccaactgccacatctgcaaggactgggagcccagcaacgagctgctgggcagcttcgaggccgccaagagctgcggcgacaacatcttccagaaggccctgagccagacccccatgccccccccctgggagggcgtgctggacatgttcagcatcaagagattcagagccagagcccagctggtgagcggccacagctgcagactggtgcaggccctgcccaccgtgatcagaagcgccggctgcatccccagcaacatcgtgtgggacctgctggccagcatctgccccgccaaggccaaggtgtggagaagcctgacccaggtgtgctgctggctgtgctgcagccccagaaagggcttccagacccagcagggccccgcccccggctggggcagattcaagagatggagccccagcaccgtgagatggagaagagacaccatcagccagatgaccggcggcagaatgtgcccctag

SEQ ID NO: 9616 - DNA, 3651 bp, Artificial Sequence
  Description of Artificial Sequence: Synthetic coding sequence
atgagccaggccggcgacgtggagggccccagcaccggcgaccccgtgctgagcccccagcacaactgcgagctgctgcagaacatggagggcgccagcagcatgcccggcctgagccccgacggccccggcgccagcagcggccccggcgtgagagccggcagcagaagaaagatccccagaaaggaggccctgagaggcggcagcagcagagccgccggcgccgccgaggtgagacccggcgtgctggagctgctggccgtggtgcagagcagaggcagcatgctggcccccggcctgcacatgcagctgcccagcgtgcccacccagggcagagccctgaccagcaagagactgcaggtgagcctgtgcgacatcctggacgacagctgccccagaaagctgtgcagcagaagcgccggcctgcccgagagagccctggcctgcagagagagactggccggcgtggaggaggtgagctgcctgagacccagagaggccagagacggcggcatgagcagccccggctgcgacagaagaagccccaccctgagcaaggaggagccccccggcagacccctgaccagcagccccgaccccgtgcccgtgagagtgagaaagaagtggagaagacagggcgcccacagcgagtgcgaggagggcgccggcgacttcctgtggctggaccagagccccagaggcgacaacctgctgagcgtgggcgaccccccccaggtggccgacctggagagcctgggcggcccctgcagaccccccagccccaaggacaccggcagcggccccggcgagcccggcggcagcggcgccggctgcgccagcggcaccgagaagttcggctacctgcccgccaccggcgacggcccccagcccggcagcccctgcggccccgtgggcttccccgtgcccagcggcggcgagagcctgagcagcgccgcccaggcccccccccagagcgccgccctgtgcctgggcgccagcgcccaggccagcgccgagcagcaggaggccgtgtgcgtggtgagaaccggcagcgacgagggccaggcccccgcccaggaccaggaggagctggaggccaaggcccagcccgccagcagaggcagactggagcagggcctggccgcccccgccgacacctgcgccagcagcagagagcccctgggcggcctgagcagcagcctggacaccgaggccagcagagcctgcagcggccccttcatggagcagagaagaagcaagggcaccaagaacctgaagaagggccccgtgccctgcgcccaggacagaggcaccgacagaagcagcgacaacagccaccaggacagacccgaggagcccagccccggcggctgccccagactggaggaggtgaagatcccccacggcgtgaagctggtgtgctacctgggcagcggccccgtgatccagctgctgggcgccatcagccacggccaggccggcggccagctgccccccaagctggaggtgctggaggacctgatggaggtgagcagccccagccccgcccagagactgagaagaaagaagagacccatggtgcagggccccgccggctgccaggtgttccagcccagccccagcggcggcaccgccggcgaccccggcggcctgagcgaccccttctacccccccagaagcggcagcctggccctgggcgaccccagcagcgaccccgcctgcagccagagcggccccatggaggccgaggaggacagcctgcccgagcagcccgaggacagcgcccagctgcagcaggagaagcccagcctgtacatcggcgtgagaggcaccgtggtgagaagcatgcaggaggtgctgtggaccagactgagagagctgcccgaccccgtgctgagcgaggaggtggtggagggcatcgccgccggcatcgaggccgccctgtgggacctgacccagggcaccaacggcagatacaagaccaagtacagaagcctgctgttcaacctgagagaccccagaaacctggacctgttcctgaaggtggtgcacggcgacgtgaccccctacgacctggtgagaatgagcagcatgcagctggccccccaggagctggccagatggagagaccaggaggagaagagaggcctgaacatcatcgagcagcagcagaaggagccctgcagactgcccgccagcaagatgacccacaagggcgaggtggagatccagagagacatggaccagaccctgaccctggaggacctggtgggcccccagatgttcatggactgcagcccccaggccctgcccatcgccagcgaggacaccaccggccagcacgaccaccacttcctggaccccaactgccacatctgcaaggactgggagcccagcaacgagctgctgggcagcttcgaggccgccaagagctgcggcgacaacatcttccagaaggccctgagccagacccccatgcccgcccccgagatgcccaagaccagagagctgagccccaccgagccccaggacagagtgccccccagcggcctgcacgtgcccgccgcccccaccaaggccctgccctgcctgcccccctgggagggcgtgctggacatgttcagcatcaagagattcagagccagagcccagctggtgagcggccacagctgcagactggtgcaggccctgcccaccgtgatcagaagcgccggctgcatccccagcaacatcgtgtgggacctgctggccagcatctgccccgccaaggccaaggacgtgtgcgtggtgagactgtgcccccacggcgccagagacacccagaactgcagactgctgtacagctacctgaacgacagacagagacacggcctggccagcgtggagcacatgggcatggtgctgctgcccctgcccgccttccagcccctgcccaccagactgagacccctgggcggccccggcctgtgggccctgcccgtgagccccctgctgagccccggcctggaggtgacccacagcagcctgctgctggccgtgctgctgcccaaggagggcctgcccgacaccgccggcagcagcccctggctgggcaaggtgcagaagatggtgagcttcaacagcaaggtggagaagagatactaccagcccgacgacagaagacccaacgtgcccctgaagggcacccccccccccggcggcgcctggcagcagagccagggcagaggcagcatcgcccccagaggcatcagcgcctggcagagaccccccagaggcagaggcagactgtggcccgagcccgagaactggcagcaccccggcagaggccagtggccccccgagcccggcctgagacagagccagcacccctacagcgtggcccccgccggccacggcttcggcagaggccagcacttccacagagacagctgcccccaccaggccctgctgagacacctggagagcctggccaccatgagccaccagctgcaggccctgctgtgcccccagaccaagagcagcatccccagacccctgcagagactgagcagcgccctggccgcccccgagccccccggccccgccagagacagcagcctgggccccaccgacgaggccggcagcgagtgccccttccccagaaaggcctag

SEQ ID NO: 9617 - DNA, 1635 bp, Artificial Sequence
  Description of Artificial Sequence: Synthetic coding sequence
atgagccaggccggcgacgtggagggccccagcaccggcgaccccgtgctgagcccccagcacaactgcgagctgctgcagaacatggagggcgccagcagcatgcccggcctgagccccgacggccccggcgccagcagcggccccggcgtgagagccggcagcagaagaaagatccccagaaaggaggccctgagaggcggcagcagcagagccgccggcgccgccgaggtgagacccggcgtgctggagctgctggccgtggtgcagagcagaggcagcatgctggcccccggcctgcacatgcagctgcccagcgtgcccacccagggcagagccctgaccagcaagagactgcaggtgagcctgtgcgacatcctggacgacagctgccccagaaagctgtgcagcagaagcgccggcctgcccgagagagccctggcctgcagagagagactggccggcgtggaggaggtgagctgcctgagacccagagaggccagagacggcggcatgagcagccccggctgcgacagaagaagccccaccctgagcaaggaggagccccccggcagacccctgaccagcagccccgaccccgtgcccgtgagagtgagaaagaagtggagaagacagggcgcccacagcgagtgcgaggagggcgccggcgacttcctgtggctggaccagagccccagaggcgacaacctgctgagcgtgggcgaccccccccaggtggccgacctggagagcctgggcggcccctgcagaccccccagccccaaggacaccggcagcggccccggcgagcccggcggcagcggcgccggctgcgccagcggcaccgagaagttcggctacctgcccgccaccggcgacggcccccagcccggcagcccctgcggccccgtgggcttccccgtgcccagcggcggcgagagcctgagcagcgccgcccaggcccccccccagagcgccgccctgtgcctgggcgccagcgcccaggccagcgccgagcagcaggaggccgtgtgcgtggtgagaaccggcagcgacgagggccaggcccccgcccaggaccaggaggagctggaggccaaggcccagcccgccagcagaggcagactggagcagggcctggccgcccccgccgacacctgcgccagcagcagagagcccctgggcggcctgagcagcagcctggacaccgaggccagcagagcctgcagcggccccttcatggagcagagaagaagcaagggcaccaagaacctgaagaagggccccgtgccctgcgcccaggacagaggcaccgacagaagcagcgacaacagccaccaggacagacccgaggagcccagccccggcggctgccccagactggaggaggtgaagatcccccacggcgtgaagctggtgtgctacgtgttccagcccagccccagcggcggcaccgccggcgaccccggcggcctgagcgaccccttctacccccccagaagcggcagcctggccctgggcgaccccagcagcgaccccgcctgcagccagagcggccccatggaggccgaggaggacagcctgcccgagcagcccgaggacagcgccttcggcagcagccagacccagtgctag

SEQ ID NO: 9618 - DNA, 810 bp, Artificial Sequence
  Description of Artificial Sequence: Synthetic coding sequence
atgcaggaggtgctgtggaccagactgagagagctgcccgaccccgtgctgagcgaggaggtggtggagggcatcgccgccggcatcgaggccgccctgtgggacctgacccagggcaccaacggcagatacaagaccaagtacagaagcctgctgttcaacctgagagaccccagaaacctggacctgttcctgaaggtggtgcacggcgacgtgaccccctacgacctggtgagaatgagcagcatgcagctggccccccaggagctggccagatggagagaccaggaggagaagagaggcccccagatgttcatggactgcagcccccaggccctgcccatcgccagcgaggacaccaccggccagcacgaccaccacttcctggaccccaactgccacatctgcaaggactgggagcccagcaacgagctgctgggcagcttcgaggccgccaagagctgcggcgacaacatcttccagaaggccctgagccagacccccatgcccgcccccgagatgcccaagaccagagagctgagccccaccgagccccaggacagatgcggcgtgggcagcagagaggtggacaaccccgccggcctgagaggcagacccccccccggcgccaccgacatcgccctggccttccccgtgtggccctgggccagcctgcccagcctgggcaacctgaccttccccatctgcgccatggagctgatcatccccgccagctggcagccccccgcccagggccaggcctgggccagcgtgcccgtgcccaccgtgggcacccaggacctgctgtag

SEQ ID NO: 9619 - DNA, 63 bp, Artificial Sequence
  Description of Artificial Sequence: Synthetic coding sequence
atggaggtgagcagccccagccccgcccagagactgagaagaaagaagagacccatggtgtag

SEQ ID NO: 9620 - DNA, 264 bp, Artificial Sequence
  Description of Artificial Sequence: Synthetic coding sequence
atggaggtgagcagccccagccccgcccagagactgagaagaaagaagagacccatggtgcagggccccgccggctgccaggtgttccagcccagccccagcggcggcaccgccggcgaccccggcggcctgagcgaccccttctacccccccagaagcggcagcctggccctgggcgaccccagcagcgaccccgcctgcagccagagcggccccatggaggccgaggaggacagcctgcccgagcagcccgaggacagctag

SEQ ID NO: 9621 - DNA, 3612 bp, Artificial Sequence
  Description of Artificial Sequence: Synthetic coding sequence
atgagccaggccggcgacgtggagggccccagcaccggcgaccccgtgctgagcccccagcacaactgcgagctgctgcagaacatggagggcgccagcagcatgcccggcctgagccccgacggccccggcgccagcagcggccccggcgtgagagccggcagcagaagaaagatccccagaaaggaggccctgagaggcggcagcagcagagccgccggcgccgccgaggtgagacccggcgtgctggagctgctggccgtggtgcagagcagaggcagcatgctggcccccggcctgcacatgcagctgcccagcgtgcccacccagggcagagccctgaccagcaagagactgcaggtgagcctgtgcgacatcctggacgacagctgccccagaaagctgtgcagcagaagcgccggcctgcccgagagagccctggcctgcagagagagactggccggcgtggaggaggtgagctgcctgagacccagagaggccagagacggcggcatgagcagccccggctgcgacagaagaagccccaccctgagcaaggaggagccccccggcagacccctgaccagcagccccgaccccgtgcccgtgagagtgagaaagaagtggagaagacagggcgcccacagcgagtgcgaggagggcgccggcgacttcctgtggctggaccagagccccagaggcgacaacctgctgagcgtgggcgaccccccccaggtggccgacctggagagcctgggcggcccctgcagaccccccagccccaaggacaccggcagcggccccggcgagcccggcggcagcggcgccggctgcgccagcggcaccgagaagttcggctacctgcccgccaccggcgacggcccccagcccggcagcccctgcggccccgtgggcttccccgtgcccagcggcggcgagagcctgagcagcgccgcccaggcccccccccagagcgccgccctgtgcctgggcgccagcgcccaggccagcgccgagcagcaggaggccgtgtgcgtggtgagaaccggcagcgacgagggccaggcccccgcccaggaccaggaggagctggaggccaaggcccagcccgccagcagaggcagactggagcagggcctggccgcccccgccgacacctgcgccagcagcagagagcccctgggcggcctgagcagcagcctggacaccgaggccagcagagcctgcagcggccccttcatggagcagagaagaagcaagggcaccaagaacctgaagaagggccccgtgccctgcgcccaggacagaggcaccgacagaagcagcgacaacagccaccaggacagacccgaggagcccagccccggcggctgccccagactggaggaggtgaagatcccccacggcgtgaagctggtgtgctacctgggcagcggccccgtgatccagctgctgggcgccatcagccacggccaggccggcggccagctgccccccaagctggaggtgctggaggacctgatggaggtgagcagccccagccccgcccagagactgagaagaaagaagagacccatggtgcagggccccgccggctgccaggtgttccagcccagccccagcggcggcaccgccggcgaccccggcggcctgagcgaccccttctacccccccagaagcggcagcctggccctgggcgaccccagcagcgaccccgcctgcagccagagcggccccatggaggccgaggaggacagcctgcccgagcagcccgaggacagcgcccagctgcagcaggagaagcccagcctgtacatcggcgtgagaggcaccgtggtgagaagcatgcaggaggtgctgtggaccagactgagagagctgcccgaccccgtgctgagcgaggaggtggtggagggcatcgccgccggcatcgaggccgccctgtgggacctgacccagggcaccaacggcagatacaagaccaagtacagaagcctgctgttcaacctgagagaccccagaaacctggacctgttcctgaaggtggtgcacggcgacgtgaccccctacgacctggtgagaatgagcagcatgcagctggccccccaggagctggccagatggagagaccaggaggagaagagaggcctgaacatcatcgagcagcagcagaaggagccctgcagactgcccgccagcaagatgacccacaagggcgaggtggagatccagagagacatggaccagaccctgaccctggaggacctggtgggcccccagatgttcatggactgcagcccccaggccctgcccatcgccagcgaggacaccaccggccagcacgaccaccacttcctggaccccaactgccacatctgcaaggactgggagcccagcaacgagctgctgggcagcttcgaggccgccaagagctgcggcgacaacatcttccagaaggccctgagccagacccccatgcccgcccccgagatgcccaagaccagagagctgagccccaccgagccccaggacagagtgccccccagcggcctgcacgtgcccgccgcccccaccaaggccctgccctgcctgcccccctgggagggcgtgctggacatgttcagcatcaagagattcagagccagagcccagctggtgagcggccacagctgcagactggtgcaggccctgcccaccgtgatcagaagcgccggctgcatccccagcaacatcgtgtgggacctgctggccagcatctgccccgccaaggccaaggacgtgtgcgtggtgagactgtgcccccacggcgccagagacacccagaactgcagactgctgtacagctacctgaacgacagacagagacacggcctggccagcgtggagcacatgggcatggtgctgctgcccctgcccgccttccagcccctgcccaccagactgagacccctgggcggccccggcctggaggtgacccacagcagcctgctgctggccgtgctgctgcccaaggagggcctgcccgacaccgccggcagcagcccctggctgggcaaggtgcagaagatggtgagcttcaacagcaaggtggagaagagatactaccagcccgacgacagaagacccaacgtgcccctgaagggcacccccccccccggcggcgcctggcagcagagccagggcagaggcagcatcgcccccagaggcatcagcgcctggcagagaccccccagaggcagaggcagactgtggcccgagcccgagaactggcagcaccccggcagaggccagtggccccccgagcccggcctgagacagagccagcacccctacagcgtggcccccgccggccacggcttcggcagaggccagcacttccacagagacagctgcccccaccaggccctgctgagacacctggagagcctggccaccatgagccaccagctgcaggccctgctgtgcccccagaccaagagcagcatccccagacccctgcagagactgagcagcgccctggccgcccccgagccccccggccccgccagagacagcagcctgggccccaccgacgaggccggcagcgagtgccccttccccagaaaggcctag

SEQ ID NO: 9622 - DNA, 3939 bp, Artificial Sequence
  Description of Artificial Sequence: Synthetic coding sequence
atggaggaggaggacgagagcagaggcaagaccgaggagagcggcgaggacagaggcgacggcccccccgacagagaccccaccctgagccccagcgccttcatcctgagagccatccagcaggccgtgggcagcagcctgcagggcgacctgcccaacgacaaggacggcagcagatgccacggcctgagatggagaagatgcagaagccccagaagcgagcccagaagccaggagagcggcggcaccgacaccgccaccgtgctggacatggccaccgacagcttcctggccggcctggtgagcgtgctggacccccccgacacctgggtgcccagcagactggacctgagacccggcgagagcgaggacatgctggagctggtggccgaggtgagaatcggcgacagagaccccatccccctgcccgtgcccagcctgctgcccagactgagagcctggagaaccggcaagaccgtgagcccccagagcaacagcagcagacccacctgcgccagacacctgaccctgggcaccggcgacggcggccccgcccccccccccgcccccagcagcgccagcagcagccccagccccagccccagcagcagcagccccagcccccccccccccccccccccccccgccccccccgccccccccgcccccagattcgacatctacgaccccttccaccccaccgacgaggcctacagccccccccccgcccccgagcagaagtacgaccccttcgagcccaccggcagcaaccccagcagcagcgccggcacccccagccccgaggaggaggaggaggaggaggaggaggaggaggaggaggaggaggacgaggaggaggaggagggcctgagccagagcatcagcagaatcagcgagaccctggccggcatctacgacgacaacagcctgagccaggacttccccggcgacgagagccccagacccgacgcccagcccacccagcccacccccgcccccggcacccccccccaggtggacagcaccagagccgacggcgccatgagaagaagagtgttcgtggtgggcaccgaggccgaggcctgcagagagggcaaggtgagcgtggaggtggtgaccgccggcggcgccgccctgcccccccccctgctgccccccggcgacagcgagatcgaggagggcgagatcgtgcagcccgaggaggagcccagactggccctgagcctgttcagacccggcggcagagccgccagacccacccccgccgccagcgccacccccaccgcccagcccctgccccagccccccgcccccagagcccccgagggcgacgacttcctgagcctgcacgccgagagcgacggcgagggcgccctgcaggtggacctgggcgagcccgcccccgccccccccgccgccgacagcagatggggcggcctggacctgagaagaaagatcctgacccagagaagagagagatacagacagagaagccccagccccgcccccgcccccgcccccgccgccgccgccggcccccccaccagaaagaagagcagaagagagagaaagagaagcggcgaggccaaggaggccgccagcagcagcagcggcacccagcccgccccccccgcccccgccagcccctgggacagcaagaagcacagaagcagagacagaaagcccggcagccacgccagcagcagcgccagaagaagaagcagaagcagaagcagaagcagaagcaccagaagaagaagcagaagcaccgacagaagaagaggcggcagcagaagaagcagaagcagagagaagagaagaagaagaagaagaagcgccagccccccccccgccaccagcagcagcagcagcagcagaagagagagacacagaggcaagcacagagacggcggcggcagcaagaagaagaagaagagaagcagaagcagaggcgagaagagaagcggcgacggcagcgagaaggcccccgcccccgcccccccccccagcggcagcaccagctgcggcgacagagacagcagaagaagaggcgccgtgccccccagcatccaggacctgaccgaccacgacctgttcgccatcaagagaaccatcaccgtgggcagactggacaagagcgaccccagaggccccagccccgcccccgccagcagccccaagagagaggtgctgtacgacagcgagggcctgagcggcgaggagagaggcggcaagagcagccagaaggacagaagaagaagcggcgccgccagcagcagcagcagcagcagagagaagggcagcagaagaaaggccctggacggcggcgacagagacagagacagagacagagacagagacagagacagaagcagcaagaaggccagaccccccaaggagagcgcccccagcagcggccccccccccaagccccccgtgagcagcggcagcggcagcagcagcagcagcagcagctgcagcagcagaaaggtgaagctgcagagcaaggtggccgtgctgatcagagagggcgtgagcagcaccacccccgccaaggacgccgccagcgccggcctgggcagcatcggcgtgaagttcagcagagacagagagagcagaagccccttcctgaagcccgacgagagagcccccaccgagatggccaaggccgcccccggcagcaccaagcccaagaagaccaaggtgaaggccaaggccggcgccaagaagaccaagggcaccaagggcaagaccaagcccagcaagaccagaaagaaggtgagaagcggcggcggcagcggcggcagcggcggccaggtgagcctgaagaagagcaaggccgacagctgcagccaggccgccggcaccaagggcgccgaggagaccagctggagcggcgaggagagagccgccaaggtgcccagcacccccccccccaaggccgccccccccccccccgccctgacccccgacagccagaccgtggacagcagctgcaagacccccgaggtgagcttcctgcccgaggaggccaccgaggaggccggcgtgagaggcggcgccgaggaggaggaggaggaggaggaggaggaggaggaggaggaggaggaggaggagcagcagcccgccaccaccaccgccaccagcaccgccgccgccgcccccagcaccgcccccagcgccggcagcaccgccggcgacagcggcgccgaggacggccccgccagcagagtgagccagctgcccaccctgcccccccccatgccctggaacctgcccgccggcgtggactgcaccaccagcggcgtgctggccctgaccgccctgctgttcaagatggaggaggccaacctggccagcagagccaaggcccaggagctgatccaggccaccaaccagatcctgagccacagaaagccccccagcagcctgggcatgacccccgcccccgtgcccaccagcctgggcctgccccccggccccagcagctacctgctgcccggcagcctgcccctgggcggctgcggcagcaccccccccacccccaccggcctggccgccaccagcgacaagagagagggcagcagcagcagcgagggcagaggcgacaccgacaagtacctgaagaagctgcacacccaggagagagccgtggaggaggtgaagctggccatcaagccctactaccagaagaaggacatcaccaaggaggagtacaaggacatcctgagaaaggccgtgcacaagatctgccacagcaagagcggcgagatcaaccccgtgaaggtgagcaacctggtgagagcctacgtgcagagatacagatacttcagaaagcacggcagaaagcccggcgacccccccggcccccccagaccccccaaggagcccggcccccccgacaagggcggccccggcctgcccctgccccccctgtag

SEQ ID NO: 9623 - DNA, 660 bp, Artificial Sequence
  Description of Artificial Sequence: Synthetic coding sequence
atggaggaggaggacgagagcagaggcaagaccgaggagagcggcgaggacagaggcgacggcccccccgacagagaccccaccctgagccccagcgccttcatcctgagagccatccagcaggccgtgggcagcagcctgcagggcgacctgcccaacgacaaggacggcagcagatgccacggcctgagatggagaagatgcagaagccccagaagcgagcccagaagccaggagagcggcggcaccgacaccgccaccgtgctggacatggccaccgacagcttcctggccggcctggtgagcgtgctggacccccccgacacctgggtgcccagcagactggacctgagacccggcgagagcgaggacatgctggagctggtggccgaggtgagaatcggcgacagagaccccatccccctgcccgtgcccagcctgctgcccagactgagagcctggagaaccggcaagaccgtgagcccccagagcaacagcagcagacccacctgcgccagacacctgaccctgggcaccggcgacggcccctgccccaccccctgccccctgctgtgcatcctgctgcccttccccttcagcctgatcttcctgcccttccccagccccacccccaccgcccccagcccccagttccactag

SEQ ID NO: 9624 - DNA, 3444 bp, Artificial Sequence
  Description of Artificial Sequence: Synthetic coding sequence
atggacgccgtgaacgccttcaaccaggagctgttcagcctgatggacatgaagccccccatcagcagagccaagatgatcctgatcaccaaggccgccatcaaggccatcaagctgtacaagcacgtggtgcagatcgtggagaagttcatcaagaagtgcaagcccgagtacaaggtgcccggcctgtacgtgatcgacagcatcgtgagacagagcagacaccagttcggcaccgacaaggacgtgttcggccccagattcagcaagaacatcaccgccaccttccagtacctgtacctgtgccccagcgaggacaagagcaagatcgtgagagtgctgaacctgtggcagaagaacggcgtgttcaagatcgagatcatccagcccctgctggacatggccgccggcaccagcaacgccgcccccgtggccgagaacgtgaccaacaacgagggcagcccccccccccccgtgaaggtgagcagcgagccccccacccaggccacccccaacagcgtgcccgccgtgccccagctgcccagcagcgacgccttcgccgccgtggcccagctgttccagaccacccagggccagcagctgcagcagatcctgcagaccttccagcagccccccaagccccagagccccgccctggacaacgccgtgatggcccaggtgcaggccatcaccgcccagctgaagaccacccccacccagcccagcgagcagaaggccgccttccccccccccgagcagaagaccgccttcgacaagaagctgctggacagattcgactacgacgacgagcccgaggccgtggaggagagcaagaaggaggacaccaccgccgtgaccaccaccgcccccgccgccgccgtgccccccgcccccaccgccaccgtgcccgccgccgccgcccccgccgccgccagccccccccccccccaggcccccttcggcttccccggcgacggcatgcagcagcccgcctacacccagcaccagaacatggaccagttccagcccagaatgatgggcatccagcaggaccccatgcaccaccaggtgcccctgccccccaacggccagatgcccggcttcggcctgctgcccaccccccccttcccccccatggcccagcccgtgatcccccccaccccccccgtgcagcagcccttccaggccagcttccaggcccagaacgagcccctgacccagaagccccaccagcaggagatggaggtggagcagccctgcatccaggaggtgaagagacacatgagcgacaacagaaagagcagaagcagaagcgccagcagaagccccaagagaagaagaagcagaagcggcagcagaagcagaagaagcagacacagaagaagcagaagcagaagcagagacagaagaagacacagccccagaagcagaagccaggagagaagagacagagagaaggagagagagagaagacagaagggcctgccccaggtgaagcccgagaccgccagcgtgtgcagcaccaccctgtgggtgggccagctggacaagagaaccacccagcaggacgtggccagcctgctggaggagttcggccccatcgagagcatcaacatgatcccccccagaggctgcgcctacatcgtgatggtgcacagacaggacgcctacagagccctgcagaagctgagcagaggcaactacaaggtgaaccagaagagcatcaagatcgcctgggccctgaacaagggcatcaaggccgactacaagcagtactgggacgtggagctgggcgtgacctacatcccctgggacaaggtgaagcccgaggagctggagagcttctgcgagggcggcatgctggacagcgacaccctgaaccccgactggaagggcatccccaagaagcccgagaacgaggtggcccagaacggcggcgccgagaccagccacaccgagcccgtgagccccatccccaagcccctgcccgtgcccgtgccccccatccccgtgcccgcccccatcaccgtgccccccccccaggtgcccccccaccagcccggcccccccgtggtgggcgccctgcagccccccgccttcaccccccccctgggcatccccccccccggcttcggccccggcgtgccccccccccccccccccccccccttcctgagacccggcttcaaccccatgcacctgccccccggcttcctgccccccggcccccccccccccatcaccccccccgtgagcatcccccccccccacaccccccccatcagcatccccaacagcaccatcgccggcatcaacgaggacaccaccaaggacctgagcatcggcaaccccatccccaccgtggtgagcggcgccagaggcaacgccgagagcggcgacagcgtgaagatgtacggcagcgccgtgccccccgccgcccccaccaacctgcccaccccccccgtgacccagcccgtgagcctgctgggcacccagggcgtggcccccggccccgtgatcggcctgcaggcccccagcaccggcctgctgggcgccagacccggcctgatccccctgcagagaccccccggcatgccccccccccacctgcagagattccccctgatgccccccagacccatgcccccccacatgatgcacagaggccccccccccggccccggcggcttcgccatgccccccccccacggcatgaagggccccttccccccccacggccccttcgtgagacccggcggcatgcccggcctgggcggccccggccccggccccggcggccccgaggacagagacggcagacagcagcccccccagcagccccagcagcagccccagccccaggccccccagcagccccagcagcagcagcagcagcagcccccccccagccagcagcccccccccacccagcagcagccccagcagttcagaaacgacaacagacagcagttcaacagcggcagagaccaggagagattcggcagaagaagcttcggcaacagagtggagaacgacagagagagatacggcaacagaaacgacgacagagacaacagcaacagagacagaagagagtggggcagaagaagccccgacagagacagacacagagacctggaggagagaaacagaagaagcagcggccacagagacagagagagagacagcagagacagagagagcagaagagagaaggaggaggccagaggcaaggagaagcccgaggtgaccgacagagccggcggcaacaagaccgtggagccccccatcagccaggtgggcaacgtggacaccgccagcgagctggagaagggcgtgagcgaggccgccgtgctgaagcccagcgaggagctgcccgccgaggccaccagcagcgtggagcccgagaaggacagcggcagcgccgccgaggcccccagatag

SEQ ID NO: 9625 - DNA, 3378 bp, Artificial Sequence
  Description of Artificial Sequence: Synthetic coding sequence
atggacgccgtgaacgccttcaaccaggagctgttcagcctgatggacatgaagccccccatcagcagagccaagatgatcctgatcaccaaggccgccatcaaggccatcaagctgtacaagcacgtggtgcagatcgtggagaagttcatcaagaagtgcaagcccgagtacaaggtgcccggcctgtacgtgatcgacagcatcgtgagacagagcagacaccagttcggcaccgacaaggacgtgttcggccccagattcagcaagaacatcaccgccaccttccagtacctgtacctgtgccccagcgaggacaagagcaagatcgtgagagtgctgaacctgtggcagaagaacggcgtgttcaagatcgagatcatccagcccctgctggacatggccgccggcaccagcaacgccgcccccgtggccgagaacgtgaccaacaacgagggcagcccccccccccccgtgaaggtgagcagcgagccccccacccaggccacccccaacagcgtgcccgccgtgccccagctgcccagcagcgacgccttcgccgccgtggcccagctgttccagaccacccagggccagcagctgcagcagatcctgcagaccttccagcagccccccaagccccagagccccgccctggacaacgccgtgatggcccaggtgcaggccatcaccgcccagctgaagaccacccccacccagcccagcgagcagaaggccgccttccccccccccgagcagaagaccgccttcgacaagaagctgctggacagattcgactacgacgacgagcccgaggccgtggaggagagcaagaaggaggacaccaccgccgtgaccaccaccgcccccgccgccgccgtgccccccgcccccaccgccaccgtgcccgccgccgccgcccccgccgccgccagccccccccccccccaggcccccttcggcttccccggcgacggcatgcagcagcccgcctacacccagcaccagaacatggaccagttccagcccagaatgatgggcatccagcaggaccccatgcaccaccaggtgcccctgccccccaacggccagatgcccggcttcggcctgctgcccaccccccccttcccccccatggcccagcccgtgatcccccccaccccccccgtgcagcagcccttccaggccagcttccaggcccagaacgagcccctgacccagaagccccaccagcaggagatggaggtggagcagccctgcatccaggaggtgaagagacacatgagcgacaacagaaagagcagaagcagaagcgccagcagaagccccaagagaagaagaagcagaagcggcagcagaagcagaagaagcagacacagaagaagcagaagcagaagcagagacagaagaagacacagccccagaagcagaagccaggagagaagagacagagagaaggagagagagagaagacagaagggcctgccccaggtgaagcccgagaccgccagcgtgtgcagcaccaccctgtgggtgggccagctggacaagagaaccacccagcaggacgtggccagcctgctggaggagttcggccccatcgagagcatcaacatgatcccccccagaggctgcgcctacatcgtgatggtgcacagacaggacgcctacagagccctgcagaagctgagcagaggcaactacaaggtgaaccagaagagcatcaagatcgcctgggccctgaacaagggcatcaaggccgactacaagcagtactgggacgtggagctgggcgtgacctacatcccctgggacaaggtgaagcccgaggagctggagagcttctgcgagggcggcatgctggacagcgacaccctgaaccccgactggaagggcatccccaagaagcccgagaacgaggtggcccagaacggcggcgccgagaccagccacaccgagcccgtgagccccatccccaagcccctgcccgtgcccgtgccccccatccccgtgcccgcccccatcaccgtgccccccccccaggtgcccccccaccagcccggcccccccgtggtgggcgccctgcagccccccgccttcaccccccccctgggcatccccccccccggcttcggccccggcgtgccccccccccccccccccccccccttcctgagacccggcttcaaccccatgcacctgccccccggcttcctgccccccggcccccccccccccatcaccccccccgtgagcatcccccccccccacaccccccccatcagcatccccaacctggtgagcggcgccagaggcaacgccgagagcggcgacagcgtgaagatgtacggcagcgccgtgccccccgccgcccccaccaacctgcccaccccccccgtgacccagcccgtgagcctgctgggcacccagggcgtggcccccggccccgtgatcggcctgcaggcccccagcaccggcctgctgggcgccagacccggcctgatccccctgcagagaccccccggcatgccccccccccacctgcagagattccccctgatgccccccagacccatgcccccccacatgatgcacagaggccccccccccggccccggcggcttcgccatgccccccccccacggcatgaagggccccttccccccccacggccccttcgtgagacccggcggcatgcccggcctgggcggccccggccccggccccggcggccccgaggacagagacggcagacagcagcccccccagcagccccagcagcagccccagccccaggccccccagcagccccagcagcagcagcagcagcagcccccccccagccagcagcccccccccacccagcagcagccccagcagttcagaaacgacaacagacagcagttcaacagcggcagagaccaggagagattcggcagaagaagcttcggcaacagagtggagaacgacagagagagatacggcaacagaaacgacgacagagacaacagcaacagagacagaagagagtggggcagaagaagccccgacagagacagacacagagacctggaggagagaaacagaagaagcagcggccacagagacagagagagagacagcagagacagagagagcagaagagagaaggaggaggccagaggcaaggagaagcccgaggtgaccgacagagccggcggcaacaagaccgtggagccccccatcagccaggtgggcaacgtggacaccgccagcgagctggagaagggcgtgagcgaggccgccgtgctgaagcccagcgaggagctgcccgccgaggccaccagcagcgtggagcccgagaaggacagcggcagcgccgccgaggcccccagatag

SEQ ID NO: 9626 - DNA, 3399 bp, Artificial Sequence
  Description of Artificial Sequence: Synthetic coding sequence
atggacgccgtgaacgccttcaaccaggagctgttcagcctgatggacatgaagccccccatcagcagagccaagatgatcctgatcaccaaggccgccatcaaggccatcaagtgcaagcccgagtacaaggtgcccggcctgtacgtgatcgacagcatcgtgagacagagcagacaccagttcggcaccgacaaggacgtgttcggccccagattcagcaagaacatcaccgccaccttccagtacctgtacctgtgccccagcgaggacaagagcaagatcgtgagagtgctgaacctgtggcagaagaacggcgtgttcaagatcgagatcatccagcccctgctggacatggccgccggcaccagcaacgccgcccccgtggccgagaacgtgaccaacaacgagggcagcccccccccccccgtgaaggtgagcagcgagccccccacccaggccacccccaacagcgtgcccgccgtgccccagctgcccagcagcgacgccttcgccgccgtggcccagctgttccagaccacccagggccagcagctgcagcagatcctgcagaccttccagcagccccccaagccccagagccccgccctggacaacgccgtgatggcccaggtgcaggccatcaccgcccagctgaagaccacccccacccagcccagcgagcagaaggccgccttccccccccccgagcagaagaccgccttcgacaagaagctgctggacagattcgactacgacgacgagcccgaggccgtggaggagagcaagaaggaggacaccaccgccgtgaccaccaccgcccccgccgccgccgtgccccccgcccccaccgccaccgtgcccgccgccgccgcccccgccgccgccagccccccccccccccaggcccccttcggcttccccggcgacggcatgcagcagcccgcctacacccagcaccagaacatggaccagttccagcccagaatgatgggcatccagcaggaccccatgcaccaccaggtgcccctgccccccaacggccagatgcccggcttcggcctgctgcccaccccccccttcccccccatggcccagcccgtgatcccccccaccccccccgtgcagcagcccttccaggccagcttccaggcccagaacgagcccctgacccagaagccccaccagcaggagatggaggtggagcagccctgcatccaggaggtgaagagacacatgagcgacaacagaaagagcagaagcagaagcgccagcagaagccccaagagaagaagaagcagaagcggcagcagaagcagaagaagcagacacagaagaagcagaagcagaagcagagacagaagaagacacagccccagaagcagaagccaggagagaagagacagagagaaggagagagagagaagacagaagggcctgccccaggtgaagcccgagaccgccagcgtgtgcagcaccaccctgtgggtgggccagctggacaagagaaccacccagcaggacgtggccagcctgctggaggagttcggccccatcgagagcatcaacatgatcccccccagaggctgcgcctacatcgtgatggtgcacagacaggacgcctacagagccctgcagaagctgagcagaggcaactacaaggtgaaccagaagagcatcaagatcgcctgggccctgaacaagggcatcaaggccgactacaagcagtactgggacgtggagctgggcgtgacctacatcccctgggacaaggtgaagcccgaggagctggagagcttctgcgagggcggcatgctggacagcgacaccctgaaccccgactggaagggcatccccaagaagcccgagaacgaggtggcccagaacggcggcgccgagaccagccacaccgagcccgtgagccccatccccaagcccctgcccgtgcccgtgccccccatccccgtgcccgcccccatcaccgtgccccccccccaggtgcccccccaccagcccggcccccccgtggtgggcgccctgcagccccccgccttcaccccccccctgggcatccccccccccggcttcggccccggcgtgccccccccccccccccccccccccttcctgagacccggcttcaaccccatgcacctgccccccggcttcctgccccccggcccccccccccccatcaccccccccgtgagcatcccccccccccacaccccccccatcagcatccccaacagcaccatcgccggcatcaacgaggacaccaccaaggacctgagcatcggcaaccccatccccaccgtggtgagcggcgccagaggcaacgccgagagcggcgacagcgtgaagatgtacggcagcgccgtgccccccgccgcccccaccaacctgcccaccccccccgtgacccagcccgtgagcctgctgggcacccagggcgtggcccccggccccgtgatcggcctgcaggcccccagcaccggcctgctgggcgccagacccggcctgatccccctgcagagaccccccggcatgccccccccccacctgcagagattccccctgatgccccccagacccatgcccccccacatgatgcacagaggccccccccccggccccggcggcttcgccatgccccccccccacggcatgaagggccccttccccccccacggccccttcgtgagacccggcggcatgcccggcctgggcggccccggccccggccccggcggccccgaggacagagacggcagacagcagcccccccagcagccccagcagcagccccagccccaggccccccagcagccccagcagcagcagcagcagcagcccccccccagccagcagcccccccccacccagcagcagccccagcagttcagaaacgacaacagacagcagttcaacagcggcagagaccaggagagattcggcagaagaagcttcggcaacagagtggagaacgacagagagagatacggcaacagaaacgacgacagagacaacagcaacagagacagaagagagtggggcagaagaagccccgacagagacagacacagagacctggaggagagaaacagaagaagcagcggccacagagacagagagagagacagcagagacagagagagcagaagagagaaggaggaggccagaggcaaggagaagcccgaggtgaccgacagagccggcggcaacaagaccgtggagccccccatcagccaggtgggcaacgtggacaccgccagcgagctggagaagggcgtgagcgaggccgccgtgctgaagcccagcgaggagctgcccgccgaggccaccagcagcgtggagcccgagaaggacagcggcagcgccgccgaggcccccagatag

SEQ ID NO: 9627 - DNA, 3816 bp, Artificial Sequence
  Description of Artificial Sequence: Synthetic coding sequence
atggaggccgtgaagaccttcaacagcgagctgtacagcctgaacgactacaagccccccatcagcaaggccaagatgacccagatcaccaaggccgccatcaaggccatcaagttctacaagcacgtggtgcagagcgtggagaagttcatccagaagtgcaagcccgagtacaaggtgcccggcctgtacgtgatcgacagcatcgtgagacagagcagacaccagttcggccaggagaaggacgtgttcgcccccagattcagcaacaacatcatcagcaccttccagaacctgtacagatgccccggcgacgacaagagcaagatcgtgagagtgctgaacctgtggcagaagaacaacgtgttcaagagcgagatcatccagcccctgctggacatggccgccggcatccccccccccgtggtgacccccgtgctggccagcaccaccaccgccatgagcaacacccccggcacccccgtgacccccgtgacccccgccaacgtggtgcagggcctgcccgacccctgggtgagccagatcaccaacaccgacaccctggccgccgtggcccagatcctgcagagcccccagggccagcagctgcagcagctgatccagaccctgcagatccagcagcagaagccccagcccagcatcctgcaggccctggacgccggcctggtggtgcagctgcaggccctgaccgcccagctgaccgccgccgccgccgccgccaacaccctgacccccctggagcagggcgtgagcttcaacaagaagctgatggacagattcgacttcggcgaggacagcgagcacagcgaggagcccaagaaggagatccccgccagccagctgagccacgtgagcgagagcgtgaacaacagcatcttccaccagatcgccgagcagctgcagcagcagaacctggagcacctgagacagcagctgctggagcagcagcagccccagaaggccaccccccaggacagccaggagggcaccttcggcagcgagcacagcgccagccccagccagggcagcagccagcagcacttcctggagcccgaggtgaacctggacgacagcatcgacatccagcagcaggacatggacatcgacgagggccaggacggcgtggaggaggaggtgttcgagcaggaggccaagaaggtggccgtgagaagcagaagcagaacccacagcagaagcagaagcagaagccccagaaagagaagaagcagaagcagaagcggcagcagaaagagaaagcacagaaagagaagcagaagcagaagcagagagagaaagagaaagagcagcagaagctacagcagcgagagaagagccagagagagagagaaggagagacagaagaagggcctgccccccatcagaagcaagaccctgagcgtgtgcagcaccaccctgtgggtgggccaggtggacaagaaggccacccagcaggacctgaccaacctgttcgaggagttcggccagatcgagagcatcaacatgatcccccccagaggctgcgcctacgtgtgcatggtgcacagacaggacgccttcagagccctgcagaagctgagcagcggcagctacaagatcggcagcaaggtgatcaagatcgcctgggccctgaacaagggcgtgaagaccgagtacaagcagttctgggacgtggacctgggcgtgacctacatcccctgggagaaggtgaaggtggacgacctggagggcttcgccgagggcggcatgatcgaccaggagaccgtgaacaccgagtgggagaccgtgaagagcagcgagcccgtgaaggagaccgtgcagaccacccagagccccacccccgtggagaaggagaccgtggtgaccacccaggccgaggtgttccccccccccgtggccatgctgcagatccccgtggcccccgccgtgcccaccgtgagcctggtgccccccgccttccccgtgagcatgcccgtgcccccccccggcttcagccccatcccccccccccccttcctgagagccagcttcaaccccagccagcccccccccggcttcatgcccccccccgtgcccccccccgtggtgcccccccccaccatcccccccgtggtgcccaccagcctggtgcagcccagcctgagcatgacccccgagaccgtgaaggacgtgggcttcggcagcctggtgatccccggcggcagcgtggccagcaacctggccaccagcgccctgcccgccggcaacgtgttcaacgcccccaccaagcaggccgagcccgaggagaaggtgccccacctgatcgaccaccagatcagcagcggcgagaacaccagaagcgtgatccccaacgacatcagcagcaacgccgccatcctgggcggccagccccccaacgtgaccagcaacagcggcatcctgggcgtgcagagacccaacgtgagcagcaacagcgagatcctgggcgtgagacccagcaacgtgagcagcagcagcggcatcatcgccgcccagccccccaacatcctgaacaacagcggcatcctgggcatccagccccccagcgtgagcaacagcagcggcctgctgggcgtgctgccccccaacatccccaacaacagcggcctggtgggcgtgcagccccccaacgtgcccaacacccccggcctgctgggcacccagccccccgccggcccccagaacctgccccccctgagcatccccaaccagagaatgcccaccatgcccatgctggacatcagacccggcctgatcccccaggcccccggccccagattccccctgatccagcccggcatccccccccagagaggcatccccccccccagcgtgctggacagcgccctgcaccccccccccagaggccccttcccccccggcgacatcttcagccagcccgagagacccttcctggcccccggcagacagagcgtggacaacgtgaccaaccccgagaagagaatccccctgggcaacgacaacatccagcaggagggcgacagagactacagattcccccccatcgagaccagagagagcatcagcagacccccccccgtggacgtgagagacgtggtgggcagacccatcgaccccagagagggccccggcagaccccccctggacggcagagaccacttcggcagaccccccgtggacatcagagagaacctggtgagacccggcatcgaccacctgggcagaagagaccacttcggcttcaaccccgagaagccctggggccacagaggcgacttcgacgagagagagcacagagtgctgcccgtgtacggcggccccaagggcctgcacgaggagagaggcagattcagaagcggcaactacagattcgaccccagaagcggcccctggaacagaggcttcggccaggaggtgcacagagacttcgacgacagaagaagaccctgggagagacagagagacagagacgacagagacttcgacttctgcagagagatgaacggcaacagactgggcagagacagaatccagaacacctgggtgccccccccccacgccagagtgttcgactacttcgagggcgccaccagccagagaaagggcgacaacgtgccccaggtgaacggcgagaacaccgagagacacgcccagcccccccccatccccgtgcagaacgaccccgagctgtacgagaagctgaccagcagcaacgagatcaacaaggagaagagcgacaccgtggccgacatcgagagcgagcccgtggtggagagcaccgagaccgagggcacctag

SEQ ID NO: 9628 - DNA, 4014 bp, Artificial Sequence
  Description of Artificial Sequence: Synthetic coding sequence
atgccccagcccctgctgcccgccctgccccccctgagcagccccagcggcgccggcagctgcggccccagcggcggcgagtgcagcggcagaagactgttcagaagaagagccagaggcctgagaagcgacaacatggaggccgtgaagaccttcaacagcgaggactgcgccagcacccccgcctgcaccgactgcttcagcagcagcatggacaccagaagcatcctgtacagcctgaacgactacaagccccccatcagcaaggccaagatgacccagatcaccaaggccgccatcaaggccatcaagttctacaagcacgtggtgcagagcgtggagaagttcatccagaagtgcaagcccgagtacaaggtgcccggcctgtacgtgatcgacagcatcgtgagacagagcagacaccagttcggccaggagaaggacgtgttcgcccccagattcagcaacaacatcatcagcaccttccagaacctgtacagatgccccggcgacgacaagagcaagatcgtgagagtgctgaacctgtggcagaagaacaacgtgttcaagagcgagatcatccagcccctgctggacatggccgccggcatccccccccccgtggtgacccccgtgctggccagcaccaccaccgccatgagcaacacccccggcacccccgtgacccccgtgacccccgccaacgtggtgcagggcctgcccgacccctgggtgagccagatcaccaacaccgacaccctggccgccgtggcccagatcctgcagagcccccagggccagcagctgcagcagctgatccagaccctgcagatccagcagcagaagccccagcccagcatcctgcaggccctggacgccggcctggtggtgcagctgcaggccctgaccgcccagctgaccgccgccgccgccgccgccaacaccctgacccccctggagcagggcgtgagcttcaacaagaagctgatggacagattcgacttcggcgaggacagcgagcacagcgaggagcccaagaaggagatccccgccagccagctgagccacgtgagcgagagcgtgaacaacagcatcttccaccagatcgccgagcagctgcagcagcagaacctggagcacctgagacagcagctgctggagcagcagcagccccagaaggccaccccccaggacagccaggagggcaccttcggcagcgagcacagcgccagccccagccagggcagcagccagcagcacttcctggagcccgaggtgaacctggacgacagcatcgacatccagcagcaggacatggacatcgacgagggccaggacggcgtggaggaggaggtgttcgagcaggaggccaagaaggtggccgtgagaagcagaagcagaacccacagcagaagcagaagcagaagccccagaaagagaagaagcagaagcagaagcggcagcagaaagagaaagcacagaaagagaagcagaagcagaagcagagagagaaagagaaagagcagcagaagctacagcagcgagagaagagccagagagagagagaaggagagacagaagaagggcctgccccccatcagaagcaagaccctgagcgtgtgcagcaccaccctgtgggtgggccaggtggacaagaaggccacccagcaggacctgaccaacctgttcgaggagttcggccagatcgagagcatcaacatgatcccccccagaggctgcgcctacgtgtgcatggtgcacagacaggacgccttcagagccctgcagaagctgagcagcggcagctacaagatcggcagcaaggtgatcaagatcgcctgggccctgaacaagggcgtgaagaccgagtacaagcagttctgggacgtggacctgggcgtgacctacatcccctgggagaaggtgaaggtggacgacctggagggcttcgccgagggcggcatgatcgaccaggagaccgtgaacaccgagtgggagaccgtgaagagcagcgagcccgtgaaggagaccgtgcagaccacccagagccccacccccgtggagaaggagaccgtggtgaccacccaggccgaggtgttccccccccccgtggccatgctgcagatccccgtggcccccgccgtgcccaccgtgagcctggtgccccccgccttccccgtgagcatgcccgtgcccccccccggcttcagccccatcccccccccccccttcctgagagccagcttcaaccccagccagcccccccccggcttcatgcccccccccgtgcccccccccgtggtgcccccccccaccatcccccccgtggtgcccaccagcctggtgcagcccagcctgagcatgacccccgagaccgtgaaggacgtgggcttcggcagcctggtgatccccggcggcagcgtggccagcaacctggccaccagcgccctgcccgccggcaacgtgttcaacgcccccaccaagcaggccgagcccgaggagaaggtgccccacctgatcgaccaccagatcagcagcggcgagaacaccagaagcgtgatccccaacgacatcagcagcaacgccgccatcctgggcggccagccccccaacgtgaccagcaacagcggcatcctgggcgtgcagagacccaacgtgagcagcaacagcgagatcctgggcgtgagacccagcaacgtgagcagcagcagcggcatcatcgccgcccagccccccaacatcctgaacaacagcggcatcctgggcatccagccccccagcgtgagcaacagcagcggcctgctgggcgtgctgccccccaacatccccaacaacagcggcctggtgggcgtgcagccccccaacgtgcccaacacccccggcctgctgggcacccagccccccgccggcccccagaacctgccccccctgagcatccccaaccagagaatgcccaccatgcccatgctggacatcagacccggcctgatcccccaggcccccggccccagattccccctgatccagcccggcatccccccccagagaggcatccccccccccagcgtgctggacagcgccctgcaccccccccccagaggccccttcccccccggcgacatcttcagccagcccgagagacccttcctggcccccggcagacagagcgtggacaacgtgaccaaccccgagaagagaatccccctgggcaacgacaacatccagcaggagggcgacagagactacagattcccccccatcgagaccagagagagcatcagcagacccccccccgtggacgtgagagacgtggtgggcagacccatcgaccccagagagggccccggcagaccccccctggacggcagagaccacttcggcagaccccccgtggacatcagagagaacctggtgagacccggcatcgaccacctgggcagaagagaccacttcggcttcaaccccgagaagccctggggccacagaggcgacttcgacgagagagagcacagagtgctgcccgtgtacggcggccccaagggcctgcacgaggagagaggcagattcagaagcggcaactacagattcgaccccagaagcggcccctggaacagaggcttcggccaggaggtgcacagagacttcgacgacagaagaagaccctgggagagacagagagacagagacgacagagacttcgacttctgcagagagatgaacggcaacagactgggcagagacagaatccagaacacctgggtgccccccccccacgccagagtgttcgactacttcgagggcgccaccagccagagaaagggcgacaacgtgccccaggtgaacggcgagaacaccgagagacacgcccagcccccccccatccccgtgcagaacgaccccgagctgtacgagaagctgaccagcagcaacgagatcaacaaggagaagagcgacaccgtggccgacatcgagagcgagcccgtggtggagagcaccgagaccgagggcacctag

SEQ ID NO: 9629 - DNA, 3816 bp, Artificial Sequence; identical to SEQ ID NO: 9627
  Description of Artificial Sequence: Synthetic coding sequence

SEQ ID NO: 9630 - DNA, 2262 bp, Artificial Sequence
  Description of Artificial Sequence: Synthetic coding sequence
atggagagagccagacccgagccccccccccagcccagacccctgagacccgcccccccccccctgcccgtggagggcaccagcttctgggccgccgccatggagcccccccccagcagccccaccctgagcgccgccgccagcgccaccctggccagcagctgcggcgaggccgtggccagcggcctgcagcccgccgtgagaagactgctgcaggtgaagcccgagcaggtgctgctgctgccccagccccaggcccagaacgaggaggccgccgccagcagcgcccaggccagactgctgcagttcagacccgacctgagactgctgcagccccccaccgccagcgacggcgccaccagcagacccgagctgcaccccgtgcagcccctggccctgcacgtgaaggccaagaagcagaagctgggccccagcctggaccagagcgtgggccccagaggcgccgtggagaccggccccagagccagcagagtggtgaagctggagggccccggccccgccctgggctacttcagaggcgacgagaagggcaagctggaggccgaggaggtgatgagagacagcatgcagggcggcgccggcaagagccccgccgccatcagagagggcgtgatcaagaccgaggagcccgagagactgctggaggactgcagactgggcgccgagcccgccagcaacggcctggtgcacggcagcgccgaggtgatcctggcccccaccagcggcgccttcggcccccaccagcaggacctgagaatccccctgaccctgcacaccgtgccccccggcgccagaatccagttccagggcgccccccccagcgagctgatcagactgaccaaggtgcccctgacccccgtgcccaccaagatgcagagcctgctggagcccagcgtgaagatcgagaccaaggacgtgcccctgaccgtgctgcccagcgacgccggcatccccgacacccccttcagcaaggacagaaacggccacgtgaagagacccatgaacgccttcatggtgtgggccagaatccacagacccgccctggccaaggccaaccccgccgccaacaacgccgagatcagcgtgcagctgggcctggagtggaacaagctgagcgaggagcagaagaagccctactacgacgaggcccagaagatcaaggagaagcacagagaggagttccccggctgggtgtaccagcccagacccggcaagagaaagagattccccctgagcgtgagcaacgtgttcagcggcaccacccagaacatcatcagcaccaaccccaccaccgtgtacccctacagaagccccacctacagcgtggtgatccccagcctgcagaaccccatcacccaccccgtgggcgagaccagccccgccatccagctgcccacccccgccgtgcagagccccagccccgtgaccctgttccagcccagcgtgagcagcgccgcccaggtggccgtgcaggaccccagcctgcccgtgtaccccgccctgcccccccagagattcaccggccccagccagaccgacacccaccagctgcacagcgaggccacccacaccgtgaagcagcccacccccgtgagcctggagagcgccaacagaatcagcagcagcgccagcaccgcccacgccagattcgccaccagcaccatccagccccccagagagtacagcagcgtgagcccctgccccagaagcgcccccatcccccaggccagccccatcccccacccccacgtgtaccagcccccccccctgggccaccccgccaccctgttcggcaccccccccagattcagcttccaccacccctacttcctgcccggcccccactacttccccagcagcacctgcccctacagcagaccccccttcggctacggcaacttccccagcagcatgcccgagtgcctgagctactacgaggacagataccccaagcacgagggcatcttcagcaccctgaacagagactacagcttcagagactacagcagcgagtgcacccacagcgagaacagcagaagctgcgagaacatgaacggcaccagctactacaacagccacagccacagcggcgaggagaacctgaaccccgtgccccagctggacatcggcaccctggagaacgtgttcaccgcccccaccagcacccccagcagcatccagcaggtgaacgtgaccgacagcgacgaggaggaggaggagaaggtgctgagagacctgtag

SEQ ID NO: 9631 - DNA, 1506 bp, Artificial Sequence
  Description of Artificial Sequence: Synthetic coding sequence
atggagagagccagacccgagccccccccccagcccagacccctgagacccgcccccccccccctgcccgtggagggcaccagcttctgggccgccgccatggagcccccccccagcagccccaccctgagcgccgccgccagcgccaccctggccagcagctgcggcgaggccgtggccagcggcctgcagcccgccgtgagaagactgctgcaggtgaagcccgagcaggtgctgctgctgccccagccccaggcccagaacgaggaggccgccgccagcagcgcccaggccagactgctgcagttcagacccgacctgagactgctgcagccccccaccgccagcgacggcgccaccagcagacccgagctgcaccccgtgcagcccctggccctgcacgtgaaggccaagaagcagaagctgggccccagcctggaccagagcgtgggccccagaggcgccgtggagaccggccccagagccagcagagtggtgaagctggagggccccggccccgccctgggctacttcagaggcgacgagaagggcaagctggaggccgaggaggtgatgagagacagcatgcagggcggcgccggcaagagccccgccgccatcagagagggcgtgatcaagaccgaggagcccgagagactgctggaggactgcagactgggcgccgagcccgccagcaacggcctggtgcacggcagcgccgaggtgatcctggcccccaccagcggcgccttcggcccccaccagcaggacctgagaatccccctgaccctgcacaccgtgccccccggcgccagaatccagttccagggcgccccccccagcgagctgatcagactgaccaaggtgcccctgacccccgtgcccaccaagatgcagagcctgctggagcccagcgtgaagatcgagaccaaggacgtgcccctgaccgtgctgcccagcgacgccggcatccccgacacccccttcagcaaggacagaaacggccacgtgaagagacccatgaacgccttcatggtgtgggccagaatccacagacccgccctggccaaggccaaccccgccgccaacaacgccgagatcagcgtgcagctgggcctggagtggaacaagctgagcgaggagcagaagaagccctactacgacgaggcccagaagatcaaggagaagcacagagaggagttccccggctgggtgtaccagcccagacccggcaagagaaagagattccccctgagcgtgagcaacgtgttcagcggcaccacccagaacatcatcagcaccaaccccaccaccgtgtacccctacagaagccccacctacagcgtggtgatccccagcctgcagaaccccatcacccaccccgtggtgcacgccctgaccgtgggcctgcccctggccatggagatcttcagagtgcagtgccagaacgccctggtgatcatgaagaccggcacccagaacatgagagtgagcttccagctgtag

SEQ ID NO: 9632 - DNA, 585 bp, Artificial Sequence
  Description of Artificial Sequence: Synthetic coding sequence
atgcccagcagccccctgagagtggccgtggtgtgcagcagcaaccagaacagaagcatggaggcccacaacatcctgagcaagagaggcttcagcgtgagaagcttcggcaccggcacccacgtgaagctgcccggccccgcccccgacaagcccaacgtgtacgacttcaagaccacctacgaccagatgtacaacgacctgctgagaaaggacaaggagctgtacacccagaacggcatcctgcacatgctggacagaaacaagagaatcaagcccagacccgagagattccagaactgcaaggacctgttcgacctgatcctgacctgcgaggagagagtgtacgaccaggtggtggaggacctgaacagcagagagcaggagacctgccagcccgtgcacgtggtgaacgtggacatccaggacaaccacgaggaggccaccctgggcgccttcctgatctgcgagctgtgccagtgcatccagcacaccgaggacatggagaacgagatcgacgagctgctgcaggagttcgaggagaagagcggcagaaccttcctgcacaccgtgtgcttctactag

SEQ ID NO: 9633 - DNA, 462 bp, Artificial Sequence
  Description of Artificial Sequence: Synthetic coding sequence
atgcccagcagccccctgagagtggccgtggtgtgcagcagcaaccagaacagaagcatggaggcccacaacatcctgagcaagagaggcttcagcgtgagaagcttcggcaccggcacccacgtgaagctgcccggccccgcccccgacaagcccaacgtgtacgacttcaagaccacctacgaccagatgtacaacgacctgctgagaaaggacaaggagctgtaccccagcggcctgcccttcaagaaccccccctgcggccccccctggaaggtgctgagagtggccagagcccaggaggcctgccaccccgtgcagtgcacccactggctgctgtgcctgtgcgagagcctggtgagcatccccggcgccagaagaatcgtgcacggcctggtgcccgtgccccccatggccgtgggcgtggtgagaagaaccgacaccgtgtggggcagcccctag

SEQ ID NO: 9634 - DNA, 489 bp, Artificial Sequence
  Description of Artificial Sequence: Synthetic coding sequence
atgcccagcagccccctgagagtggccgtggtgtgcagcagcaaccagaacagaagcatggaggcccacaacatcctgagcaagagaggcttcagcgtgagaagcttcggcaccggcacccacgtgaagctgcccggccccgcccccgacaagcccaacgtgtacgacttcaagaccacctacgaccagatgtacaacgacctgctgagaaaggacaaggagctgtacacccagaacggcatcctgcacatgctggacagaaacaagagaatcaagcccagacccgagagattccagaactgcaaggacctgttcgacctgatcctgacctgcgaggagagagtgtacgaccaggtggtggagggcgaggaggccgccgcctgctgggccggcctgcagcagctgagccagggcctgggcatgcccgccggcccccaccacgaccagtacagccccagcagagtggccggcgccggcgagcagacctag

SEQ ID NO: 9635 - DNA, 336 bp, Artificial Sequence
  Description of Artificial Sequence: Synthetic coding sequence
atgctggacagaaacaagagaatcaagcccagacccgagagattccagaactgcaaggacctgttcgacctgatcctgacctgcgaggagagagtgtacgaccaggtggtggaggacctgaacagcagagagcaggagacctgccagcccgtgcacgtggtgaacgtggacatccaggacaaccacgaggaggccaccctgggcgccttcctgatctgcgagctgtgccagtgcatccagcacaccgaggacatggagaacgagatcgacgagctgctgcaggagttcgaggagaagagcggcagaaccttcctgcacaccgtgtgcttctactag

SEQ ID NO: 9636 - DNA, 609 bp, Artificial Sequence
  Description of Artificial Sequence: Synthetic coding sequence
atgttcaccgagctgagaagcaagctgagcccccccagaggcagagccggcgccgtgagagccggcttcggcgagagaagagacgtggacgccaccgcccacttcagcttctgcagaaccctgctggagcacaccgtgagcgccgagagcatcccctgccacctgcccagaacccccggcaccagcctgacctggcacgacagcagaagccagagagccgccagcagcagacccatcaagctgctgcagcagcccggcaccgacaccccccagggcagactgtacagcgaccactacggcctgtaccacaccagccccagcctgggcggcctgaccagacccgtggtgctgtggagccagcaggacgtgtgcaagtggctgaagaagcactgcccccacaactacctggtgtacgtggaggccttcagccagcacgccatcaccggcagagccctgctgagactgaacgccgagaagctgcagagaatgggcctggcccaggaggcccagagacaggaggtgctgcagcaggtgctgagactgcaggtgagagaggagggcagaagcctgcagctgctgagccaggccagcttcggcaagatgagctag

SEQ ID NO: 9637 - DNA, 321 bp, Artificial Sequence
  Description of Artificial Sequence: Synthetic coding sequence
atgttcaccgagctgagaagcaagctgagcccccccagaggcagagccggcgccgtgagagccggcttcggcgagagaagagacgtggacggcagcgtgcacctgcagatcccctacagagccttcatccacagcttcatcgacaacgagtgcggcgtgcccctgtgcaaccagacctggatcaagacccccgccagccccgacagcgccaccgcccacttcagcttctgcagaaccctgctggagcacaccgtgagcgccgagagcatcccctgccacctgcccagaacccccggcaccagcctgacctggcacgactag

SEQ ID NO: 9638 - DNA, 2046 bp, Artificial Sequence
  Description of Artificial Sequence: Synthetic coding sequence
atgagcaagggcatcctgcaggtgcacccccccatctgcgactgccccggctgcagaatcagcagccccgtgaacagaggcagactggccgacaagagaaccgtggccctgcccgccgccagaaacctgaagaaggagagaacccccagcttcagcgccagcgacggcgacagcgacggcagcggccccacctgcggcagaagacccggcctgaagcaggaggacggcccccacatcagaatcatgaagagaagagtgcacacccactgggacgtgaacatcagcttcagagaggccagctgcagccaggacggcaacctgcccaccctgatcagcagcgtgcacagaagcagacacctggtgatgcccgagcaccagagcagatgcgagttccagagaggcagcctggagatcggcctgagacccgccggcgacctgctgggcaagagactgggcagaagccccagaatcagcagcgactgcttcagcgagaagagagccagaagcgagagcccccaggaggccctgctgctgcccagagagctgggccccagcatggcccccgaggaccactacagaagactggtgagcgccctgagcgaggccagcaccttcgaggacccccagagactgtaccacctgggcctgcccagccacggcgaggaccccccctggcacgaccccccccaccacctgcccagccacgacctgctgagagtgagacaggaggtggccgccgccgccctgagaggccccagcggcctggaggcccacctgcccagcagcaccgccggccagagaagaaagcagggcctggcccagcacagagagggcgccgcccccgccgccgcccccagcttcagcgagagagagctgccccagcccccccccctgctgagcccccagaacgccccccacgtggccctgggcccccacctgagaccccccttcctgggcgtgcccagcgccctgtgccagacccccggctacggcttcctgccccccgcccaggccgagatgttcgcctggcagcaggagctgctgagaaagcagaacctggccagactggagctgcccgccgacctgctgagacagaaggagctggagagcgccagaccccagctgctggcccccgagaccgccctgagacccaacgacggcgccgaggagctgcagagaagaggcgccctgctggtgctgaaccacggcgccgcccccctgctggccctgcccccccagggcccccccggcagcggcccccccacccccagcagagacagcgccagaagagcccccagaaagggcggccccggccccgccagcgccagacccagcgagagcaaggagatgaccggcgccagactgtgggcccaggacggcagcgaggacgagccccccaaggacagcgacggcgaggaccccgagaccgccgccgtgggctgcagaggccccacccccggccaggcccccgccggcggcgccggcgccgagggcaagggcctgttccccggcagcaccctgcccctgggcttcccctacgccgtgagcccctacttccacaccggcgccgtgggcggcctgagcatggacggcgaggaggcccccgcccccgaggacgtgaccaagtggaccgtggacgacgtgtgcagcttcgtgggcggcctgagcggctgcggcgagtacaccagagtgttcagagagcagggcatcgacggcgagaccctgcccctgctgaccgaggagcacctgctgaccaacatgggcctgaagctgggccccgccctgaagatcagagcccaggtggccagaagactgggcagagtgttctacgtggccagcttccccgtggccctgcccctgcagccccccaccctgagagcccccgagagagagctgggcaccggcgagcagcccctgagccccaccaccgccaccagcccctacggcggcggccacgccctggccggccagaccagccccaagcaggagaacggcaccctggccctgctgcccggcgcccccgaccccagccagcccctgtgctag

SEQ ID NO: 9639 - DNA, 540 bp, Artificial Sequence
  Description of Artificial Sequence: Synthetic coding sequence
atgagcaagggcatcctgcaggtgcacccccccatctgcgactgccccggctgcagaatcagcagccccgtgaacagaggcagactggccgacaagagaaccgtggccctgcccgccgccagaaacctgaagaaggagagaacccccagcttcagcgccagcgacggcgacagcgacggcagcggccccacctgcggcagaagacccggcctgaagcaggaggacggcccccacatcagaatcatgaagagaagagtgcacacccactgggacgtgaacatcagcttcagagaggccagctgcagccaggacggcaacctgcccaccctgatcagcagcgtgcacagaagcagacacctggtgatgcccgagcaccagagcagatgcgagttccagagaggcagcctggagatcggcctgagacccgccggcgacctgctgggcaagagactgggcagaagccccagaatcagcagcgactgcttcagcgagaagagagccagaagcgagagcccccaggaggccctgctgctgccctag

SEQ ID NO: 9640 - DNA, 330 bp, Artificial Sequence
  Description of Artificial Sequence: Synthetic coding sequence
atgagcaagggcatcctgcaggtgcacccccccatctgcgactgccccggctgcagaatcagcagccccgtgaacagaggcagactggccgacaagagaaccgtggccctgcccgccgccagaaacctgaagaaggagagaacccccagcttcagcgccagcgacggcgacagcgacggcagcggccccacctgcggcagaagacccggcctgaagcaggaggacggcccccacatcagaatcatgaagagaagagtgcacacccactgggacgtgaacatcagcttcagagaggccagctgcagccaggacggcaacctgcccacctag

SEQ ID NO: 9641 - DNA, 606 bp, Artificial Sequence
  Description of Artificial Sequence: Synthetic coding sequence
atggccgtggaggccctgcactgcggcctgaaccccagaggcatcgaccaccccgcccacgccgagggcatcaagctgcagatcgagggcgagggcgtggagagccagagcatcaagaacaagaacttccagaaggtgcccgaccagaagggcacccccaagagactgcaggccgaggccgagaccgccaagagcgccaccgtgaagctgagcaagcccgtggccctgtggacccagcaggacgtgtgcaagtggctgaagaagcactgccccaaccagtaccagatctacagcgagagcttcaagcagcacgacatcaccggcagagccctgctgagactgaccgacaagaagctggagagaatgggcatcgcccaggagaacctgagacagcacatcctgcagcaggtgctgcagctgaaggtgagagaggaggtgagaaacctgcagctgctgacccagggcaccctgctgctgcccgacggctggatggacggcgagatcagaagaaagaccaccctgctgctgggccagaccggcgtgagagagaacctgctgctgttcctgcacagaatcagcatcatcgagaacagcatccagatctag

SEQ ID NO: 9642 - DNA, 486 bp, Artificial Sequence
  Description of Artificial Sequence: Synthetic coding sequence
atggccgtggaggccctgcactgcggcctgaaccccagaggcatcgaccaccccgcccacgccgagggcatcaagctgcagatcgagggcgagggcgtggagagccagagcatcaagaacaagaacttccagaaggtgcccgaccagaagggcacccccaagagactgcaggccgaggccgagaccgccaagagcgccaccgtgaagctgagcaagcccgtggccctgtggacccagcaggacgtgtgcaagtggctgaagaagcactgccccaaccagtaccagatctacagcgagagcttcaagcagcacgacatcaccggcagagccctgctgagactgaccgacaagaagctggagagaatgggcatcgcccaggagaacctgagacagcacatcctgcagcaggtgctgcagctgaaggtgagagaggaggtgagaaacctgcagctgctgacccaggccagcagcgagggcagcccctag

SEQ ID NO: 9643 - DNA, 279 bp, Artificial Sequence
  Description of Artificial Sequence: Synthetic coding sequence
atgagaagctgcctgatgcccggcaacgagatgagcatgaccagccccgagggcaccgagcccaagggcaagcagagaagatggcagagacagaagaccttcggcggcggcaccatgcacagccaggacagccaggagatcgacggcaagagcctgctgctgatgaccagaaacgacgtgctgaccggcctgcagctgaagctgggccccgccctgaagatctacgagtaccacgtgaagcccctgcagaccaagcacctgaagaacaacagcagctag

SEQ ID NO: 9644 - DNA, 309 bp, Artificial Sequence
  Description of Artificial Sequence: Synthetic coding sequence
atgctgagcgtggacatggagaacaaggagaacggcagcgtgggcgtgaagaacagcatggagaacggcagaccccccgaccccgccgactgggccgtgatggacgtggtgaactacttcagaaccgtgggcttcgaggagcaggccagcgccttccaggagcaggagatcgacggcaagagcctgctgctgatgaccagaaacgacgtgctgaccggcctgcagctgaagctgggccccgccctgaagatctacgagtaccacgtgaagcccctgcagaccaagcacctgaagaacaacagcagctag

SEQ ID NO: 9645 - DNA, 309 bp, Artificial Sequence; identical to SEQ ID NO: 9644
  Description of Artificial Sequence: Synthetic coding sequence

SEQ ID NO: 9646 - DNA, 309 bp, Artificial Sequence; identical to SEQ ID NO: 9644
  Description of Artificial Sequence: Synthetic coding sequence

SEQ ID NO: 9647 - DNA, 369 bp, Artificial Sequence
  Description of Artificial Sequence: Synthetic coding sequence
atggccaacagcctgctggagggcgtgttcgccgaggtgaaggagccctgcagcctgcccatgctgagcgtggacatggagaacaaggagaacggcagcgtgggcgtgaagaacagcatggagaacggcagaccccccgaccccgccgactgggccgtgatggacgtggtgaactacttcagaaccgtgggcttcgaggagcaggccagcgccttccaggagcaggagatcgacggcaagagcctgctgctgatgaccagaaacgacgtgctgaccggcctgcagctgaagctgggccccgccctgaagatctacgagtaccacgtgaagcccctgcagaccaagcacctgaagaacaacagcagctag

SEQ ID NO: 9648 - DNA, 351 bp, Artificial Sequence
  Description of Artificial Sequence: Synthetic coding sequence
atgagaggcgtggccgaggtgaaggagccctgcagcctgcccatgctgagcgtggacatggagaacaaggagaacggcagcgtgggcgtgaagaacagcatggagaacggcagaccccccgaccccgccgactgggccgtgatggacgtggtgaactacttcagaaccgtgggcttcgaggagcaggccagcgccttccaggagcaggagatcgacggcaagagcctgctgctgatgaccagaaacgacgtgctgaccggcctgcagctgaagctgggccccgccctgaagatctacgagtaccacgtgaagcccctgcagaccaagcacctgaagaacaacagcagctag

SEQ ID NO: 9649 - DNA, 309 bp, Artificial Sequence; identical to SEQ ID NO: 9644
  Description of Artificial Sequence: Synthetic coding sequence

SEQ ID NO: 9650 - DNA, 3666 bp, Artificial Sequence
  Description of Artificial Sequence: Synthetic coding sequence
atgatcaccagcgagctgcccgtgctgcaggacagcaccaacgagaccaccgcccacagcgacgccggcagcgagctggaggagaccgaggtgaagggcaagagaaagagaggcagacccggcagaccccccagcaccaacaagaagcccagaaagagccccggcgagaagagcagaatcgaggccggcatcagaggcgccggcagaggcagagccaacggccacccccagcagaacggcgagggcgagcccgtgaccctgttcgaggtggtgaagctgggcaagagcgccatgcagagcgtggtggacgactggatcgagagctacaagcaggacagagacatcgccctgctggacctgatcaacttcttcatccagtgcagcggctgcagaggcaccgtgagaatcgagatgttcagaaacatgcagaacgccgagatcatcagaaagatgaccgaggagttcgacgaggacagcggcgactaccccctgaccatgcccggcccccagtggaagaagttcagaagcaacttctgcgagttcatcggcgtgctgatcagacagtgccagtacagcatcatctacgacgagtacatgatggacaccgtgatcagcctgctgaccggcctgagcgacagccaggtgagagccttcagacacaccagcaccctggccgccatgaagctgatgaccgccctggtgaacgtggccctgaacctgagcatccaccaggacaacacccagagacagtacgaggccgagagaaacaagatgatcggcaagagagccaacgagagactggagctgctgctgcagaagagaaaggagctgcaggagaaccaggacgagatcgagaacatgatgaacagcatcttcaagggcatcttcgtgcacagatacagagacgccatcgccgagatcagagccatctgcatcgaggagatcggcgtgtggatgaagatgtacagcgacgccttcctgaacgacagctacctgaagtacgtgggctggaccctgcacgacagacagggcgaggtgagactgaagtgcctgaaggccctgcagagcctgtacaccaacagagagctgttccccaagctggagctgttcaccaacagattcaaggacagaatcgtgagcatgaccctggacaaggagtacgacgtggccgtggaggccatcagactggtgaccctgatcctgcacggcagcgaggaggccctgagcaacgaggactgcgagaacgtgtaccacctggtgtacagcgcccacagacccgtggccgtggccgccggcgagttcctgcacaagaagctgttcagcagacacgacccccaggccgaggaggccctggccaagagaagaggcagaaacagccccaacggcaacctgatcagaatgctggtgctgttcttcctggagagcgagctgcacgagcacgccgcctacctggtggacagcctgtgggagagcagccaggagctgctgaaggactgggagtgcatgaccgagctgctgctggaggagcccgtgcagggcgaggaggccatgagcgacagacaggagagcgccctgatcgagctgatggtgtgcaccatcagacaggccgccgaggcccacccccccgtgggcagaggcaccggcaagagagtgctgaccgccaaggagagaaagacccagatcgacgacagaaacaagctgaccgagcacttcatcatcaccctgcccatgctgctgagcaagtacagcgccgacgccgagaaggtggccaacctgctgcagatcccccagtacttcgacctggagatctacagcaccggcagaatggagaagcacctggacgccctgctgaagcagatcaagttcgtggtggagaagcacgtggagagcgacgtgctggaggcctgcagcaagacctacagcatcctgtgcagcgaggagtacaccatccagaacagagtggacatcgccagaagccagctgatcgacgagttcgtggacagattcaaccacagcgtggaggacctgctgcaggagggcgaggaggccgacgacgacgacatctacaacgtgctgagcaccctgaagagactgaccagcttccacaacgcccacgacctgaccaagtgggacctgttcggcaactgctacagactgctgaagaccggcatcgagcacggcgccatgcccgagcagatcgtggtgcaggccctgcagtgcagccactacagcatcctgtggcagctggtgaagatcaccgacggcagccccagcaaggaggacctgctggtgctgagaaagaccgtgaagagcttcctggccgtgtgccagcagtgcctgagcaacgtgaacacccccgtgaaggagcaggccttcatgctgctgtgcgacctgctgatgatcttcagccaccagctgatgaccggcggcagagagggcctgcagcccctggtgttcaaccccgacaccggcctgcagagcgagctgctgagcttcgtgatggaccacgtgttcatcgaccaggacgaggagaaccagagcatggagggcgacgaggaggacgaggccaacaagatcgaggccctgcacaagagaagaaacctgctggccgccttcagcaagctgatcatctacgacatcgtggacatgcacgccgccgccgacatcttcaagcactacatgaagtactacaacgactacggcgacatcatcaaggagaccctgagcaagaccagacagatcgacaagatccagtgcgccaagaccctgatcctgagcctgcagcagctgttcaacgagctggtgcaggagcagggccccaacctggacagaaccagcgcccacgtgagcggcatcaaggagctggccagaagattcgccctgaccttcggcctggaccagatcaagaccagagaggccgtggccaccctgcacaaggacggcatcgagttcgccttcaagtaccagaaccagaagggccaggagtaccccccccccaacctggccttcctggaggtgctgagcgagttcagcagcaagctgctgagacaggacaagaagaccgtgcacagctacctggagaagttcctgaccgagcagatgatggagagaagagaggacgtgtggctgcccctgatcagctacagaaacagcctggtgaccggcggcgaggacgacagaatgagcgtgaacagcggcagcagcagcagcaagaccagcagcgtgagaaacaagaagggcagaccccccctgcacaagaagagagtggaggacgagagcctggacaacacctggctgaacagaaccgacaccatgatccagacccccggccccctgcccgccccccagctgaccagcaccgtgctgagagagaacagcagacccatgggcgaccagatccaggagcccgagagcgagcacggcagcgagcccgacttcctgcacaacagaggcctgatggaggaggacgccgagcccatcttcgaggacgtgatgatgagcagcagaagccagctggaggacatgaacgaggagttcgaggacaccatggtgatcgacctgccccccagcagaaacagaagagagagagccgagctgagacccgacttcttcgacagcgccgccatcatcgaggacgacagcggcttcggcatgcccatgttctag

SEQ ID NO: 9651 - DNA, 3777 bp, Artificial Sequence
  Description of Artificial Sequence: Synthetic coding sequence
atgatcaccagcgagctgcccgtgctgcaggacagcaccaacgagaccaccgcccacagcgacgccggcagcgagctggaggagaccgaggtgaagggcaagagaaagagaggcagacccggcagaccccccagcaccaacaagaagcccagaaagagccccggcgagaagagcagaatcgaggccggcatcagaggcgccggcagaggcagagccaacggccacccccagcagaacggcgagggcgagcccgtgaccctgttcgaggtggtgaagctgggcaagagcgccatgcagagcgtggtggacgactggatcgagagctacaagcaggacagagacatcgccctgctggacctgatcaacttcttcatccagtgcagcggctgcagaggcaccgtgagaatcgagatgttcagaaacatgcagaacgccgagatcatcagaaagatgaccgaggagttcgacgaggacagcggcgactaccccctgaccatgcccggcccccagtggaagaagttcagaagcaacttctgcgagttcatcggcgtgctgatcagacagtgccagtacagcatcatctacgacgagtacatgatggacaccgtgatcagcctgctgaccggcctgagcgacagccaggtgagagccttcagacacaccagcaccctggccgccatgaagctgatgaccgccctggtgaacgtggccctgaacctgagcatccaccaggacaacacccagagacagtacgaggccgagagaaacaagatgatcggcaagagagccaacgagagactggagctgctgctgcagaagagaaaggagctgcaggagaaccaggacgagatcgagaacatgatgaacagcatcttcaagggcatcttcgtgcacagatacagagacgccatcgccgagatcagagccatctgcatcgaggagatcggcgtgtggatgaagatgtacagcgacgccttcctgaacgacagctacctgaagtacgtgggctggaccctgcacgacagacagggcgaggtgagactgaagtgcctgaaggccctgcagagcctgtacaccaacagagagctgttccccaagctggagctgttcaccaacagattcaaggacagaatcgtgagcatgaccctggacaaggagtacgacgtggccgtggaggccatcagactggtgaccctgatcctgcacggcagcgaggaggccctgagcaacgaggactgcgagaacgtgtaccacctggtgtacagcgcccacagacccgtggccgtggccgccggcgagttcctgcacaagaagctgttcagcagacacgacccccaggccgaggaggccctggccaagagaagaggcagaaacagccccaacggcaacctgatcagaatgctggtgctgttcttcctggagagcgagctgcacgagcacgccgcctacctggtggacagcctgtgggagagcagccaggagctgctgaaggactgggagtgcatgaccgagctgctgctggaggagcccgtgcagggcgaggaggccatgagcgacagacaggagagcgccctgatcgagctgatggtgtgcaccatcagacaggccgccgaggcccacccccccgtgggcagaggcaccggcaagagagtgctgaccgccaaggagagaaagacccagatcgacgacagaaacaagctgaccgagcacttcatcatcaccctgcccatgctgctgagcaagtacagcgccgacgccgagaaggtggccaacctgctgcagatcccccagtacttcgacctggagatctacagcaccggcagaatggagaagcacctggacgccctgctgaagcagatcaagttcgtggtggagaagcacgtggagagcgacgtgctggaggcctgcagcaagacctacagcatcctgtgcagcgaggagtacaccatccagaacagagtggacatcgccagaagccagctgatcgacgagttcgtggacagattcaaccacagcgtggaggacctgctgcaggagggcgaggaggccgacgacgacgacatctacaacgtgctgagcaccctgaagagactgaccagcttccacaacgcccacgacctgaccaagtgggacctgttcggcaactgctacagactgctgaagaccggcatcgagcacggcgccatgcccgagcagatcgtggtgcaggccctgcagtgcagccactacagcatcctgtggcagctggtgaagatcaccgacggcagccccagcaaggaggacctgctggtgctgagaaagaccgtgaagagcttcctggccgtgtgccagcagtgcctgagcaacgtgaacacccccgtgaaggagcaggccttcatgctgctgtgcgacctgctgatgatcttcagccaccagctgatgaccggcggcagagagggcctgcagcccctggtgttcaaccccgacaccggcctgcagagcgagctgctgagcttcgtgatggaccacgtgttcatcgaccaggacgaggagaaccagagcatggagggcgacgaggaggacgaggccaacaagatcgaggccctgcacaagagaagaaacctgctggccgccttcagcaagctgatcatctacgacatcgtggacatgcacgccgccgccgacatcttcaagcactacatgaagtactacaacgactacggcgacatcatcaaggagaccctgagcaagaccagacagatcgacaagatccagtgcgccaagaccctgatcctgagcctgcagcagctgttcaacgagctggtgcaggagcagggccccaacctggacagaaccagcgcccacgtgagcggcatcaaggagctggccagaagattcgccctgaccttcggcctggaccagatcaagaccagagaggccgtggccaccctgcacaaggacggcatcgagttcgccttcaagtaccagaaccagaagggccaggagtaccccccccccaacctggccttcctggaggtgctgagcgagttcagcagcaagctgctgagacaggacaagaagaccgtgcacagctacctggagaagttcctgaccgagcagatgatggagagaagagaggacgtgtggctgcccctgatcagctacagaaacagcctggtgaccggcggcgaggacgacagaatgagcgtgaacagcggcagcagcagcagcaagaccagcagcgtgagaaacaagaagggcagaccccccctgcacaagaagagagtggaggacgagagcctggacaacacctggctgaacagaaccgacaccatgatccagacccccggccccctgcccgccccccagctgaccagcaccgtgctgagagagaacagcagacccatgggcgaccagatccaggagcccgagagcgagcacggcagcgagcccgacttcctgcacaacccccagatgcagatcagctggctgggccagcccaagctggaggacctgaacagaaaggacagaaccggcatgaactacatgaaggtgagaaccggcgtgagacacgccgtgagaggcctgatggaggaggacgccgagcccatcttcgaggacgtgatgatgagcagcagaagccagctggaggacatgaacgaggagttcgaggacaccatggtgatcgacctgccccccagcagaaacagaagagagagagccgagctgagacccgacttcttcgacagcgccgccatcatcgaggacgacagcggcttcggcatgcccatgttctag

SEQ ID NO: 9652 - DNA, 2997 bp, Artificial Sequence
  Description of Artificial Sequence: Synthetic coding sequence
atgaagctgatgaccgccctggtgaacgtggccctgaacctgagcatccaccaggacaacacccagagacagtacgaggccgagagaaacaagatgatcggcaagagagccaacgagagactggagctgctgctgcagaagagaaaggagctgcaggagaaccaggacgagatcgagaacatgatgaacagcatcttcaagggcatcttcgtgcacagatacagagacgccatcgccgagatcagagccatctgcatcgaggagatcggcgtgtggatgaagatgtacagcgacgccttcctgaacgacagctacctgaagtacgtgggctggaccctgcacgacagacagggcgaggtgagactgaagtgcctgaaggccctgcagagcctgtacaccaacagagagctgttccccaagctggagctgttcaccaacagattcaaggacagaatcgtgagcatgaccctggacaaggagtacgacgtggccgtggaggccatcagactggtgaccctgatcctgcacggcagcgaggaggccctgagcaacgaggactgcgagaacgtgtaccacctggtgtacagcgcccacagacccgtggccgtggccgccggcgagttcctgcacaagaagctgttcagcagacacgacccccaggccgaggaggccctggccaagagaagaggcagaaacagccccaacggcaacctgatcagaatgctggtgctgttcttcctggagagcgagctgcacgagcacgccgcctacctggtggacagcctgtgggagagcagccaggagctgctgaaggactgggagtgcatgaccgagctgctgctggaggagcccgtgcagggcgaggaggccatgagcgacagacaggagagcgccctgatcgagctgatggtgtgcaccatcagacaggccgccgaggcccacccccccgtgggcagaggcaccggcaagagagtgctgaccgccaaggagagaaagacccagatcgacgacagaaacaagctgaccgagcacttcatcatcaccctgcccatgctgctgagcaagtacagcgccgacgccgagaaggtggccaacctgctgcagatcccccagtacttcgacctggagatctacagcaccggcagaatggagaagcacctggacgccctgctgaagcagatcaagttcgtggtggagaagcacgtggagagcgacgtgctggaggcctgcagcaagacctacagcatcctgtgcagcgaggagtacaccatccagaacagagtggacatcgccagaagccagctgatcgacgagttcgtggacagattcaaccacagcgtggaggacctgctgcaggagggcgaggaggccgacgacgacgacatctacaacgtgctgagcaccctgaagagactgaccagcttccacaacgcccacgacctgaccaagtgggacctgttcggcaactgctacagactgctgaagaccggcatcgagcacggcgccatgcccgagcagatcgtggtgcaggccctgcagtgcagccactacagcatcctgtggcagctggtgaagatcaccgacggcagccccagcaaggaggacctgctggtgctgagaaagaccgtgaagagcttcctggccgtgtgccagcagtgcctgagcaacgtgaacacccccgtgaaggagcaggccttcatgctgctgtgcgacctgctgatgatcttcagccaccagctgatgaccggcggcagagagggcctgcagcccctggtgttcaaccccgacaccggcctgcagagcgagctgctgagcttcgtgatggaccacgtgttcatcgaccaggacgaggagaaccagagcatggagggcgacgaggaggacgaggccaacaagatcgaggccctgcacaagagaagaaacctgctggccgccttcagcaagctgatcatctacgacatcgtggacatgcacgccgccgccgacatcttcaagcactacatgaagctgttcaacgagctggtgcaggagcagggccccaacctggacagaaccagcgcccacgtgagcggcatcaaggagctggccagaagattcgccctgaccttcggcctggaccagatcaagaccagagaggccgtggccaccctgcacaaggacggcatcgagttcgccttcaagtaccagaaccagaagggccaggagtaccccccccccaacctggccttcctggaggtgctgagcgagttcagcagcaagctgctgagacaggacaagaagaccgtgcacagctacctggagaagttcctgaccgagcagatgatggagagaagagaggacgtgtggctgcccctgatcagctacagaaacagcctggtgaccggcggcgaggacgacagaatgagcgtgaacagcggcagcagcagcagcaagaccagcagcgtgagaaacaagaagggcagaccccccctgcacaagaagagagtggaggacgagagcctggacaacacctggctgaacagaaccgacaccatgatccagacccccggccccctgcccgccccccagctgaccagcaccgtgctgagagagaacagcagacccatgggcgaccagatccaggagcccgagagcgagcacggcagcgagcccgacttcctgcacaacccccagatgcagatcagctggctgggccagcccaagctggaggacctgaacagaaaggacagaaccggcatgaactacatgaaggtgagaaccggcgtgagacacgccgtgagaggcctgatggaggaggacgccgagcccatcttcgaggacgtgatgatgagcagcagaagccagctggaggacatgaacgaggagttcgaggacaccatggtgatcgacctgccccccagcagaaacagaagagagagagccgagctgagacccgacttcttcgacagcgccgccatcatcgaggacgacagcggcttcggcatgcccatgttctag

SEQ ID NO: 9653 - DNA, 2529 bp, Artificial Sequence
  Description of Artificial Sequence: Synthetic coding sequence
atgaccctggacaaggagtacgacgtggccgtggaggccatcagactggtgaccctgatcctgcagctgttcagcagacacgacccccaggccgaggaggccctggccaagagaagaggcagaaacagccccaacggcaacctgatcagaatgctggtgctgttcttcctggagagcgagctgcacgagcacgccgcctacctggtggacagcctgtgggagagcagccaggagctgctgaaggactgggagtgcatgaccgagctgctgctggaggagcccgtgcagggcgaggaggccatgagcgacagacaggagagcgccctgatcgagctgatggtgtgcaccatcagacaggccgccgaggcccacccccccgtgggcagaggcaccggcaagagagtgctgaccgccaaggagagaaagacccagatcgacgacagaaacaagctgaccgagcacttcatcatcaccctgcccatgctgctgagcaagtacagcgccgacgccgagaaggtggccaacctgctgcagatcccccagtacttcgacctggagatctacagcaccggcagaatggagaagcacctggacgccctgctgaagcagatcaagttcgtggtggagaagcacgtggagagcgacgtgctggaggcctgcagcaagacctacagcatcctgtgcagcgaggagtacaccatccagaacagagtggacatcgccagaagccagctgatcgacgagttcgtggacagattcaaccacagcgtggaggacctgctgcaggagggcgaggaggccgacgacgacgacatctacaacgtgctgagcaccctgaagagactgaccagcttccacaacgcccacgacctgaccaagtgggacctgttcggcaactgctacagactgctgaagaccggcatcgagcacggcgccatgcccgagcagatcgtggtgcaggccctgcagtgcagccactacagcatcctgtggcagctggtgaagatcaccgacggcagccccagcaaggaggacctgctggtgctgagaaagaccgtgaagagcttcctggccgtgtgccagcagtgcctgagcaacgtgaacacccccgtgaaggagcaggccttcatgctgctgtgcgacctgctgatgatcttcagccaccagctgatgaccggcggcagagagggcctgcagcccctggtgttcaaccccgacaccggcctgcagagcgagctgctgagcttcgtgatggaccacgtgttcatcgaccaggacgaggagaaccagagcatggagggcgacgaggaggacgaggccaacaagatcgaggccctgcacaagagaagaaacctgctggccgccttcagcaagctgatcatctacgacatcgtggacatgcacgccgccgccgacatcttcaagcactacatgaagtactacaacgactacggcgacatcatcaaggagaccctgagcaagaccagacagatcgacaagatccagtgcgccaagaccctgatcctgagcctgcagcagctgttcaacgagctggtgcaggagcagggccccaacctggacagaaccagcgcccacgtgagcggcatcaaggagctggccagaagattcgccctgaccttcggcctggaccagatcaagaccagagaggccgtggccaccctgcacaaggacggcatcgagttcgccttcaagtaccagaaccagaagggccaggagtaccccccccccaacctggccttcctggaggtgctgagcgagttcagcagcaagctgctgagacaggacaagaagaccgtgcacagctacctggagaagttcctgaccgagcagatgatggagagaagagaggacgtgtggctgcccctgatcagctacagaaacagcctggtgaccggcggcgaggacgacagaatgagcgtgaacagcggcagcagcagcagcaagaccagcagcgtgagaaacaagaagggcagaccccccctgcacaagaagagagtggaggacgagagcctggacaacacctggctgaacagaaccgacaccatgatccagacccccggccccctgcccgccccccagctgaccagcaccgtgctgagagagaacagcagacccatgggcgaccagatccaggagcccgagagcgagcacggcagcgagcccgacttcctgcacaacccccagatgcagatcagctggctgggccagcccaagctggaggacctgaacagaaaggacagaaccggcatgaactacatgaaggtgagaaccggcgtgagacacgccgtgagaggcctgatggaggaggacgccgagcccatcttcgaggacgtgatgatgagcagcagaagccagctggaggacatgaacgaggagttcgaggacaccatggtgatcgacctgccccccagcagaaacagaagagagagagccgagctgagacccgacttcttcgacagcgccgccatcatcgaggacgacagcggcttcggcatgcccatgttctag

SEQ ID NO: 9654 - DNA, 405 bp, Artificial Sequence
  Description of Artificial Sequence: Synthetic coding sequence
atgatcttcagcatgctgagaaagctgcccaaggtgacctgcagagacgtgctgcccgagatcagagccatctgcatcgaggagatcggctgctggatgcagagctacagcaccagcttcctgaccgacagctacctgaagtacatcggctggaccctgcacgacaagcacagagaggtgagagtgaagtgcgtgaaggccctgaagggcctgtacggcaacagagacctgaccgccagactggagctgttcaccggcagattcaaggactggatggtgagcatgatcgtggacagagagtacagcgtggccgtggaggccgtgagactgctgatcctgatcctgaagaacatggagggcgtgctgatggacgtggactgcgagagcgtgtaccccatcgtgtag

SEQ ID NO: 9655 - DNA, 618 bp, Artificial Sequence
  Description of Artificial Sequence: Synthetic coding sequence
atgatcttcagcatgctgagaaagctgcccaaggtgacctgcagagacgtgctgcccgagatcagagccatctgcatcgaggagatcggctgctggatgcagagctacagcaccagcttcctgaccgacagctacctgaagtacatcggctggaccctgcacgacaagcacagagaggtgagagtgaagtgcgtgaaggccctgaagggcctgtacggcaacagagacctgaccgccagactggagctgttcaccggcagattcaaggactggatggtgagcatgatcgtggacagagagtacagcgtggccgtggaggccgtgagactgctgatcctgatcctgaagctgttctaccccgagtgcgagatcagaaccatgggcggcagagagcagagacagagccccggcgcccagagaaccttcttccagctgctgctgagcttcttcgtggagagcaagctgcacgaccacgccgcctacctggtggacaacctgtgggactgcgccggcacccagctgaaggactgggagggcctgaccagcctgctgctggagaaggaccagagcacctgccacatggagcccggccccggcaccttccacctgctgggctag

SEQ ID NO: 9656 - DNA, 456 bp, Artificial Sequence
  Description of Artificial Sequence: Synthetic coding sequence
atgcagcacagagaggtgagagtgaagtgcgtgaaggccctgaagggcctgtacggcaacagagacctgaccgccagactggagctgttcaccggcagattcaaggactggatggtgagcatgatcgtggacagagagtacagcgtggccgtggaggccgtgagactgctgatcctgatcctgaagctgttctaccccgagtgcgagatcagaaccatgggcggcagagagcagagacagagccccggcgcccagagaaccttcttccagctgctgctgagcttcttcgtggagagcaagctgcacgaccacgccgcctacctggtggacaacctgtgggactgcgccggcacccagctgaaggactgggagggcctgaccagcctgctgctggagaaggaccagagcacctgccacatggagcccggccccggcaccttccacctgctgggctag

SEQ ID NO: 9657 - DNA, 387 bp, Artificial Sequence
  Description of Artificial Sequence: Synthetic coding sequence
atgatcttcagcatgctgagaaagctgcccaaggtgacctgcagagacgtgctgcccgagatcagagccatctgcatcgaggagatcggctgctggatgcagagctacagcaccagcttcctgaccgacagctacctgaagtacatcggctggaccctgcacgacaagcacagagaggtgagagtgaagtgcgtgaaggccctgaagggcctgtacggcaacagagacctgaccgccagactggagctgttcaccggcagattcaaggactggatggtgagcatgatcgtggacagagagtacagcgtggccgtggaggccgtgagactgctgatcctgatcctgaagatcggcagccagacccccgccaccagagagtgcatctag

SEQ ID NO: 9658 - DNA, 378 bp, Artificial Sequence
  Description of Artificial Sequence: Synthetic coding sequence
atgcagcacagagaggtgagagtgaagtgcgtgaaggccctgaagggcctgtacggcaacagagacctgaccgccagactggagctgttcaccggcagattcaaggactggatggtgagcatgatcgtggacagagagtacagcgtggccgtggaggccgtgagactgctgatcctgatcctgaagctgttctaccccgagtgcgagatcagaaccatgggcggcagagagcagagacagagccccggcgcccagagaaccttcttccagctgctgctgagcttcttcgtggagagcaaggtgacctacaccgagagaaccctggccgtggtgcacagaacctacaagtgggccggcgtgggcggcagcagactgtag

SEQ ID NO: 9659 - DNA, 240 bp, Artificial Sequence
  Description of Artificial Sequence: Synthetic coding sequence
atgggcggcagagagcagagacagagccccggcgcccagagaaccttcttccagctgctgctgagcttcttcgtggagagcaagctgcacgaccacgccgcctacctggtggacaacctgtgggactgcgccggcacccagctgaaggactgggagggcctgaccagcctgctgctggagaaggaccagagcacctgccacatggagcccggccccggcaccttccacctgctgggctag

SEQ ID NO: 9660 - DNA, 405 bp, Artificial Sequence; identical to SEQ ID NO: 9654
  Description of Artificial Sequence: Synthetic coding sequence

SEQ ID NO: 9661 - DNA, 405 bp, Artificial Sequence; identical to SEQ ID NO: 9654
  Description of Artificial Sequence: Synthetic coding sequence

SEQ ID NO: 9662 - DNA, 405 bp, Artificial Sequence; identical to SEQ ID NO: 9654
  Description of Artificial Sequence: Synthetic coding sequence

SEQ ID NO: 9663 - DNA, 618 bp, Artificial Sequence
  Description of Artificial Sequence: Synthetic coding sequence
atgatcttcagcatgctgagaaagctgcccaaggtgacctgcagagacgtgctgcccgagatcagagccatctgcatcgaggagatcggctgctggatgcagagctacagcaccagcttcctgaccgacagctacctgaagtacatcggctggaccctgcacgacaagcacagagaggtgagagtgaagtgcgtgaaggccctgaagggcctgtacggcaacagagacctgaccgccagactggagctgttcaccggctgcttcaaggactggatggtgagcatgatcatggacagagagtacagcgtggccgtggaggccgtgagactgctgatcctgatcctgaagctgttctaccccgagtgcgagatcagaaccatgggcggcagagagcagagacagagccccggcgcccagagaaccttcttccagctgctgctgagcttcttcgtggagagcaagctgcacgaccacgccgcctacctggtggacaacctgtgggactgcgccggcacccagctgaaggactgggagggcctgaccagcctgctgctggagaaggaccagagcacctgccacatggagcccggccccggcaccttccacctgctgggctag

SEQ ID NO: 9664 - DNA, 405 bp, Artificial Sequence
  Description of Artificial Sequence: Synthetic coding sequence
atgatcttcagcatgctgagaaagctgcccaaggtgacctgcagagacgtgctgcccgagatcagagccatctgcatcgaggagatcggctgctggatgcagagctacagcaccagcttcctgaccgacagctacctgaagtacatcggctggaccctgcacgacaagcacagagaggtgagagtgaagtgcgtgaaggccctgaagggcctgtacggcaacagagacctgaccgccagactggagctgttcaccggctgcttcaaggactggatggtgagcatgatcatggacagagagtacagcgtggccgtggaggccgtgagactgctgatcctgatcctgaagaacatggagggcgtgctgatggacgtggactgcgagagcgtgtaccccatcgtgtag

SEQ ID NO: 9665 - DNA, 456 bp, Artificial Sequence
  Description of Artificial Sequence: Synthetic coding sequence
atgcagcacagagaggtgagagtgaagtgcgtgaaggccctgaagggcctgtacggcaacagagacctgaccgccagactggagctgttcaccggctgcttcaaggactggatggtgagcatgatcatggacagagagtacagcgtggccgtggaggccgtgagactgctgatcctgatcctgaagctgttctaccccgagtgcgagatcagaaccatgggcggcagagagcagagacagagccccggcgcccagagaaccttcttccagctgctgctgagcttcttcgtggagagcaagctgcacgaccacgccgcctacctggtggacaacctgtgggactgcgccggcacccagctgaaggactgggagggcctgaccagcctgctgctggagaaggaccagagcacctgccacatggagcccggccccggcaccttccacctgctgggctag

SEQ ID NO: 9666 - DNA, 351 bp, Artificial Sequence
  Description of Artificial Sequence: Synthetic coding sequence
atgatcttcagcatgctgagaaagctgcccaaggtgacctgcagagacgtgctgcccgagatcagagccatctgcatcgaggagatcggctgctggatgcagagctacagcaccagcttcctgaccgacagctacctgaagtacatcggctggaccctgcacgacaagcacagagaggtgagagtgaagtgcgtgaaggccctgaagggcctgtacggcaacagagacctgaccgccagactggagctgttcaccggctgcttcaaggactggatggtgagcatgatcatggacagagagtacagcgtggccgtggaggccgtgagactgctgatcctgatcctgaagtag

SEQ ID NO: 9667 - DNA, 3708 bp, Artificial Sequence
  Description of Artificial Sequence: Synthetic coding sequence
atggcccacctggagctgctgctggtggagaacttcaagagctggagaggcagacaggtgatcggccccttcagaagattcacctgcatcatcggccccaacggcagcggcaagagcaacgtgatggacgccctgagcttcgtgatgggcgagaagatcgccaacctgagagtgaagaacatccaggagctgatccacggcgcccacatcggcaagcccatcagcagcagcgccagcgtgaagatcatctacgtggaggagagcggcgaggagaagaccttcgccagaatcatcagaggcggctgcagcgagttcagattcaacgacaacctggtgagcagaagcgtgtacatcgccgagctggagaagatcggcatcatcgtgaaggcccagaactgcctggtgttccagggcaccgtggagagcatcagcgtgaagaagcccaaggagagaacccagttcttcgaggagatcagcaccagcggcgagctgatcggcgagtacgaggagaagaagagaaagctgcagaaggccgaggaggacgcccagttcaacttcaacaagaagaagaacatcgccgccgagagaagacaggccaagctggagaaggaggaggccgagagataccagagcctgctggaggagctgaagatgaacaagatccagctgcagctgttccagctgtaccacaacgagaagaagatccacctgctgaacaccaagctggagcacgtgaacagagacctgagcgtgaagagagagagcctgagccaccacgagaacatcgtgaaggccagaaagaaggagcacggcatgctgaccagacagctgcagcagaccgagaaggagctgaagagcgtggagaccctgctgaaccagaagagaccccagtacatcaaggccaaggagaacaccagccaccacctgaagaagctggacgtggccaagaagagcatcaaggacagcgagaagcagtgcagcaagcaggaggacgacatcaaggccctggagaccgagctggccgacctggacgccgcctggagaagcttcgagaagcagatcgaggaggagatcctgcacaagaagagagacatcgagctggaggccagccagctggacagatacaaggagctgaaggagcaggtgagaaagaaggtggccaccatgacccagcagctggagaagctgcagtgggagcagaagaccgacgaggagagactggccttcgagaagagaagacacggcgaggtgcagggcaacctgaagcagatcaaggagcagatcgaggaccacaagaagagaatcgagaagctggaggagtacaccaagacctgcatggactgcctgaaggagaagaagcagcaggaggagaccctggtggacgagatcgagaagaccaagagcagaatgagcgagttcaacgaggagctgaacctgatcagaagcgagctgcagaacgccggcatcgacacccacgagggcaagagacagcagaagagagccgaggtgctggagcacctgaagagactgtaccccgacagcgtgttcggcagactgttcgacctgtgccaccccatccacaagaagtaccagctggccgtgaccaaggtgttcggcagattcatcaccgccatcgtggtggccagcgagaaggtggccaaggactgcatcagattcctgaaggaggagagagccgagcccgagaccttcctggccctggactacctggacatcaagcccatcaacgagagactgagagagctgaagggctgcaagatggtgatcgacgtgatcaagacccagttcccccagctgaagaaggtgatccagttcgtgtgcggcaacggcctggtgtgcgagaccatggaggaggccagacacatcgccctgagcggccccgagagacagaagaccgtggccctggacggcaccctgttcctgaagagcggcgtgatcagcggcggcagcagcgacctgaagtacaaggccagatgctgggacgagaaggagctgaagaacctgagagacagaagaagccagaagatccaggagctgaagggcctgatgaagaccctgagaaaggagaccgacctgaagcagatccagaccctgatccagggcacccagaccagactgaagtacagccagaacgagctggagatgatcaagaagaagcacctggtggccttctaccaggagcagagccagctgcagagcgagctgctgaacatcgagagccagtgcatcatgctgagcgagggcatcaaggagagacagagaagaatcaaggagttccaggagaagatcgacaaggtggaggacgacatcttccagcacttctgcgaggagatcggcgtggagaacatcagagagttcgagaacaagcacgtgaagagacagcaggagatcgaccagaagagactggagttcgagaagcagaagaccagactgaacgtgcagctggagtacagcagaagccacctgaagaagaagctgaacaagatcaacaccctgaaggagaccatccagaagggcagcgaggacatcgaccacctgaagaaggccgaggagaactgcctgcagaccgtgaacgagctgatggccaagcagcagcagctgaaggacatcagagtgacccagaacagcagcgccgagaaggtgcagacccagatcgaggaggagagaaagaagttcctggccgtggacagagaggtgggcaagctgcagaaggaggtggtgagcatccagaccagcctggagcagaagagactggagaagcacaacctgctgctggactgcaaggtgcaggacatcgagatcatcctgctgagcggcagcctggacgacatcatcgaggtggagatgggcaccgaggccgagagcacccaggccaccatcgacatctacgagaaggaggaggccttcgagatcgactacagcagcctgaaggaggacctgaaggccctgcagagcgaccaggagatcgaggcccacctgagactgctgctgcagcaggtggccagccaggaggacatcctgctgaagaccgccgcccccaacctgagagccctggagaacctgaagaccgtgagagacaagttccaggagagcaccgacgccttcgaggccagcagaaaggaggccagactgtgcagacaggagttcgagcaggtgaagaagagaagatacgacctgttcacccagtgcttcgagcacgtgagcatcagcatcgaccagatctacaagaagctgtgcagaaacaacagcgcccaggccttcctgagccccgagaaccccgaggagccctacctggagggcatcagctacaactgcgtggcccccggcaagagattcatgcccatggacaacctgagcggcggcgagaagtgcgtggccgccctggccctgctgttcgccgtgcacagcttcagacccgcccccttcttcgtgctggacgaggtggacgccgccctggacaacaccaacatcggcaaggtgagcagctacatcaaggagcagacccaggaccagttccagatgatcgtgatcagcctgaaggaggagttctacagcagagccgacgccctgatcggcatctaccccgagtacgacgactgcatgttcagcagagtgctgaccctggacctgagccagtaccccgacaccgagggccaggagagcagcaagagacacggcgagagcagatag

SEQ ID NO: 9668 - DNA, 3486 bp, Artificial Sequence
  Description of Artificial Sequence: Synthetic coding sequence
atggcccacctggagctgctgctggtggagaacttcaagagctggagaggcagacaggtgatcggccccttcagaagattcacctgcatcatcggccccaacggcagcggcaagagcaacgtgatggacgccctgagcttcgtgatgggcgagaagatcgccaacctgagagtgaagaacatccaggagctgatccacggcgcccacatcggcaagcccatcagcagcagcgccagcgtgaagatcatctacgtggaggagagcggcgaggagaagaccttcgccagaatcatcagaggcggctgcagcgagttcagattcaacgacaacctggtgagcagaagcgtgtacatcgccgagctggagaagatcggcatcatcgtgaaggcccagaactgcctggtgttccagggcaccgtggagagcatcagcgtgaagaagcccaaggagagaacccagttcttcgaggagatcagcaccagcggcgagctgatcggcgagtacgaggagaagaagagaaagctgcagaaggccgaggaggacgcccagttcaacttcaacaagaagaagaacatcgccgccgagagaagacaggccaagctggagaaggaggaggccgagagataccagagcctgctggaggagctgaagatgaacaagatccagctgcagctgttccagctgtaccacaacgagaagaagatccacctgctgaacaccaagctggagcacgtgaacagagacctgagcgtgaagagagagagcctgagccaccacgagaacatcgtgaaggccagaaagaaggagcacggcatgctgaccagacagctgcagcagaccgagaaggagctgaagagcgtggagaccctgctgaaccagaagagaccccagtacatcaaggccaaggagaacaccagccaccacctgaagaagctggacgtggccaagaagagcatcaaggacagcgagaagcagtgcagcaagcaggaggacgacatcaaggccctggagaccgagctggccgacctggacgccgcctggagaagcttcgagaagcagatcgaggaggagatcctgcacaagaagagagacatcgagctggaggccagccagctggacagatacaaggagctgaaggagcaggtgagaaagaaggtggccaccatgacccagcagctggagaagctgcagtgggagcagaagaccgacgaggagagactggccttcgagaagagaagacacggcgaggtgcagggcaacctgaagcagatcaaggagcagatcgaggaccacaagaagagaatcgagaagctggaggagtacaccaagacctgcatggactgcctgaaggagaagaagcagcaggaggagaccctggtggacgagatcgagaagaccaagagcagaatgagcgagttcaacgaggagctgaacctgatcagaagcgagctgcagaacgccggcatcgacacccacgagggcaagagacagcagaagagagccgaggtgctggagcacctgaagagactgtaccccgacagcgtgttcggcagactgttcgacctgtgccaccccatccacaagaagtaccagctggccgtgaccaaggtgttcggcagattcatcaccgccatcgtggtggccagcgagaaggtggccaaggactgcatcagattcctgaaggaggagagagccgagcccgagaccttcctggccctggactacctggacatcaagcccatcaacgagagactgagagagctgaagggctgcaagatggtgatcgacgtgatcaagacccagttcccccagctgaagaaggtgatccagttcgtgtgcggcaacggcctggtgtgcgagaccatggaggaggccagacacatcgccctgagcggccccgagagacagaagaccgtggccctggacggcaccctgttcctgaagagcggcgtgatcagcggcggcagcagcgacctgaagtacaaggccagatgctgggacgagaaggagctgaagaacctgagagacagaagaagccagaagatccaggagctgaagggcctgatgaagaccctgagaaaggagaccgacctgaagcagatccagaccctgatccagggcacccagaccagactgaagtacagccagaacgagctggagatgatcaagaagaagcacctggtggccttctaccaggagcagagccagctgcagagcgagctgctgaacatcgagagccagtgcatcatgctgagcgagggcatcaaggagagacagagaagaatcaaggagttccaggagaagatcgacaaggtggaggacgacatcttccagcacttctgcgaggagatcggcgtggagaacatcagagagttcgagaacaagcacgtgaagagacagcaggagatcgaccagaagagactggagttcgagaagcagaagaccagactgaacgtgcagctggagtacagcagaagccacctgaagaagaagctgaacaagatcaacaccctgaaggagaccatccagaagggcagcgaggacatcgaccacctgaagaaggccgaggagaactgcctgcagaccgtgaacgagctgatggccaagcagcagcagctgaaggacatcagagtgacccagaacagcagcgccgagaaggtgcagacccagatcgaggaggagagaaagaagttcctggccgtggacagagaggtgggcaagctgcagaaggaggtggtgagcatccagaccagcctggagcagaagagactggagaagcacaacctgctgctggactgcaaggtgcaggacatcgagatcatcctgctgagcggcagcctggacgacatcatcgaggtggagatgggcaccgaggccgagagcacccaggccaccatcgacatctacgagaaggaggaggccttcgagatcgactacagcagcctgaaggaggacctgaaggccctgcagagcgaccaggagatcgaggcccacctgagactgctgctgcagcaggtggccagccaggaggacatcctgctgaagaccgccgcccccaacctgagagccctggagaacctgaagaccgtgagagacaagttccaggagagcaccgacgccttcgaggccagcagaaaggaggccagactgtgcagacaggagttcgagcaggtgaagaagagaagatacgacctgttcacccagtgcttcgagcacgtgagcatcagcatcgaccagatctacaagaagctgtgcagaaacaacagcgcccaggtgagcagctacatcaaggagcagacccaggaccagttccagatgatcgtgatcagcctgaaggaggagttctacagcagagccgacgccctgatcggcatctaccccgagtacgacgactgcatgttcagcagagtgctgaccctggacctgagccagtaccccgacaccgagggccaggagagcagcaagagacacggcgagagcagatag

SEQ ID NO: 9669 - DNA, 5754 bp, Artificial Sequence
  Description of Artificial Sequence: Synthetic coding sequence
atggccgccgccgacggcggcggccccggcggcgccagcgtgggcaccgaggaggacggcggcggcgtgggccacagaaccgtgtacctgttcgacagaagagagaaggagagcgagctgggcgacagacccctgcaggtgggcgagagaagcgactacgccggcttcagagcctgcgtgtgccagaccctgggcatcagccccgaggagaagttcgtgatcaccaccaccagcagaaaggagatcacctgcgacaacttcgacgagaccgtgaaggacggcgtgaccctgtacctgctgcagagcgtgaaccagctgctgctgaccgccaccaaggagagaatcgacttcctgccccactacgacaccctggtgaagagcggcatgtacgagtactacgccagcgagggccagaaccccctgcccttcgccctggccgagctgatcgacaacagcctgagcgccaccagcagaaacatcggcgtgagaagaatccagatcaagctgctgttcgacgagacccagggcaagcccgccgtggccgtgatcgacaacggcagaggcatgaccagcaagcagctgaacaactgggccgtgtacagactgagcaagttcaccagacagggcgacttcgagagcgaccacagcggctacgtgagacccgtgcccgtgcccagaagcctgaacagcgacatcagctacttcggcgtgggcggcaagcaggccgtgttcttcgtgggccagagcgccagaatgatcagcaagcccgccgacagccaggacgtgcacgagctggtgctgagcaaggaggacttcgagaagaaggagaagaacaaggaggccatctacagcggctacatcagaaacagaaagcccagcgacagcgtgcacatcaccaacgacgacgagagattcctgcaccacctgatcatcgaggagaaggagaaggacagcttcaccgccgtggtgatcaccggcgtgcagcccgagcacatccagtacctgaagaactacttccacctgtggaccagacagctggcccacatctaccactactacatccacggccccaagggcaacgagatcagaaccagcaaggaggtggagcccttcaacaacatcgacatcgagatcagcatgttcgagaagggcaaggtgcccaagatcgtgaacctgagagagatccaggacgacatgcagaccctgtacgtgaacaccgccgccgacagcttcgagttcaaggcccacgtggagggcgacggcgtggtggagggcatcatcagataccaccccttcctgtacgacagagagacctaccccgacgacccctgcttccccagcaagctgaaggacgaggacgacgaggacgactgcttcatcctggagaaggccgccagaggcaagagacccatcttcgagtgcttctggaacggcagactgatcccctacaccagcgtggaggacttcgactggtgcaccccccccaagaagagaggcctggcccccatcgagtgctacaacagaatcagcggcgccctgttcaccaacgacaagttccaggtgagcaccaacaagctgaccttcatggacctggagctgaagctgaaggacaagaacaccctgttcaccagaatcctgaacggccaggagcagagaatgaagatcgacagagagttcgccctgtggctgaaggactgccacgagaagtacgacaagcagatcaagttcaccctgttcaagggcgtgatcaccagacccgacctgcccagcaagaagcagggcccctgggccacctacgccgccatcgagtgggacggcaagatctacaaggccggccagctggtgaagaccatcaagaccctgcccctgttctacggcagcatcgtgagattcttcctgtacggcgaccacgacggcgaggtgtacgccaccggcggcgaggtgcagatcgccatggagccccaggccctgtacgacgaggtgagaaccgtgcccatcgccaagctggacagaaccgtggccgagaaggccgtgaagaagtacgtggaggacgagatggccagactgcccgacagactgagcgtgacctggcccgagggcgacgagctgctgcccaacgaggtgagacccgccggcacccccatcggcgccctgagaatcgagatcctgaacaagaagggcgaggccatgcagaagctgcccggcaccagccacggcggcagcaagaagctgctggtggagctgaaggtgatcctgcacagcagcagcggcaacaaggagatcatcagccacatcagccagcacggcggcaagtggccctactggttcaagaagatggagaacatccagaagctgggcaactacaccctgaagctgcaggtggtgctgaacgagagcaacgccgacacctacgccggcagacccctgcccagcaaggccatcaagttcagcgtgaaggagggcaagcccgagaagttcagcttcggcctgctggacctgcccttcagagtgggcgtgcccttcaacatccccctggagttccaggacgagttcggccacaccagccagctggtgaccgacatccagcccgtgctggaggccagcggcctgagcctgcactacgaggagatcaccaagggccccaactgcgtgatcagaggcgtgaccgccaagggccccgtgaacagctgccagggcaagaactacaacctgaaggtgaccctgcccggcctgaaggaggacagccagatcctgaagatcagactgctgcccggccaccccagaagactgaaggtgaagcccgacagcgagatcctggtgatcgagaacggcaccgccttccccttccaggtggaggtgctggacgagagcgacaacatcaccgcccagcccaagctgatcgtgcactgcaagttcagcggcgcccccaacctgcccgtgtacgtggtggactgcagcagcagcggcaccagcatcctgaccggcagcgccatccaggtgcagaacatcaagaaggaccagaccctgaaggccagaatcgagatccccagctgcaaggacgtggcccccgtggagaagaccatcaagctgctgcccagcagccacgtggccagactgcagatcttcagcgtggagggccagaaggccatccagatcaagcaccaggacgaggtgaactggatcgccggcgacatcatgcacaacctgatcttccagatgtacgacgagggcgagagagagatcaacatcaccagcgccctggccgagaagatcaaggtgaactggacccccgagatcaacaaggagcacctgctgcagggcctgctgcccgacgtgcaggtgcccaccagcgtgaaggacatgagatactgccaggtgagcttccaggacgaccacgtgagcctggagagcgccttcaccgtgagacccctgcccgacgagcccaagcacctgaagtgcgagatgaagggcggcaagaccgtgcagatgggccaggagctgcagggcgaggtggtgatcatcatcaccgaccagtacggcaaccagatccaggccttcagccccagcagcctgagcagcctgagcatcgccggcgtgggcctggacagcagcaacctgaagaccaccttccaggagaacacccagagcatcagcgtgagaggcatcaagttcatccccggcccccccggcaacaaggacctgtgcttcacctggagagagttcagcgacttcatcagagtgcagctgatcagcggcccccccgccaagctgctgctgatcgactggcccgagctgaaggagagcatccccgtgatcaacggcagagacctgcagaaccccatcatcgtgcagctgtgcgaccagtgggacaaccccgcccccgtgcagcacgtgaagatcagcctgaccaaggccagcaacctgaagctgatgcccagcaaccagcagcacaagaccgacgagaagggcagagccaacctgggcgtgttcagcgtgttcgcccccagaggcgagcacaccctgcaggtgaaggccatctacaacaagagcatcatcgagggccccatcatcaagctgatgatcctgcccgaccccgagaagcccgtgagactgaacgtgaagtacgacaaggacgccagcttcctggccggcggcctgttcaccgacttcatgatcagcgtgatcagcgaggacgacagcatcatcaagaacatcaaccccgccagaatcagcatgaagatgtggaagctgagcaccagcggcaacagaccccccgccaacgccgagaccttcagctgcaacaagatcaaggacaacgacaaggaggacggctgcttctacttcagagacaaggtgatccccaacaaggtgggcacctactgcatccagttcggcttcatgatggacaagaccaacatcctgaacagcgagcaggtgatcgtggaggtgctgcccaaccagcccgtgaagctggtgcccaagatcaagccccccacccccgccgtgagcaacgtgagaagcgtggccagcagaaccctggtgagagacctgcacctgagcatcaccgacgactacgacaaccacaccggcatcgacctggtgggcaccatcatcgccaccatcaagggcagcaacgaggaggacaccgacacccccctgttcatcggcaaggtgagaaccctggagttccccttcgtgaacggcagcgccgagatcatgagcctggtgctggccgagagcagccccggcagagacagcaccgagtacttcatcgtgttcgagcccagactgcccctgctgagcagaaccctggagccctacatcctgcccttcatgttctacaacgacgtgaagaagcagcagcagatggccgccctgaccaaggagaaggaccagctgagccagagcatcgtgatgtacaagagcctgttcgaggccagccagcagctgctgaacgagatgaagtgccaggtggaggaggccagactgaaggaggcccagctgagaaacgagctgaagatccacaacatcgacatccccaccacccagcaggtgccccacatcgaggccctgctgaagagaaagctgagcgagcaggaggagctgaagaagaagcccagaagaagctgcaccctgcccaactacaccaagggcagcggcgacgtgctgggcaagatcgcccacctggcccagatcgaggacgacagagccgccatggtgatcagctggcacctggccagcgacatggactgcgtggtgaccctgaccaccgacgccgccagaagaatctacgacgagacccagggcagacagcaggtgctgcccctggacagcatctacaagaagaccctgcccgactggaagagaagcctgccccacttcagaaacggcaagctgtacttcaagcccatcggcgaccccgtgttcgccagagacctgctgaccttccccgacaacgtggagcactgcgagaccgtgttcggcatgctgctgggcgacaccatcatcctggacaacctggacgccgccaaccactacagaaaggaggtggtgaagatcacccactgccccaccctgctgaccagagacggcgacagaatcagaagcaacggcaagttcggcggcctgcagaacaaggccccccccatggacaagctgagaggcatggtgttcggcgcccccgtgcccaagcagtgcctgatcctgggcgagcagatcgtgcacgcctgcgtgcccagctacagcggcggctag

SEQ ID NO: 9670 - DNA, 6018 bp, Artificial Sequence
  Description of Artificial Sequence: Synthetic coding sequence
atggccgccgccgacggcggcggccccggcggcgccagcgtgggcaccgaggaggacggcggcggcgtgggccacagaaccgtgtacctgttcgacagaagagagaaggagagcgagctgggcgacagacccctgcaggtgggcgagagaagcgactacgccggcttcagagcctgcgtgtgccagaccctgggcatcagccccgaggagaagttcgtgatcaccaccaccagcagaaaggagatcacctgcgacaacttcgacgagaccgtgaaggacggcgtgaccctgtacctgctgcagagcgtgaaccagctgctgctgaccgccaccaaggagagaatcgacttcctgccccactacgacaccctggtgaagagcggcatgtacgagtactacgccagcgagggccagaaccccctgcccttcgccctggccgagctgatcgacaacagcctgagcgccaccagcagaaacatcggcgtgagaagaatccagatcaagctgctgttcgacgagacccagggcaagcccgccgtggccgtgatcgacaacggcagaggcatgaccagcaagcagctgaacaactgggccgtgtacagactgagcaagttcaccagacagggcgacttcgagagcgaccacagcggctacgtgagacccgtgcccgtgcccagaagcctgaacagcgacatcagctacttcggcgtgggcggcaagcaggccgtgttcttcgtgggccagagcgccagaatgatcagcaagcccgccgacagccaggacgtgcacgagctggtgctgagcaaggaggacttcgagaagaaggagaagaacaaggaggccatctacagcggctacatcagaaacagaaagcccagcgacagcgtgcacatcaccaacgacgacgagagattcctgcaccacctgatcatcgaggagaaggagaaggacagcttcaccgccgtggtgatcaccggcgtgcagcccgagcacatccagtacctgaagaactacttccacctgtggaccagacagctggcccacatctaccactactacatccacggccccaagggcaacgagatcagaaccagcaaggaggtggagcccttcaacaacatcgacatcgagatcagcatgttcgagaagggcaaggtgcccaagatcgtgaacctgagagagatccaggacgacatgcagaccctgtacgtgaacaccgccgccgacagcttcgagttcaaggcccacgtggagggcgacggcgtggtggagggcatcatcagataccaccccttcctgtacgacagagagacctaccccgacgacccctgcttccccagcaagctgaaggacgaggacgacgaggacgactgcttcatcctggagaaggccgccagaggcaagagacccatcttcgagtgcttctggaacggcagactgatcccctacaccagcgtggaggacttcgactggtgcaccccccccaagaagagaggcctggcccccatcgagtgctacaacagaatcagcggcgccctgttcaccaacgacaagttccaggtgagcaccaacaagctgaccttcatggacctggagctgaagctgaaggacaagaacaccctgttcaccagaatcctgaacggccaggagcagagaatgaagatcgacagagagttcgccctgtggctgaaggactgccacgagaagtacgacaagcagatcaagttcaccctgttcaagggcgtgatcaccagacccgacctgcccagcaagaagcagggcccctgggccacctacgccgccatcgagtgggacggcaagatctacaaggccggccagctggtgaagaccatcaagaccctgcccctgttctacggcagcatcgtgagattcttcctgtacggcgaccacgacggcgaggtgtacgccaccggcggcgaggtgcagatcgccatggagccccaggccctgtacgacgaggtgagaaccgtgcccatcgccaagctggacagaaccgtggccgagaaggccgtgaagaagtacgtggaggacgagatggccagactgcccgacagactgagcgtgacctggcccgagggcgacgagctgctgcccaacgaggtgagacccgccggcacccccatcggcgccctgagaatcgagatcctgaacaagaagggcgaggccatgcagaagctgcccggcaccagccacggcggcagcaagaagctgctggtggagctgaaggtgatcctgcacagcagcagcggcaacaaggagatcatcagccacatcagccagcacggcggcaagtggccctactggttcaagaagatggagaacatccagaagctgggcaactacaccctgaagctgcaggtggtgctgaacgagagcaacgccgacacctacgccggcagacccctgcccagcaaggccatcaagttcagcgtgaaggagggcaagcccgagaagttcagcttcggcctgctggacctgcccttcagagtgggcgtgcccttcaacatccccctggagttccaggacgagttcggccacaccagccagctggtgaccgacatccagcccgtgctggaggccagcggcctgagcctgcactacgaggagatcaccaagggccccaactgcgtgatcagaggcgtgaccgccaagggccccgtgaacagctgccagggcaagaactacaacctgaaggtgaccctgcccggcctgaaggaggacagccagatcctgaagatcagactgctgcccggccaccccagaagactgaaggtgaagcccgacagcgagatcctggtgatcgagaacggcaccgccttccccttccaggtggaggtgctggacgagagcgacaacatcaccgcccagcccaagctgatcgtgcactgcaagttcagcggcgcccccaacctgcccgtgtacgtggtggactgcagcagcagcggcaccagcatcctgaccggcagcgccatccaggtgcagaacatcaagaaggaccagaccctgaaggccagaatcgagatccccagctgcaaggacgtggcccccgtggagaagaccatcaagctgctgcccagcagccacgtggccagactgcagatcttcagcgtggagggccagaaggccatccagatcaagcaccaggacgaggtgaactggatcgccggcgacatcatgcacaacctgatcttccagatgtacgacgagggcgagagagagatcaacatcaccagcgccctggccgagaagatcaaggtgaactggacccccgagatcaacaaggagcacctgctgcagggcctgctgcccgacgtgcaggtgcccaccagcgtgaaggacatgagatactgccaggtgagcttccaggacgaccacgtgagcctggagagcgccttcaccgtgagacccctgcccgacgagcccaagcacctgaagtgcgagatgaagggcggcaagaccgtgcagatgggccaggagctgcagggcgaggtggtgatcatcatcaccgaccagtacggcaaccagatccaggccttcagccccagcagcctgagcagcctgagcatcgccggcgtgggcctggacagcagcaacctgaagaccaccttccaggagaacacccagagcatcagcgtgagaggcatcaagttcatccccggcccccccggcaacaaggacctgtgcttcacctggagagagttcagcgacttcatcagagtgcagctgatcagcggcccccccgccaagctgctgctgatcgactggcccgagctgaaggagagcatccccgtgatcaacggcagagacctgcagaaccccatcatcgtgcagctgtgcgaccagtgggacaaccccgcccccgtgcagcacgtgaagatcagcctgaccaaggccagcaacctgaagctgatgcccagcaaccagcagcacaagaccgacgagaagggcagagccaacctgggcgtgttcagcgtgttcgcccccagaggcgagcacaccctgcaggtgaaggccatctacaacaagagcatcatcgagggccccatcatcaagctgatgatcctgcccgaccccgagaagcccgtgagactgaacgtgaagtacgacaaggacgccagcttcctggccggcggcctgttcaccgacttcatgatcagcgtgatcagcgaggacgacagcatcatcaagaacatcaaccccgccagaatcagcatgaagatgtggaagctgagcaccagcggcaacagaccccccgccaacgccgagaccttcagctgcaacaagatcaaggacaacgacaaggaggacggctgcttctacttcagagacaaggtgatccccaacaaggtgggcacctactgcatccagttcggcttcatgatggacaagaccaacatcctgaacagcgagcaggtgatcgtggaggtgctgcccaaccagcccgtgaagctggtgcccaagatcaagccccccacccccgccgtgagcaacgtgagaagcgtggccagcagaaccctggtgagagacctgcacctgagcatcaccgacgactacgacaaccacaccggcatcgacctggtgggcaccatcatcgccaccatcaagggcagcaacgaggaggacaccgacacccccctgttcatcggcaaggtgagaaccctggagttccccttcgtgaacggcagcgccgagatcatgagcctggtgctggccgagagcagccccggcagagacagcaccgagtacttcatcgtgttcgagcccagactgcccctgctgagcagaaccctggagccctacatcctgcccttcatgttctacaacgacgtgaagaagcagcagcagatggccgccctgaccaaggagaaggaccagctgagccagagcatcgtgatgtacaagagcctgttcgaggccagccagcagctgctgaacgagatgaagtgccaggtggaggaggccagactgaaggaggcccagctgagaaacgagctgaagatccacaacatcgacatccccaccacccagcaggtgccccacatcgaggccctgctgaagagaaagctgagcgagcaggaggagctgaagaagaagcccagaagaagctgcaccctgcccaactacaccaagggcagcggcgacgtgctgggcaagatcgcccacctggcccagatcgaggacgacagagccgccatggtgatcagctggcacctggccagcgacatggactgcgtggtgaccctgaccaccgacgccgccagaagaatctacgacgagacccagggcagacagcaggtgctgcccctggacagcatctacaagaagaccctgcccgactggaagagaagcctgccccacttcagaaacggcaagctgtacttcaagcccatcggcgaccccgtgttcgccagagacctgctgaccttccccgacaacgtggagcactgcgagaccgtgttcggcatgctgctgggcgacaccatcatcctggacaacctggacgccgccaaccactacagaaaggaggtggtgaagatcacccactgccccaccctgctgaccagagacggcgacagaatcagaagcaacggcaagttcggcggcctgcagaacaaggccccccccatggacaagctgagaggcatggtgttcggcgcccccgtgcccaagcagtgcctgatcctgggcgagcagatcgacctgctgcagcagtacagaagcgccgtgtgcaagctggacagcgtgaacaaggacctgaacagccagctggagtacctgagaacccccgacatgagaaagaagaagcaggagctggacgagcacgagaagaacctgaagctgatcgaggagaagctgggcatgacccccatcagaaagtgcaacgacagcctgagacacagccccaaggtggagaccaccgactgccccgtgccccccaagagaatgagaagagaggccaccagacagaacagaatcatcaccaagaccgacgtgtag

SEQ ID NO: 9671 - DNA, 384 bp, Artificial Sequence
  Description of Artificial Sequence: Synthetic coding sequence
atgcccaagagcaaggagctggtgagcagcagcagcagcggcagcgacagcgacagcgaggtggacaagaagctgaagagaaagaagcaggtggcccccgagaagcccgtgaagaagcagaagaccggcgagaccagcagagccctgagcagcagcaagcagagcagcagcagcagagacgacaacatgttccagatcggcaagatgagatacgtgagcgtgagagacttcaagggcaaggtgctgatcgacatcagagagtactggatggaccccgagggcgagatgaagcccggcagaaagggcatcagcctgaaccccgagcagtggagccagctgaaggagcagatcagcgacatcgacgacgccgtgagaaagctgtag

SEQ ID NO: 9672 - DNA, 384 bp, Artificial Sequence; identical to SEQ ID NO: 9671
  Description of Artificial Sequence: Synthetic coding sequence

SEQ ID NO: 9673 - DNA, 384 bp, Artificial Sequence; identical to SEQ ID NO: 9671
  Description of Artificial Sequence: Synthetic coding sequence

SEQ ID NO: 9674 - DNA, 201 bp, Artificial Sequence
  Description of Artificial Sequence: Synthetic coding sequence
atgcccaagagcaaggagctggtgagcagcagcagcagcggcagcgacagcgacagcgaggtggacaagaagctgaagagaaagaagcaggtggcccccgagaagcccgtgaagaagcagaagaccggcgagaccagcagagccctgagcagcagcaagcagagcagcagcagcagagacgacaacatgttccaggtgtag

SEQ ID NO: 9675 - DNA, 384 bp, Artificial Sequence; identical to SEQ ID NO: 9671
  Description of Artificial Sequence: Synthetic coding sequence

SEQ ID NO: 9676 - DNA, 384 bp, Artificial Sequence; identical to SEQ ID NO: 9671
  Description of Artificial Sequence: Synthetic coding sequence

SEQ ID NO: 9677 - DNA, 372 bp, Artificial Sequence
  Description of Artificial Sequence: Synthetic coding sequence
atgcccaagagcaaggagctggtgagcagcagcagcagcggcagcgacagcgacagcgaggtggacaagaagctgaagagaaagaagcaggtggcccccgagaagcccgtgaagaagcagaagaccggcgagaccagcagagccctgagcagcagcaagcagagcagcagcagcagagacgacaacatgttccagatcggcaagatgagatacgtgagcgtgagagacttcaagggcaaggtgctgatcgacatcagagagtactggatggaccccgagggcgagatgaagcccggcagaaagggcatcagcctgaaccccgagcagtggagccagctgaaggagcagatcctggtggccctgtggcagtag

SEQ ID NO: 9678 - DNA, 2241 bp, Artificial Sequence
  Description of Artificial Sequence: Synthetic coding sequence
atggcctggatcagaagcacctgcatcctgttcttcaccctgctgttcgcccacatcgccgccgtgcccatcaagtacctgcccgaggagaacgtgcacgacgccgacttcggcgagcagaaggacatcagcgagatcaacctggccgccggcctggacctgttccagggcgacatcctgctgcagaagagcagaaacggcctgagagaccccaacaccagatggaccttccccatcccctacatcctggccgacaacctgggcctgaacgccaagggcgccatcctgtacgccttcgagatgttcagactgaagagctgcgtggacttcaagccctacgagggcgagagcagctacatcatcttccagcagttcgacggctgctggagcgaggtgggcgaccagcacgtgggccagaacatcagcatcggccagggctgcgcctacaaggccatcatcgagcacgagatcctgcacgccctgggcttctaccacgagcagagcagaaccgacagagacgactacgtgaacatctggtgggaccagatcctgagcggctaccagcacaacttcgacacctacgacgacagcctgatcaccgacctgaacaccccctacgactacgagagcctgatgcactaccagcccttcagcttcaacaagaacgccagcgtgcccaccatcaccgccaagatccccgagttcaacagcatcatcggccagagactggacttcagcgccatcgacctggagagactgaacagaatgtacaactgcaccaccacccacaccctgctggaccactgcaccttcgagaaggccaacatctgcggcatgatccagggcaccagagacgacaccgactgggcccaccaggacagcgcccaggccggcgaggtggaccacaccctgctgggccagtgcaccggcgccggctacttcatgcagttcagcaccagcagcggcagcgccgaggaggccgccctgctggagagcagaatcctgtaccccaagagaaagcagcagtgcctgcagttcttctacaagatgaccggcagccccagcgacagactggtggtgtgggtgagaagagacgacagcaccggcaacgtgagaaagctggtgaaggtgcagaccttccagggcgacgacgaccacaactggaagatcgcccacgtggtgctgaaggaggagcagaagttcagatacctgttccagggcaccaagggcgacccccagaacagcaccggcggcatctacctggacgacatcaccctgaccgagaccccctgccccaccggcgtgtggaccgtgagaaacttcagccaggtgctggagaacaccagcaagggcgacaagctgcagagccccagattctacaacagcgagggctacggcttcggcgtgaccctgtaccccaacagcagagagagcagcggctacctgagactggccttccacgtgtgcagcggcgagaacgacgccatcctggagtggcccgtggagaacagacaggtgatcatcaccatcctggaccaggagcccgacgtgagaaacagaatgagcagcagcatggtgttcaccaccagcaagagccacaccagccccgccatcaacgacaccgtgatctgggacagacccagcagagtgggcacctaccacaccgactgcaactgcttcagaagcatcgacctgggctggagcggcttcatcagccaccagatgctgaagagaagaagcttcctgaagaacgacgacctgatcatcttcgtggacttcgaggacatcacccacctgagccagaccgaggtgcccaccaagggcaagagactgagcccccagggcctgatcctgcagggccaggagcagcaggtgagcgaggagggcagcggcaaggccatgctggaggaggccctgcccgtgagcctgagccagggccagcccagcagacagaagagaagcgtggagaacaccggccccctggaggaccacaactggccccagtacttcagagacccctgcgaccccaacccctgccagaacgacggcatctgcgtgaacgtgaagggcatggccagctgcagatgcatcagcggccacgccttcttctacaccggcgagagatgccaggccgtgcaggtgcacggcagcgtgctgggcatggtgatcggcggcaccgccggcgtgatcttcctgaccttcagcatcatcgccatcctgagccagagacccagaaagtag

SEQ ID NO: 9679 - DNA, 2826 bp, Artificial Sequence
  Description of Artificial Sequence: Synthetic coding sequence
atggagggcgccagcagagtgtgcagacagggcagagtggccctgcccgccgaggaggactacctgcccctgaagcccagagtgggcaaggccgccaaggagtaccccttcatcctggacgccttccagagagaggccatccagtgcgtggacaacaaccagagcgtgctggtgagcgcccacaccagcgccggcaagaccgtgtgcgccgagtacgccatcgccctggccctgagagagaagcagagagtgatcttcaccagccccatcaaggccctgagcaaccagaagtacagagagatgtacgaggagttccaggacgtgggcctgatgaccggcgacgtgaccatcaaccccaccgccagctgcctggtgatgaccaccgagatcctgagaagcatgctgtacagaggcagcgaggtgatgagagaggtggcctgggtgatcttcgacgagatccactacatgagagacagcgagagaggcgtggtgtgggaggagaccatcatcctgctgcccgacaacgtgcactacgtgttcctgagcgccaccatccccaacgccagacagttcgccgagtggatctgccacctgcacaagcagccctgccacgtgatctacaccgactacagacccacccccctgcagcactacatcttccccgccggcggcgacggcctgcacctggtggtggacgagaacggcgacttcagagaggacaacttcaacaccgccatgcaggtgctgagagacgccggcgacctggccaagggcgaccagaagggcagaaagggcggcaccaagggccccagcaacgtgttcaagatcgtgaagatgatcatggagagaaacttccagcccgtgatcatcttcagcttcagcaagaaggactgcgaggcctacgccctgcagatgaccaagctggacttcaacaccgacgaggagaagaagatggtggaggaggtgttcagcaacgccatcgactgcctgagcgacgaggacaagaagctgccccaggtggagcacgtgctgcccctgctgaagagaggcatcggcatccaccacggcggcctgctgcccatcctgaaggagaccatcgagatcctgttcagcgagggcctgatcaaggccctgttcgccaccgagaccttcgccatgggcatcaacatgcccgccagaaccgtgctgttcaccaacgccagaaagttcgacggcaaggacttcagatggatcagcagcggcgagtacatccagatgagcggcagagccggcagaagaggcatggacgacagaggcatcgtgatcctgatggtggacgagaagatgagccccaccatcggcaagcagctgctgaagggcagcgccgaccccctgaacagcgccttccacctgacctacaacatggtgctgaacctgctgagagtggaggagatcaaccccgagtacatgctggagaagagcttctaccagttccagcactacagagccatccccggcgtggtggagaaggtgaagaacagcgaggagcagtacaacaagatcgtgatccccaacgaggagagcgtggtgatctactacaagatcagacagcagctggccaagctgggcaaggagatcgaggagtacatccacaagcccaagtactgcctgcccttcctgcagcccggcagactggtgaaggtgaagaacgagggcgacgacttcggctggggcgtggtggtgaacttcagcaagaagagcaacgtgaagcccaacagcggcgagctggaccccctgtacgtggtggaggtgctgctgagatgcagcaaggagagcctgaagaacagcgccaccgaggccgccaagcccgccaagcccgacgagaagggcgagatgcaggtggtgcccgtgctggtgcacctgctgagcgccatcagcagcgtgagactgtacatccccaaggacctgagacccgtggacaacagacagagcgtgctgaagagcatccaggaggtgcagaagagattccccgacggcatccccctgctggaccccatcgacgacatgggcatccaggaccagggcctgaagaaggtgatccagaaggtggaggccttcgagcacagaatgtacagccaccccctgcacaacgaccccaacctggagaccgtgtacaccctgtgcgagaagaaggcccagatcgccatcgacatcaagagcgccaagagagagctgaagaaggccagaaccgtgctgcagatggacgagctgaagtgcagaaagagagtgctgagaagactgggcttcgccaccagcagcgacgtgatcgagatgaagggcagagtggcctgcgagatcagcagcgccgacgagctgctgctgaccgagatgatgttcaacggcctgttcaacgacctgagcgccgagcaggccaccgccctgctgagctgcttcgtgttccaggagaacagcagcgagatgcccaagctgaccgagcagctggccggccccctgagacagatgcaggagtgcgccaagagaatcgccaaggtgagcgccgaggccaagctggagatcgacgaggagacctacctgagcagcttcaagccccacctgatggacgtggtgtacacctgggccaccggcgccaccttcgcccacatctgcaagatgaccgacgtgttcgagggcagcatcatcagatgcatgagaagactggaggagctgctgagacagatgtgccaggccgccaaggccatcggcaacaccgagctggagaacaagttcgccgagggcatcaccaagatcaagagagacatcgtgttcgccgccagcctgtacctgtag

SEQ ID NO: 9680 - DNA, 3144 bp, Artificial Sequence
  Description of Artificial Sequence: Synthetic coding sequence
atggacgccgaggccgaggacaagaccctgagaaccagaagcaagggcaccgaggtgcccatggacagcctgatccaggagctgagcgtggcctacgactgcagcatggccaagaagagaaccgccgaggaccaggccctgggcgtgcccgtgaacaagagaaagagcctgctgatgaagcccagacactacagccccaaggccgactgccaggaggacagaagcgacagaaccgaggacgacggccccctggagacccacggccacagcaccgccgaggagatcatgatcaagcccatggacgagagcctgctgagcaccgcccaggagaacagcagcagaaaggaggacagatacagctgctaccaggagctgatggtgaagagcctgatgcacctgggcaagttcgagaagaacgtgagcgtgcagaccgtgagcgagaacctgaacgacagcggcatccagagcctgaaggccgagagcgacgaggccgacgagtgcttcctgatccacagcgacgacggcagagacaagatcgacgacagccagccccccttctgcagcagcgacgacaacgagagcaacagcgagagcgccgagaacggctgggacagcggcagcaacttcagcgaggagaccaagccccccagagtgcccaagtacgtgctgaccgaccacaagaaggacctgctggaggtgcccgagatcaagaccgagggcgacaagttcatcccctgcgagaacagatgcgacagcgagaccgagagaaaggacccccagaacgccctggccgagcccctggacggcaacgcccagcccagcttccccgacgtggaggaggaggacagcgagagcctggccgtgatgaccgaggagggcagcgacctggagaaggccaagggcaacctgagcctgctggagcaggccatcgccctgcaggccgagagaggctgcgtgttccacaacacctacaaggagctggacagattcctgctggagcacctggccggcgagagaagacagaccaaggtgatcgacatgggcggcagacagatcttcaacaacaagcacagccccagacccgagaagagagagaccaagtgccccatccccggctgcgacggcaccggccacgtgaccggcctgtacccccaccacagaagcctgagcggctgcccccacaaggtgagagtgcccctggagatcctggccatgcacgagaacgtgctgaagtgccccacccccggctgcaccggcagaggccacgtgaacagcaacagaaacacccacagaagcctgagcggctgccccatcgccgccgccgagaagctggccatgagccaggacaagaaccagctggacagcccccagaccggccagtgccccgaccaggcccacagaaccagcctggtgaagcagatcgagttcaacttccccagccaggccatcaccagccccagagccaccgtgagcaaggagcaggagaagttcggcaaggtgcccttcgactacgccagcttcgacgcccaggtgttcggcaagagacccctgatccagaccgtgcagggcagaaagaccccccccttccccgagagcaagcacttccccaaccccgtgaagttccccaacagactgcccagcgccggcgcccacacccagagccccggcagagccagcagctacagctacggccagtgcagcgaggacacccacatcgccgccgccgccgccatcctgaacctgagcaccagatgcagagaggccaccgacatcctgagcaacaagccccagagcctgcacgccaagggcgccgagatcgaggtggacgagaacggcaccctggacctgagcatgaagaagaacagaatcctggacaagagcgcccccctgaccagcagcaacaccagcatccccacccccagcagcagccccttcaagaccagcagcatcctggtgaacgccgccttctaccaggccctgtgcgaccaggagggctgggacacccccatcaactacagcaagacccacggcaagaccgaggaggagaaggagaaggaccccgtgagcagcctggagaacctggaggagaagaagttccccggcgaggccagcatccccagccccaagcccaagctgcacgccagagacctgaagaaggagctgatcacctgccccacccccggctgcgacggcagcggccacgtgaccggcaactacgccagccacagaagcgtgagcggctgccccctggccgacaagaccctgaagagcctgatggccgccaacagccaggagctgaagtgccccacccccggctgcgacggcagcggccacgtgaccggcaactacgccagccacagaagcctgagcggctgccccagagccagaaagggcggcgtgaagatgacccccaccaaggaggagaaggaggaccccgagctgaagtgccccgtgatcggctgcgacggccagggccacatcagcggcaagtacaccagccacagaaccgccagcggctgccccctggccgccaagagacagaaggagaaccccctgaacggcgccagcctgagctggaagctgaacaagcaggagctgccccactgccccctgcccggctgcaacggcctgggccacgtgaacaacgtgttcgtgacccacagaagcctgagcggctgccccctgaacgcccaggtgatcaagaagggcaaggtgagcgaggagctgatgaccatcaagctgaaggccaccggcggcatcgagagcgacgaggagatcagacacctggacgaggagatcaaggagctgaacgagagcaacctgaagatcgaggccgacatgatgaagctgcagacccagatcaccagcatggagagcaacctgaagaccatcgaggaggagaacaagctgatcgagcagaacaacgagagcctgctgaaggagctggccggcctgagccaggccctgatcagcagcctggccgacatccagctgccccagatgggccccatcagcgagcagaacttcgaggcctacgtgaacaccctgaccgacatgtacagcaacctggagagagactacagccccgagtgcaaggccctgctggagagcatcaagcaggccgtgaagggcatccacgtgtag

SEQ ID NO: 9681 - DNA, 1863 bp, Artificial Sequence
  Description of Artificial Sequence: Synthetic coding sequence
atggacgccgaggccgaggacaagaccctgagaaccagaagcaagggcaccgaggtgcccatggacagcctgatccaggagctgagcgtggcctacgactgcagcatggccaagaagagaaccgccgaggaccaggccctgggcgtgcccgtgaacaagagaaagagcctgctgatgaagcccagacactacagccccaaggccgactgccaggaggacagaagcgacagaaccgaggacgacggccccctggagacccacggccacagcaccgccgaggagatcatgatcaagcccatggacgagagcctgctgagcaccgcccaggagaacagcagcagaaaggaggacagatacagctgctaccaggagctgatggtgaagagcctgatgcacctgggcaagttcgagaagaacgtgagcgtgcagaccgtgagcgagaacctgaacgacagcggcatccagagcctgaaggccgagagcgacgaggccgacgagtgcttcctgatccacagcgacgacggcagagacaagatcgacgacagccagccccccttctgcagcagcgacgacaacgagagcaacagcgagagcgccgagaacggctgggacagcggcagcaacttcagcgaggagaccaagccccccagagtgcccaagtacgtgctgaccgaccacaagaaggacctgctggaggtgcccgagatcaagaccgagggcgacaagttcatcccctgcgagaacagatgcgacagcgagaccgagagaaaggacccccagaacgccctggccgagcccctggacggcaacgcccagcccagcttccccgacgtggaggaggaggacagcgagagcctggccgtgatgaccgaggagggcagcgacctggagaaggccaagggcaacctgagcctgctggagcaggccatcgccctgcaggccgagagaggctgcgtgttccacaacacctacaaggagctggacagattcctgctggagcacctggccggcgagagaagacagaccaaggtgatcgacatgggcggcagacagatcttcaacaacaagcacagccccagacccgagaagagagagaccaagtgccccatccccggctgcgacggcaccggccacgtgaccggcctgtacccccaccacagaagcctgagcggctgcccccacaaggtgagagtgcccctggagatcctggccatgcacgagaacgtgctgaagtgccccacccccggctgcaccggcagaggccacgtgaacagcaacagaaacacccacagaagcctgagcggctgccccatcgccgccgccgagaagctggccatgagccaggacaagaaccagctggacagcccccagaccggccagtgccccgaccaggcccacagaaccagcctggtgaagcagatcgagttcaacttccccagccaggccatcaccagccccagagccaccgtgagcaaggagcaggagaagttcggcaaggtgcccttcgactacgccagcttcgacgcccaggtgttcggcaagagacccctgatccagaccgtgcagggcagaaagaccccccccttccccgagagcaagcacttccccaaccccgtgaagttccccaacagactgcccagcgccggcgcccacacccagagccccggcagagccagcagctacagctacggccagtgcagcgaggacacccacatcgccgccgccgccgccatcctgaacctgagcaccagatgcagagaggccaccgacatcctgagcaacaagccccagagcctgcacgccaagggcgccgagatcgaggtggacgagaacggcaccctggacctgagcatgaagaagtag

SEQ ID NO: 9682 - DNA, 42 bp, Artificial Sequence
  Description of Artificial Sequence: Synthetic coding sequence
atggacgccgaggccgaggacaagaccctgagaaccagatag

SEQ ID NO: 9683 - DNA, 990 bp, Artificial Sequence
  Description of Artificial Sequence: Synthetic coding sequence
atgagcgccgccggcctgctggcccccgcccccgcccaggccggcgccccccccgcccccgagtactaccccgaggaggacgaggagctggagagcgccgaggacgacgagagaagctgcagaggcagagagagcgacgaggacaccgaggacgccagcgagaccgacctggccaagcacgacgaggaggactacgtggagatgaaggagcagatgtaccaggacaagctggccagcctgaagagacagctgcagcagctgcaggagggcaccctgcaggagtaccagaagagaatgaagaagctggaccagcagtacaaggagagaatcagaaacgccgacaccctgctgctgcaggcccagaccgagcaggtggagagaaactacatcaaggagaagaaggccgccgtgaaggagttcgaggacaagaaggtggagctgaaggagaacctgatcgccgagctggaggagaagaagaagatgatcgagaacgagaagctgaccatggagctgaccggcgacagcatggaggtgaagcccatcatgaccagaaagctgagaagaagacccaacgaccccgtgcccatccccgacaagagaagaaagcccgcccccgcccagctgaactacctgctgaccgacgagcagatcatggaggacctgagaaccctgaacaagctgaagagccccaagagacccgccagccccagcagccccgagcacctgcccgccacccccgccgagagccccgcccagagattcgaggccagaatcgaggacggcaagctgtactacgacaagagatggtaccacaagagccaggccatctacctggagagcaaggacaaccagaagctgagctgcgtgatcagcagcgtgggcgccaacgagatctgggtgagaaagaccagcgacagcaccaagatgagaatctacctgggccagctgcagagaggcctgttcgtgatcagaagaagaagcgccgcctag

SEQ ID NO: 9684 - DNA, 987 bp, Artificial Sequence
  Description of Artificial Sequence: Synthetic coding sequence
atgagcgccgccggcctgctggcccccgcccccgcccaggccggcgccccccccgcccccgagtactaccccgaggaggacgaggagctggagagcgccgaggacgacgagagaagctgcagaggcagagagagcgacgaggacaccgaggacgccagcgagaccgacctggccaagcacgacgaggaggactacgtggagatgaaggagcagatgtaccaggacaagctggccagcctgaagagacagctgcagcagctgcaggagggcaccctgcaggagtaccagaagagaatgaagaagctggaccagcagtacaaggagagaatcagaaacgccgagctgttcctgcagctggagaccgagcaggtggagagaaactacatcaaggagaagaaggccgccgtgaaggagttcgaggacaagaaggtggagctgaaggagaacctgatcgccgagctggaggagaagaagaagatgatcgagaacgagaagctgaccatggagctgaccggcgacagcatggaggtgaagcccatcatgaccagaaagctgagaagaagacccaacgaccccgtgcccatccccgacaagagaagaaagcccgcccccgcccagctgaactacctgctgaccgacgagcagatcatggaggacctgagaaccctgaacaagctgaagagccccaagagacccgccagccccagcagccccgagcacctgcccgccacccccgccgagagccccgcccagagattcgaggccagaatcgaggacggcaagctgtactacgacaagagatggtaccacaagagccaggccatctacctggagagcaaggacaaccagaagctgagctgcgtgatcagcagcgtgggcgccaacgagatctgggtgagaaagaccagcgacagcaccaagatgagaatctacctgggccagctgcagagaggcctgttcgtgatcagaagaagaagcgccgcctag

SEQ ID NO: 9685 - DNA, 591 bp, Artificial Sequence
  Description of Artificial Sequence: Synthetic coding sequence
atggccagcaacgtgaccaacaagaccgaccccctgttcagcagcagcttcgacctggactacgacttccagagagactactacgacagaatgtacagctaccccgccagagtgcccccccccccccccatcgccagagccgtggtgcccagcaagagacagagagtgagcggcaacaccagcagaagaggcaagagcggcttcaacagcaagagcggccagagaggcagcagcaagagcggcaagctgaagggcgacgacctgcaggccatcaagaaggagctgacccagatcaagcagaaggtggacagcctgctggagaacctggagaagatcgagaaggagcagagcaagcaggccgtggagatgaagaacgacaagagcgaggaggagcagagcagcagcagcgtgaagaaggacgagaccaacgtgaagatggagagcgagggcggcgccgacgacagcgccgaggagggcgacctgctggacgacgacgacaacgaggacagaggcgacgaccaggtgaagaccaccggcaaggagagaaagagatggtggagaggcgcccagggccacatggagtgcctgtag

SEQ ID NO: 9686 - DNA, 1197 bp, Artificial Sequence
  Description of Artificial Sequence: Synthetic coding sequence
atggccgtgaccctggacaaggacgcctactacagaagagtgaagagactgtacagcaactggagaaagggcgaggacgagtacgccaacgtggacgccatcgtggtgagcgtgggcgtggacgaggagatcgtgtacgccaagagcaccgccctgcagacctggctgttcggctacgagctgaccgacaccatcatggtgttctgcgacgacaagatcatcttcatggccagcaagaagaaggtggagttcctgaagcagatcgccaacaccaagggcaacgagaacgccaacggcgcccccgccatcaccctgctgatcagagagaagaacgagagcaacaagagcagcttcgacaagatgatcgaggccatcaaggagagcaagaacggcaagaagatcggcgtgttcagcaaggacaagttccccggcgagttcatgaagagctggaacgactgcctgaacaaggagggcttcgacaagatcgacatcagcgccgtggtggcctacaccatcgccgtgaaggaggacggcgagctgaacctgatgaagaaggccgccagcatcaccagcgaggtgttcaacaagttcttcaaggagagagtgatggagatcgtggacgccgacgagaaggtgagacacagcaagctggccgagagcgtggagaaggccatcgaggagaagaagtacctggccggcgccgaccccagcaccgtggagatgtgctacccccccatcatccagagcggcggcaactacaacctgaagttcagcgtggtgagcgacaagaaccacatgcacttcggcgccatcacctgcgccatgggcatcagattcaagagctactgcagcaacctggtgagaaccctgatggtggaccccagccaggaggtgcaggagaactacaacttcctgctgcagctgcaggaggagctgctgaaggagctgagacacggcgtgaagatctgcgacgtgtacaacgccgtgatggacgtggtgaagaagcagaagcccgagctgctgaacaagatcaccaagaacctgggcttcggcatgggcatcgagttcagagagggcagcctggtgatcaacagcaagaaccagtacaagctgaagaagggcatggtgttcagcatcaacctgggcttcagcgacctgaccaacaagaagaagaagaagaagaagaaggccaagtag

SEQ ID NO: 9687 - DNA, 954 bp, Artificial Sequence
  Description of Artificial Sequence: Synthetic coding sequence
atgaacaacaccgccgccagccccatgagcaccgccaccagcagcagcggcagaagcaccggcaagagcatcagcttcgccaccgagctgcagagcatgatgtacagcctgggcgacgccagaagacccctgcacgagaccgccgtgctggtggaggacgtggtgcacacccagctgatcaacctgctgcagcaggccgccgaggtgagccagctgagaggcgccagagtgatcacccccgaggacctgctgttcctgatgagaaaggacaagaagaagctgagaagactgctgaagtacatgttcatcagagactacaagagcaagatcgtgaagggcatcgacgaggacgacctgctggaggacaagctgagcggcagcaacaacgccaacaagagacagaagatcgcccaggacttcctgaacagcatcgaccagaccggcgagctgctggccatgttcgaggacgacgagatcgacgaggtgaagcaggagagaatggagagagccgagagacagaccagaatcatggacagcgcccagtacgccgagttctgcgagagcagacagctgagcttcagcaagaaggccagcaagttcagagactggctggactgcagcagcatggagatcaagcccaacgtggtggccatggagatcctggcctacctggcctacgagaccgtggcccagctggtggacctggccctgctggtgagacaggacatggtgaccaaggccggcgaccccttcagccacgccatcagcgccaccttcatccagtaccacaacagcgccgagagcaccgccgcctgcggcgtggaggcccacagcgacgccatccagccctgccacatcagagaggccatcagaagatacagccacagaatcggccccctgagccccttcaccaacgcctacagaagaaacggcatggccttcctggcctgctag

SEQ ID NO: 9688 - DNA, 327 bp, Artificial Sequence
  Description of Artificial Sequence: Synthetic coding sequence
atggagatcctggcctacctggcctacgagaccgtggcccagctggtggacctggccctgctggtgagacaggacatggtgaccaaggccggcgaccccttcagccacgccatcagcgccaccttcatccagtaccacaacagcgccgagagcaccgccgcctgcggcgtggaggcccacagcgacgccatccagccctgccacatcagagaggccatcagaagatacagccacagaatcggccccctgagccccttcaccatcagcttcagcctgaccgagtgcctgccccaggagtgggacggcttcagcagcctgctgatgtag

SEQ ID NO: 9689 - DNA, 954 bp, Artificial Sequence; identical to SEQ ID NO: 9687
  Description of Artificial Sequence: Synthetic coding sequence

SEQ ID NO: 9690 - DNA, 987 bp, Artificial Sequence
  Description of Artificial Sequence: Synthetic coding sequence
atggtggtgttcggcaccaccttcttcaacttcgacagcttcatcggcaagaccgacagcatcgagatcatcggcaagagcgtgttcccctactgctaccacaacatcctgcccctgctgaacgacagcggcagatacagcctgggcgacgccagaagacccctgcacgagaccgccgtgctggtggaggacgtggtgcacacccagctgatcaacctgctgcagcaggccgccgaggtgagccagctgagaggcgccagagtgatcacccccgaggacctgctgttcctgatgagaaaggacaagaagaagctgagaagactgctgaagtacatgttcatcagagactacaagagcaagatcgtgaagggcatcgacgaggacgacctgctggaggacaagctgagcggcagcaacaacgccaacaagagacagaagatcgcccaggacttcctgaacagcatcgaccagaccggcgagctgctggccatgttcgaggacgacgagatcgacgaggtgaagcaggagagaatggagagagccgagagacagaccagaatcatggacagcgcccagtacgccgagttctgcgagagcagacagctgagcttcagcaagaaggccagcaagttcagagactggctggactgcagcagcatggagatcaagcccaacgtggtggccatggagatcctggcctacctggcctacgagaccgtggcccagctggtggacctggccctgctggtgagacaggacatggtgaccaaggccggcgaccccttcagccacgccatcagcgccaccttcatccagtaccacaacagcgccgagagcaccgccgcctgcggcgtggaggcccacagcgacgccatccagccctgccacatcagagaggccatcagaagatacagccacagaatcggccccctgagccccttcaccaacgcctacagaagaaacggcatggccttcctggcctgctag

SEQ ID NO: 9691 - DNA, 987 bp, Artificial Sequence; identical to SEQ ID NO: 9690
  Description of Artificial Sequence: Synthetic coding sequence

SEQ ID NO: 9692 - DNA, 954 bp, Artificial Sequence; identical to SEQ ID NO: 9687
  Description of Artificial Sequence: Synthetic coding sequence

SEQ ID NO: 9693 - DNA, 624 bp, Artificial Sequence
  Description of Artificial Sequence: Synthetic coding sequence
atggccggccccgccacccagagccccatgaagctgatggccctgcagctgctgctgtggcacagcgccctgtggaccgtgcaggaggccacccccctgggccccgccagcagcctgccccagagcttcctgctgaagtgcctggagcaggtgagaaagatccagggcgacggcgccgccctgcaggagaagctggtgagcgagtgcgccacctacaagctgtgccaccccgaggagctggtgctgctgggccacagcctgggcatcccctgggcccccctgagcagctgccccagccaggccctgcagctggccggctgcctgagccagctgcacagcggcctgttcctgtaccagggcctgctgcaggccctggagggcatcagccccgagctgggccccaccctggacaccctgcagctggacgtggccgacttcgccaccaccatctggcagcagatggaggagctgggcatggcccccgccctgcagcccacccagggcgccatgcccgccttcgccagcgccttccagagaagagccggcggcgtgctggtggccagccacctgcagagcttcctggaggtgagctacagagtgctgagacacctggcccagccctag

SEQ ID NO: 9694 - DNA, 2220 bp, Artificial Sequence
  Description of Artificial Sequence: Synthetic coding sequence
atggccccccagaagcacggcggcggcggcggcggcggcagcggccccagcgccggcagcggcggcggcggcttcggcggcagcgccgccgtggccgccgccaccgccagcggcggcaagagcggcggcggcagctgcggcggcggcggcagctacagcgccagcagcagcagcagcgccgccgccgccgccggcgccgccgtgctgcccgtgaagaagcccaagatggagcacgtgcaggccgaccacgagctgttcctgcaggccttcgagaagcccacccagatctacagattcctgagaaccagaaacctgatcgcccccatcttcctgcacagaaccctgacctacatgagccacagaaacagcagaaccaacatcaagagaaagaccttcaaggtggacgacatgctgagcaaggtggagaagatgaagggcgagcaggagagccacagcctgagcgcccacctgcagctgaccttcaccggcttcttccacaagaacgacaagcccagccccaacagcgagaacgagcagaacagcgtgaccctggaggtgctgctggtgaaggtgtgccacaagaagagaaaggacgtgagctgccccatcagacaggtgcccaccggcaagaagcaggtgcccctgaaccccgacctgaaccagaccaagcccggcaacttccccagcctggccgtgagcagcaacgagttcgagcccagcaacagccacatggtgaagagctacagcctgctgttcagagtgaccagacccggcagaagagagttcaacggcatgatcaacggcgagaccaacgagaacatcgacgtgaacgaggagctgcccgccagaagaaagagaaacagagaggacggcgagaagaccttcgtggcccagatgaccgtgttcgacaagaacagaagactgcagctgctggacggcgagtacgaggtggccatgcaggagatggaggagtgccccatcagcaagaagagagccacctgggagaccatcctggacggcaagagactgccccccttcgagaccttcagccagggccccaccctgcagttcaccctgagatggaccggcgagaccaacgacaagagcaccgcccccatcgccaagcccctggccaccagaaacagcgagagcctgcaccaggagaacaagcccggcagcgtgaagcccacccagaccatcgccgtgaaggagagcctgaccaccgacctgcagaccagaaaggagaaggacacccccaacgagaacagacagaagctgagaatcttctaccagttcctgtacaacaacaacaccagacagcagaccgaggccagagacgacctgcactgcccctggtgcaccctgaactgcagaaagctgtacagcctgctgaagcacctgaagctgtgccacagcagattcatcttcaactacgtgtaccaccccaagggcgccagaatcgacgtgagcatcaacgagtgctacgacggcagctacgccggcaacccccaggacatccacagacagcccggcttcgccttcagcagaaacggccccgtgaagagaacccccatcacccacatcctggtgtgcagacccaagagaaccaaggccagcatgagcgagttcctggagagcgaggacggcgaggtggagcagcagagaacctacagcagcggccacaacagactgtacttccacagcgacacctgcctgcccctgagaccccaggagatggaggtggacagcgaggacgagaaggaccccgagtggctgagagagaagaccatcacccagatcgaggagttcagcgacgtgaacgagggcgagaaggaggtgatgaagctgtggaacctgcacgtgatgaagcacggcttcatcgccgacaaccagatgaaccacgcctgcatgctgttcgtggagaactacggccagaagatcatcaagaagaacctgtgcagaaacttcatgctgcacctggtgagcatgcacgacttcaacctgatcagcatcatgagcatcgacaaggccgtgaccaagctgagagagatgcagcagaagctggagaagggcgagagcgccagccccgccaacgaggagatcaccgaggagcagaacggcaccgccaacggcttcagcgagatcaacagcaaggagaaggccctggagaccgacagcgtgagcggcgtgagcaagcagagcaagaagcagaagctgtag

SEQ ID NO: 9695 - DNA, 1938 bp, Artificial Sequence
  Description of Artificial Sequence: Synthetic coding sequence
atgagcctgaagatggacaacagagacgtggccggcaaggccaacagatggttcggcgtggccccccccaagagcggcaagatgaacatgaacatcctgcaccaggaggagctgatcgcccagaagaagagagagatcgaggccaagatggagcagaaggccaagcagaaccaggtggccagcccccagcccccccaccccggcgagatcaccaacgcccacaacagcagctgcatcagcaacaagttcgccaacgacggcagcttcctgcagcagttcctgaagctgcagaaggcccagaccagcaccgacgcccccaccagcgcccccagcgccccccccagcacccccacccccagcgccggcaagagaagcctgctgatcagcagaagaaccggcctgggcctggccagcctgcccggccccgtgaagagctacagccacgccaagcagctgcccgtggcccacagacccagcgtgttccagagccccgacgaggacgaggaggaggactacgagcagtggctggagatcaaggtgagcccccccgagggcgccgagaccagaaaggtgatcgagaagctggccagattcgtggccgagggcggccccgagctggagaaggtggccatggaggactacaaggacaaccccgccttcgccttcctgcacgacaagaacagcagagagttcctgtactacagaaagaaggtggccgagatcagaaaggaggcccagaagagccaggccgccagccagaaggtgagcccccccgaggacgaggaggtgaagaacctggccgagaagctggccagattcatcgccgacggcggccccgaggtggagaccatcgccctgcagaacaacagagagaaccaggccttcagcttcctgtacgagcccaacagccagggctacaagtactacagacagaagctggaggagttcagaaaggccaaggccagcagcaccggcagcttcaccgcccccgaccccggcctgaagagaaagagcccccccgaggccctgagcggcagcctgccccccgccaccacctgccccgccagcagcacccccgcccccaccatcatccccgcccccgccgcccccggcaagcccgccagcgccgccaccgtgaagagaaagagaaagagcagatggggccccgaggaggacaaggtggagctgccccccgccgagctggtgcagagagacgtggacgccagccccagccccctgagcgtgcaggacctgaagggcctgggctacgagaagggcaagcccgtgggcctggtgggcgtgaccgagctgagcgacgcccagaagaagcagctgaaggagcagcaggagatgcagcagatgtacgacatgatcatgcagcacaagagagccatgcaggacatgcagctgctgtgggagaaggccgtgcagcagcaccagcacggctacgacagcgacgaggaggtggacagcgagctgggcacctgggagcaccagctgagaagaatggagatggacaagaccagagagtgggccgagcagctgaccaagatgggcagaggcaagcacttcatcggcgacttcctgccccccgacgagctggagaagttcatggagaccttcaaggccctgaaggagggcagagagcccgactacagcgagtacaaggagttcaagctgaccgtggagaacatcggctaccagatgctgatgaagatgggctggaaggagggcgagggcctgggcagcgagggccagggcatcaagaaccccgtgaacaagggcaccaccaccgtggacggcgccggcttcggcatcgacagacccgccgagctgagcaaggaggacgacgagtacgaggccttcagaaagagaatgatgctggcctacagattcagacccaaccccctgaacaaccccagaagaccctactactag

SEQ ID NO: 9696 - DNA, 669 bp, Artificial Sequence
  Description of Artificial Sequence: Synthetic coding sequence
atgagcctgaagatggacaacagagacgtggccggcaaggccaacagatggttcggcgtggccccccccaagagcggcaagatgaacatgaacatcctgcaccaggaggagctgatcgcccagaagaagagagagatcgaggccaagatggagcagaaggccaagcagaaccaggtggccagcccccagcccccccaccccggcgagatcaccaacgcccacaacagcagctgcatcagcaacaagttcgccaacgacggcagcttcctgcagcagttcctgaagctgcagaaggcccagaccagcaccgacgcccccaccagcgcccccagcgccccccccagcacccccacccccagcgccggcaagagaagcctgctgatcagcagaagaaccggcctgggcctggccagcctgcccggccccgtgaagagctacagccacgccaagcagctgcccgtggcccacagacccagcgtgttccagagccccgacgaggacgaggaggaggactacgagcagtggctggagatcaaggtgtgcctgaccaagaccgtgagacccaccccccccagcagctggtgcttcgtgcccggcctgggcacccccgacagcctgctgcacctgaccctgttcagcccccaccccctgtgcagatgcggcccctag

SEQ ID NO: 9697 - DNA, 558 bp, Artificial Sequence
  Description of Artificial Sequence: Synthetic coding sequence
atgagcctgaagatggacaacagagacgtggccggcaaggccaacagatggttcggcgtggccccccccaagagcggcaagatgaacatgaacatcctgcaccaggaggagctgatcgcccagaagaagagagagatcgaggccaagatggagcagaaggccaagcagaaccaggtggccagcccccagcccccccaccccggcgagatcaccaacgcccacaacagcagctgcatcagcaacaagttcgccaacgacggcagcttcctgcagcagttcctgaagctgcagaaggcccagaccagcaccgacgcccccaccagcgcccccagcgccccccccagcacccccacccccagcgccggcaagagaagcctgctgatcagcagaagaaccggcctgggcctggccagcctgcccggccccgtgaagagctacagccacgccaagcagctgcccgtggcccacagacccagcgtgttccagagccccgacgaggacgaggaggaggactacgagcagtggctggagatcaagggcagaagatggctgagatag

SEQ ID NO: 9698 - DNA, 3093 bp, Artificial Sequence
  Description of Artificial Sequence: Synthetic coding sequence
atggccgccagaagaatcacccaggagaccttcgacgccgtgctgcaggagaaggccaagagataccacatggacgccagcggcgaggccgtgagcgagaccctgcagttcaaggcccaggacctgctgagagccgtgcccagaagcagagccgagatgtacgacgacgtgcacagcgacggcagatacagcctgagcggcagcgtggcccacagcagagacgccggcagagagggcctgagaagcgacgtgttccccggccccagcttcagaagcagcaaccccagcatcagcgacgacagctacttcagaaaggagtgcggcagagacctggagttcagccacagcgacagcagagaccaggtgatcggccacagaaagctgggccacttcagaagccaggactggaagttcgccctgagaggcagctgggagcaggacttcggccaccccgtgagccaggagagcagctggagccaggagtacagcttcggccccagcgccgtgctgggcgacttcggcagcagcagactgatcgagaaggagtgcctggagaaggagagcagagactacgacgtggaccaccccggcgaggccgacagcgtgctgagaggcggcagccaggtgcaggccagaggcagagccctgaacatcgtggaccaggagggcagcctgctgggcaagggcgagacccagggcctgctgaccgccaagggcggcgtgggcaagctggtgaccctgagaaacgtgagcaccaagaagatccccaccgtgaacagaatcacccccaagacccagggcaccaaccagatccagaagaacacccccagccccgacgtgaccctgggcaccaaccccggcaccgaggacatccagttccccatccagaagatccccctgggcctggacctgaagaacctgagactgcccagaagaaagatgagcttcgacatcatcgacaagagcgacgtgttcagcagattcggcatcgagatcatcaagtgggccggcttccacaccatcaaggacgacatcaagttcagccagctgttccagaccctgttcgagctggagaccgagacctgcgccaagatgctggccagcttcaagtgcagcctgaagcccgagcacagagacttctgcttcttcaccatcaagttcctgaagcacagcgccctgaagacccccagagtggacaacgagttcctgaacatgctgctggacaagggcgccgtgaagaccaagaactgcttcttcgagatcatcaagcccttcgacaagtacatcatgagactgcaggacagactgctgaagagcgtgacccccctgctgatggcctgcaacgcctacgagctgagcgtgaagatgaagaccctgagcaaccccctggacctggccctggccctggagaccaccaacagcctgtgcagaaagagcctggccctgctgggccagaccttcagcctggccagcagcttcagacaggagaagatcctggaggccgtgggcctgcaggacatcgcccccagccccgccgccttccccaacttcgaggacagcaccctgttcggcagagagtacatcgaccacctgaaggcctggctggtgagcagcggctgccccctgcaggtgaagaaggccgagcccgagcccatgagagaggaggagaagatgatcccccccaccaagcccgagatccaggccaaggcccccagcagcctgagcgacgccgtgccccagagagccgaccacagagtggtgggcaccatcgaccagctggtgaagagagtgatcgagggcagcctgagccccaaggagagaaccctgctgaaggaggaccccgcctactggttcctgagcgacgagaacagcctggagtacaagtactacaagctgaagctggccgagatgcagagaatgagcgagaacctgagaggcgccgaccagaagcccaccagcgccgactgcgccgtgagagccatgctgtacagcagagccgtgagaaacctgaagaagaagctgctgccctggcagagaagaggcctgctgagagcccagggcctgagaggctggaaggccagaagagccaccaccggcacccagaccctgctgagcagcggcaccagactgaagcaccacggcagacaggcccccggcctgagccaggccaagcccagcctgcccgacagaaacgacgccgccaaggactgcccccccgaccccgtgggccccagcccccaggaccccagcctggaggccagcggccccagccccaagcccgccggcgtggacatcagcgaggccccccagaccagcagcccctgccccagcgccgacatcgacatgaagaccatggagaccgccgagaagctggccagattcgtggcccaggtgggccccgagatcgagcagttcagcatcgagaacagcaccgacaaccccgacctgtggttcctgcacgaccagaacagcagcgccttcaagttctacagaaagaaggtgttcgagctgtgccccagcatctgcttcaccagcagcccccacaacctgcacaccggcggcggcgacaccaccggcagccaggagagccccgtggacctgatggagggcgaggccgagttcgaggacgagcccccccccagagaggccgagctggagagccccgaggccagcagcggcacctgcttccccagaaagagaatcagcagcaagagcctgaaggtgggcatgatccccgcccccaagagagtgtgcctgatccaggagcccaaggtgcacgagcccgtgagaatcgcctacgacagacccagaggcagacccatgagcaagaagaagaagcccaaggacctggacttcgcccagcagaagctgaccgacaagaacctgggcttccagatgctgcagaagatgggctggaaggagggccacggcctgggcagcctgggcaagggcatcagagagcccgtgagcgtgggcacccccagcgagggcgagggcctgggcgccgacggccaggagcacaaggaggacaccttcgacgtgttcagacagagaatgatgcagatgtacagacacaagagagccaacaagtag

SEQ ID NO: 9699 - DNA, 3249 bp, Artificial Sequence
  Description of Artificial Sequence: Synthetic coding sequence
atggccgccagaagaatcacccaggagaccttcgacgccgtgctgcaggagaaggccaagagataccacatggacgccagcggcgaggccgtgagcgagaccctgcagttcaaggcccaggacctgctgagagccgtgcccagaagcagagccgagatgtacgacgacgtgcacagcgacggcagatacagcctgagcggcagcgtggcccacagcagagacgccggcagagagggcctgagaagcgacgtgttccccggccccagcttcagaagcagcaaccccagcatcagcgacgacagctacttcagaaaggagtgcggcagagacctggagttcagccacagcgacagcagagaccaggtgatcggccacagaaagctgggccacttcagaagccaggactggaagttcgccctgagaggcagctgggagcaggacttcggccaccccgtgagccaggagagcagctggagccaggagtacagcttcggccccagcgccgtgctgggcgacttcggcagcagcagactgatcgagaaggagtgcctggagaaggagagcagagactacgacgtggaccaccccggcgaggccgacagcgtgctgagaggcggcagccaggtgcaggccagaggcagagccctgaacatcgtggaccaggagggcagcctgctgggcaagggcgagacccagggcctgctgaccgccaagggcggcgtgggcaagctggtgaccctgagaaacgtgagcaccaagaagatccccaccgtgaacagaatcacccccaagacccagggcaccaaccagatccagaagaacacccccagccccgacgtgaccctgggcaccaaccccggcaccgaggacatccagttccccatccagaagatccccctgggcctggacctgaagaacctgagactgcccagaagaaagatgagcttcgacatcatcgacaagagcgacgtgttcagcagattcggcatcgagatcatcaagtgggccggcttccacaccatcaaggacgacatcaagttcagccagctgttccagaccctgttcgagctggagaccgagacctgcgccaagatgctggccagcttcaagtgcagcctgaagcccgagcacagagacttctgcttcttcaccatcaagttcctgaagcacagcgccctgaagacccccagagtggacaacgagttcctgaacatgctgctggacaagggcgccgtgaagaccaagaactgcttcttcgagatcatcaagcccttcgacaagtacatcatgagactgcaggacagactgctgaagagcgtgacccccctgctgatggcctgcaacgcctacgagctgagcgtgaagatgaagaccctgagcaaccccctggacctggccctggccctggagaccaccaacagcctgtgcagaaagagcctggccctgctgggccagaccttcagcctggccagcagcttcagacaggagaagatcctggaggccgtgggcctgcaggacatcgcccccagccccgccgccttccccaacttcgaggacagcaccctgttcggcagagagtacatcgaccacctgaaggcctggctggtgagcagcggctgccccctgcaggtgaagaaggccgagcccgagcccatgagagaggaggagaagatgatcccccccaccaagcccgagatccaggccaaggcccccagcagcctgagcgacgccgtgccccagagagccgaccacagagtggtgggcaccatcgaccagctggtgaagagagtgatcgagggcagcctgagccccaaggagagaaccctgctgaaggaggaccccgcctactggttcctgagcgacgagaacagcctggagtacaagtactacaagctgaagctggccgagatgcagagaatgagcgagaacctgagaggcgccgaccagaagcccaccagcgccgactgcgccgtgagagccatgctgtacagcagagccgtgagaaacctgaagaagaagctgctgccctggcagagaagaggcctgctgagagcccagggcctgagaggctggaaggccagaagagccaccaccggcacccagaccctgctgagcagcggcaccagactgaagcaccacggcagacaggcccccggcctgagccaggccaagcccagcctgcccgacagaaacgacgccgccaaggactgcccccccgaccccgtgggccccagcccccaggaccccagcctggaggccagcggccccagccccaagcccgccggcgtggacatcagcgaggccccccagaccagcagcccctgccccagcgccgacatcgacatgaagaccatggagaccgccgagaagctggccagattcgtggcccaggtgggccccgagatcgagcagttcagcatcgagaacagcaccgacaaccccgacctgtggttcctgcacgaccagaacagcagcgccttcaagttctacagaaagaaggtgttcgagctgtgccccagcatctgcttcaccagcagcccccacaacctgcacaccggcggcggcgacaccaccggcagccaggagagccccgtggacctgatggagggcgaggccgagttcgaggacgagcccccccccagagaggccgagctggagagccccgaggtgatgcccgaggaggaggacgaggacgacgaggacggcggcgaggaggcccccgcccccggcggcgccggcaagagcgagggcagcacccccgccgacggcctgcccggcgaggccgccgaggacgacctggccggcgcccccgccctgagccaggccagcagcggcacctgcttccccagaaagagaatcagcagcaagagcctgaaggtgggcatgatccccgcccccaagagagtgtgcctgatccaggagcccaaggtgcacgagcccgtgagaatcgcctacgacagacccagaggcagacccatgagcaagaagaagaagcccaaggacctggacttcgcccagcagaagctgaccgacaagaacctgggcttccagatgctgcagaagatgggctggaaggagggccacggcctgggcagcctgggcaagggcatcagagagcccgtgagcgtgggcacccccagcgagggcgagggcctgggcgccgacggccaggagcacaaggaggacaccttcgacgtgttcagacagagaatgatgcagatgtacagacacaagagagccaacaagtag

SEQ ID NO: 9700 - DNA, 3249 bp, Artificial Sequence; identical to SEQ ID NO: 9699
  Description of Artificial Sequence: Synthetic coding sequence

SEQ ID NO: 9701 - DNA, 2586 bp, Artificial Sequence
  Description of Artificial Sequence: Synthetic coding sequence
atgaccgccaccttcgccaagaacgtggccggcatctggaacttcctgaccctgatcctgggcaccagaagcctggccaccggcaactggggcatcagcgtgctgagaaccggcaacctgagaagcgtggtgctgggcaacaagaccctggccatccagttcctgaagagccccctgggccacagaagcatcgtgctgatccccctgggcctggacctgaagaacctgagactgcccagaagaaagatgagcttcgacatcatcgacaagagcgacgtgttcagcagattcggcatcgagatcatcaagtgggccggcttccacaccatcaaggacgacatcaagttcagccagctgttccagaccctgttcgagctggagaccgagacctgcgccaagatgctggccagcttcaagtgcagcctgaagcccgagcacagagacttctgcttcttcaccatcaagttcctgaagcacagcgccctgaagacccccagagtggacaacgagttcctgaacatgctgctggacaagggcgccgtgaagaccaagaactgcttcttcgagatcatcaagcccttcgacaagtacatcatgagactgcaggacagactgctgaagagcgtgacccccctgctgatggcctgcaacgcctacgagctgagcgtgaagatgaagaccctgagcaaccccctggacctggccctggccctggagaccaccaacagcctgtgcagaaagagcctggccctgctgggccagaccttcagcctggccagcagcttcagacaggagaagatcctggaggccgtgggcctgcaggacatcgcccccagccccgccgccttccccaacttcgaggacagcaccctgttcggcagagagtacatcgaccacctgaaggcctggctggtgagcagcggctgccccctgcaggtgaagaaggccgagcccgagcccatgagagaggaggagaagatgatcccccccaccaagcccgagatccaggccaaggcccccagcagcctgagcgacgccgtgccccagagagccgaccacagagtggtgggcaccatcgaccagctggtgaagagagtgatcgagggcagcctgagccccaaggagagaaccctgctgaaggaggaccccgcctactggttcctgagcgacgagaacagcctggagtacaagtactacaagctgaagctggccgagatgcagagaatgagcgagaacctgagaggcgccgaccagaagcccaccagcgccgactgcgccgtgagagccatgctgtacagcagagccgtgagaaacctgaagaagaagctgctgccctggcagagaagaggcctgctgagagcccagggcctgagaggctggaaggccagaagagccaccaccggcacccagaccctgctgagcagcggcaccagactgaagcaccacggcagacaggcccccggcctgagccaggccaagcccagcctgcccgacagaaacgacgccgccaaggactgcccccccgaccccgtgggccccagcccccaggaccccagcctggaggccagcggccccagccccaagcccgccggcgtggacatcagcgaggccccccagaccagcagcccctgccccagcgccgacatcgacatgaagaccatggagaccgccgagaagctggccagattcgtggcccaggtgggccccgagatcgagcagttcagcatcgagaacagcaccgacaaccccgacctgtggttcctgcacgaccagaacagcagcgccttcaagttctacagaaagaaggtgttcgagctgtgccccagcatctgcttcaccagcagcccccacaacctgcacaccggcggcggcgacaccaccggcagccaggagagccccgtggacctgatggagggcgaggccgagttcgaggacgagcccccccccagagaggccgagctggagagccccgaggtgatgcccgaggaggaggacgaggacgacgaggacggcggcgaggaggcccccgcccccggcggcgccggcaagagcgagggcagcacccccgccgacggcctgcccggcgaggccgccgaggacgacctggccggcgcccccgccctgagccaggccagcagcggcacctgcttccccagaaagagaatcagcagcaagagcctgaaggtgggcatgatccccgcccccaagagagtgtgcctgatccaggagcccaaggtgcacgagcccgtgagaatcgcctacgacagacccagaggcagacccatgagcaagaagaagaagcccaaggacctggacttcgcccagcagaagctgaccgacaagaacctgggcttccagatgctgcagaagatgggctggaaggagggccacggcctgggcagcctgggcaagggcatcagagagcccgtgagcgtgtacgccgccggcagcctgggctgggagtgggtgggcccccagagcttccacctgcagcccgccgcctggctgctgcacagccaggacggcctgcagctggccgtggacttctgcttcctgaacagaagacacctgcagatgagaagctag

SEQ ID NO: 9702 - DNA, 534 bp, Artificial Sequence
  Description of Artificial Sequence: Synthetic coding sequence
tgaatgaagcacaccgccaccgccagattccagagaaaccacagactgatcagcgagatcctgagcgagagcgtggtgcccgacgtgagaagcgtggtgaccaccgccagaatgcaggtgctgaagagacaggtgcagagcctgatggtgcaccagagaaagctggaggccgagctgctgcagatcgaggagagacaccaggagaagaagagaaagttcctggagagcaccgacagcttcaacaacgagctgaagagactgtgcggcctgaaggtggaggtggacatggagaagatcgccgccgagatcgcccaggccgaggagcaggccagaaagagacaggaggagagagagaaggaggccgccgagcaggccgagagaagccagagcagcatcgtgcccgaggaggagcaggccgccaacaagggcgaggagaagaaggacgacgagaacatccccatggagaccgagaagaactgccagctgtgccccagaaagaccctgaccagcagatacaccgacttccccgactag

SEQ ID NO: 9703 - DNA, 1236 bp, Artificial Sequence
  Description of Artificial Sequence: Synthetic coding sequence
atgagcaagagacccagctacgcccccccccccacccccgcccccgccacccagatgcccagcacccccggcttcgtgggctacaacccctacagccacctggcctacaacaactacagactgggcggcaaccccggcaccaacagcagagtgaccgccagcagcggcatcaccatccccaagccccccaagccccccgacaagcccctgatgccctacatgagatacagcagaaaggtgtgggaccaggtgaaggccagcaaccccgacctgaagctgtgggagatcggcaagatcatcggcggcatgtggagagacctgaccgacgaggagaagcaggagtacctgaacgagtacgaggccgagaagatcgagtacaacgagagcatgaaggcctaccacaacagccccgcctacctggcctacatcaacgccaagagcagagccgaggccgccctggaggaggagagcagacagagacagagcagaatggagaagggcgagccctacatgagcatccagcccgccgaggaccccgacgactacgacgacggcttcagcatgaagcacaccgccaccgccagattccagagaaaccacagactgatcagcgagatcctgagcgagagcgtggtgcccgacgtgagaagcgtggtgaccaccgccagaatgcaggtgctgaagagacaggtgcagagcctgatggtgcaccagagaaagctggaggccgagctgctgcagatcgaggagagacaccaggagaagaagagaaagttcctggagagcaccgacagcttcaacaacgagctgaagagactgtgcggcctgaaggtggaggtggacatggagaagatcgccgccgagatcgcccaggccgaggagcaggccagaaagagacaggaggagagagagaaggaggccgccgagcaggccgagagaagccagagcagcatcgtgcccgaggaggagcaggccgccaacaagggcgaggagaagaaggacgacgagaacatccccatggagaccgaggagacccacctggaggagaccaccgagagccagcagaacggcgaggagggcaccagcacccccgaggacaaggagagcggccaggagggcgtggacagcatggccgaggagggcaccagcgacagcaacaccggcagcgagagcaacagcgccaccgtggaggagccccccaccgaccccatccccgaggacgagaagaaggagtag

SEQ ID NO: 9704 - DNA, 987 bp, Artificial Sequence
  Description of Artificial Sequence: Synthetic coding sequence
atgagcaagagacccagctacgcccccccccccacccccgcccccgccaccgccagcagcggcatcaccatccccaagccccccaagccccccgacaagcccctgatgccctacatgagatacagcagaaaggtgtgggaccaggtgaaggccagcaaccccgacctgaagctgtgggagatcggcaagatcatcggcggcatgtggagagacctgaccgacgaggagaagcaggagtacctgaacgagtacgaggccgagaagatcgagtacaacgagagcatgaaggcctaccacaacagccccgcctacctggcctacatcaacgccaagagcagagccgaggccgccctggaggaggagagcagacagagacagagcagaatggagaagggcgagccctacatgagcatccagcccgccgaggaccccgacgactacgacgacggcttcagcatgaagcacaccgccaccgccagattccagagaaaccacagactgatcagcgagatcctgagcgagagcgtggtgcccgacgtgagaagcgtggtgaccaccgccagaatgcaggtgctgaagagacaggtgcagagcctgatggtgcaccagagaaagctggaggccgagctgctgcagatcgaggagagacaccaggagaagaagagaaagttcctggagagcaccgacagcttcaacaacgagctgaagagactgtgcggcctgaaggtggaggtggacatggagaagatcgccgccgagatcgcccaggccgaggagcaggccagaaagagacaggaggagagagagaaggaggccgccgagcaggccgagagaagccagagcagcatcgtgcccgaggaggagcaggccgccaacaagggcgaggagaagaaggacgacgagaacatccccatggagaccgagaagaactgccagctgtgccccagaaagaccctgaccagcagatacaccgacttccccgactag

SEQ ID NO: 9705 - DNA, 570 bp, Artificial Sequence
  Description of Artificial Sequence: Synthetic coding sequence
tgagccgaggaccccgacgactacgacgacggcttcagcatgaagcacaccgccaccgccagattccagagaaaccacagactgatcagcgagatcctgagcgagagcgtggtgcccgacgtgagaagcgtggtgaccaccgccagaatgcaggtgctgaagagacaggtgcagagcctgatggtgcaccagagaaagctggaggccgagctgctgcagatcgaggagagacaccaggagaagaagagaaagttcctggagagcaccgacagcttcaacaacgagctgaagagactgtgcggcctgaaggtggaggtggacatggagaagatcgccgccgagatcgcccaggccgaggagcaggccagaaagagacaggaggagagagagaaggaggccgccgagcaggccgagagaagccagagcagcatcgtgcccgaggaggagcaggccgccaacaagggcgaggagaagaaggacgacgagaacatccccatggagaccgagaagaactgccagctgtgccccagaaagaccctgaccagcagatacaccgacttccccgactag

SEQ ID NO: 9706 - DNA, 1182 bp, Artificial Sequence
  Description of Artificial Sequence: Synthetic coding sequence
atgcccagcacccccggcttcgtgggctacaacccctacagccacctggcctacaacaactacagactgggcggcaaccccggcaccaacagcagagtgaccgccagcagcggcatcaccatccccaagccccccaagccccccgacaagcccctgatgccctacatgagatacagcagaaaggtgtgggaccaggtgaaggccagcaaccccgacctgaagctgtgggagatcggcaagatcatcggcggcatgtggagagacctgaccgacgaggagaagcaggagtacctgaacgagtacgaggccgagaagatcgagtacaacgagagcatgaaggcctaccacaacagccccgcctacctggcctacatcaacgccaagagcagagccgaggccgccctggaggaggagagcagacagagacagagcagaatggagaagggcgagccctacatgagcatccagcccgccgaggaccccgacgactacgacgacggcttcagcatgaagcacaccgccaccgccagattccagagaaaccacagactgatcagcgagatcctgagcgagagcgtggtgcccgacgtgagaagcgtggtgaccaccgccagaatgcaggtgctgaagagacaggtgcagagcctgatggtgcaccagagaaagctggaggccgagctgctgcagatcgaggagagacaccaggagaagaagagaaagttcctggagagcaccgacagcttcaacaacgagctgaagagactgtgcggcctgaaggtggaggtggacatggagaagatcgccgccgagatcgcccaggccgaggagcaggccagaaagagacaggaggagagagagaaggaggccgccgagcaggccgagagaagccagagcagcatcgtgcccgaggaggagcaggccgccaacaagggcgaggagaagaaggacgacgagaacatccccatggagaccgaggagacccacctggaggagaccaccgagagccagcagaacggcgaggagggcaccagcacccccgaggacaaggagagcggccaggagggcgtggacagcatggccgaggagggcaccagcgacagcaacaccggcagcgagagcaacagcgccaccgtggaggagccccccaccgaccccatccccgaggacgagaagaaggagtag

SEQ ID NO: 9707 - DNA, 474 bp, Artificial Sequence
  Description of Artificial Sequence: Synthetic coding sequence
ctgagcgagagcgtggtgcccgacgtgagaagcgtggtgaccaccgccagaatgcaggtgctgaagagacaggtgcagagcctgatggtgcaccagagaaagctggaggccgagctgctgcagatcgaggagagacaccaggagaagaagagaaagttcctggagagcaccgacagcttcaacaacgagctgaagagactgtgcggcctgaaggtggaggtggacatggagaagatcgccgccgagatcgcccaggccgaggagcaggccagaaagagacaggaggagagagagaaggaggccgccgagcaggccgagagaagccagagcagcatcgtgcccgaggaggagcaggccgccaacaagggcgaggagaagaaggacgacgagaacatccccatggagaccgagaagaactgccagctgtgccccagaaagaccctgaccagcagatacaccgacttccccgactag

SEQ ID NO: 9708 - DNA, 1026 bp, Artificial Sequence
  Description of Artificial Sequence: Synthetic coding sequence
atgccctacatgagatacagcagaaaggtgtgggaccaggtgaaggccagcaaccccgacctgaagctgtgggagatcggcaagatcatcggcggcatgtggagagacctgaccgacgaggagaagcaggagtacctgaacgagtacgaggccgagaagatcgagtacaacgagagcatgaaggcctaccacaacagccccgcctacctggcctacatcaacgccaagagcagagccgaggccgccctggaggaggagagcagacagagacagagcagaatggagaagggcgagccctacatgagcatccagcccgccgaggaccccgacgactacgacgacggcttcagcatgaagcacaccgccaccgccagattccagagaaaccacagactgatcagcgagatcctgagcgagagcgtggtgcccgacgtgagaagcgtggtgaccaccgccagaatgcaggtgctgaagagacaggtgcagagcctgatggtgcaccagagaaagctggaggccgagctgctgcagatcgaggagagacaccaggagaagaagagaaagttcctggagagcaccgacagcttcaacaacgagctgaagagactgtgcggcctgaaggtggaggtggacatggagaagatcgccgccgagatcgcccaggccgaggagcaggccagaaagagacaggaggagagagagaaggaggccgccgagcaggccgagagaagccagagcagcatcgtgcccgaggaggagcaggccgccaacaagggcgaggagaagaaggacgacgagaacatccccatggagaccgaggagacccacctggaggagaccaccgagagccagcagaacggcgaggagggcaccagcacccccgaggacaaggagagcggccaggagggcgtggacagcatggccgaggagggcaccagcgacagcaacaccggcagcgagagcaacagcgccaccgtggaggagccccccaccgaccccatccccgaggacgagaagaaggagtag

SEQ ID NO: 9709 - DNA, 708 bp, Artificial Sequence
  Description of Artificial Sequence: Synthetic coding sequence
atgcagagaagaggccagagagacctgtggagacacaacaagagctgcgccagaaacagatgccccagaccccccagagagagaggcggcgccggcttcccctgggtgagagcccagctgagcgtgagacagttcaccctgagagtgagagtgcccggccccgtgcacctgagaggcagaagccccacccccgccctggaccccctggcccccctgaaccccctgatcagaggccccagaacccccggcctgagaagatggatccagagcctggccctgctgctgcccaactgcagcagcagcagaatccccaccgtgcccagaccccacagcggcctgtgggtgcagagcgacttccccctgggcttcctgagcagaaccgagcccagactgaccagaagctgcagaggcgccttcagaagccccagacccctgcccaagagcggccaggccgacggcaccagcgaggagagcctgcacctggacatccagaagctgaaggagaagagagacatgctggacaaggagatcagccagttcgtgagcgagggctacagcgtggacgagctggaggaccacatcacccagctgcacgagtacaacgacatcaaggacgtgggccagatgctgatgggcaagctggccgtgatcagaggcgtgaccaccaaggagctgtaccccgagttcggcctggacatgaacgactag

SEQ ID NO: 9710 - DNA, 924 bp, Artificial Sequence
  Description of Artificial Sequence: Synthetic coding sequence
atgaagaacctggtggtgcccatgtgggagggcaagtggaagaccgccaagagagccagaatgaactacaaggtgaagctggaggagatcagcggcctgctggtggacgccctgtacaccaacaccatctactacctgatcaaggtggactacagagaggtgtggctgatcagactgttctacaacttcagcttcctggagaagaaccaggacttcaccttcaagatggagagccccagcgacagcgccgtggtgctgcccagcaccccccaggccagcgccaaccccagcagcccctacaccaacagcagcagaaagcagcccatgagcgccaccctgagagagagactgagaaagaccagattcagcttcaacagcagctacaacgtggtgaagagactgaaggtggagagcgaggagaacgaccagaccttcagcgagaagcccgccagcagcaccgaggagaactgcctggagttccaggagagcttcaagcacatcgacagcgagttcgaggagaacaccaacctgaagaacaccctgaagaacctgaacgtgtgcgagagccagagcctggacagcggcagctgcagcgccctgcagaacgagttcgtgagcgagaagctgcccaagcagagactgaacgccgagaaggccaagctggtgaagcaggtgcaggagaaggaggacctgctgagaagactgaagctggtgaagatgtacagaagcaagaacgacctgagccagctgcagctgctgatcaagaagtggagaagctgcagccagctgctgctgtacgagctgcagagcgccgtgagcgaggagaacaagaagctgagcctgacccagctgatcgaccactacggcctggacgacaagctgctgcactacaacagaagcgaggaggagttcatcgacgtgtag

SEQ ID NO: 9711 - DNA, 738 bp, Artificial Sequence
  Description of Artificial Sequence: Synthetic coding sequence
atggccgagggcgagaagaaccaggacttcaccttcaagatggagagccccagcgacagcgccgtggtgctgcccagcaccccccaggccagcgccaaccccagcagcccctacaccaacagcagcagaaagcagcccatgagcgccaccctgagagagagactgagaaagaccagattcagcttcaacagcagctacaacgtggtgaagagactgaaggtggagagcgaggagaacgaccagaccttcagcgagaagcccgccagcagcaccgaggagaactgcctggagttccaggagagcttcaagcacatcgacagcgagttcgaggagaacaccaacctgaagaacaccctgaagaacctgaacgtgtgcgagagccagagcctggacagcggcagctgcagcgccctgcagaacgagttcgtgagcgagaagctgcccaagcagagactgaacgccgagaaggccaagctggtgaagcaggtgcaggagaaggaggacctgctgagaagactgaagctggtgaagatgtacagaagcaagaacgacctgagccagctgcagctgctgatcaagaagtggagaagctgcagccagctgctgctgtacgagctgcagagcgccgtgagcgaggagaacaagaagctgagcctgacccagctgatcgaccactacggcctggacgacaagctgctgcactacaacagaagcgaggaggagttcatcgacgtgtag

SEQ ID NO: 9712 - DNA, 699 bp, Artificial Sequence
  Description of Artificial Sequence: Synthetic coding sequence
atggagagccccagcgacagcgccgtggtgctgcccagcaccccccaggccagcgccaaccccagcagcccctacaccaacagcagcagaaagcagcccatgagcgccaccctgagagagagactgagaaagaccagattcagcttcaacagcagctacaacgtggtgaagagactgaaggtggagagcgaggagaacgaccagaccttcagcgagaagcccgccagcagcaccgaggagaactgcctggagttccaggagagcttcaagcacatcgacagcgagttcgaggagaacaccaacctgaagaacaccctgaagaacctgaacgtgtgcgagagccagagcctggacagcggcagctgcagcgccctgcagaacgagttcgtgagcgagaagctgcccaagcagagactgaacgccgagaaggccaagctggtgaagcaggtgcaggagaaggaggacctgctgagaagactgaagctggtgaagatgtacagaagcaagaacgacctgagccagctgcagctgctgatcaagaagtggagaagctgcagccagctgctgctgtacgagctgcagagcgccgtgagcgaggagaacaagaagctgagcctgacccagctgatcgaccactacggcctggacgacaagctgctgcactacaacagaagcgaggaggagttcatcgacgtgtag

SEQ ID NO: 9713 - DNA, 1059 bp, Artificial Sequence
  Description of Artificial Sequence: Synthetic coding sequence
atgttcagaggcctgagcagctggctgggcctgcagcagcccgtggccggcggcggccagcccaacggcgacgccccccccgagcagcccagcgagaccgtggccgagagcgccgaggaggagctgcagcaggccggcgaccaggagctgctgcaccaggccaaggacttcggcaactacctgttcaacttcgccagcgccgccaccaagaagatcaccgagagcgtggccgagaccgcccagaccatcaagaagagcgtggaggagggcaagatcgacggcatcatcgacaagaccatcatcggcgacttccagaaggagcagaagaagttcgtggaggagcagcacaccaagaagagcgaggccgccgtgcccccctgggtggacaccaacgacgaggagaccatccagcagcagatcctggccctgagcgccgacaagagaaacttcctgagagacccccccgccggcgtgcagttcaacttcgacttcgaccagatgtaccccgtggccctggtgatgctgcaggaggacgagctgctgagcaagatgagattcgccctggtgcccaagctggtgaaggaggaggtgttctggagaaactacttctacagagtgagcctgatcaagcagagcgcccagctgaccgccctggccgcccagcagcaggccgccggcaaggaggagaagagcaacggcagagagcaggacctgcccctggccgaggccgtgagacccaagaccccccccgtggtgatcaagagccagctgaagacccaggaggacgaggaggagatcagcaccagccccggcgtgagcgagttcgtgagcgacgccttcgacgcctgcaacctgaaccaggaggacctgagaaaggagatggagcagctggtgctggacaagaagcaggaggagaccgccgtgctggaggaggacagcgccgactgggagaaggagctgcagcaggagctgcaggagtacgaggtggtgaccgagagcgagaagagagacgagaactgggacaaggagatcgagaagatgctgcaggaggagaactag

SEQ ID NO: 9714 - DNA, 2439 bp, Artificial Sequence
  Description of Artificial Sequence: Synthetic coding sequence
atgcaggccaagaacaaggacgccctgcagcccatcaaggaggacagaaccggcaaggcccaggacgacgccttctggctgcagagcctgatcaccgacgccttccacgacaagggcttccagaagatcaaggagtacttccagcagaaggagagccacttcccccagaagtacaacagactgctgctgtacagactggacagaagcatcaacaaggagctggacaagaacgagttccagagcgtgagcctgctgctgaagtgcatccagagattcctggtggacggcctgaaggaggacgagcccctgctgatcagacagggcctgatccccaagctggtgagctggttcgagagaaccaccggcatcctgaccagcgagggcctggccagcgacaccagcctgatctgcgtgatcgaggacttcttcgacaccgccctgatcatcagcagaagcagcagcgagggcaagatccagatgctggacagcttcctgctgagcctgggcttcctggtgaccgagaagaccgtgaaccacctgctgcagcaggagggcctgaagaccttcaactgcatcctgcacgccgtgcccagagaggagagaaagaagttccccctgagcgagggcatgtgccacctgatgaaggacctggccagaaccctgctgaccgtgggcgactacgaccagcaggtggccatcagcgaggccctgtgcagactgaccatcaagaagagcagagacgagctggtgcacaagtggttcgacgacgaggtgatcgccgaggccttcaaggagatcaaggacagagagttcgagaccgacagcagaagattcctgaaccacctgaacaacagactgggcgaccagagaagagtgtacagcttcccctgcatcgccgccttcgccgacgagcacgagatgagaaagcccgccgacgagaagctggagaagttctggatcgacttcaacctgggcagccagagcgtgaccttctacatcgacaacgccgagaacaccctgtgggacagcgtgaccctgcccaaggaggccgtgatgaacttcagcatcaccgagaccgagaagatcaagatcttcatcatctacctgaagaagcccatgatcatcagctacaaggaggtgatgaagatcgagatccacttcgacctgcagttcaacatcagccaggtgagcatccaggccctgggcgaggacaagcagatgctgcccgaccagaccaagatcagcagcgagctgttcagcaagagcgacaaggaggacagagagagccccagcggcctggagagagagaccgagcaggccgaggagagcaccaacatggtggagttcatgagcgccgaggacgacagatgcctgatcaccctgcacctgaacgaccagagcgagccccccgtgatcggcgagcccgccagcgacagccacctgcagcccgtgccccccttcggcgtgcccgacttcccccagcagcccaagagccactacagaaagcacctgttcagcgagagcaaccaggacagcagcaccagcgagctgagctggaccagcaaccagaagaagaagagcctgaagagctacagcagcagaaagaagaccagaaccagaagcaacctgagaatcctgcccgtgttcccccccagcagcggcagcggccacgagaaggaccaggccaagctgctgagccccagcgagaaggagatccccgagcagaacaacaccaccagccccaagaccagcgagcagaagttccaggacagcttcgccttcctgaccgccgaggacagcgcccagaagaccgagctgcaggacccccacagcctgagcgagctgagcagcctgaagcacagcgaggacgaggagaagcccaagatcgtgaaccaggagagcctgaccgagagcaccagcctgaagcacaagctgagaaacctggaggacaaggacatccccgagggcagcttcgccaagagccagcagagcagactggaggaggaggtggcccccggcagccccttcagcatcaccgaggagagagagctgcccgagggcatcagcaccagcagcctggaggtggtgcccgagaacctgaacggcagcgccatcctgcccaccttcgagaacttcaccaagaagagaaagagaaagtacgagctgagatacagaaagagacccttcaacagcgagaacgccaagaaggcccccgactgcctgatcaagctgctgaaccagatgcagctgttcagactgaacaagctggagagattccagaacctggtgctgcaggagctgagcagcctgaagcaggacatccaggccctggagcacctggagaaggaggtgctggagttctggggcaagcagagcgccgacctgcagagcttctgcgacctgcaggtgctgagattcaacagcacccagaccagctag

SEQ ID NO: 9715 - DNA, 867 bp, Artificial Sequence
  Description of Artificial Sequence: Synthetic coding sequence
atgctggacagcttcctgctgagcctgggcttcctggtgaccgagaagaccgtgaaccacctgctgcagcaggagggcctgaagaccttcaactgcatcctgcacgccgtgcccagagaggagagaaagaagttccccctgagcgagggcatgtgccacctgatgaaggacctggccagaaccctgctgaccgtgggcgactacgaccagcaggtggccatcagcgaggccctgtgcagactgaccatcaagaagagcagagacgagctggtgcacaagtggttcgacgacgaggtgatcgccgaggccttcaaggagatcaaggacagagagttcgagaccgacagcagaagattcctgaaccacctgaacaacagactgggcgaccagagaagagtgtacagcttcccctgcatcgccgccttcgccgacgagcacgagatgagaaagcccgccgacgagaagctggagaagttctggatcgacttcaacctgggcagccagagcgtgaccttctacatcgacaacgccgagaacaccctgtgggacagcgtgaccctgcccaaggaggccgtgatgaacttcagcatcaccgagaccgagaagatcaagatcttcatcatctacctgaagaagcccatgatcatcagctacaaggaggtgatgaagatcgagatccacttcgacctgcagttcaacatcagccaggtgagcatccaggccctgggcgaggacaagcagatgctgcccgaccagaccaagatcagcagcgagctgttcagcaagagcgacaaggaggacagagagagccccagcggcctggagagagagaccgaggtgagcctgcagaagaccagcctgctgtag

SEQ ID NO: 9716 - DNA, 1845 bp, Artificial Sequence
  Description of Artificial Sequence: Synthetic coding sequence
atgggcgactggatgaccgtgaccgaccccggcctgagcagcgagagcaagaccatcagccagtacaccagcgagaccaagatgagccccagcagcctgtacagccagcaggtgctgtgcagcagcatccccctgagcaagaacgtgcacagcttcttcagcgccttctgcaccgaggacaacatcgagcagagcatcagctacctggaccaggagctgaccaccttcggcttccccagcctgtacgaggagagcaagggcaaggagaccaagagagagctgaacatcgtggccgtgctgaactgcatgaacgagctgctggtgctgcagagaaagaacctgctggcccaggagaacgtggagacccagaacctgaagctgggcagcgacatggaccacctgcagagctgctacagcaagctgaaggagcagctggagaccagcagaagagagatgatcggcctgcaggagagagacagacagctgcagtgcaagaacagaaacctgcaccagctgctgaagaacgagaaggacgaggtgcagaagctgcagaacatcatcgccagcagagccacccagtacaaccacgacatgaagagaaaggagagagagtacaacaagctgaaggagagactgcaccagctggtgatgaacaagaaggacaagaagatcgccatggacatcctgaactacgtgggcagagccgacggcaagagaggcagctggagaaccggcaagaccgaggccagaaacgaggacgagatgtacaagatcctgctgaacgactacgagtacagacagaagcagatcctgatggagaacgccgagctgaagaaggtgctgcagcagatgaagaaggagatgatcagcctgctgagcccccagaagaagaagcccagagagagagtggacgacagcaccggcaccgtgatcagcgacgtggaggaggacgccggcgagctgagcagagagagcatgtgggacctgagctgcgagaccgtgagagagcagctgaccaacagcatcagaaagcagtggagaatcctgaagagccacgtggagaagctggacaaccaggtgagcaaggtgcacctggagggcttcaacgacgaggacgtgatcagcagacaggaccacgagcaggagaccgagaagctggagctggagatccagcagtgcaaggagatgatcaagacccagcagcagctgctgcagcagcagctggccaccgcctacgacgacgacaccaccagcctgctgagagactgctacctgctggaggagaaggagagactgaaggaggagtggagcctgttcaaggagcagaagaagaacttcgagagagagagaagaagcttcaccgaggccgccatcagactgggcctggagagaaaggccttcgaggaggagagagccagctggctgaagcagcagttcctgaacatgaccaccttcgaccaccagaacagcgagaacgtgaagctgttcagcgccttcagcggcagcagcgactgggacaacctgatcgtgcacagcagacagccccagaagaagccccacagcgtgagcaacggcagccccgtgtgcatgagcaagctgaccaagagcctgcccgccagccccagcaccagcgacttctgccagaccagaagctgcatcagcgagcacagcagcatcaacgtgctgaacatcaccgccgaggagatcaagcccaaccaggtgggcggcgagtgcaccaaccagaagtggagcgtggccagcagacccggcagccaggagggctgctacagcggctgcagcctgagctacaccaacagccacgtggagaaggacgacctgccctag

SEQ ID NO: 9717 - DNA, 1683 bp, Artificial Sequence
  Description of Artificial Sequence: Synthetic coding sequence
atgggcgactggatgaccgtgaccgaccccggcctgagcagcgagagcaagaccatcagccagtacaccagcgagaccaagatgagccccagcagcctgtacagccagcaggtgctgtgcagcagcatccccctgagcaagaacgtgcacagcttcttcagcgccttctgcaccgaggacaacatcgagcagagcatcagctacctggaccaggagctgaccaccttcggcttccccagcctgtacgaggagagcaagggcaaggagaccaagagagagctgaacatcgtggccgtgctgaactgcatgaacgagctgctggtgctgcagagaaagaacctgctggcccaggagaacgtggagacccagaacctgaagctgggcagcgacatggaccacctgcagagctgctacagcaagctgaaggagcagctggagaccagcagaagagagatgatcggcctgcaggagagagacagacagctgcagtgcaagaacagaaacctgcaccagctgctgaagaacgagaaggacgaggtgcagaagctgcagaacatcatcgccagcagagccacccagtacaaccacgacatgaagagaaaggagagagagtacaacaagctgaaggagagactgcaccagctggtgatgaacaagaaggacaagaagatcgccatggacatcctgaactacgtgggcagagccgacggcaagagaggcagctggagaaccggcaagaccgaggccagaaacgaggacgagatgtacaagatcctgctgaacgactacgagtacagacagaagcagatcctgatggagaacgccgagctgaagaaggtgctgcagcagatgaagaaggagatgatcagcctgctgagcccccagaagaagaagcccagagagagagtggacgacagcaccggcaccgtgatcagcgacgtggaggaggacgccggcgagctgagcagagagagcatgtgggacctgagctgcgagaccgtgagagagcagctgaccaacagcatcagaaagcagtggagaatcctgaagagccacgtggagaagctggacaaccaggtgagcaaggtgcacctggagggcttcaacgacgaggacgtgatcagcagacaggaccacgagcaggagaccgagaagctggagctggagatccagcagtgcaaggagatgatcaagacccagcagcagctgctgcagcagcagctggccaccgcctacgacgacgacaccaccagcctgctgagagactgctacctgctggaggagaaggagagactgaaggaggagtggagcctgttcaaggagcagaagaagaacttcgagagagagagaagaagcttcaccgaggccgccatcagactgggcctggagagaaaggccttcgaggaggagagagccagctggctgaagcagcagttcctgaacatgaccaccttcgaccaccagaacagcgagaacgtgaagctgttcagcgccttcagcggcagcagcgactgggacaacctgatcgtgcacagcagacagccccagaagaagccccacagcgtgagcaacggcagccccgtgtgcatgagcaagctgaccaagagcctgcccgccagccccagcaccagcgacttctgccagaccagaagctgcatcagcgagcacagagccaagaactag

SEQ ID NO: 9718 - DNA, 543 bp, Artificial Sequence
  Description of Artificial Sequence: Synthetic coding sequence
atgggcgactggatgaccgtgaccgaccccggcctgagcagcgagagcaagaccatcagccagtacaccagcgagaccaagatgagccccagcagcctgtacagccagcaggtgctgtgcagcagcatccccctgagcaagaacgtgcacagcttcttcagcgccttctgcaccgaggacaacatcgagcagagcatcagctacctggaccaggagctgaccaccttcggcttccccagcctgtacgaggagagcaagggcaaggagaccaagagagagctgaacatcgtggccgtgctgaactgcatgaacgagctgctggtgctgcagagaaagaacctgctggcccaggagaacgtggagacccagaacctgaagctgggcagcgacatggaccacctgcagagctgctacagcaagctgaaggagcagctggagaccagcagaagagagatgatcggcctgcaggagagagacagacagctgcagtgcaagaacagaaacctgcaccagctgctgaagaacgagaaggacgaggtgtag

SEQ ID NO: 9719 - DNA, 1764 bp, Artificial Sequence
  Description of Artificial Sequence: Synthetic coding sequence
atgagccccagcagcctgtacagccagcaggtgctgtgcagcagcatccccctgagcaagaacgtgcacagcttcttcagcgccttctgcaccgaggacaacatcgagcagagcatcagctacctggaccaggagctgaccaccttcggcttccccagcctgtacgaggagagcaagggcaaggagaccaagagagagctgaacatcgtggccgtgctgaactgcatgaacgagctgctggtgctgcagagaaagaacctgctggcccaggagaacgtggagacccagaacctgaagctgggcagcgacatggaccacctgcagagctgctacagcaagctgaaggagcagctggagaccagcagaagagagatgatcggcctgcaggagagagacagacagctgcagtgcaagaacagaaacctgcaccagctgctgaagaacgagaaggacgaggtgcagaagctgcagaacatcatcgccagcagagccacccagtacaaccacgacatgaagagaaaggagagagagtacaacaagctgaaggagagactgcaccagctggtgatgaacaagaaggacaagaagatcgccatggacatcctgaactacgtgggcagagccgacggcaagagaggcagctggagaaccggcaagaccgaggccagaaacgaggacgagatgtacaagatcctgctgaacgactacgagtacagacagaagcagatcctgatggagaacgccgagctgaagaaggtgctgcagcagatgaagaaggagatgatcagcctgctgagcccccagaagaagaagcccagagagagagtggacgacagcaccggcaccgtgatcagcgacgtggaggaggacgccggcgagctgagcagagagagcatgtgggacctgagctgcgagaccgtgagagagcagctgaccaacagcatcagaaagcagtggagaatcctgaagagccacgtggagaagctggacaaccaggtgagcaaggtgcacctggagggcttcaacgacgaggacgtgatcagcagacaggaccacgagcaggagaccgagaagctggagctggagatccagcagtgcaaggagatgatcaagacccagcagcagctgctgcagcagcagctggccaccgcctacgacgacgacaccaccagcctgctgagagactgctacctgctggaggagaaggagagactgaaggaggagtggagcctgttcaaggagcagaagaagaacttcgagagagagagaagaagcttcaccgaggccgccatcagactgggcctggagagaaaggccttcgaggaggagagagccagctggctgaagcagcagttcctgaacatgaccaccttcgaccaccagaacagcgagaacgtgaagctgttcagcgccttcagcggcagcagcgactgggacaacctgatcgtgcacagcagacagccccagaagaagccccacagcgtgagcaacggcagccccgtgtgcatgagcaagctgaccaagagcctgcccgccagccccagcaccagcgacttctgccagaccagaagctgcatcagcgagcacagcagcatcaacgtgctgaacatcaccgccgaggagatcaagcccaaccaggtgggcggcgagtgcaccaaccagaagtggagcgtggccagcagacccggcagccaggagggctgctacagcggctgcagcctgagctacaccaacagccacgtggagaaggacgacctgccctag

SEQ ID NO: 9720 - DNA, 1515 bp, Artificial Sequence
  Description of Artificial Sequence: Synthetic coding sequence
atgggcgactggatgaccgtgaccgaccccgagagcaagaccatcagccagtacaccagcgagaccaagatgagccccagcagcctgtacagccagcaggtgctgtgcagcagcatccccctgagcaagaacgtgcacagcttcttcagcgccttctgcaccgaggacaacatcgagcagagcatcagctacctggaccaggagctgaccaccttcggcttccccagcctgtacgaggagagcaagggcaaggagaccaagagagagctgaacatcgtggccgtgctgaactgcatgaacgagctgctggtgctgcagagaaagaacctgctggcccaggagaacgtggagacccagaacctgaagctgggcagcgacatggaccacctgcagagctgctacagcaagctgaaggagcagctggagaccagcagaagagagatgatcggcctgcaggagagagacagacagctgcagtgcaagaacagaaacctgcaccagctgctgaagaacgagaaggacgaggtgcagaagctgcagaacatcatcgccagcagagccacccagtacaaccacgacatgaagagaaaggagagagagtacaacaagctgaaggagagactgcaccagctggtgatgaacaagaaggacaagaagatcgccatggacatcctgaactacgtgggcagagccgacggcaagagaggcagctggagaaccggcaagaccgaggccagaaacgaggacgagatgtacaagatcctgctgaacgactacgagtacagacagaagcagatcctgatggagaacgccgagctgaagaaggtgctgcagcagatgaagaaggagatgatcagcctgctgagcccccagaagaagaagcccagagagagagtggacgacagcaccggcaccgtgatcagcgacgtggaggaggacgccggcgagctgagcagagagagcatgtgggacctgagctgcgagaccgtgagagagcagctgaccaacagcatcagaaagcagtggagaatcctgaagagccacgtggagaagctggacaaccaggtgagcaaggtgcacctggagggcttcaacgacgaggacgtgatcagcagacaggaccacgagcaggagaccgagaagctggagctggagatccagcagtgcaaggagatgatcaagacccagcagcagctgctgcagcagcagctggccaccgcctacgacgacgacaccaccagcctgctgagagactgctacctgctggaggagaaggagagactgaaggaggagtggagcctgttcaaggagcagaagaagaacttcgagagagagagaagaagcttcaccgaggccgccatcagactgggcctggagatcggcttcctgctgctgagcgtgctgcacaagaagagcctgctgggcatccaccacagcagcaccgtgagcagatgcggcgtgagaagacagtgcaaccaggactacatctgctgcctgaagaagaagggcatctag

SEQ ID NO: 9721 - DNA, 672 bp, Artificial Sequence
  Description of Artificial Sequence: Synthetic coding sequence
atgaacggcgacgacgccttcgccagaagacccaccgtgggcgcccagatccccgagaagatccagaaggccttcgacgacatcgccaagtacttcagcaaggaggagtgggagaagatgaaggccagcgagaagatcttctacgtgtacatgaagagaaagtacgaggccatgaccaagctgggcttcaaggccaccctgccccccttcatgtgcaacaagagagccgaggacttccagggcaacgacctggacaacgaccccaacagaggcaaccaggtggagagaccccagatgaccttcggcagactgcagggcatcagccccaagatcatgcccaagaagcccgccgaggagggcaacgacagcgaggaggtgcccgaggccagcggcccccagaacgacggcaaggagctgtgcccccccggcaagcccaccaccagcgagaagatccacgagagaagcggcaacagagaggcccaggagaaggaggagagaagaggcaccgcccacagatggagcagccagaacacccacaacatcggcagattcagcctgagcaccagcatgggcgccgtgcacggcacccccaagaccatcacccacaacagagaccccaagggcggcaacatgcccggccccaccgactgcgtgagagagaacagctggtag

SEQ ID NO: 9722 - DNA, 567 bp, Artificial Sequence
  Description of Artificial Sequence: Synthetic coding sequence
atgaacggcgacgacgccttcgccagaagacccaccgtgggcgcccagatccccgagaagatccagaaggccttcgacgacatcgccaagtacttcagcaaggaggagtgggagaagatgaaggccagcgagaagatcttctacgtgtacatgaagagaaagtacgaggccatgaccaagctgggcttcaaggccaccctgccccccttcatgtgcaacaagagagccgaggacttccagggcaacgacctggacaacgaccccaacagaggcaaccaggtggagagaccccagatgaccttcggcagactgcagggcatcagccccaagatcatgcccaagaagcccgccgaggagggcaacgacagcgaggaggtgcccgaggccagcggcccccagaacgacggcaaggagctgtgcccccccggcaagcccaccaccagcgagaagatccacgagagaagcggccccaagagaggcgagcacgcctggacccacagactgagagagagaaagcagctggtgatctacgaggagatcagcgaccccgaggaggacgacgagtag

SEQ ID NO: 9723 - DNA, 567 bp, Artificial Sequence
  Description of Artificial Sequence: Synthetic coding sequence
atgaacggcgacgacgccttcgccagaagacccagagacgacgcccagatcagcgagaagctgagaaaggccttcgacgacatcgccaagtacttcagcaagaaggagtgggagaagatgaagagcagcgagaagatcgtgtacgtgtacatgaagctgaactacgaggtgatgaccaagctgggcttcaaggtgaccctgccccccttcatgagaagcaagagagccgccgacttccacggcaacgacttcggcaacgacagaaaccacagaaaccaggtggagagaccccagatgaccttcggcagcctgcagagaatcttccccaagatcatgcccaagaagcccgccgaggaggagaacggcctgaaggaggtgcccgaggccagcggcccccagaacgacggcaagcagctgtgcccccccggcaaccccagcaccctggagaagatcaacaagaccagcggccccaagagaggcaagcacgcctggacccacagactgagagagagaaagcagctggtggtgtacgaggagatcagcgaccccgaggaggacgacgagtag

SEQ ID NO: 9724 - DNA, 462 bp, Artificial Sequence
  Description of Artificial Sequence: Synthetic coding sequence
atgaacggcgacgacgccttcgccagaagacccagagacgacgcccagatcagcgagaagctgagaaaggccttcgacgacatcgccaagtacttcagcaagaaggagtgggagaagatgaagagcagcgagaagatcgtgtacgtgtacatgaagctgaactacgaggtgatgaccaagctgggcttcaaggtgaccctgccccccttcatgagaagcaagagagccgccgacttccacggcaacgacttcggcaacgacagaaaccacagaaaccaggtggagagaccccagatgaccttcggcagcctgcagagaatcttccccaaggaccccaagggcggcaacatgcccggccccaccgactgcgtgagagagagcagctggtggttcatgaagagaagcgccaccctgagaaagatgaccagcaacagccccagaggctacgacacctgcccctag

SEQ ID NO: 9725 - DNA, 690 bp, Artificial Sequence
  Description of Artificial Sequence: Synthetic coding sequence
atgaacggcgacgacgccttcgtgagaagacccagagtgggcagccagatccccgagaagatgcagaagcacccctggagacaggtgtgcgacagaggcatccacctggtgaacctgagccccttctggaaggtgggcagagagcccgccagcagcatcaaggccctgctgtgcggcagaggcgaggccagagccttcgacgacatcgccaagtacttcagcgagaaggagtgggagaagatgaaggccagcgagaagatcatctacgtgtacatgaagagaaagtacgaggccatgaccaagctgggcttcaaggccaccctgccccccttcatgagaaacaagagagtggccgacttccagggcaacgacttcgacaacgaccccaacagaggcaaccaggtggagcacccccagatgaccttcggcagactgcagggcatcttccccaagatcacccccgagaagcccgccgaggagggcaacgacagcaagggcgtgcccgaggccagcggcccccagaacaacggcaagcagctgagacccagcggcaagctgaacaccagcgagaaggtgaacaagaccagcggccccaagagaggcaagcacgcctggacccacagagtgagagagagaaagcagctggtgatctacgaggagatcagcgacccccaggaggacgacgagtag

SEQ ID NO: 9726 - DNA, 567 bp, Artificial Sequence
  Description of Artificial Sequence: Synthetic coding sequence
atgaacggcgacgacgccttcgtgagaagacccagagtgggcagccagatccccgagaagatgcagaaggccttcgacgacatcgccaagtacttcagcgagaaggagtgggagaagatgaaggccagcgagaagatcatctacgtgtacatgaagagaaagtacgaggccatgaccaagctgggcttcaaggccaccctgccccccttcatgagaaacaagagagtggccgacttccagggcaacgacttcgacaacgaccccaacagaggcaaccaggtggagcacccccagatgaccttcggcagactgcagggcatcttccccaagatcacccccgagaagcccgccgaggagggcaacgacagcaagggcgtgcccgaggccagcggcccccagaacaacggcaagcagctgagacccagcggcaagctgaacaccagcgagaaggtgaacaagaccagcggccccaagagaggcaagcacgcctggacccacagagtgagagagagaaagcagctggtgatctacgaggagatcagcgacccccaggaggacgacgagtag

SEQ ID NO: 9727 - DNA, 567 bp, Artificial Sequence; identical to SEQ ID NO: 9726
  Description of Artificial Sequence: Synthetic coding sequence

SEQ ID NO: 9728 - DNA, 387 bp, Artificial Sequence
  Description of Artificial Sequence: Synthetic coding sequence
ctgatcaccagcgccgccgagtgcccccacgccaccgaggtgagcctggagttcggcaacctgtaccagcagagaaagatcctgatgtacagcctgagcgtggagcacccccagatgaccttcggcagactgcagggcatcttccccaagatcacccccgagaagcccgccgaggagggcaacgacagcaagggcgtgcccgaggccagcggcccccagaacaacggcaagcagctgagacccagcggcaagctgaacaccagcgagaaggtgaacaagaccagcggccccaagagaggcaagcacgcctggacccacagagtgagagagagaaagcagctggtgatctacgaggagatcagcgacccccaggaggacgacgagtag

SEQ ID NO: 9729 - DNA, 273 bp, Artificial Sequence
  Description of Artificial Sequence: Synthetic coding sequence
atgaccttcggcagactgcagagaatcatccccaagatcatgcccgagaagcccgccgaggagggcagcgacagcaagggcgtgcccgaggccagcggcccccagaacgacggcaagaagctgtgcccccccggcaaggccagcagcagcgagaagatccacgagagaagcggccccaagagaggcaagcacgcctggacccacagactgagagagagaaagcagctggtgatctacgaggagatcagcgaccccgaggaggacgacaagtag

SEQ ID NO: 9730 - DNA, 567 bp, Artificial Sequence
  Description of Artificial Sequence: Synthetic coding sequence
atgaacggcgacgacgccttcgccaagagacccagagacgacgccaaggccagcgagaagagaagcaaggccttcgacgacatcgccaagtacttcagcaaggaggagtgggagaagatgaagttcagcgagaagatcagctgcgtgcacatgaagagaaagtacgaggccatgaccaagctgggcttcaacgtgaccctgagcctgttcatgagaaacaagagagccaccgacagccagagaaacgacagcgacaacgacagaaacagaggcaacgaggtggagagaccccagatgaccttcggcagactgcagagaatcatccccaagatcatgcccgagaagcccgccgaggagggcagcgacagcaagggcgtgcccgaggccagcggcccccagaacgacggcaagaagctgtgcccccccggcaaggccagcagcagcgagaagatccacgagagaagcggccccaagagaggcaagcacgcctggacccacagactgagagagagaaagcagctggtgatctacgaggagatcagcgaccccgaggaggacgacaagtag

SEQ ID NO: 9731 - DNA, 567 bp, Artificial Sequence
  Description of Artificial Sequence: Synthetic coding sequence
atgaacggcgacgacgccttcgccagaagacccagagccggcgcccagatccccgagaagatccagaagagcttcgacgacatcgccaagtacttcagcaagaaggagtgggagaagatgaagagcctggagaagatcagctacgtgtacatgaagagaaagtacgaggccatgaccaagctgggcttcaaggccaccctgccccccttcatgcacaacaccggcgccaccgacctgcagggcaacgacttcgacaacgacagaaaccagggcaaccaggtggagagaccccagatgaccttctgcagactgcagagaatcttccccaagatcatgcccaagaagcccgccgaggagggcaacgacagcaagggcgtgcccgaggccagcggcagccagaacgacggcaagcacctgtgcccccccggcaagcccagcaccagcgagaagatcaacaagaccagcggccccaagagaggcaagcacgcctggacccacagactgagagagagaaagcagctggtgatctacgaggagatcagcgaccccgaggaggacgacgagtag

SEQ ID NO: 9732 - DNA, 567 bp, Artificial Sequence
  Description of Artificial Sequence: Synthetic coding sequence
atgaacggcgacgacgccttcgccagaagacccagagccggcagccagatccccgagaagatccagaaggccttcgacgacatcgccaagtacttcagcaagaaggagtgggagaagatgaagagcagcgagaagatcatctacgtgtacatgaagagaaagtacgaggccatgaccaagctgggcttcaaggccaccctgccccccttcatgtgcaacaccggcgccaccgacctgcagggcaacgacttcgacaacgacagaaaccacagaaaccaggtggagagaagccagatgaccttcggcagactgcagggcatcttccccaagatcatgcccaagaagcccgccgaggtgggcaacgacagcaaggaggtgcccgaggccagcggcctgcagaacgacggcaagcagctgtgcccccccggcaagcccaccaccagcgagaagatcaacaaggccagcggccccaagagaggcaagcacgcctggacccacagactgagagagagaaagcagctggtgatctacgaggagatcagcgaccccgaggaggacgacgagtag

SEQ ID NO: 9733 - DNA, 567 bp, Artificial Sequence; identical to SEQ ID NO: 9732
  Description of Artificial Sequence: Synthetic coding sequence

SEQ ID NO: 9734 - DNA, 5481 bp, Artificial Sequence
  Description of Artificial Sequence: Synthetic coding sequence
atgagacccggctgcgacctgctgctgagagccgccgccaccgtgaccgccgccatcatgagcgacagcgacagcgaggaggacagcagcggcggcggccccttcaccctggccggcatcctgttcggcaacatcagcggcgccggccagctggagggcgagagcgtgctggacgacgagtgcaagaagcacctggccggcctgggcgccctgggcctgggcagcctgatcaccgagctgaccgccaacgaggagctgaccggcaccggcggcgccctggtgaacgacgagggctggatcagaagcaccgaggacgccgtggactacagcgacatcaacgaggtggccgaggacgagagccagagacaccagcagaccatgggcagcctgcagcccctgtaccacagcgactacgacgaggacgactacgacgccgactgcgaggacatcgactgcaagctgatgcccccccccccccccccccccggccccatgaagaaggacaaggaccaggacgccatcacctgcgtgagcgagagcggcgaggacatcatcctgcccagcatcatcgcccccagcttcctggccagcgagaaggtggacttcagcagctacagcgacagcgagagcgagatgggcccccaggaggccacccaggccgagagcgaggacggcaagctgaccctgcccctggccggcatcatgcagcacgacgccaccaagctgctgcccagcgtgaccgagctgttccccgagttcagacccggcaaggtgctgagattcctgcacctgttcggccccggcaagaacgtgcccagcgtgtggagaagcgccagaagaaagagaaagaagcacagagagctgatccaggaggagcagatccaggaggtggagtgcagcgtggagagcgaggtgagccagaagagcctgtggaactacgactacgcccccccccccccccccgagcagtgcctggccgacgacgagatcaccatgatggtgcccgtggagagcaagttcagccagagcaccggcgacgtggacaaggtgaccgacaccaagcccagagtggccgagtggagatacggccccgccagactgtggtacgacatgctgggcgtgagcgaggacggcagcggcttcgactacggcttcaagctgagaaagacccagcacgagcccgtgatcaagagcagaatgatggaggagttcagaaagctggaggagagcaacggcaccgacctgctggccgacgagaacttcctgatggtgacccagctgcactgggaggacagcatcatctgggacggcgaggacatcaagcacaagggcaccaagccccagggcgccagcctggccggctggctgcccagcatcaagaccagaaacgtgatggcctacaacgtgcagcagggcttcgcccccaccctggacgacgacaagccctggtacagcatcttccccatcgacaacgaggacctggtgtacggcagatgggaggacaacatcatctgggacgcccaggccatgcccagactgctggagccccccgtgctggccctggaccccaacgacgagaacctgatcctggagatccccgacgagaaggaggaggccaccagcaacagccccagcaaggagagcaagaaggagagcagcctgaagaagagcagaatcctgctgggcaagaccggcgtgatcagagaggagccccagcagaacatgagccagcccgaggtgaaggacccctggaacctgagcaacgacgagtactacttccccaagcagcagggcctgagaggcaccttcggcggcaacatcatccagcacagcatccccgccatggagctgtggcagcccttcttccccacccacatgggccccatcaagatcagacagttccacagaccccccctgaagaagtacagcttcggcgccctgagccagcccggcccccacagcgtgcagcccctgctgaagcacatcaagaagaaggccaagatgagagagcaggagagacaggccagcggcggcggcgagctgttcttcatgagaaccccccaggacctgaccggcaaggacggcgacctgatcctggccgagtacagcgaggagaacggccccctgatgatgcaggtgggcatggccaccaagatcaagaactactacaagagaaagcccggcaaggaccccggcgcccccgactgcaagtacggcgagaccgtgtactgccacaccagccccttcctgggcagcctgcaccccggccagctgctgcaggccctggagaacaacctgttcagagcccccgtgtacctgcacaagatgcccgagaccgacttcctgatcatcagaaccagacagggctactacatcagagagctggtggacatcttcgtggtgggccagcagtgccccctgttcgaggtgcccggccccaacagcagaagagccaacatgcacatcagagacttcctgcaggtgttcatctacagactgttctggaagagcaaggacagacccagaagaatcagaatggaggacatcaagaaggccttccccagccacagcgagagcagcatcagaaagagactgaagctgtgcgccgacttcaagagaaccggcatggacagcaactggtgggtgctgaagagcgacttcagactgcccaccgaggaggagatcagagccaaggtgagccccgagcagtgctgcgcctactacagcatgatcgccgccaagcagagactgaaggacgccggctacggcgagaagagcttcttcgcccccgaggaggagaacgaggaggacttccagatgaagatcgacgacgaggtgcacgccgccccctggaacaccaccagagccttcatcgccgccatgaagggcaagtgcctgctggaggtgaccggcgtggccgaccccaccggctgcggcgagggcttcagctacgtgaagatccccaacaagcccacccagcagaaggacgacaaggagccccaggccgtgaagaagaccgtgaccggcaccgacgccgacctgagaagactgagcctgaagaacgccaagcagctgctgagaaagttcggcgtgcccgaggaggagatcaagaagctgagcagatgggaggtgatcgacgtggtgagaaccatgagcaccgagcaggcccacagcggcgagggccccatgagcaagttcgccagaggcagcagattcagcgtggccgagcaccaggagagatacaaggaggagtgccagagaatcttcgacctgcagaacaaggtgctgagcagcaccgaggtgctgagcaccgacaccgacagcatcagcgccgaggacagcgacttcgaggagatgggcaagaacatcgagaacatgctgcagaacaagaagaccagcagccagctgagcagagagtgggaggagcaggagagaaaggagctgagaagaatgctgctggtggccggcagcgccgccagcggcaacaaccacagagacgacgtgaccgccagcatgaccagcctgaagagcagcgccaccggccactgcctgaagatctacagaaccttcagagacgaggagggcaaggagtacgtgagatgcgagaccgtgagaaagcccgccgtgatcgacgcctacgtgagaatcagaaccaccaaggacgagaagttcatccagaagttcgccctgttcgacgagaagcacagagaggagatgagaaaggagagaagaagaatccaggagcagctgagaagactgaagagaaaccaggagaaggagaagctgaagggcccccccgagaagaagcccaagaagatgaaggagagacccgacctgaagctgaagtgcggcgcctgcggcgccatcggccacatgagaaccaacaagttctgccccctgtactaccagaccaacgtgccccccagcaagcccgtggccatgaccgaggagcaggaggaggagctggagaagaccgtgatccacaacgacaacgaggagctgatcaaggtggagggcaccaagatcgtgttcggcaagcagctgatcgagaacgtgcacgaggtgagaagaaagagcctggtgctgaagttccccaagcagcagctgccccccaagaagaagagaagagtgggcaccaccgtgcactgcgactacctgaacatcccccacaagagcatccacagaagaagaaccgaccccatggtgaccctgagcagcatcctggagagcatcatcaacgacatgagagacctgcccaacacccaccccttccacacccccgtgaacgccaaggtggtgaaggactactacaagatcatcaccagacccatggacctgcagaccctgagagagaacgtgagaaagtgcctgtaccccagcagagaggagttcagagagcacctggagctgatcgtgaagaacagcgccacctacaacggccccaagcacagcctgacccagatcagccagagcatgctggacctgtgcgacgagaagctgaaggagaaggaggacaagctggccagactggagaaggccatcaaccccctgctggacgacgacgaccaggtggccttcagcttcatcctggacaacatcgtgacccagaagatgatggccgtgcccgacagctggcccttccaccaccccgtgaacaagaagttcgtgcccgactactacaagatgatcgtgaaccccgtggacctggagaccatcagaaagaacatcagcaagcacaagtaccagagcagagagagcttcctggacgacgtgaacctgatcctggccaacagcgtgaagtacaacggccccgagagccagtacaccaagaccgcccaggagatcgtgaacatctgctaccagaccatcaccgagtacgacgagcacctgacccagctggagaaggacatctgcaccgccaaggaggccgccctggaggaggccgagctggagagcctggaccccatgacccccggcccctacaccagccagccccccgacatgtacgacaccaacaccagcctgagcaccagcagagacgccagcgtgttccaggacgagagcaacctgagcgtgctggacatcagcaccgccacccccgagaagcagatgtgccagggccagggcagactgggcgaggaggacagcgacgtggacgtggagggctacgacgacgaggaggaggacggcaagcccaagccccccgcccccgagggcggcgacggcgacctggccgacgaggaggagggcaccgtgcagcagcccgaggccagcgtgctgtacgaggacctgctgatcagcgagggcgaggacgacgaggaggacgccggcagcgacgaggagggcgacaaccccttcagcgccatccagctgagcgagagcggcagcgacagcgacgtgggctacggcggcatcagacccaagcagcccttcatgctgcagcacgccagcggcgagcacaaggacggccacggcaagtag

SEQ ID NO: 9735 - DNA, 375 bp, Artificial Sequence
  Description of Artificial Sequence: Synthetic coding sequence
atggccgacgaggaggaggaccccaccttcgaggaggagaacgaggagatcggcggcggcgccgagggcggccagggcaagagaaagagactgttcagcaaggagctgagatgcatgatgtacggcttcggcgacgaccagaacccctacaccgagagcgtggacatcctggaggacctggtgatcgagttcatcaccgagatgacccacaaggccatgagcatcggcagacagggcagagtgcaggtggaggacatcgtgttcctgatcagaaaggaccccagaaagttcgccagagtgaaggacctgctgaccatgaacgaggagctgaagagagccagaaaggccttcgacgaggccaactacggcagctag

SEQ ID NO: 9736 - DNA, 375 bp, Artificial Sequence; identical to SEQ ID NO: 9735
  Description of Artificial Sequence: Synthetic coding sequence

SEQ ID NO: 9737 - DNA, 3600 bp, Artificial Sequence
  Description of Artificial Sequence: Synthetic coding sequence
atgcccctgaccggcgtggagcccgccagaatgaacagaaagaagggcgacaagggcttcgagagccccagaccctacaagctgacccaccaggtggtgtgcatcaacaacatcaacttccagagaaagagcgtggtgggcttcgtggagctgaccatcttccccaccgtggccaacctgaacagaatcaagctgaacagcaagcagtgcagaatctacagagtgagaatcaacgacctggaggccgccttcatctacaacgaccccaccctggaggtgtgccacagcgagagcaagcagagaaacctgaactacttcagcaacgcctacgccgccgccgtgagcgccgtggaccccgacgccggcaacggcgagctgtgcatcaaggtgcccagcgagctgtggaagcacgtggacgagctgaaggtgctgaagatccacatcaacttcagcctggaccagcccaagggcggcctgcacttcgtggtgcccagcgtggagggcagcatggccgagagaggcgcccacgtgttcagctgcggctaccagaacagcaccagattctggttcccctgcgtggacagctacagcgagctgtgcacctggaagctggagttcaccgtggacgccgccatggtggccgtgagcaacggcgacctggtggagaccgtgtacacccacgacatgagaaagaagaccttccactacatgctgaccatccccaccgccgccagcaacatcagcctggccatcggccccttcgagatcctggtggacccctacatgcacgaggtgacccacttctgcctgccccagctgctgcccctgctgaagcacaccaccagctacctgcacgaggtgttcgagttctacgaggagatcctgacctgcagatacccctacagctgcttcaagaccgtgttcatcgacgaggcctacgtggaggtggccgcctacgccagcatgagcatcttcagcaccaacctgctgcacagcgccatgatcatcgacgagacccccctgaccagaagatgcctggcccagagcctggcccagcagttcttcggctgcttcatcagcagaatgagctggagcgacgagtgggtgctgaagggcatcagcggctacatctacggcctgtggatgaagaagaccttcggcgtgaacgagtacagacactggatcaaggaggagctggacaagatcgtggcctacgagctgaagaccggcggcgtgctgctgcaccccatcttcggcggcggcaaggagaaggacaaccccgccagccacctgcacttcagcatcaagcacccccacaccctgagctgggagtactacagcatgttccagtgcaaggcccacctggtgatgagactgatcgagaacagaatcagcatggagttcatgctgcaggtgttcaacaagctgctgagcctggccagcaccgccagcagccagaagttccagagccacatgtggagccagatgctggtgagcaccagcggcttcctgaagagcatcagcaacgtgagcggcaaggacatccagcccctgatcaagcagtgggtggaccagagcggcgtggtgaagttctacggcagcttcgccttcaacagaaagagaaacgtgctggagctggagatcaagcaggactacaccagccccggcacccagaagtacgtgggccccctgaaggtgaccgtgcaggagctggacggcagcttcaaccacaccctgcagatcgaggagaacagcctgaagcacgacatcccctgccacagcaagagcagaagaaacaagaagaagaagatccccctgatgaacggcgaggaggtggacatggacctgagcgccatggacgccgacagccccctgctgtggatcagaatcgaccccgacatgagcgtgctgagaaaggtggagttcgagcaggccgacttcatgtggcagtaccagctgagatacgagagagacgtggtggcccagcaggagagcatcctggccctggagaagttccccacccccgccagcagactggccctgaccgacatcctggagcaggagcagtgcttctacagagtgagaatgagcgcctgcttctgcctggccaagatcgccaacagcatggtgagcacctggaccggcccccccgccatgaagagcctgttcaccagaatgttctgctgcaagagctgccccaacatcgtgaagaccaacaacttcatgagcttccagagctacttcctgcagaagaccatgcccgtggccatggccctgctgagagacgtgcacaacctgtgccccaaggaggtgctgaccttcatcctggacctgatcaagtacaacgacaacagaaagaacaagttcagcgacaactactacagagccgagatgatcgacgccctggccaacagcgtgacccccgccgtgagcgtgaacaacgaggtgagaaccctggacaacctgaaccccgacgtgagactgatcctggaggagatcaccagattcctgaacatggagaagctgctgcccagctacagacacaccatcaccgtgagctgcctgagagccatcagagtgctgcagaagaacggccacgtgcccagcgaccccgccctgttcaagagctacgccgagtacggccacttcgtggacatcagaatcgccgccctggaggccgtggtggactacaccaaggtggacagaagctacgaggagctgcagtggctgctgaacatgatccagaacgaccccgtgccctacgtgagacacaagatcctgaacatgctgaccaagaacccccccttcaccaagaacatggagagccccctgtgcaacgaggccctggtggaccagctgtggaagctgatgaacagcggcaccagccacgactggagactgagatgcggcgccgtggacctgtacttcaccctgttcggcctgagcagacccagctgcctgcccctgcccgagctgggcctggtgctgaacctgaaggagaagaaggccgtgctgaaccccaccatcatccccgagagcgtggccggcaaccaggaggccgccaacaaccccagcagccacccccagctggtgggcttccagaaccccttcagcagcagccaggacgaggaggagatcgacatggacaccgtgcacgacagccaggccttcatcagccaccacctgaacatgctggagagacccagcacccccggcctgagcaagtacagacccgccagcagcagaagcgccctgatcccccagcacagcgccggctgcgacagcacccccaccaccaagccccagtggagcctggagctggccagaaagggcaccggcaaggagcaggcccccctggagatgagcatgcaccccgccgccagcgcccccctgagcgtgttcaccaaggagagcaccgccagcaagcacagcgaccaccaccaccaccaccaccacgagcacaagaagaagaagaagaagcacaagcacaagcacaagcacaagcacaagcacgacagcaaggagaaggacaaggagcccttcaccttcagcagccccgccagcggcagaagcatcagaagccccagcctgagcgactag

SEQ ID NO: 9738 - DNA, 1770 bp, Artificial Sequence
  Description of Artificial Sequence: Synthetic coding sequence
atgaagagagtgagaaccgagcagatccagatggccgtgagctgctacctgaagagaagacagtacgtggacagcgacggccccctgaagcagggcctgagactgagccagaccgccgaggagatggccgccaacctgaccgtgcagagcgagagcggctgcgccaacatcgtgagcgccgccccctgccaggccgagccccagcagtacgaggtgcagttcggcagactgagaaacttcctgaccgacagcgacagccagcacagccacgaggtgatgcccctgctgtaccccctgttcgtgtacctgcacctgaacctggtgcagaacagccccaagagcaccgtggagagcttctacagcagattccacggcatgttcctgcagaacgccagccagaaggacgtgatcgagcagctgcagaccacccagaccatccaggacatcctgagcaacttcaagctgagagccttcctggacaacaagtacgtggtgagactgcaggaggacagctacaactacctgatcagatacctgcagagcgacaacaacaccgccctgtgcaaggtgctgaccctgcacatccacctggacgtgcagcccgccaagagaaccgactaccagctgtacgccagcggcagcagcagcagaagcgagaacaacggcctggagccccccgacatgcccagccccatcctgcagaacgaggccgccctggaggtgctgcaggagagcatcaagagagtgaaggacggcccccccagcctgaccaccatctgcttctacgccttctacaacaccgagcagctgctgaacaccgccgagatcagccccgacagcaagctgctggccgccggcttcgacaacagctgcatcaagctgtggagcctgagaagcaagaagctgaagagcgagccccaccaggtggacgtgagcagaatccacctggcctgcgacatcctggaggaggaggacgacgaggacgacaacgccggcaccgagatgaagatcctgagaggccactgcggccccgtgtacagcaccagattcctggccgacagcagcggcctgctgagctgcagcgaggacatgagcatcagatactgggacctgggcagcttcaccaacaccgtgctgtaccagggccacgcctaccccgtgtgggacctggacatcagcccctacagcctgtacttcgccagcggcagccacgacagaaccgccagactgtggagcttcgacagaacctaccccctgagaatctacgccggccacctggccgacgtggactgcgtgaagttccaccccaacagcaactacctggccaccggcagcaccgacaagaccgtgagactgtggagcgcccagcagggcaacagcgtgagactgttcaccggccacagaggccccgtgctgagcctggccttcagccccaacggcaagtacctggccagcgccggcgaggaccagagactgaagctgtgggacctggccagcggcaccctgtacaaggagctgagaggccacaccgacaacatcaccagcctgaccttcagccccgacagcggcctgatcgccagcgccagcatggacaacagcgtgagagtgtgggacatcagaaacacctactgcagcgcccccgccgacggcagcagcagcgagctggtgggcgtgtacaccggccagatgagcaacgtgctgagcgtgcagttcatggcctgcaacctgctgctggtgaccggcatcacccaggagaaccaggagcactag

SEQ ID NO: 9739 - DNA, 255 bp, Artificial Sequence
  Description of Artificial Sequence: Synthetic coding sequence
atgaagagagtgagaaccgagcagatccagatggccgtgagctgctacctgaagagaagacagtacgtggacagcgacggccccctgaagcagggcctgagactgagccagaccgccgaggagatggccgccaacctgaccggcaacggcggcggcagcagcggcggcgtgagcctggagcaggagaacagcagacagtacccctgcggcatcaccagccccctgctgaagaccgtgcccgagagagccgactag

SEQ ID NO: 9740 - DNA, 978 bp, Artificial Sequence
  Description of Artificial Sequence: Synthetic coding sequence
atgaagagagtgagaaccgagcagatccagatggccgtgagctgctacctgaagagaagacagtacgtggacagcgacggccccctgaagcagggcctgagactgagccagaccgccgaggagatggccgccaacctgaccgtgcagagcgagagcggctgcgccaacatcgtgagcgccgccccctgccaggccgagccccagcagtacgaggtgcagttcggcagactgagaaacttcctgaccgacagcgacagccagcacagccacgaggtgatgcccctgctgtaccccctgttcgtgtacctgcacctgaacctggtgcagaacagccccaagagcaccgtggagagcttctacagcagattccacggcatgttcctgcagaacgccagccagaaggacgtgatcgagcagctgcagaccacccagaccatccaggacatcctgagcaacttcaagctgagagccttcctggacaacaagtacgtggtgagactgcaggaggacagctacaactacctgatcagatacctgcagagcgacaacaacaccgccctgtgcaaggtgctgaccctgcacatccacctggacgtgcagcccgccaagagaaccgactaccagctgtacgccagcggcagcagcagcagaagcgagaacaacggcctggagccccccgacatgcccagccccatcctgcagaacgaggccgccctggaggtgctgcaggagagcatcaagagagtgaaggacggcccccccagcctgaccaccatctgcttctacgccttctacaacaccgagcagctgctgaacaccgccgagatcagccccgacagcaagctgctggccgccggcttcgacaacagctgcatcaagctgtggagcctgagaagcaagaagctgaagagcgagccccaccaggtggacgtgagcagaatccacctggcctgcgacatcctggaggaggaggtgtag

SEQ ID NO: 9741 - DNA, 1770 bp, Artificial Sequence; identical to SEQ ID NO: 9738
  Description of Artificial Sequence: Synthetic coding sequence

SEQ ID NO: 9742 - DNA, 1869 bp, Artificial Sequence
  Description of Artificial Sequence: Synthetic coding sequence
atgagcgagagagaggagagaagattcgtggagatccccagagagagcgtgagactgatggccgagagcaccggcctggagctgagcgacgaggtggccgccctgctggccgaggacgtgtgctacagactgagagaggccacccagaacagcagccagttcatgaagcacaccaagagaagaaagctgaccgtggaggacttcaacagagccctgagatggagcagcgtggaggccgtgtgcggctacggcagccaggaggccctgcccatgagacccgccagagagggcgagctgtacttccccgaggacagagaggtgaacctggtggagctggccctggccaccaacatccccaagggctgcgccgagaccgccgtgagagtgcacgtgagctacctggacggcaagggcaacctggccccccagggcagcgtgcccagcgccgtgagcagcctgaccgacgacctgctgaagtactaccaccaggtgaccagagccgtgctgggcgacgacccccagctgatgaaggtggccctgcaggacctgcagaccaacagcaagatcggcgccctgctgccctacttcgtgtacgtggtgagcggcgtgaagagcgtgagccacgacctggagcagctgcacagactgctgcaggtggccagaagcctgttcagaaacccccacctgtgcctgggcccctacgtgagatgcctggtgggcagcgtgctgtactgcgtgctggagcccctggccgccagcatcaaccccctgaacgaccactggaccctgagagacggcgccgccctgctgctgagccacatcttctggacccacggcgacctggtgagcggcctgtaccagcacatcctgctgagcctgcagaagatcctggccgaccccgtgagacccctgtgctgccactacggcgccgtggtgggcctgcacgccctgggctggaaggccgtggagagagtgctgtacccccacctgagcacctactggaccaacctgcaggccgtgctggacgactacagcgtgagcaacgcccaggtgaaggccgacggccacaaggtgtacggcgccatcctggtggccgtggagagactgctgaagatgaaggcccaggccgccgagcccaacagaggcggccccggcggcagaggctgcagaagactggacgacctgccctgggacagcctgctgttccaggagagcagcagcggcggcggcgccgagcccagcttcggcagcggcctgcccctgccccccggcggcgccggccccgaggaccccagcctgagcgtgaccctggccgacatctacagagagctgtacgccttcttcggcgacagcctggccaccagattcggcaccggccagcccgcccccaccgcccccagaccccccggcgacaagaaggagcccgccgccgcccccgacagcgtgagaaagatgccccagctgaccgccagcgccatcgtgagcccccacggcgacgagagccccagaggcagcggcggcggcggccccgccagcgccagcggccccgccgccagcgagagcagacccctgcccagagtgcacagagccagaggcgcccccagacagcagggccccggcaccggcaccagagacgtgttccagaagagcagattcgcccccagaggcgccccccacttcagattcatcatcgccggcagacaggccggcagaagatgcagaggcagactgttccagaccgccttccccgccccctacggccccagccccgccagcagatacgtgcagaagctgcccatgatcggcagaaccagcagacccgccagaagatgggccctgagcgactacagcctgtacctgcccctgtag

SEQ ID NO: 9743 - DNA, 153 bp, Artificial Sequence
  Description of Artificial Sequence: Synthetic coding sequence
atgagcgagagagaggagagaagattcgtggagatccccagagagagcgtgagactgatggccgagagcaccggcctggagctgagcgacgaggtggccgccctgctggccgaggacgtgtgctacagactgagagaggccacccagaactag

SEQ ID NO: 9744 - DNA, 438 bp, Artificial Sequence
  Description of Artificial Sequence: Synthetic coding sequence
atgagcgagagagaggagagaagattcgtggagatccccagagagagcgtgagactgatggccgagagcaccggcctggagctgagcgacgaggtggccgccctgctggccgaggacgtgtgctacagactgagagaggccacccagaacagcagccagttcatgaagcacaccaagagaagaaagctgaccgtggaggacttcaacagagccctgagatggagcagcgtggaggccgtgtgcggctacggcagccaggaggccctgcccatgagacccgccagagagggcgagctgtacttccccgaggacagagaggtgaacctggtggagctggccctggccaccaacatccccaagggctgcgccgagaccgccgtgagagtgcacgtgagctacctggacggcaagggcaacctggccccccagggcagctag

SEQ ID NO: 9745 - DNA, 1473 bp, Artificial Sequence
  Description of Artificial Sequence: Synthetic coding sequence
atggccaccgagttcatcaagagctgctgcggcggctgcttctacggcgagaccgagaagcacaacttcagcgtggagagagacttcaaggccgccgtgcccaacagccagaacgccaccatcagcgtgccccccctgaccagcgtgagcgtgaagccccagctgggctgcaccgaggactacctgctgagcaagctgcccagcgacggcaaggaggtgcccttcgtggtgcccaagttcaagctgagctacatccagcccagaacccaggagacccccagccacctggaggagctggagggcagcgccagagccagcttcggcgacagaaaggtggagctgagcagcagcagccagcacggccccagctacgacgtgtacaaccccttctacatgtaccagcacatcagccccgacctgagcagaagattcccccccagaagcgaggtgaagagactgtacggcagcgtgtgcgacctgagaaccaacaagctgcccggcagccccggcctgagcaagagcatgttcgacctgaccaacagcagccagagattcatccagagacacgacagcctgagcagcgtgcccagcagcagcagcagcagaaagaacagccagggcagcaacagaagcctggacaccatcaccctgagcggcgacgagagagacttcggcagactgaacgtgaagctgttctacaacagcagcgtggagcagatctggatcaccgtgctgcagtgcagagacctgagctggcccagcagctacggcgacacccccaccgtgagcatcaagggcatcctgaccctgcccaagcccgtgcacttcaagagcagcgccaaggagggcagcaacgccatcgagttcatggagaccttcgtgttcgccatcaagctgcagaacctgcagaccgtgagactggtgttcaagatccagacccagacccccagaaagaagaccatcggcgagtgcagcatgagcctgagaaccctgagcacccaggagatggactacagcctggacatcaccccccccagcaagatcagcgtgtgccacgccgagctggagctgggcacctgcttccaggccgtgaacagcagaatccagctgcagatcctggaggccagatacctgcccagcagcagcacccccctgaccctgagcttcttcgtgaaggtgggcatgttcagcagcggcgagctgatctacaagaagaagaccagactgctgaaggccagcaacggcagagtgaagtggggcgagaccatgatcttccccctgatccagagcgagaaggagatcgtgttcctgatcaagctgtacagcagaagcagcgtgagaagaaagcacttcgtgggccagatctggatcagcgaggacagcaacaacatcgaggccgtgaaccagtggaaggagaccgtgatcaaccccgagaaggtggtgatcagatggcacaagctgaaccccagctag

SEQ ID NO: 9746 - DNA, 1473 bp, Artificial Sequence; identical to SEQ ID NO: 9745
  Description of Artificial Sequence: Synthetic coding sequence

SEQ ID NO: 9747 - DNA, 1473 bp, Artificial Sequence; identical to SEQ ID NO: 9745
  Description of Artificial Sequence: Synthetic coding sequence

SEQ ID NO: 9748 - DNA, 1281 bp, Artificial Sequence
  Description of Artificial Sequence: Synthetic coding sequence
atggccaccgagttcatcaagagctgctgcggcggctgcttctacggcgagaccgagaagcacaacttcagcgtggagagagacttcaaggccgccgtgcccaacagccagaacgccaccatcagcgtgccccccctgaccagcgtgagcgtgaagccccagctgggctgcaccgaggactacctgctgagcaagctgcccagcgacggcaaggaggtgcccttcgtggtgcccaagttcaagctgagctacatccagcccagaacccaggagacccccagccacctggaggagctggagggcagcgccagagccagcttcggcgacagaaaggtggagctgagcagcagcagccagcacggccccagctacgacgtgtacaaccccttctacatgtaccagcacatcagccccgacctgagcagaagattcccccccagaagcgaggtgaagagactgtacggcagcgtgtgcgacctgagaaccaacaagctgcccggcagccccggcctgagcaagagcatgttcgacctgaccaacagcagccagagattcatccagagacacgacagcctgagcagcgtgcccagcagcagcagcagcagaaagaacagccagggcagcaacagaagcctggacaccatcaccctgagcggcgacgagagagacttcggcagactgaacgtgaagctgttctacaacagcagcgtggagcagatctggatcaccgtgctgcagtgcagagacctgagctggcccagcagctacggcgacacccccaccgtgagcatcaagggcatcctgaccctgcccaagcccgtgcacttcaagagcagcgccaaggagggcagcaacgtgtgccacgccgagctggagctgggcacctgcttccaggccgtgaacagcagaatccagctgcagatcctggaggccagatacctgcccagcagcagcacccccctgaccctgagcttcttcgtgaaggtgggcatgttcagcagcggcgagctgatctacaagaagaagaccagactgctgaaggccagcaacggcagagtgaagtggggcgagaccatgatcttccccctgatccagagcgagaaggagatcgtgttcctgatcaagctgtacagcagaagcagcgtgagaagaaagcacttcgtgggccagatctggatcagcgaggacagcaacaacatcgaggccgtgaaccagtggaaggagaccgtgatcaaccccgagaaggtggtgatcagatggcacaagctgaaccccagctag

SEQ ID NO: 9749 - DNA, 1767 bp, Artificial Sequence
  Description of Artificial Sequence: Synthetic coding sequence
atggacctggaggaggccgaggagttcaaggagagatgcacccagtgcgccgccgtgagctggggcctgaccgacgagggcaagtactactgcaccagctgccacaacgtgaccgagagataccaggaggtgaccaacaccgacctgatccccaacacccagatcaaggccctgaacagaggcctgaagaagaagaacaacaccgagaagggctgggactggtacgtgtgcgagggcttccagtacatcctgtaccagcaggccgaggccctgaagaacctgggcgtgggccccgagctgaagaacgacgtgctgcacaacttctggaagagatacctgcagaagagcaagcaggcctactgcaagaaccccgtgtacaccaccggcagaaagcccaccgtgctggaggacaacctgagccacagcgactgggccagcgagcccgagctgctgagcgacgtgagctgcccccccttcctggagagcggcgccgagagccagagcgacatccacaccagaaagcccttccccgtgagcaaggccagccagagcgagaccagcgtgtgcagcggcagcctggacggcgtggagtacagccagagaaaggagaagggcatcgtgaagatgaccatgccccagaccctggccttctgctacctgagcctgctgtggcagagagaggccatcaccctgagcgacctgctgagattcgtggaggaggaccacatcccctacatcaacgccttccagcacttccccgagcagatgaagctgtacggcagagacagaggcatcttcggcatcgagagctggcccgactacgaggacatctacaagaagaccgtggaggtgggcaccttcctggacctgcccagattccccgacatcaccgaggactgctacctgcaccccaacatcctgtgcatgaagtacctgatggaggtgaacctgcccgacgagatgcacagcctgacctgccacgtggtgaagatgaccggcatgggcgaggtggacttcctgaccttcgaccccatcgccaagatggccaagaccgtgaagtacgacgtgcaggccgtggccatcatcgtggtggtgctgaagctgctgttcctgctggacgacagcttcgagtggagcctgagcaacctggccgagaagcacaacgagaagaacaagaaggacaagccctggttcgacttcagaaagtggtaccagatcatgaagaaggccttcgacgagaagaagcagaagtgggaggaggccagagccaagtacctgtggaagagcgagaagcccctgtactacagcttcgtggacaagcccgtggcctacaagaagagagagatggtggtgaacctgcagaagcagttcagcaccctggtggagagcaccgccaccgccggcaagaagagccccagcagcttccagttcaactggaccgaggaggacaccgacagaacctgcttccacggccacagcctgcagggcgtgctgaaggagaagggccagagcctgctgaccaagaacagcctgtactggctgagcacccagaagttctgcagatgctactgcacccacgtgaccacctacgaggagagcaactacagcctgagctaccagttcatcctgaacctgttcagcttcctgctgagaatcaagaccagcctgctgcacgaggaggtgagcctggtggagaagaagctgttcgagaagaagtacagcgtgaagagaaagaagagcagaagcaagaaggtgagaagacactag

SEQ ID NO: 9750 - DNA, 1002 bp, Artificial Sequence
  Description of Artificial Sequence: Synthetic coding sequence
atgaagctgtacggcagagacagaggcatcttcggcatcgagagctggcccgactacgaggacatctacaagaagaccgtggaggtgggcaccttcctggacctgcccagattccccgacatcaccgaggactgctacctgcaccccaacatcctgtgcatgaagtacctgatggaggtgaacctgcccgacgagatgcacagcctgacctgccacgtggtgaagatgaccggcatgggcgaggtggacttcctgaccttcgaccccatcgccaagatggccaagaccgtgaagtacgacgtgcaggccgtggccatcatcgtggtggtgctgaagctgctgttcctgctggacgacagcttcgagtggagcctgagcaacctggccgagaagcacaacgagaagaacaagaaggacaagccctggttcgacttcagaaagtggtaccagatcatgaagaaggccttcgacgagaagaagcagaagtgggaggaggccagagccaagtacctgtggaagagcgagaagcccctgtactacagcttcgtggacaagcccgtggcctacaagaagagagagatggtggtgaacctgcagaagcagttcagcaccctggtggagagcaccgccaccgccggcaagaagagccccagcagcttccagttcaactggaccgaggaggacaccgacagaacctgcttccacggccacagcctgcagggcgtgctgaaggagaagggccagagcctgctgaccaagaacagcctgtactggctgagcacccagaagttctgcagatgctactgcacccacgtgaccacctacgaggagagcaactacagcctgagctaccagttcatcctgaacctgttcagcttcctgctgagaatcaagaccagcctgctgcacgaggaggtgagcctggtggagaagaagctgttcgagaagaagtacagcgtgaagagaaagaagagcagaagcaagaaggtgagaagacactag

SEQ ID NO: 9751 - DNA, 894 bp, Artificial Sequence
  Description of Artificial Sequence: Synthetic coding sequence
atgagcagattcaagttcatcgacatcggcatcaacctgaccgaccccatgttcagaggcatctacagaggcgtgcagaagcaccaggacgacctgcaggacgtgatcggcagagccgtggagatcggcgtgaagaagttcatgatcaccggcggcaacctgcaggacagcaaggacgccctgcacctggcccagaccaacggcatgttcttcagcaccgtgggctgccaccccaccagatgcggcgagttcgagaagaacaaccccgacctgtacctgaaggagctgctgaacctggccgagaacaacaagggcaaggtggtggccatcggcgagtgcggcctggacttcgacagactgcagttctgccccaaggacacccagctgaagtacttcgagaagcagttcgagctgagcgagcagaccaagctgcccatgttcctgcactgcagaaacagccacgccgagttcctggacatcatgaagagaaacagagacagatgcgtgggcggcgtggtgcacagcttcgacggcaccaaggaggccgccgccgccctgatcgacctggacctgtacatcggcttcaacggctgcagcctgaagaccgaggccaacctggaggtgctgaagagcatccccagcgagaagctgatgatcgagaccgacgccccctggtgcggcgtgaagagcacccacgccggcagcaagtacatcagaaccgccttccccaccaagaagaagtgggagagcggccactgcctgaaggacagaaacgagccctgccacatcatccagatcctggagatcatgagcgccgtgagagacgaggaccccctggagctggccaacaccctgtacaacaacaccatcaaggtgttcttccccggcatctag

SEQ ID NO: 9752 - DNA, 753 bp, Artificial Sequence
  Description of Artificial Sequence: Synthetic coding sequence
atgatcaccggcggcaacctgcaggacagcaaggacgccctgcacctggcccagaccaacggcatgttcttcagcaccgtgggctgccaccccaccagatgcggcgagttcgagaagaacaaccccgacctgtacctgaaggagctgctgaacctggccgagaacaacaagggcaaggtggtggccatcggcgagtgcggcctggacttcgacagactgcagttctgccccaaggacacccagctgaagtacttcgagaagcagttcgagctgagcgagcagaccaagctgcccatgttcctgcactgcagaaacagccacgccgagttcctggacatcatgaagagaaacagagacagatgcgtgggcggcgtggtgcacagcttcgacggcaccaaggaggccgccgccgccctgatcgacctggacctgtacatcggcttcaacggctgcagcctgaagaccgaggccaacctggaggtgctgaagagcatccccagcgagaagctgatgatcgagaccgacgccccctggtgcggcgtgaagagcacccacgccggcagcaagtacatcagaaccgccttccccaccaagaagaagtgggagagcggccactgcctgaaggacagaaacgagccctgccacatcatccagatcctggagatcatgagcgccgtgagagacgaggaccccctggagctggccaacaccctgtacaacaacaccatcaaggtgttcttccccggcatctag

SEQ ID NO: 9753 - DNA, 333 bp, Artificial Sequence
  Description of Artificial Sequence: Synthetic coding sequence
atgatcaccggcggcaacctgcaggacagcaaggacgccctgcacctggcccagaccaacggcatgttcttcagcaccgtgggctgccaccccaccagatgcggcgagttcgagaagaacaaccccgacctgtacctgaaggagctgctgaacctggccgagaacaacaagggcaaggtggtggccatcggcgagtgcggcctggacttcgacagactgcagttctgccccaaggacacccagctgaagtacttcgagaagcagttcgagctgagcgagcagaccaagctgcccatgttcctgcactgcagaaacagccacgccgagttctag

SEQ ID NO: 9754 - DNA, 2286 bp, Artificial Sequence
  Description of Artificial Sequence: Synthetic coding sequence
atggccagcgagagaggcaaggtgaagcacaactggagcagcaccagcgagggctgccccagaaagagaagctgcctgagagagccctgcgacgtggcccccagcagcagacccgcccagagaagcgccagcagaagcggcggccccagcagccccaagagactgaaggcccagaaggaggacgacgtggcctgcagcagaagactgagctggggcagcagcagaagaagaaacaacagcagcagcagcttcagcccccacttcctgggccccggcgtgggcggcgccgccagcaagggctgcctgatcagaaacaccagaggcttcctgagcagcggcggcagccccctgagacccgccaacgccagcctggaggagatggccagcctggaggaggaggcctgcagcctgaaggtggacagcaaggacagcagccacaacagcaccaacagcgagttcgccgccgaggccgagggccagaacgacaccatcgaggagcccaacaaggtgcagaagagaaagagagacagactgagagaccagggcagcaccatgatctacctgaaggccatccagggcatcctgggcaagagcatgcccaagagaaagggcgaggccgccaccagagccaagcccagcgccgccgagcaccccagccacggcgagggccccgccagaagcgagggccccgccaagaccgccgagggcgccgccagaagcgtgaccgtgaccgccgcccagaaggagaaggacgccacccccgaggtgagcatggaggaggacaagaccgtgcccgagagaagcagcttctacgacagaagagtggtgatcgacccccaggagaagcccagcgaggagcccctgggcgacagaagaaccgtgatcgacaagtgcagcccccccctggagttcctggacgacagcgacagccacctggagatccagaagcacaaggacagagaggtggtgatggagcaccccagcagcggcagcgactggagcgacgtggaggagatcagcaccgtgagattcagccaggaggagcccgtgagcctgaagcccagcgccgtgcccgagcccagcagcttcaccaccgactacgtgatgtaccccccccacctgtacagcagcccctggtgcgactacgccagctactggaccagcagccccaagcccagcagctaccccagcaccggcagcagcagcaacgacgccgcccaggtgggcaagagcagcagaagcagaatgagcgactacagccccaacagcaccggcagcgtgcagaacaccagcagagacatggaggccagcgaggagggctggagccagaacagcagaagcttcagattcagcagaagcagcgaggagagagaggtgaaggagaagagaaccttccaggaggagatgccccccagaccctgcggcggccacgccagcagcagcctgcccaagagccacctggagcccagcctggaggagggcttcatcgacacccactgccacctggacatgctgtacagcaagctgagcttccagggcaccttcaccaagttcagaaagatctacagcagcagcttccccaaggagttccagggctgcatcagcgacttctgcgaccccagaaccctgaccgactgcctgtgggaggagctgctgaaggaggacctggtgtggggcgccttcggctgccacccccacttcgccagatactacagcgagagccaggagagaaacctgctgcaggccctgagacaccccaaggccgtggccttcggcgagatgggcctggactacagctacaagtgcaccacccccgtgcccgagcagcacaaggtgttcgagagacagctgcagctggccgtgagcctgaagaagcccctggtgatccactgcagagaggccgacgaggacctgctggagatcatgaagaagttcgtgccccccgactacaagatccacagacactgcttcaccggcagctaccccgtgatcgagcccctgctgaagtacttccccaacatgagcgtgggcttcaccgccgtgctgacctacagcagcgcctgggaggccagagaggccctgagacagatccccctggagagaatcatcgtggagaccgacgccccctacttcctgcccagacaggtgcccaagagcctgtgccagtacgcccaccccggcctggccctgcacaccgtgagagagatcgccagagtgaaggaccagcccctgagcctgaccctggccgccctgagagagaacaccagcagactgtacagcctgtag

SEQ ID NO: 9755 - DNA, 2286 bp, Artificial Sequence; identical to SEQ ID NO: 9754
  Description of Artificial Sequence: Synthetic coding sequence

SEQ ID NO: 9756 - DNA, 822 bp, Artificial Sequence
  Description of Artificial Sequence: Synthetic coding sequence
atgagagccgccggcgtgggcctggtggactgccactgccacctgagcgcccccgacttcgacagagacctggacgacgtgctggagaaggccaagaaggccaacgtggtggccctggtggccgtggccgagcacagcggcgagttcgagaagatcatgcagctgagcgagagatacaacggcttcgtgctgccctgcctgggcgtgcaccccgtgcagggcctgccccccgaggaccagagaagcgtgaccctgaaggacctggacgtggccctgcccatcatcgagaactacaaggacagactgctggccatcggcgaggtgggcctggacttcagccccagattcgccggcaccggcgagcagaaggaggagcagagacaggtgctgatcagacagatccagctggccaagagactgaacctgcccgtgaacgtgcacagcagaagcgccggcagacccaccatcaacctgctgcaggagcagggcgccgagaaggtgctgctgcacgccttcgacggcagacccagcgtggccatggagggcgtgagagccggctacttcttcagcatcccccccagcatcatcagaagcggccagcagaagctggtgaagcagctgcccctgaccagcatctgcctggagaccgacagccccgccctgggccccgagaagcaggtgagaaacgagccctggaacatcagcatcagcgccgagtacatcgcccaggtgaagggcatcagcgtggaggaggtgatcgaggtgaccacccagaacgccctgaagctgttccccaagctgagacacctgctgcagaagtag

SEQ ID NO: 9757 - DNA, 825 bp, Artificial Sequence
  Description of Artificial Sequence: Synthetic coding sequence
atgagagccgccggcgtgggcctggtggactgccactgccacctgagcgcccccgacttcgacagagacctggacgacgtgctggagaaggccaagaaggccaacgtggtggccctggtggccgtggccgagcacagcggcgagttcgagaagatcatgcagctgagcgagagatacaacggcttcgtgctgccctgcctgggcgtgcaccccgtgcagggcctgccccccgaggaccagagaagcgtgaccctgaaggacctggacgtggccctgcccatcatcgagaactacaaggacagactgctggccatcggcgaggtgggcctggacttcagccccagattcgccggcaccggcgagcagaaggaggagcagagacaggtgctgatcagacagatccagctggccaagagactgaacctgcccgtgaacgtgcacagcagaagcgccggcagacccaccatcaacctgctgcaggagcagggcgccgagaaggtgctgctgcacgccttcgacggcagacccagcgtggccatggagggcgtgagagccggctacttcttcagcatcccccccagcatcatcagaagcggccagaagcagaagctggtgaagcagctgcccctgaccagcatctgcctggagaccgacagccccgccctgggccccgagaagcaggtgagaaacgagccctggaacatcagcatcagcgccgagtacatcgcccaggtgaagggcatcagcgtggaggaggtgatcgaggtgaccacccagaacgccctgaagctgttccccaagctgagacacctgctgcagaagtag

SEQ ID NO: 9758 - DNA, 762 bp, Artificial Sequence
  Description of Artificial Sequence: Synthetic coding sequence
atgagagccgccggcgtgggcctggtggactgccactgccacctgagcgcccccgacttcgacagagacctggacgacgtgctggagaaggccaagaaggccaacgtggtggccctggtggccgtggccgagcacagcggcgagttcgagaagatcatgcagctgagcgagagatacaacggcttcgtgctgccctgcctgggcgtgcaccccgtgcagggcctgccccccgaggaccagagaagcgtgaccctgaaggtgggcctggacttcagccccagattcgccggcaccggcgagcagaaggaggagcagagacaggtgctgatcagacagatccagctggccaagagactgaacctgcccgtgaacgtgcacagcagaagcgccggcagacccaccatcaacctgctgcaggagcagggcgccgagaaggtgctgctgcacgccttcgacggcagacccagcgtggccatggagggcgtgagagccggctacttcttcagcatcccccccagcatcatcagaagcggccagaagcagaagctggtgaagcagctgcccctgaccagcatctgcctggagaccgacagccccgccctgggccccgagaagcaggtgagaaacgagccctggaacatcagcatcagcgccgagtacatcgcccaggtgaagggcatcagcgtggaggaggtgatcgaggtgaccacccagaacgccctgaagctgttccccaagctgagacacctgctgcagaagtag

SEQ ID NO: 9759 - DNA, 723 bp, Artificial Sequence
  Description of Artificial Sequence: Synthetic coding sequence
atgagagccgccggcgtgggcctggtggactgccactgccacctgagcgcccccgacttcgacagagacctggacgacgtgctggagaaggccaagaaggccaacgtggtggccctggtggccgtggccgagcacagcggcgagttcgagaagatcatgcagctgagcgagagatacaacggcttcgtgctgccctgcctgggcgtgcaccccgtgcagggcctgccccccgaggaccagagaagcgtgaccctgaaggacctggacgtggccctgcccatcatcgagaactacaaggacagactgctggccatcggcgaggtgggcctggacttcagccccagattcgccggcaccggcgagcagaaggaggagcagagacaggtgctgatcagacagatccagctggccaagagactgaacctgcccgtgaacgtgcacagcagaagcgccggcagacccaccatcaacctgctgcaggagcagggcgccgagaaggtgctgctgcacgccttcgacggcagacccagcgtggccatggagggcgtgagagccggctacttcttcagcatcccccccagcatcatcagaagcggccagctgctgagcctgttcagcaagaagcagaagctggtgaagcagctgcccctgaccagcatctgcctggagaccgacagccccgccctgggccccgagaagcagcagaacatcctgcccagatag

SEQ ID NO: 9760 - DNA, 846 bp, Artificial Sequence
  Description of Artificial Sequence: Synthetic coding sequence
atgagagccgccggcgtgggcctggtggactgccactgccacctgagcgcccccgacttcgacagagacctggacgacgtgctggagaaggccaagaaggccaacgtggtggccctggtggccgtggccgagcacagcggcgagttcgagaagatcatgcagctgagcgagagatacaacggcttcgtgctgccctgcctgggcgtgcaccccgtgcagggcctgccccccgaggaccagagaagcgtgaccctgaaggacctggacgtggccctgcccatcatcgagaactacaaggacagactgctggccatcggcgaggtgggcctggacttcagccccagattcgccggcaccggcgagcagaaggaggagcagagacaggtgctgatcagacagatccagctggccaagagactgaacctgcccgtgaacgtgcacagcagaagcgccggcagacccaccatcaacctgctgcaggagcagggcgccgagaaggtgctgctgcacgccttcgacggcagacccagcgtggccatggagggcgtgagagccggctacttcttcagcatcccccccagcatcatcagaagcggccagctgctgagcctgttcagcaagaagcagaagctggtgaagcagctgcccctgaccagcatctgcctggagaccgacagccccgccctgggccccgagaagcaggtgagaaacgagccctggaacatcagcatcagcgccgagtacatcgcccaggtgaagggcatcagcgtggaggaggtgatcgaggtgaccacccagaacgccctgaagctgttccccaagctgagacacctgctgcagaagtag

SEQ ID NO: 9761 - DNA, 1824 bp, Artificial Sequence
  Description of Artificial Sequence: Synthetic coding sequence
atggccgagaagagaagaggcagcccctgcagcatgctgagcctgaaggcccacgccttcagcgtggaggccctgatcggcgccgagaagcagcagcagctgcagaagaagagaagaaagctgggcgccgaggaggccgccggcgccgtggacgacggcggctgcagcagaggcggcggcgccggcgagaagggcagcagcgagggcgacgagggcgccgccctgcccccccccgccggcgccaccagcggccccgccagaagcggcgccgacctggagagaggcgccgccggcggctgcgaggacggcttccagcagggcgccagccccctggccagccccggcggcagccccaagggcagccccgccagaagcctggccagacccggcacccccctgcccagcccccaggcccccagagtggacctgcagggcgccgagctgtggaagagattccacgagatcggcaccgagatgatcatcaccaaggccggcagaagaatgttccccgccatgagagtgaagatcagcggcctggacccccaccagcagtactacatcgccatggacatcgtgcccgtggacaacaagagatacagatacgtgtaccacagcagcaagtggatggtggccggcaacgccgacagccccgtgccccccagagtgtacatccaccccgacagccccgccagcggcgagacctggatgagacaggtgatcagcttcgacaagctgaagctgaccaacaacgagctggacgaccagggccacatcatcctgcacagcatgcacaagtaccagcccagagtgcacgtgatcagaaaggactgcggcgacgacctgagccccatcaagcccgtgcccagcggcgagggcgtgaaggccttcagcttccccgagaccgtgttcaccaccgtgaccgcctaccagaaccagcagatcaccagactgaagatcgacagaaaccccttcgccaagggcttcagagacagcggcagaaacagaatgggcctggaggccctggtggagagctacgccttctggagacccagcctgagaaccctgaccttcgaggacatccccggcatccccaagcagggcaacgccagcagcagcaccctgctgcagggcaccggcaacggcgtgcccgccacccacccccacctgctgagcggcagcagctgcagcagccccgccttccacctgggccccaacaccagccagctgtgcagcctggcccccgccgactacagcgcctgcgccagaagcggcctgaccctgaacagatacagcaccagcctggccgagacctacaacagactgaccaaccaggccggcgagaccttcgccccccccagaacccccagctacgtgggcgtgagcagcagcaccagcgtgaacatgagcatgggcggcaccgacggcgacaccttcagctgcccccagaccagcctgagcatgcagatcagcggcatgagcccccagctgcagtacatcatgcccagccccagcagcaacgccttcgccaccaaccagacccaccagggcagctacaacaccttcagactgcacagcccctgcgccctgtacggctacaacttcagcaccagccccaagctggccgccagccccgagaagatcgtgagcagccagggcagcttcctgggcagcagccccagcggcaccatgaccgacagacagatgctgccccccgtggagggcgtgcacctgctgagcagcggcggccagcagagcttcttcgacagcagaaccctgggcagcctgaccctgagcagcagccaggtgagcgcccacatggtgtag

SEQ ID NO: 9762 - DNA, 918 bp, Artificial Sequence
  Description of Artificial Sequence: Synthetic coding sequence
agaggcagacacatctggaagctgggcttccccaagggcggctgcgaggacggcttccagcagggcgccagccccctggccagccccggcggcagccccaagggcagccccgccagaagcctggccagacccggcacccccctgcccagcccccaggcccccagagtggacctgcagggcgccgagctgtggaagagattccacgagatcggcaccgagatgatcatcaccaaggccggcagaagaatgttccccgccatgagagtgaagatcagcggcctggacccccaccagcagtactacatcgccatggacatcgtgcccgtggacaacaagagatacagatacgtgtaccacagcagcaagtggatggtggccggcaacgccgacagccccgtgccccccagagtgtacatccaccccgacagccccgccagcggcgagacctggatgagacaggtgatcagcttcgacaagctgaagctgaccaacaacgagctggacgaccagggccacatcatcctgcacagcatgcacaagtaccagcccagagtgcacgtgatcagaaaggactgcggcgacgacctgagccccatcaagcccgtgcccagcggcgagggcgtgaaggccttcagcttccccgagaccgtgttcaccaccgtgaccgcctaccagaaccagcagatcaccagactgaagatcgacagaaaccccttcgccaagggcttcagagacagcggcagaaacagaatgggcctggaggccctggtggagagctacgccttctggagacccagcctgagaaccctgaccttcgaggacatccccggcatccccaagcaggagtacagagacctgaagaccgactacatcttccccgagagagacaacctggtgagcagagagaccaagctgtag

SEQ ID NO: 9763 - DNA, 2049 bp, Artificial Sequence
  Description of Artificial Sequence: Synthetic coding sequence
atgcagctggagcactgcctgagccccagcatcatgctgagcaagaagttcctgaacgtgagcagcagctacccccacagcggcggcagcgagctggtgctgcacgaccaccccatcatcagcaccaccgacaacctggagagaagcagccccctgaagaagatcaccagaggcatgaccaaccagagcgacaccgacaacttccccgacagcaaggacagccccggcgacgtgcagagaagcaagctgagccccgtgctggacggcgtgagcgagctgagacacagcttcgacggcagcgccgccgacagatacctgctgagccagagcagccagccccagagcgccgccaccgcccccagcgccatgttcccctaccccggccagcacggccccgcccaccccgccttcagcatcggcagccccagcagatacatggcccaccaccccgtgatcaccaacggcgcctacaacagcctgctgagcaacagcagcccccagggctaccccaccgccggctacccctacccccagcagtacggccacagctaccagggcgcccccttctaccagttcagcagcacccagcccggcctggtgcccggcaaggcccaggtgtacctgtgcaacagacccctgtggctgaagttccacagacaccagaccgagatgatcatcaccaagcagggcagaagaatgttccccttcctgagcttcaacatcagcggcctggaccccaccgcccactacaacatcttcgtggacgtgatcctggccgaccccaaccactggagattccagggcggcaagtgggtgccctgcggcaaggccgacaccaacgtgcagggcaacagagtgtacatgcaccccgacagccccaacaccggcgcccactggatgagacaggagatcagcttcggcaagctgaagctgaccaacaacaagggcgccagcaacaacaacggccagatggtggtgctgcagagcctgcacaagtaccagcccagactgcacgtggtggaggtgaacgaggacggcaccgaggacaccagccagcccggcagagtgcagaccttcaccttccccgagacccagttcatcgccgtgaccgcctaccagaacaccgacatcacccagctgaagatcgaccacaaccccttcgccaagggcttcagagacaactacgacaccatctacaccggctgcgacatggacagactgacccccagccccaacgacagccccagaagccagatcgtgcccggcgccagatacgccatggccggcagcttcctgcaggaccagttcgtgagcaactacgccaaggccagattccaccccggcgccggcgccggccccggccccggcaccgacagaagcgtgccccacaccaacggcctgctgagcccccagcaggccgaggaccccggcgcccccagcccccagagatggttcgtgacccccgccaacaacagactggacttcgccgccagcgcctacgacaccgccaccgacttcgccggcaacgccgccaccctgctgagctacgccgccgccggcgtgaaggccctgcccctgcaggccgccggctgcaccggcagacccctgggctactacgccgaccccagcggctggggcgccagaagccccccccagtactgcggcaccaagagcggcagcgtgctgccctgctggcccaacagcgccgccgccgccgccagaatggccggcgccaacccctacctgggcgaggaggccgagggcctggccgccgagagaagccccctgccccccggcgccgccgaggacgccaagcccaaggacctgagcgacagcagctggatcgagacccccagcagcatcaagagcatcgacagcagcgacagcggcatctacgagcaggccaagagaagaagaatcagccccgccgacacccccgtgagcgagagcagcagccccctgaagagcgaggtgctggcccagagagactgcgagaagaactgcgccaaggacatcagcggctactacggcttctacagccacagctag

SEQ ID NO: 9764 - DNA, 1188 bp, Artificial Sequence
  Description of Artificial Sequence: Synthetic coding sequence
atgcaccccgacagccccaacaccggcgcccactggatgagacaggagatcagcttcggcaagctgaagctgaccaacaacaagggcgccagcaacaacaacggccagatggtggtgctgcagagcctgcacaagtaccagcccagactgcacgtggtggaggtgaacgaggacggcaccgaggacaccagccagcccggcagagtgcagaccttcaccttccccgagacccagttcatcgccgtgaccgcctaccagaacaccgacatcacccagctgaagatcgaccacaaccccttcgccaagggcttcagagacaactacgacaccatctacaccggctgcgacatggacagactgacccccagccccaacgacagccccagaagccagatcgtgcccggcgccagatacgccatggccggcagcttcctgcaggaccagttcgtgagcaactacgccaaggccagattccaccccggcgccggcgccggccccggccccggcaccgacagaagcgtgccccacaccaacggcctgctgagcccccagcaggccgaggaccccggcgcccccagcccccagagatggttcgtgacccccgccaacaacagactggacttcgccgccagcgcctacgacaccgccaccgacttcgccggcaacgccgccaccctgctgagctacgccgccgccggcgtgaaggccctgcccctgcaggccgccggctgcaccggcagacccctgggctactacgccgaccccagcggctggggcgccagaagccccccccagtactgcggcaccaagagcggcagcgtgctgccctgctggcccaacagcgccgccgccgccgccagaatggccggcgccaacccctacctgggcgaggaggccgagggcctggccgccgagagaagccccctgccccccggcgccgccgaggacgccaagcccaaggacctgagcgacagcagctggatcgagacccccagcagcatcaagagcatcgacagcagcgacagcggcatctacgagcaggccaagagaagaagaatcagccccgccgacacccccgtgagcgagagcagcagccccctgaagagcgaggtgctggcccagagagactgcgagaagaactgcgccaaggacatcagcggctactacggcttctacagccacagctag

SEQ ID NO: 9765 - DNA, 1056 bp, Artificial Sequence
  Description of Artificial Sequence: Synthetic coding sequence
atgcaccccgacagccccaacaccggcgcccactggatgagacaggagatcagcttcggcaagctgaagctgaccaacaacaagggcgccagcaacaacaacggccagatggtggtgctgcagagcctgcacaagtaccagcccagactgcacgtggtggaggtgaacgaggacggcaccgaggacaccagccagcccggcagagtgcagaccttcaccttccccgagacccagttcatcgccgtgaccgcctaccagaacaccgacatcacccagctgaagatcgaccacaaccccttcgccaagggcttcagagacaactacgacaccatctacaccggctgcgacatggacagagccggccccggccccggcaccgacagaagcgtgccccacaccaacggcctgctgagcccccagcaggccgaggaccccggcgcccccagcccccagagatggttcgtgacccccgccaacaacagactggacttcgccgccagcgcctacgacaccgccaccgacttcgccggcaacgccgccaccctgctgagctacgccgccgccggcgtgaaggccctgcccctgcaggccgccggctgcaccggcagacccctgggctactacgccgaccccagcggctggggcgccagaagccccccccagtactgcggcaccaagagcggcagcgtgctgccctgctggcccaacagcgccgccgccgccgccagaatggccggcgccaacccctacctgggcgaggaggccgagggcctggccgccgagagaagccccctgccccccggcgccgccgaggacgccaagcccaaggacctgagcgacagcagctggatcgagacccccagcagcatcaagagcatcgacagcagcgacagcggcatctacgagcaggccaagagaagaagaatcagccccgccgacacccccgtgagcgagagcagcagccccctgaagagcgaggtgctggcccagagagactgcgagaagaactgcgccaaggacatcagcggctactacggcttctacagccacagctag

SEQ ID NO: 9766 - DNA, 2739 bp, Artificial Sequence
  Description of Artificial Sequence: Synthetic coding sequence
atgagcctgcccatcggcagcgccgaggtggccagcgagagagtggagctgtggagaagcggcttcagatggtggcagagatgcctgtgcttctgcagatacagaagagtggccatggccgccgtggacagcgacgtggagagcctgcccagaggcggcttcagatgctgcctgtgccacgtgaccaccgccaacagacccagcctggacgcccacctgggcggcagaaagcacagacacctggtggagctgagagccgccagaaaggcccagggcctgagaagcgtgttcgtgagcggcttccccagagacgtggacagcgcccagctgagcgagtacttcctggccttcggccccgtggccagcgtggtgatggacaaggacaagggcgtgttcgccatcgtggagatgggcgacgtgggcgccagagaggccgtgctgagccagagccagcacagcctgggcggccacagactgagagtgagacccagagagcagaaggagttccagagccccgccagcaagagccccaagggcgccgcccccgacagccaccagctggccaaggccctggccgaggccgccgacgtgggcgcccagatgatcaagctggtgggcctgagagagctgagcgaggccgagagacagctgagaagcctggtggtggccctgatgcaggaggtgttcaccgagttcttccccggctgcgtggtgcaccccttcggcagcagcatcaacagcttcgacgtgcacggctgcgacctggacctgttcctggacctgggcgacctggaggagccccagcccgtgcccaaggcccccgagagccccagcctggacagcgccctggccagccccctggacccccaggccctggcctgcacccccgccagcccccccgacagccagccccccgccagcccccaggacagcgaggccctggacttcgagacccccagcagcagcctggccccccagacccccgacagcgccctggccagcgagaccctggccagcccccagagcctgccccccgccagccccctgctggaggacagagaggagggcgacctgggcaaggccagcgagctggccgagacccccaaggaggagaaggccgagggcgccgccatgctggagctggtgggcagcatcctgagaggctgcgtgcccggcgtgtacagagtgcagaccgtgcccagcgccagaagacccgtggtgaagttctgccacagacccagcggcctgcacggcgacgtgagcctgagcaacagactggccctgcacaacagcagattcctgagcctgtgcagcgagctggacggcagagtgagacccctggtgtacaccctgagatgctgggcccagggcagaggcctgagcggcagcggccccctgctgagcaactacgccctgaccctgctggtgatctacttcctgcagaccagagacccccccgtgctgcccaccgtgagccagctgacccagaaggccggcgagggcgagcaggtggaggtggacggctgggactgcagcttccccagagacgccagcagactggagcccagcatcaacgtggagcccctgagcagcctgctggcccagttcttcagctgcgtgagctgctgggacctgagaggcagcctgctgagcctgagagagggccaggccctgcccgtggccggcggcctgcccagcaacctgtgggagggcctgagactgggccccctgaacctgcaggaccccttcgacctgagccacaacgtggccgccaacgtgaccagcagagtggccggcagactgcagaactgctgcagagccgccgccaactactgcagaagcctgcagtaccagagaagaagcagcagaggcagagactggggcctgctgcccctgctgcagcccagcagccccagcagcctgctgagcgccacccccatccccctgcccctggcccccttcacccagctgaccgccgccctggtgcaggtgttcagagaggccctgggctgccacatcgagcaggccaccaagagaaccagaagcgagggcggcggcaccggcgagagcagccagggcggcaccagcaagagactgaaggtggacggccagaagaactgctgcgaggagggcaaggaggagcagcagggctgcgccggcgacggcggcgaggacagagtggaggagatggtgatcgaggtgggcgagatggtgcaggactgggccatgcagagccccggccagcccggcgacctgcccctgaccaccggcaagcacggcgcccccggcgaggagggccagcccagccacgccgccctggccgagagaggccccaagggccacgaggccgcccaggagtggagccagggcgaggccggcaagggcgccagcctgcccagcagcgccagctggagatgcgccctgtggcacagagtgtggcagggcagaagaagagccagaagaagactgcagcagcagaccaaggagggcgccggcggcggcgccggcaccagagccggctggctggccaccgaggcccaggtgacccaggagctgaagggcctgagcggcggcgaggagagacccgagaccgagcccctgctgagcttcgtggccagcgtgagccccgccgacagaatgctgaccgtgacccccctgcaggacccccagggcctgttccccgacctgcaccacttcctgcaggtgttcctgccccaggccatcagacacctgaagtag

SEQ ID NO: 9767 - DNA, 2625 bp, Artificial Sequence
  Description of Artificial Sequence: Synthetic coding sequence
atggccgccgtggacagcgacgtggagagcctgcccagaggcggcttcagatgctgcctgtgccacgtgaccaccgccaacagacccagcctggacgcccacctgggcggcagaaagcacagacacctggtggagctgagagccgccagaaaggcccagggcctgagaagcgtgttcgtgagcggcttccccagagacgtggacagcgcccagctgagcgagtacttcctggccttcggccccgtggccagcgtggtgatggacaaggacaagggcgtgttcgccatcgtggagatgggcgacgtgggcgccagagaggccgtgctgagccagagccagcacagcctgggcggccacagactgagagtgagacccagagagcagaaggagttccagagccccgccagcaagagccccaagggcgccgcccccgacagccaccagctggccaaggccctggccgaggccgccgacgtgggcgcccagatgatcaagctggtgggcctgagagagctgagcgaggccgagagacagctgagaagcctggtggtggccctgatgcaggaggtgttcaccgagttcttccccggctgcgtggtgcaccccttcggcagcagcatcaacagcttcgacgtgcacggctgcgacctggacctgttcctggacctgggcgacctggaggagccccagcccgtgcccaaggcccccgagagccccagcctggacagcgccctggccagccccctggacccccaggccctggcctgcacccccgccagcccccccgacagccagccccccgccagcccccaggacagcgaggccctggacttcgagacccccagcagcagcctggccccccagacccccgacagcgccctggccagcgagaccctggccagcccccagagcctgccccccgccagccccctgctggaggacagagaggagggcgacctgggcaaggccagcgagctggccgagacccccaaggaggagaaggccgagggcgccgccatgctggagctggtgggcagcatcctgagaggctgcgtgcccggcgtgtacagagtgcagaccgtgcccagcgccagaagacccgtggtgaagttctgccacagacccagcggcctgcacggcgacgtgagcctgagcaacagactggccctgcacaacagcagattcctgagcctgtgcagcgagctggacggcagagtgagacccctggtgtacaccctgagatgctgggcccagggcagaggcctgagcggcagcggccccctgctgagcaactacgccctgaccctgctggtgatctacttcctgcagaccagagacccccccgtgctgcccaccgtgagccagctgacccagaaggccggcgagggcgagcaggtggaggtggacggctgggactgcagcttccccagagacgccagcagactggagcccagcatcaacgtggagcccctgagcagcctgctggcccagttcttcagctgcgtgagctgctgggacctgagaggcagcctgctgagcctgagagagggccaggccctgcccgtggccggcggcctgcccagcaacctgtgggagggcctgagactgggccccctgaacctgcaggaccccttcgacctgagccacaacgtggccgccaacgtgaccagcagagtggccggcagactgcagaactgctgcagagccgccgccaactactgcagaagcctgcagtaccagagaagaagcagcagaggcagagactggggcctgctgcccctgctgcagcccagcagccccagcagcctgctgagcgccacccccatccccctgcccctggcccccttcacccagctgaccgccgccctggtgcaggtgttcagagaggccctgggctgccacatcgagcaggccaccaagagaaccagaagcgagggcggcggcaccggcgagagcagccagggcggcaccagcaagagactgaaggtggacggccagaagaactgctgcgaggagggcaaggaggagcagcagggctgcgccggcgacggcggcgaggacagagtggaggagatggtgatcgaggtgggcgagatggtgcaggactgggccatgcagagccccggccagcccggcgacctgcccctgaccaccggcaagcacggcgcccccggcgaggagggccagcccagccacgccgccctggccgagagaggccccaagggccacgaggccgcccaggagtggagccagggcgaggccggcaagggcgccagcctgcccagcagcgccagctggagatgcgccctgtggcacagagtgtggcagggcagaagaagagccagaagaagactgcagcagcagaccaaggagggcgccggcggcggcgccggcaccagagccggctggctggccaccgaggcccaggtgacccaggagctgaagggcctgagcggcggcgaggagagacccgagaccgagcccctgctgagcttcgtggccagcgtgagccccgccgacagaatgctgaccgtgacccccctgcaggacccccagggcctgttccccgacctgcaccacttcctgcaggtgttcctgccccaggccatcagacacctgaagtag

SEQ ID NO: 9768 - DNA, 495 bp, Artificial Sequence
  Description of Artificial Sequence: Synthetic coding sequence
atgtgcccccccgtgagcatgagatacgaggaggagggcatgagctacctgtacgccagctggatgtaccagctgcagcacggcgaccagctgagcatctgcttcacctgcttcaaggccgccttcctggacttcaaggacctgctggagagcgaggactgggaggaggacaactgggaccccgagctgatggagcacaccgaggccgagagcgagcaggagggcagcagcggcatggagctgagctggggccagagccccggccagcccgtgcagggcggcagcgaggcctggggccccggcaccctggccgccgcccccgagggcctggaggacgccggcctggacccccacttcgtgcccaccgagctgtggccccaggaggccgtgcccctgggcctgggcctggaggacgccgactggacccagggcctgccctggagattcgaggagctgctgacctgcagccactggcccagcttcttccccagctag

SEQ ID NO: 9769 - DNA, 1236 bp, Artificial Sequence
  Description of Artificial Sequence: Synthetic coding sequence
atgctgagcctgagagagcagcagctgcaggtgtggttcaagaacagaagagccaagctggccagagagagaagactgcagcagcagccccagagagtgcccggccagagaggcagaggcgccagagccgcccccctggtgcccgccgccagcgccagcgccccccagagaggccccagcggcatcctgcccgccgccgagcccaccatctgcagcctgcaccaggcctggggcggccccggctgcagagcccagaagggcatccccgccgccctgagccccggccccggccccatccccgcccccatccccggccccgcccagatccccggccccctgcccggcagcatccccggccccatccccggccccgcccagatccccagccccatccccgcccccatccccggccccatcagcggccccgtgcagatccccggccccttcagaggccccatccccggccccatcagcggccccgcccccatccccggccccatcagcggccccttcagcggccccaaccccggccccatccccggccccaaccccggccccatccccggccccatcagcggccccatccccggccccatcagcgtgcccatccccggccccatccccggccccatcagcggccccatcagcggccccaaccccggccccatccccggccccatccccggccccatcagcggccccaaccccggccccatccccggccccatcagcggccccaaccccggcctgatccccggccccatccccggccccatcagcggccccggccccatcatcggccccatccccagccccgcccagatccccggccccggcagactgcagggccccggccccatcctgagccccggcagaatgagaagccccggcagcctgcccggcctggcccccatcctgggccccggcagcggccccggcagcggcagcgtgcccgcccccatccccggccccggcagcctgcccgcccccgcccccctgtggccccagagccccgacgccagcgacttcctgcccgacacccagctgttcccccacttcaccgagctgctgctgcccctggaccccctggagggcagcagcgtgagcaccatgaccagccagtaccaggagggcgacgacagcatgggcaagaagcacagcggcagccagccccaggaggagggcggcagcgtgaacgagaaccacagcggccccagactgctgctggacctgtag

SEQ ID NO: 9770 - DNA, 1527 bp, Artificial Sequence
  Description of Artificial Sequence: Synthetic coding sequence
atggacgaggccggcaaccaccacagcgagcagaccatcaccagaaccgagaaccagaccccccacgccctggcccacagaagaatgggcccctgcctgagctgcagccagctgtacagccagtacctgggcctgagccagacccacagcagcccccccctggccctggacccccccagaagacagagacaggagagaaccgtgtacaccgagagccagcagaaggtgctggagttctacttccagaaggaccagtaccccaactacgaccagagactgaacctggccgagatgctgagcctgagagagcagcagctgcaggtgtggttcaagaacagaagagccaagctggccagagagagaagactgcagcagcagccccagagagtgcccggccagagaggcagaggcgccagagccgcccccctggtgcccgccgccagcgccagcgccccccagagaggccccagcggcatcctgcccgccgccgagcccaccatctgcagcctgcaccaggcctggggcggccccggctgcagagcccagaagggcatccccgccgccctgagccccggccccggccccatccccgcccccatccccggccccgcccagatccccggccccctgcccggcagcatccccggccccatccccggccccgcccagatccccagccccatccccgcccccatccccggccccatcagcggccccgtgcagatccccggccccttcagaggccccatccccggccccatcagcggccccgcccccatccccggccccatcagcggccccttcagcggccccaaccccggccccatccccggccccaaccccggccccatccccggccccatcagcggccccatccccggccccatcagcgtgcccatccccggccccatccccggccccatcagcggccccatcagcggccccaaccccggccccatccccggccccatccccggccccatcagcggccccaaccccggccccatccccggccccatcagcggccccaaccccggcctgatccccggccccatccccggccccatcagcggccccggccccatcatcggccccatccccagccccgcccagatccccggccccggcagactgcagggccccggccccatcctgagccccggcagaatgagaagccccggcagcctgcccggcctggcccccatcctgggccccggcagcggccccggcagcggcagcgtgcccgcccccatccccggccccggcagcctgcccgcccccgcccccctgtggccccagagccccgacgccagcgacttcctgcccgacacccagctgttcccccacttcaccgagctgctgctgcccctggaccccctggagggcagcagcgtgagcaccatgaccagccagtaccaggagggcgacgacagcatgggcaagaagcacagcggcagccagccccaggaggagggcggcagcgtgaacgagaaccacagcggccccagactgctgctggacctgtag

SEQ ID NO: 9771 - DNA, 1206 bp, Artificial Sequence
  Description of Artificial Sequence: Synthetic coding sequence
atgctgagcctgagagagcagcagctgcaggtgtggttcaagaacagaagagccaagctggccagagagagaagactgcagcagcagccccagagagtgcccggccagagaggcagaggcgccagagccgcccccctggtgcccgccgccagcgccagcgccccccagagaggccccagcggcatcctgcccgccgccgagcccaccatctgcagcctgcaccaggcctggggcggccccggctgcagagcccagaagggcatccccgccgccctgagccccggccccggccccatccccgcccccatccccggccccgcccagatccccggccccctgcccggcagcatccccggccccatccccggccccgcccagatccccagccccatccccgcccccatccccggccccatcagcggccccgtgcagatccccggccccttcagaggccccatccccggccccatcagcggccccttcagcggccccaaccccggccccatccccggccccaaccccggccccatccccggccccatcagcggccccatccccggccccatcagcgtgcccatccccggccccatccccggccccatcagcggccccatcagcggccccaaccccggccccatccccggccccatccccggccccatcagcggccccaaccccggccccatccccggccccatcagcggccccaaccccggcctgatccccggccccatccccggccccatcagcggccccggccccatcatcggccccatccccagccccgcccagatccccggccccggcagactgcagggccccggccccatcctgagccccggcagaatgagaagccccggcagcctgcccggcctggcccccatcctgggccccggcagcggccccggcagcggcagcgtgcccgcccccatccccggccccggcagcctgcccgcccccgcccccctgtggccccagagccccgacgccagcgacttcctgcccgacacccagctgttcccccacttcaccgagctgctgctgcccctggaccccctggagggcagcagcgtgagcaccatgaccagccagtaccaggagggcgacgacagcatgggcaagaagcacagcggcagccagccccaggaggagggcggcagcgtgaacgagaaccacagcggccccagactgctgctggacctgtag

SEQ ID NO: 9772 - DNA, 1206 bp, Artificial Sequence
  Description of Artificial Sequence: Synthetic coding sequence
atggtgctggcccagagcagagtgagcgccggcgtgggcagcccccactgcagcggcagcggcggcggcggcagcgacagcttcccctggcccgccagccaccccggcaacccccagtgcagcttcagcaccgccttcctggccagccccagactgagcagaggcaccctggcctacctgccccccgccccctggagcagcctggccacccccagcgccctgctgggcagcagctgcgcccccccccccccccccgccagatgcccccagcccagagccctgagccccgagctgggcaccaaggccggccccagaagaccccacagatgggagctgcccagaagccccagccagggcgcccagggccccgcccccagaagaagactgctggagaccatgaagggcatcgtggccgccagcggcagcgagaccgaggacgaggacagcatggacatccccctggacctgagcagcagcgccggcagcggcaagagaagaagaagaggcaacctgcccaaggagagcgtgcagatcctgagagactggctgtacgagcacagatacaacgcctaccccagcgagcaggagaaggccctgctgagccagcagacccacctgagcaccctgcaggtgtgcaactggttcatcaacgccagaagaagactgctgcccgacatgctgagaaaggacggcaaggaccccaaccagttcaccatcagcagaagaggcgccaagatcagcgagaccagcagcgtggagagcgtgatgggcatcaagaacttcatgcccgccctggaggagacccccttccacagctgcaccgccggccccaaccccaccctgggcagacccctgagccccaagcccagcagccccggcagcgtgctggccagacccagcgtgatctgccacaccaccgtgaccgccctgaaggacgtgcccttcagcctgtgccagagcgtgggcgtgggccagaacaccgacatccagcagatcgccgccaagaacttcaccgacaccagcctgatgtaccccgaggacacctgcaagagcggccccagcaccaacacccagagcggcctgttcaacacccccccccccaccccccccgacctgaaccaggacttcagcggcttccagctgctggtggacgtggccctgaagagagccgccgagatggagctgcaggccaagctgaccgcctag

SEQ ID NO: 9773 - DNA, 819 bp, Artificial Sequence
  Description of Artificial Sequence: Synthetic coding sequence
atgaagggcaagaagggcatcgtggccgccagcggcagcgagaccgaggacgaggacagcatggacatccccctggacctgagcagcagcgccggcagcggcaagagaagaagaagaggcaacctgcccaaggagagcgtgcagatcctgagagactggctgtacgagcacagatacaacgcctaccccagcgagcaggagaaggccctgctgagccagcagacccacctgagcaccctgcaggtgtgcaactggttcatcaacgccagaagaagactgctgcccgacatgctgagaaaggacggcaaggaccccaaccagttcaccatcagcagaagaggcgccaagatcagcgagaccagcagcgtggagagcgtgatgggcatcaagaacttcatgcccgccctggaggagacccccttccacagctgcaccgccggccccaaccccaccctgggcagacccctgagccccaagcccagcagccccggcagcgtgctggccagacccagcgtgatctgccacaccaccgtgaccgccctgaaggacgtgcccttcagcctgtgccagagcgtgggcgtgggccagaacaccgacatccagcagatcgccgccaagaacttcaccgacaccagcctgatgtaccccgaggacacctgcaagagcggccccagcaccaacacccagagcggcctgttcaacacccccccccccaccccccccgacctgaaccaggacttcagcggcttccagctgctggtggacgtggccctgaagagagccgccgagatggagctgcaggccaagctgaccgcctag

SEQ ID NO: 9774 - DNA, 759 bp, Artificial Sequence
  Description of Artificial Sequence: Synthetic coding sequence
atggacatccccctggacctgagcagcagcgccggcagcggcaagagaagaagaagaggcaacctgcccaaggagagcgtgcagatcctgagagactggctgtacgagcacagatacaacgcctaccccagcgagcaggagaaggccctgctgagccagcagacccacctgagcaccctgcaggtgtgcaactggttcatcaacgccagaagaagactgctgcccgacatgctgagaaaggacggcaaggaccccaaccagttcaccatcagcagaagaggcgccaagatcagcgagaccagcagcgtggagagcgtgatgggcatcaagaacttcatgcccgccctggaggagacccccttccacagctgcaccgccggccccaaccccaccctgggcagacccctgagccccaagcccagcagccccggcagcgtgctggccagacccagcgtgatctgccacaccaccgtgaccgccctgaaggacgtgcccttcagcctgtgccagagcgtgggcgtgggccagaacaccgacatccagcagatcgccgccaagaacttcaccgacaccagcctgatgtaccccgaggacacctgcaagagcggccccagcaccaacacccagagcggcctgttcaacacccccccccccaccccccccgacctgaaccaggacttcagcggcttccagctgctggtggacgtggccctgaagagagccgccgagatggagctgcaggccaagctgaccgcctag

SEQ ID NO: 9775 - DNA, 759 bp, Artificial Sequence; identical to SEQ ID NO: 9774
  Description of Artificial Sequence: Synthetic coding sequence

SEQ ID NO: 9776 - DNA, 759 bp, Artificial Sequence; identical to SEQ ID NO: 9774
  Description of Artificial Sequence: Synthetic coding sequence

SEQ ID NO: 9777 - DNA, 759 bp, Artificial Sequence; identical to SEQ ID NO: 9774
  Description of Artificial Sequence: Synthetic coding sequence

SEQ ID NO: 9778 - DNA, 819 bp, Artificial Sequence; identical to SEQ ID NO: 9773
  Description of Artificial Sequence: Synthetic coding sequence

SEQ ID NO: 9779 - DNA, 759 bp, Artificial Sequence; identical to SEQ ID NO: 9774
  Description of Artificial Sequence: Synthetic coding sequence

SEQ ID NO: 9780 - DNA, 861 bp, Artificial Sequence
  Description of Artificial Sequence: Synthetic coding sequence
atgacctgcagcggcaagagctgcgccctggccagaagcagcctgaccagcagccagggcatcgtggccgccagcggcagcgagaccgaggacgaggacagcatggacatccccctggacctgagcagcagcgccggcagcggcaagagaagaagaagaggcaacctgcccaaggagagcgtgcagatcctgagagactggctgtacgagcacagatacaacgcctaccccagcgagcaggagaaggccctgctgagccagcagacccacctgagcaccctgcaggtgtgcaactggttcatcaacgccagaagaagactgctgcccgacatgctgagaaaggacggcaaggaccccaaccagttcaccatcagcagaagaggcgccaagatcagcgagaccagcagcgtggagagcgtgatgggcatcaagaacttcatgcccgccctggaggagacccccttccacagctgcaccgccggccccaaccccaccctgggcagacccctgagccccaagcccagcagccccggcagcgtgctggccagacccagcgtgatctgccacaccaccgtgaccgccctgaaggacgtgcccttcagcctgtgccagagcgtgggcgtgggccagaacaccgacatccagcagatcgccgccaagaacttcaccgacaccagcctgatgtaccccgaggacacctgcaagagcggccccagcaccaacacccagagcggcctgttcaacacccccccccccaccccccccgacctgaaccaggacttcagcggcttccagctgctggtggacgtggccctgaagagagccgccgagatggagctgcaggccaagctgaccgcctag

SEQ ID NO: 9781 - DNA, 279 bp, Artificial Sequence
  Description of Artificial Sequence: Synthetic coding sequence
atggacatccccctggacctgagcagcagcgccggcagcggcaagagaagaagaagaggcaacctgcccaaggagagcgtgcagatcctgagagactggctgtacgagcacagatacaacgcctaccccagcgagcaggagaaggccctgctgagccagcagacccacctgagcaccctgcaggtgtgcaactggttcatcaacgccagaagaagactgctgcccgacatgctgagaaaggacggcaaggaccccaaccagttcaccatcagcagatag

SEQ ID NO: 9782 - DNA, 402 bp, Artificial Sequence
  Description of Artificial Sequence: Synthetic coding sequence
atggacatccccctggacctgagcagcagcgccggcagcggcaagagaagaagaagaggcaacctgcccaaggagagcgtgcagatcctgagagactggctgtacgagcacagatacaacgcctaccccagcgagcaggagaaggccctgctgagccagcagacccacctgagcaccctgcaggtgtgcaactggttcatcaacgccagaagaagactgctgcccgacatgctgagaaaggacggcaaggaccccaaccagttcaccatcagcagaagaggcgccaagatcagcgagaccagcagcgtggagagcgtgatgggcatcaagaacttcatgcccgccctggaggagacccccttccacagctgcaccgccggccccaaccccaccctgggctag

SEQ ID NO: 9783 - DNA, 741 bp, Artificial Sequence
  Description of Artificial Sequence: Synthetic coding sequence
atggacatccccctggacctgagcagcagcgccggcagcggcaagagaagaagaagaggcaacctgcccaaggagagcgtgcagatcctgagagactggctgtacgagcacagatacaacgcctaccccagcgagcaggagaaggccctgctgagccagcagacccacctgagcaccctgcaggtgtgcaactggttcatcaacgccagaagaagactgctgcccgacatgctgagaaaggacggcaaggaccccaaccagttcaccatcagcagaagaggcgccaagatcagcgagaccagcagcgtggagagcgtgatgggcatcaagaacttcatgcccgccctggaggagacccccttccacagctgcaccgccggccccaaccccaccctgggcagacccctgagccccaagcccagcagccccggcagcgtgctggccagacccagcgtgatctgccacaccaccgtgaccgccctgaaggacgtgcccttcagcctgtgccagagcgtgggcgtgggccagaacaccgacatccagcagatcgccgccaagaacttcaccgacaccagcctgatgtaccccgaggacacctgcaagagcggccccagcaccaacacccagagcggcctgttcaacacccccccccccaccccccccgacctgaaccaggacttcagcggcttccagctgctggtggacgtggccctgaagagagccgccgagatggagctgtag

SEQ ID NO: 9784 - DNA, 660 bp, Artificial Sequence
  Description of Artificial Sequence: Synthetic coding sequence
atggacatccccctggacctgagcagcagcgccggcagcggcaagagaagaagaagaggcaacctgcccaaggagagcgtgcagatcctgagagactggctgtacgagcacagatacaacgcctaccccagcgagcaggagaaggccctgctgagccagcagacccacctgagcaccctgcaggtgtgcaactggttcatcaacgccagaagaagactgctgcccgacatgctgagaaaggacggcaaggaccccaaccagttcaccatcagcagaagaggcgccaagatcagcgagaccagcagcgtggagagcgtgatgggcatcaagaacttcatgcccgccctggaggagacccccttccacagctgcaccgccggccccaaccccaccctgggcagacccctgagccccaagcccagcagccccggcagcgtgctggccagacccagcgtgatctgccacaccaccgtgaccgccctgaaggacgtgcccttcagcctgtgccagagcgtgggcgtgggccagaacaccgacatccagcagatcgccgccaagaacttcaccgacaccagcctgatgtaccccgaggacacctgcaagagcggccccagcaccaacacccagagcggcctgttcaacacccccccccccacctag

SEQ ID NO: 9785 - DNA, 396 bp, Artificial Sequence
  Description of Artificial Sequence: Synthetic coding sequence
atggacatccccctggacctgagcagcagcgccggcagcggcaagagaagaagaagaggcaacctgcccaaggagagcgtgcagatcctgagagactggctgtacgagcacagatacaacgcctaccccagcgagcaggagaaggccctgctgagccagcagacccacctgagcaccctgcaggtgtgcaactggttcatcaacgccagaagaagactgctgcccgacatgctgagaaaggacggcaaggaccccaaccagttcaccatcagcagaagaggcgccaagatcagcgagaccagcagcgtggagagcgtgatgggcatcaagaacttcatgcccgccctggaggagacccccttccacagctgcaccgccggccccaaccccacctag

SEQ ID NO: 9786 - DNA, 417 bp, Artificial Sequence
  Description of Artificial Sequence: Synthetic coding sequence
atggacatccccctggacctgagcagcagcgccggcagcggcaagagaagaagaagaggcaacctgcccaaggagagcgtgcagatcctgagagactggctgtacgagcacagatacaacgcctaccccagcgagcaggagaaggccctgctgagccagcagacccacctgagcaccctgcaggtgtgcaactggttcatcaacgccagaagaagactgctgcccgacatgctgagaaaggacggcaaggaccccaaccagttcaccatcagcagaagaggcgccaagatcagcgagaccagcagcgtggagagcgtgatgggcatcaagaacttcatgcccgccctggaggagacccccttccacagctgcaccgccggccccaaccccaccctgggcagacccctgagcccctag

SEQ ID NO: 9787 - DNA, 759 bp, Artificial Sequence; identical to SEQ ID NO: 9774
  Description of Artificial Sequence: Synthetic coding sequence

SEQ ID NO: 9788 - DNA, 507 bp, Artificial Sequence
  Description of Artificial Sequence: Synthetic coding sequence
atggacatccccctggacctgagcagcagcgccggcagcggcaagagaagaagaagaggcaacctgcccaaggagagcgtgcagatcctgagagactggctgtacgagcacagatacaacgcctaccccagcgagcaggagaaggccctgctgagccagcagacccacctgagcaccctgcaggtgtgcaactggttcatcaacgccagaagaagactgctgcccgacatgctgagaaaggacggcaaggaccccaaccagttcaccatcagcagaagaggcgccaagatcagcgagaccagcagcgtggagagcgtgatgggcatcaagaacttcatgcccgccctggaggagacccccttccacagctgcaccgccggccccaaccccaccctgggcagacccctgagccccaagcccagcagccccggcagcgtgctggccagacccagcgtgatctgccacaccaccgtgaccgccctgaaggacgtgcccttcagcctgtag

SEQ ID NO: 9789 - DNA, 2523 bp, Artificial Sequence
  Description of Artificial Sequence: Synthetic coding sequence
atggccggccccggcagcaccggcggccagatcggcgccgccgccctggccggcggcgccagaagcaaggtggcccccagcgtggacttcgaccacagctgcagcgacagcgtggagtacctgaccctgaacttcggccccttcgagaccgtgcacagatggagaagactgcccccctgcgacgagttcgtgggcgccagaagaagcaagcacaccgtggtggcctacaaggacgccatctacgtgttcggcggcgacaacggcaagaccatgctgaacgacctgctgagattcgacgtgaaggactgcagctggtgcagagccttcaccaccggcaccccccccgcccccagataccaccacagcgccgtggtgtacggcagcagcatgttcgtgttcggcggctacaccggcgacatctacagcaacagcaacctgaagaacaagaacgacctgttcgagtacaagttcgccaccggccagtggaccgagtggaagatcgagggcagactgcccgtggccagaagcgcccacggcgccaccgtgtacagcgacaagctgtggatcttcgccggctacgacggcaacgccagactgaacgacatgtggaccatcggcctgcaggacagagagctgacctgctgggaggaggtggcccagagcggcgagatcccccccagctgctgcaacttccccgtggccgtgtgcagagacaagatgttcgtgttcagcggccagagcggcgccaagatcaccaacaacctgttccagttcgagttcaaggacaagacctggaccagaatccccaccgagcacctgctgagaggcagccccccccccccccagagaagatacggccacaccatggtggccttcgacagacacctgtacgtgttcggcggcgccgccgacaacaccctgcccaacgagctgcactgctacgacgtggacttccagacctgggaggtggtgcagcccagcagcgacagcgaggtgggcggcgccgaggtgcccgagagagcctgcgccagcgaggaggtgcccaccctgacctacgaggagagagtgggcttcaagaagagcagagacgtgttcggcctggacttcggcaccaccagcgccaagcagcccacccagcccgccagcgagctgcccagcggcagactgttccacgccgccgccgtgatcagcgacgccatgtacatcttcggcggcaccgtggacaacaacatcagaagcggcgagatgtacagattccagttcagctgctaccccaagtgcaccctgcacgaggactacggcagactgtgggagagcagacagttctgcgacgtggagttcgtgctgggcgagaaggaggagtgcgtgcagggccacgtggccatcgtgaccgccagaagcagatggctgagaagaaagatcacccaggccagagagagactggcccagaagctggagcaggaggccgcccccgtgcccagagaggcccccggcgtggccgccggcggcgccagaccccccctgctgcacgtggccatcagagaggccgaggccagacccttcgaggtgctgatgcagttcctgtacaccgacaagatcaagtaccccagaaagggccacgtggaggacgtgctgctgatcatggacgtgtacaagctggccctgagcttccagctgtgcagactggagcagctgtgcagacagtacatcgaggccagcgtggacctgcagaacgtgctggtggtgtgcgagagcgccgccagactgcagctgagccagctgaaggagcactgcctgaacttcgtggtgaaggagagccacttcaaccaggtgatcatgatgaaggagttcgagagactgagcagccccctgatcgtggagatcgtgagaagaaagcagcagcccccccccagaacccccctggaccagcccgtggacatcggcaccagcctgatccaggacatgaaggcctacctggagggcgccggcgccgagttctgcgacatcaccctgctgctggacggccaccccagacccgcccacaaggccatcctggccgccagaagcagctacttcgaggccatgttcagaagcttcatgcccgaggacggccaggtgaacatcagcatcggcgagatggtgcccagcagacaggccttcgagagcatgctgagatacatctactacggcgaggtgaacatgccccccgaggacagcctgtacctgttcgccgccccctactactacggcttctacaacaacagactgcaggcctactgcaagcagaacctggagatgaacgtgaccgtgcagaacgtgctgcagatcctggaggccgccgacaagacccaggccctggacatgaagagacactgcctgcacatcatcgtgcaccagttcaccaaggtgagcaagctgcccaccctgagaagcctgagccagcagctgctgctggacatcatcgacagcctggccagccacatcagcgacaagcagtgcgccgagctgggcgccgacatctag

SEQ ID NO: 9790 - DNA, 930 bp, Artificial Sequence
  Description of Artificial Sequence: Synthetic coding sequence
atgcccagacactgcagcgccgccggctgctgcaccagagacaccagagagaccagaaacagaggcatcagcttccacagactgcccaagaaggacaaccccagaagaggcctgtggctggccaactgccagagactggaccccagcggccagggcctgtgggaccccgccagcgagtacatctacttctgcagcaagcacttcgaggaggactgcttcgagctggtgggcatcagcggctaccacagactgaaggagggcgccgtgcccaccatcttcgagagcttcagcaagctgagaagaaccaccaagaccaagggccacagctacccccccggccccgccgaggtgagcagactgagaagatgcagaaagagatgcagcgagggcagaggccccaccacccccttcagcccccccccccccgccgacgtgacctgcttccccgtggaggaggccagcgcccccgccaccctgcccgccagccccgccggcagactggagcccggcctgagcagccccttcagcgacctgctgggccccctgggcgcccaggccgacgaggccggctgcagcgcccagcccagccccgagagacagcccagccccctggagcccagacccgtgagccccagcgcctacatgctgagactgcccccccccgccggcgcctacatccagaacgagcacagctaccaggtgggcagcgccctgctgtggaagagaagagccgaggccgccctggacgccctggacaaggcccagagacagctgcaggcctgcaagagaagagagcagagactgagactgagactgaccaagctgcagcaggagagagccagagagaagagagcccaggccgacgccagacagaccctgaaggagcacgtgcaggacttcgccatgcagctgagcagcagcatggcctag

SEQ ID NO: 9791 - DNA, 1140 bp, Artificial Sequence
  Description of Artificial Sequence: Synthetic coding sequence
atgggcgacagcagaagaagaagcctgggcaaccagcccagcagcgaggccgccggcagaagcgagagagagcaggacggcgaccccagaggcctgcagagcagcgtgtacgagagcagaagagtgaccgaccccgagagacaggacctggacaacgccgagctgggccccgaggaccccgaggaggagctgccccccgaggaggtggccggcgaggagttccccgagaccctggaccccaaggaggccctgagcgagctggagagagtgctggacaaggacctggaggaggacatccccgagatcagcagactgagcatcagccagaagctgcccagcaccaccatgaccaaggccagaaagagaagaagaagaagaagactgatggagctggccgagcccaagatcaactggcaggtgctgaaggacagaaagggcagatgcggcaagggctacgcctggatcagcccctgcaagatgagcctgcacttctgcctgtgctggcccagcgtgtactggaccgagagattcctggaggacaccaccctgaccatcaccgtgcccgccgtgagcagaagagtggaggagctgagcagacccaagagattctacctggagtactacaacaacaacagaaccacccccgtgtggcccatccccagaagcagcctggagtacagagccagcagcagactgaaggagctggccgcccccaagatcagagacaacttctggagcatgcccatgagcgaggtgagccaggtgagcagagccgcccagatggccgtgcccagcagcagaatcctgcagctgagcaagcccaaggcccccgccaccctgctggaggagtgggaccccgtgcccaagcccaagccccacgtgagcgaccacaacagactgctgcacctggccagacccaaggcccagagcgacaagtgcgtgcccgacagagaccccagatgggaggtgctggacgtgaccaagaaggtggtggccagccccagaatcatcagcctggccaagcccaaggtgagaaagggcctgaacgagggctacgacagaagacccctggccagcatgagcctgcccccccccaaggccagccccgagaagtgcgaccagcccagacccggcctgtag

SEQ ID NO: 9792 - DNA, 1068 bp, Artificial Sequence
  Description of Artificial Sequence: Synthetic coding sequence
atgggcgacagcagaagaagaagcctgggcaaccagcccagcagcgaggccgccggcagaagcgagagagagcaggacggcgaccccagaggcctgcagagcagcgtgtacgagagcagaagagtgaccgaccccgagagacaggacctggacaacgccgagctgggccccgaggaccccgaggaggagctgccccccgaggaggtggccggcgaggagttccccgagaccctggaccccaaggaggccctgagcgagctggagagagtgctggacaaggacctggaggaggacatccccgagatcagcagactgagcatcagccagaagctgcccagcaccaccatgaccaaggccagaaagagaagaagaagaagaagactgatggagctggccgagcccaagatcaactggcaggtgctgaaggacagacccagcgtgtactggaccgagagattcctggaggacaccaccctgaccatcaccgtgcccgccgtgagcagaagagtggaggagctgagcagacccaagagattctacctggagtactacaacaacaacagaaccacccccgtgtggcccatccccagaagcagcctggagtacagagccagcagcagactgaaggagctggccgcccccaagatcagagacaacttctggagcatgcccatgagcgaggtgagccaggtgagcagagccgcccagatggccgtgcccagcagcagaatcctgcagctgagcaagcccaaggcccccgccaccctgctggaggagtgggaccccgtgcccaagcccaagccccacgtgagcgaccacaacagactgctgcacctggccagacccaaggcccagagcgacaagtgcgtgcccgacagagaccccagatgggaggtgctggacgtgaccaagaaggtggtggccagccccagaatcatcagcctggccaagcccaaggtgagaaagggcctgaacgagggctacgacagaagacccctggccagcatgagcctgcccccccccaaggccagccccgagaagtgcgaccagcccagacccggcctgtag

SEQ ID NO: 9793 - DNA, 450 bp, Artificial Sequence
  Description of Artificial Sequence: Synthetic coding sequence
atgagcttcctgctgcccaagctgaccagcaagaaggaggtggaccaggccatcaagagcaccgccgagaaggtgctggtgctgagattcggcagagacgaggaccccgtgtgcctgcagctggacgacatcctgagcaagaccagcagcgacctgagcaagatggccgccatctacctggtggacgtggaccagaccgccgtgtacacccagtacttcgacatcagctacatccccagcaccgtgttcttcttcaacggccagcacatgaaggtggactacggcagccccgaccacaccaagttcgtgggcagcttcaagaccaagcaggacttcatcgacctgatcgaggtgatctacagaggcgccatgagaggcaagctgatcgtgcagagccccatcgaccccaagaacatccccaagtacgacctgctgtaccaggacatctag

SEQ ID NO: 9794 - DNA, 450 bp, Artificial Sequence; identical to SEQ ID NO: 9793
  Description of Artificial Sequence: Synthetic coding sequence

SEQ ID NO: 9795 - DNA, 450 bp, Artificial Sequence; identical to SEQ ID NO: 9793
  Description of Artificial Sequence: Synthetic coding sequence

SEQ ID NO: 9796 - DNA, 891 bp, Artificial Sequence
  Description of Artificial Sequence: Synthetic coding sequence
atggagagagccgtgcccctggccgtgcccctgggccagaccgaggtgttccaggccctgcagagactgcacatgaccatcttcagccagagcgtgagcccctgcggcaagttcctggccgccggcaacaactacggccagatcgccatcttcagcctgagcagcgccctgagcagcgaggccaaggaggagagcaagaagcccgtggtgaccttccaggcccacgacggccccgtgtacagcatggtgagcaccgacagacacctgctgagcgccggcgacggcgaggtgaaggcctggctgtgggccgagatgctgaagaagggctgcaaggagctgtggagaagacagcccccctacagaaccagcctggaggtgcccgagatcaacgccctgctgctggtgcccaaggagaacagcctgatcctggccggcggcgactgccagctgcacaccatggacctggagaccggcaccttcaccagagtgctgagaggccacaccgactacatccactgcctggccctgagagagagaagccccgaggtgctgagcggcggcgaggacggcgccgtgagactgtgggacctgagaaccgccaaggaggtgcagaccatcgaggtgtacaagcacgaggagtgcagcagaccccacaacggcagatggatcggctgcctggccaccgacagcgactggatggtgtgcggcggcggccccgccctgaccctgtggcacctgagaagcagcacccccaccaccatcttccccatcagagccccccagaagcacgtgaccttctaccaggacctggtgctgaccgccgccggcaacagctgcagagtggacgtgttcaccaacctgggctacagagccttcagcctgagcttctag

SEQ ID NO: 9797 - DNA, 1026 bp, Artificial Sequence
  Description of Artificial Sequence: Synthetic coding sequence
atggagagagccgtgcccctggccgtgcccctgggccagaccgaggtgttccaggccctgcagagactgcacatgaccatcttcagccagagcgtgagcccctgcggcaagttcctggccgccggcaacaactacggccagatcgccatcttcagcctgagcagcgccctgagcagcgaggccaaggaggagagcaagaagcccgtggtgaccttccaggcccacgacggccccgtgtacagcatggtgagcaccgacagacacctgctgagcgccggcgacggcgaggtgaaggcctggctgtgggccgagatgctgaagaagggctgcaaggagctgtggagaagacagcccccctacagaaccagcctggaggtgcccgagatcaacgccctgctgctggtgcccaaggagaacagcctgatcctggccggcggcgactgccagctgcacaccatggacctggagaccggcaccttcaccagagtgctgagaggccacaccgactacatccactgcctggccctgagagagagaagccccgaggtgctgagcggcggcgaggacggcgccgtgagactgtgggacctgagaaccgccaaggaggtgcagaccatcgaggtgtacaagcacgaggagtgcagcagaccccacaacggcagatggatcggctgcctggccaccgacagcgactggatggtgtgcggcggcggccccgccctgaccctgtggcacctgagaagcagcacccccaccaccatcttccccatcagagccccccagaagcacgtgaccttctaccaggacctgatcctgagcgccggccagggcagatgcgtgaaccagtggcagctgagcggcgagctgaaggcccaggtgcccggcagcagccccggcctgctgagcctgagcctgaaccagcagcccgccgcccccgagtgcaaggtgctgaccgccgccggcaacagctgcagagtggacgtgttcaccaacctgggctacagagccttcagcctgagcttctag

SEQ ID NO: 9798 - DNA, 2868 bp, Artificial Sequence
  Description of Artificial Sequence: Synthetic coding sequence
atgagcaagaccaacaagagcaagagcggcagcagaagcagcagaagcagaagcgccagcagaagcagaagcagaagcttcagcaagagcagaagcagaagcagaagcctgagcagaagcagaaagagaagactgagcagcagaagcagaagcagaagctacagccccgcccacaacagagagagaaaccaccccagagtgtaccagaacagagacttcagaggccacaacagaggctacagaagaccctactacttcagaggcagaaacagaggcttctacccctggggccagtacaacagaggcggctacggcaactacagaagcaactggcagaactacagacaggcctacagccccagaagaggcagaagcagaagcagaagccccaagagaagaagccccagccccagaagcagaagccacagcagaaacagcgacaagagcagcagcgacagaagcagaagaagcagcagcagcagaagcagcagcaaccacagcagagtggagagcagcaagagaaagagcgccaaggagaagaagagcagcagcaaggacagcagacccagccaggccgccggcgacaaccagggcgacgaggccaaggagcagaccttcagcggcggcaccagccaggacaccaaggccagcgagagcagcaagccctggcccgacgccacctacggcaccggcagcgccagcagagccagcgccgtgagcgagctgagccccagagagagaagccccgccctgaagagccccctgcagagcgtggtggtgagaagaagaagccccagacccagccccgtgcccaagcccagcccccccctgagcagcaccagccagatgggcagcaccctgcccagcggcgccggctaccagagcggcacccaccagggccagttcgaccacggcagcggcagcctgagccccagcaagaagagccccgtgggcaagagcccccccagcaccggcagcacctacggcagcagccagaaggaggagagcgccgccagcggcggcgccgcctacaccaagagatacctggaggagcagaagaccgagaacggcaaggacaaggagcagaagcagaccaacaccgacaaggagaagatcaaggagaagggcagcttcagcgacaccggcctgggcgacggcaagatgaagagcgacagcttcgcccccaagaccgacagcgagaagcccttcagaggcagccagagccccaagagatacaagctgagagacgacttcgagaagaagatggccgacttccacaaggaggagatggacgaccaggacaaggacaaggccaagggcagaaaggagagcgagttcgacgacgagcccaagttcatgagcaaggtgatcggcgccaacaagaaccaggaggaggagaagagcggcaagtgggagggcctggtgtacgccccccccggcaaggagaagcagagaaagaccgaggagctggaggaggagagcttccccgagagaagcaagaaggaggacagaggcaagagaagcgagggcggccacagaggcttcgtgcccgagaagaacttcagagtgaccgcctacaaggccgtgcaggagaagagcagcagccccccccccagaaagaccagcgagagcagagacaagctgggcgccaagggcgacttccccaccggcaagagcagcttcagcatcaccagagaggcccaggtgaacgtgagaatggacagcttcgacgaggacctggccagacccagcggcctgctggcccaggagagaaagctgtgcagagacctggtgcacagcaacaagaaggagcaggagttcagaagcatcttccagcacatccagagcgcccagagccagagaagccccagcgagctgttcgcccagcacatcgtgaccatcgtgcaccacgtgaaggagcaccacttcggcagcagcggcatgaccctgcacgagagattcaccaagtacctgaagagaggcaccgagcaggaggccgccaagaacaagaagagccccgagatccacagaagaatcgacatcagccccagcaccttcagaaagcacggcctggcccacgacgagatgaagagccccagagagcccggctacaaggccgagggcaagtacaaggacgaccccgtggacctgagactggacatcgagagaagaaagaagcacaaggagagagacctgaagagaggcaagagcagagagagcgtggacagcagagacagcagccacagcagagagagaagcgccgagaagaccgagaagacccacaagggcagcaagaagcagaagaagcacagaagagccagagacagaagcagaagcagcagcagcagcagccagagcagccacagctacaaggccgaggagtacaccgaggagaccgaggagagagaggagagcaccaccggcttcgacaagagcagactgggcaccaaggacttcgtgggccccagcgagagaggcggcggcagagccagaggcaccttccagttcagagccagaggcagaggctggggcagaggcaactacagcggcaacaacaacaacaacagcaacaacgacttccagaagagaaacagagaggaggagtgggaccccgagtacacccccaagagcaagaagtactacctgcacgacgacagagagggcgagggcagcgacaagtgggtgagcagaggcagaggcagaggcgccttccccagaggcagaggcagattcatgttcagaaagagcagcaccagccccaagtgggcccacgacaagttcagcggcgaggagggcgagatcgaggacgacgagagcggcaccgagaacagagaggagaaggacaacatccagcccaccaccgagtag

SEQ ID NO: 9799 - DNA, 2868 bp, Artificial Sequence; identical to SEQ ID NO: 9798
  Description of Artificial Sequence: Synthetic coding sequence

SEQ ID NO: 9800 - DNA, 123 bp, Artificial Sequence
  Description of Artificial Sequence: Synthetic coding sequence
atgagcaagaccaacaagagcaagagcggcagcagaagcagcagaagcagaagcgccagcagaagcagaagcagaagcttcagcaagagcagaagcagaagcagaagcctgagcagaagctag

SEQ ID NO: 9801 - DNA, 1416 bp, Artificial Sequence
  Description of Artificial Sequence: Synthetic coding sequence
atggagctgagcagcaagaagaagctgcacgccctgagcctggccgagaagatccaggtgctggagctgctggacgagagcaagatgagccagagcgaggtggccagaagattccaggtgagccagccccagatcagcagaatctgcaagaacaaggagaagctgctggccgactggtgcagcggcaccgccaacagagagagaaagagaaagagagagagcaagtacagcggcatcgacgaggccctgctgtgctggtaccacatcgccagagccaaggcctgggacgtgaccggccccatgctgctgcacaaggccaaggagctggccgacatcatgggccaggacttcgtgcccagcatcggctggctggtgagatggaagagaagaaacaacgtgggcttcggcgccagacacgtgctggcccccagcttcccccccgagccccccccccccggcctgaccagccaggcccagctgcccctgagcctgaaggacttcagccccgaggacgtgttcggctgcgccgagctgcccctgctgtacagagccgtgcccggcagcttcggcgcctgcgaccaggtgcaggtgctgctgtgcgccaacagcagaggcaccgagaagagaagagtgctgctgggcggcctgcaggccgcccccagatgcttcttcggcatcagaagcgaggccctgcccgccagctaccaccccgacctgggcatcccctggctggagtggctggcccagttcgacagagacatgggccagcagggcagacaggtggccctgctgctggccgccagagtggtggaggagctggccggcctgcccggcctgtaccacgtgaagctgctgcccctggccgccagcagcaccaccccccccctgcccagcagcgtggtgagagccttcaaggcccactacagacacagactgctgggcaagctggccgccatccagagcgagagagacggcaccagcctggccgaggccggcgccggcatcaccgtgctggacgccctgcacgtggccagcgccgcctgggccaaggtgcccccccagctgatcttcagcagcttcatccaggagggcctggcccccggcaagaccccccccagcagccacaagaccagcgagatgccccccgtgcccggcggcctgagcctggaggagttcagcagattcgtggacctggagggcgaggagcccagaagcggcgtgtgcaaggaggagatcggcaccgaggacgagaagggcgacagagagggcgccttcgagcccctgcccaccaaggccgacgccctgagagccctgggcaccctgagaagatggttcgagtgcaacagcaccagccccgagctgttcgagaagttctacgactgcgaggaggaggtggagagactgtgctgcctgtag

SEQ ID NO: 9802 - DNA, 1539 bp, Artificial Sequence
  Description of Artificial Sequence: Synthetic coding sequence
atggccgaggccagcgtggacgccagcaccctgcccgtgaccgtgaagaagaagaagagcctgagcatcgaggagaagatcgacatcatcaacgccgtggagagcggcaagaagaaggccgagatcgccgccgagtacggcatcaagaagaacagcctgagcagcatcatgaagaacaaggacaaggtgctggaggccttcgagagcctgagattcgaccccaagagaaagagactgagaaccgccttctacaccgacctggaggaggccctgatgagatggtacagaatcgcccagtgcctgaacgtgcccgtgaacggccccatgctgagactgaaggccaacgacttcgcccagaagctgggccacaacgacttcaagtgcagcaacggctggctggacagattcaagagcagatacggcctggtgttcagagcccagcccgtggaggccaccggcgtgcccgtggaccccagcaccgtgtggtaccagaacgtgctgccctactacctgaacgactaccaccccaagaacgtgttcaacatcaaggagaccggcctgctgtacagaatgctgcccaccaacaccttcgccttcaagggcgagacctgcagcgtgggcaagctgtgcaaggacagaatcaccctggtggtgggcaccaacatggacggcagcgagaagctgcccctgctggtgatcggcaagaagagaaccccccactgcttcaagggcctgaagagcctgcccgtgtgctacgaggccaacagaatggcctggatgaccagcgacgtgttcgagcagtggatgagaaagctggacgaggagttccaggcccagcagagaagagtggtgatcttcgtggagagcttccccgcccaccccgaggtgaagaacctgaagagcatcgagctggccttcttccccagctgcctgagcagcaagtgcatcgccatgaagcagggcgtgatcaagagcctgaagatcaagtacagacactgcctgatcaagaagttcctgagcagcgtggagggcagcaaggagttcaccttcagcctgctggacgccgtggacaccctgcacctgtgctggagagccgtgacccccgagaccatcgtgaagagctacgaggaggccggcttcaagagccagaagggcgagagcgacatcaccaacgccgagaaggacaccggcctggacctggtggccgacgccctgggcgccggcgtggagttccccgagggcctgagcatcgaggagtacgccgccctggacgacgacctggagacctgcgaggccgcccccaacggcgacagcatctgcaccaaggagagcaagagcgacgagaccggcttctacaccagcgacgaggaggacgacgacggcagccccggcaccgagctgcccctgcccagcaagagcgaggccatcaccgccctggacaccctgaagaagttcctgagaagccaggacatgaacgacggcctgcagaacagcctggccgacctggagaacttcatcaacagcctgagccccaagtag

SEQ ID NO: 9803 - DNA, 1782 bp, Artificial Sequence
  Description of Artificial Sequence: Synthetic coding sequence
atggccttcagaaaggcctacagcatcaaggacaagctgcaggccatcgagagagtgaagggcggcgagagacaggccagcgtgtgcagagacttcggcgtgcccggcggcaccctgagaggctggctgaaggacgagcccaagctgagatggttcctggagcagctgggcggcgaggtgggcacccagagaaagaagatgagactggccaacgaggaggagatcgacagagccgtgtacgcctggttcctggccctgagacagcacggcgtgcccctgagcggccccctgatccaggcccaggccgaggccttcgccagacagatctacggccccgagtgcaccttcaaggccagccacggctggttctggagatggcagaagagacacggcatcagcagccagagattctacggcgaggccggcccccccgcccccagccccgcccccggcccccccgtgaaggaggagcccgccctgcccagcggcgccggccccctgcccgacagagcccccgccccccccccccccgccgagggcggctacggcgacgagcagatctacagcgccagcgtgaccggcctgtactggaagctgctgcccgagcaggccgccccccccggcgccggcgaccccggcgccggcggctgcggcagaagatggagaggcgacagagtgaccgtgctgctggccgccaacctgaccggcagccacaagctgaagcccctggtgatcggcagactgcccgacccccccagcctgagacaccacaaccaggacaagttccccgccagctacagatacagccccgacgcctggctgagcagacccctgctgagaggctggttcttcgaggagttcgtgcccggcgtgaagagatacctgagaagaagctgcctgcagcagaaggccgtgctgctggtggcccaccccccctgccccagccccgccgccagcatgcccgccctggacagcgaggacgcccccgtgagatgcagacccgagcccctgggcccccccgaggagctgcagacccccgacggcgccgtgagagtgctgttcctgagcaagggcagcagcagagcccacatccccgcccccctggagcagggcgtggtggccgccttcaagcagctgtacaagagagagctgctgagactggccgtgagctgcgccagcggcagccccctggacttcatgagaagcttcatgctgaaggacatgctgtacctggccggcctgagctgggacctggtgcaggccggcagcatcgagagatgctggctgctgggcctgagagccgccttcgagcccagacccggcgaggacagcgccggccagcccgcccaggccgaggaggccgccgagcacagcagagtgctgagcgacctgacccacctggccgccctggcctacaagtgcctggcccccgaggaggtggccgagtggctgcacctggacgacgacggcggcccccccgagggctgcagagaggaggtgggccccgccctgccccccgccgccccccccgcccccgccagcctgcccagcgccatgggcggcggcgaggacgaggaggaggccaccgactacggcggcaccagcgtgcccaccgccggcgaggccgtgagaggcctggagaccgccctgagatggctggagaaccaggaccccagagaggtgggccccctgagactggtgcagctgagaagcctgatcagcatggccagaagactgggcggcatcggccacacccccgccggcccctacgacggcgtgtag

SEQ ID NO: 9804 - DNA, 1929 bp, Artificial Sequence
  Description of Artificial Sequence: Synthetic coding sequence
atgtaccccgccggcccccccgccggccccgtgcccagaagaggcagaagacccctgcccggcccccccgcccccgcccccgcccccgtgcccgccgccagaccccccccccccgcccccggccccagacccagagtggccgtgaagatggccttcagaaaggcctacagcatcaaggacaagctgcaggccatcgagagagtgaagggcggcgagagacaggccagcgtgtgcagagacttcggcgtgcccggcggcaccctgagaggctggctgaaggacgagcccaagctgagatggttcctggagcagctgggcggcgaggtgggcacccagagaaagaagatgagactggccaacgaggaggagatcgacagagccgtgtacgcctggttcctggccctgagacagcacggcgtgcccctgagcggccccctgatccaggcccaggccgaggccttcgccagacagatctacggccccgagtgcaccttcaaggccagccacggctggttctggagatggcagaagagacacggcatcagcagccagagattctacggcgaggccggcccccccgcccccagccccgcccccggcccccccgtgaaggaggagcccgccctgcccagcggcgccggccccctgcccgacagagcccccgccccccccccccccgccgagggcggctacggcgacgagcagatctacagcgccagcgtgaccggcctgtactggaagctgctgcccgagcaggccgccccccccggcgccggcgaccccggcgccggcggctgcggcagaagatggagaggcgacagagtgaccgtgctgctggccgccaacctgaccggcagccacaagctgaagcccctggtgatcggcagactgcccgacccccccagcctgagacaccacaaccaggacaagttccccgccagctacagatacagccccgacgcctggctgagcagacccctgctgagaggctggttcttcgaggagttcgtgcccggcgtgaagagatacctgagaagaagctgcctgcagcagaaggccgtgctgctggtggcccaccccccctgccccagccccgccgccagcatgcccgccctggacagcgaggacgcccccgtgagatgcagacccgagcccctgggcccccccgaggagctgcagacccccgacggcgccgtgagagtgctgttcctgagcaagggcagcagcagagcccacatccccgcccccctggagcagggcgtggtggccgccttcaagcagctgtacaagagagagctgctgagactggccgtgagctgcgccagcggcagccccctggacttcatgagaagcttcatgctgaaggacatgctgtacctggccggcctgagctgggacctggtgcaggccggcagcatcgagagatgctggctgctgggcctgagagccgccttcgagcccagacccggcgaggacagcgccggccagcccgcccaggccgaggaggccgccgagcacagcagagtgctgagcgacctgacccacctggccgccctggcctacaagtgcctggcccccgaggaggtggccgagtggctgcacctggacgacgacggcggcccccccgagggctgcagagaggaggtgggccccgccctgccccccgccgccccccccgcccccgccagcctgcccagcgccatgggcggcggcgaggacgaggaggaggccaccgactacggcggcaccagcgtgcccaccgccggcgaggccgtgagaggcctggagaccgccctgagatggctggagaaccaggaccccagagaggtgggccccctgagactggtgcagctgagaagcctgatcagcatggccagaagactgggcggcatcggccacacccccgccggcccctacgacggcgtgtag

SEQ ID NO: 9805 - DNA, 1566 bp, Artificial Sequence
  Description of Artificial Sequence: Synthetic coding sequence
atggccaacaagggcaacaagaagagaagacagttcagcctggaggagaagatgaaggtggtgggcgccgtggacagcggcaagagaaagggcgacgtggccaaggagttcggcatcacccccagcaccctgagcaccttcctgaaggacagaaccaagttcgaggagaaggtgagagaggccagcgtgggcccccagagaaagagaatgagaagcgccctgtacgacgacatcgacaaggccgtgttcgcctggttccaggagatccacgccaagaacatcctggtgaccggcagcgtgatcagaaagaaggccctgaacctggccaacatgctgggctacgacaacttccaggccagcgtgggctggctgaacagattcagagacagacacggcatcgccctgaaggccgtgtgcagagaggacagcgacagactgatgaacggcctgggcatcgacaagatcaacgagtggcacgccggcgagatcatcaagctgatcgccgactacagccccgacgacatcttcaacgccgacgagaccggcgtgttcttccagctgctgccccagcacaccctggccgccaagggcgaccactgcagaggcggcaagaaggccaagcagagactgaccgccctgttctgctgcaacgccagcggcaccgagaagatgagacccctgatcgtgggcagaagcgccagcccccactgcctgaagaacatccacagcctgccctgcgactacagagccaaccagtgggcctggatgaccagagacctgttcaacgagtggctgatgcaggtggacgccagaatgaagagagccgagagaagaatcctgctgctgatcgacaactgcagcgcccacaacatgctgccccacctggagagaatccaggtgggctacctgcccagcaactgcaccgccgtgctgcagcccctgaacctgggcatcatccacaccatgaaggtgctgtaccagagccacctgctgaagcagatcctgctgaagctgaacagcagcgaggaccaggaggaggtggacatcaagcaggccatcgacatgatcgccgccgcctggtggagcgtgaagcccagcaccgtggtgaagtgctggcagaaggccggcatcgtgcccatggagttcgccgagtgcgacaccgagagcgccgccagcgagcccgacatcgccatcgagaagctgtggcacaccgtggccatcgccacctgcgtgcccaacgaggtgaacttccaggacttcgtgaccgccgacgacgacctgatcatcagccaggacaccgacatcatccaggacatggtggccggcgagaacaccagcgaggccggcagcgaggacgagggcgaggtgagcctgcccgagcagcccaaggtgaccatcaccgaggccatcagcagcgtgcagaagctgagacagttcctgagcacctgcgtggacatccccgacgccatcttcggccagctgaacggcatcgacgagtacctgatgaagagagtgacccagaccctgatcgacagcaagatcaccgacttcctgcagaccaagtag

SEQ ID NO: 9806 - DNA, 1566 bp, Artificial Sequence; identical to SEQ ID NO: 9805
  Description of Artificial Sequence: Synthetic coding sequence

SEQ ID NO: 9807 - DNA, 684 bp, Artificial Sequence
  Description of Artificial Sequence: Synthetic coding sequence
atgcccggctgcagaatcagcgcctgcggccccggcgcccaggagggcaccgccgagcagagaagccccccccccccctgggaccccatgcccagcagccagccccccccccccacccccaccctgacccccacccccacccccggccagagcccccccctgcccgacgccgccggcgccagcgccggcgccgccgaggaccaggagctgcagagatggagacagggcgccagcggcatcgccggcctggccggccccggcggcggcagcggcgccgccgccggcgccggcggcagagccctggagctggccgaggccagaagaagactgctggaggtggagggcagaagaagactggtgagcgagctggagagcagagtgctgcagctgcacagagtgttcctggccgccgagctgagactggcccacagagccgagagcctgagcagactgagcggcggcgtggcccaggccgagctgtacctggccgcccacggcagcagactgaagaagggccccagaagaggcagaagaggcagaccccccgccctgctggccagcgccctgggcctgggcggctgcgtgccctggggcgccggcagactgagaagaggccacggccccgagcccgacagccccttcagaagaagcccccccagaggccccgccagcccccagagatag

SEQ ID NO: 9808 - DNA, 153 bp, Artificial Sequence
  Description of Artificial Sequence: Synthetic coding sequence
tgaggcagaccccccgccctgctggccagcgccctgggcctgggcggctgcgtgccctggggcgccggcagactgagaagaggccacggccccgagcccgacagccccttcagaagaagcccccccagaggccccgccagcccccagagatag

SEQ ID NO: 9809 - DNA, 375 bp, Artificial Sequence
  Description of Artificial Sequence: Synthetic coding sequence
tacctgctgctggagtactgcgagggcaacgacctggacttctacctgaagcagcacaagctgatgagcgagaaggaggccagaagcatcgtgatgcagatcgtgaacgccctgagatacctgaacgagatcaagccccccatcatccactacgacctgaagcccggcaacatcctgctggtggacggcaccgcctgcggcgagatcaagatcaccgacttcggcctgagcaagatcatggacgacgacagctacggcgtggacggcatggacctgaccagccagggcgccggcacctactggtacctgccccccgagtgcttcgtggtgggcaaggagccccccaagatcagcaacaaggtggacgtgtggtag

SEQ ID NO: 9810 - DNA, 1242 bp, Artificial Sequence
  Description of Artificial Sequence: Synthetic coding sequence
atgagcgtgcagagcagcagcggcagcctggagggcccccccagctggagccagctgagcaccagccccacccccggcagcgccgccgccgccagaagcctgctgaaccacaccccccccagcggcagacccagagagggcgccatggacgagctgcacagcctggaccccagaagacaggagctgctggaggccagattcaccggcgtggccagcggcagcaccggcagcaccggcagctgcagcgtgggcgccaaggccagcaccaacaacgagagcagcaaccacagcttcggcagcctgggcagcctgagcgacaaggagagcgagacccccgagaagaagcagagcgagagcagcagaggcagaaagagaaaggccgagaaccagaacgagagcagccagggcaagagcatcggcggcagaggccacaagatcagcgactacttcgagtaccagggcggcaacggcagcagccccgtgagaggcatcccccccgccatcagaagcccccagaacagccacagccacagcacccccagcagcagcgtgagacccaacagccccagccccaccgccctggccttcggcgaccaccccatcgtgcagcccaagcagctgagcttcaagatcatccagaccgacctgaccatgctgaagctggccgccctggagagcaacaagatccaggacctggagaagaaggagggcagaatcgacgacctgctgagagccaactgcgacctgagaagacagatcgacgagcagcagaagctgctggagaagtacaaggagagactgaacaagtgcatcagcatgagcaagaagctgctgatcgagaagagcacccaggagaagctgagcagcagagagaagagcatgcaggacagactgagactgggccacttcaccaccgtgagacacggcgccagcttcaccgagcagtggaccgacggcttcgccttccagaacctggtgaagcagcaggagtgggtgaaccagcagagagaggacatcgagagacagagaaagctgctggccaagagaaagccccccaccgccaacaacagccaggcccccagcaccaacagcgagcccaagcagagaaagaacaaggccgtgaacggcgccgagaacgaccccttcgtgagacccaacctgccccagctgctgaccctggccgagtaccacgagcaggaggagatcttcaagctgagactgggccacctgaagaagagatag

SEQ ID NO: 9811 - DNA, 2301 bp, Artificial Sequence
  Description of Artificial Sequence: Synthetic coding sequence
atgagcgtgcagagcagcagcggcagcctggagggcccccccagctggagccagctgagcaccagccccacccccggcagcgccgccgccgccagaagcctgctgaaccacaccccccccagcggcagacccagagagggcgccatggacgagctgcacagcctggaccccagaagacaggagctgctggaggccagattcaccggcgtggccagcggcagcaccggcagcaccggcagctgcagcgtgggcgccaaggccagcaccaacaacgagagcagcaaccacagcttcggcagcctgggcagcctgagcgacaaggagagcgagacccccgagaagaagcagagcgagagcagcagaggcagaaagagaaaggccgagaaccagaacgagagcagccagggcaagagcatcggcggcagaggccacaagatcagcgactacttcgagtaccagggcggcaacggcagcagccccgtgagaggcatcccccccgccatcagaagcccccagaacagccacagccacagcacccccagcagcagcgtgagacccaacagccccagccccaccgccctggccttcggcgaccaccccatcgtgcagcccaagcagctgagcttcaagatcatccagaccgacctgaccatgctgaagctggccgccctggagagcaacaagatccaggacctggagaagaaggagggcagaatcgacgacctgctgagagccaactgcgacctgagaagacagatcgacgagcagcagaagctgctggagaagtacaaggagagactgaacaagtgcatcagcatgagcaagaagctgctgatcgagaagagcacccaggagaagctgagcagcagagagaagagcatgcaggacagactgagactgggccacttcaccaccgtgagacacggcgccagcttcaccgagcagtggaccgacggcttcgccttccagaacctggtgaagcagcaggagtgggtgaaccagcagagagaggacatcgagagacagagaaagctgctggccaagagaaagccccccaccgccaacaacagccaggcccccagcaccaacagcgagcccaagcagagaaagaacaaggccgtgaacggcgccgagaacgaccccttcgtgagacccaacctgccccagctgctgaccctggccgagtaccacgagcaggaggagatcttcaagctgagactgggccacctgaagaaggaggaggccgagatccaggccgagctggagagactggagagagtgagaaacctgcacatcagagagctgaagagaatcaacaacgaggacaacagccagttcaaggaccaccccaccctgaacgagagatacctgctgctgcacctgctgggcagaggcggcttcagcgaggtgtacaaggccttcgacctgtacgagcagagatacgccgccgtgaagatccaccagctgaacaagagctggagagacgagaagaaggagaactaccacaagcacgcctgcagagagtacagaatccacaaggagctggaccaccccagaatcgtgaagctgtacgactacttcagcctggacaccgacaccttctgcaccgtgctggagtactgcgagggcaacgacctggacttctacctgaagcagcacaagctgatgagcgagaaggaggccagaagcatcgtgatgcagatcgtgaacgccctgagatacctgaacgagatcaagccccccatcatccactacgacctgaagcccggcaacatcctgctggtggacggcaccgcctgcggcgagatcaagatcaccgacttcggcctgagcaagatcatggacgacgacagctacggcgtggacggcatggacctgaccagccagggcgccggcacctactggtacctgccccccgagtgcttcgtggtgggcaaggagccccccaagatcagcaacaaggtggacgtgtggagcgtgggcgtgatcttcttccagtgcctgtacggcagaaagcccttcggccacaaccagagccagcaggacatcctgcaggagaacaccatcctgaaggccaccgaggtgcagttccccgtgaagcccgtggtgagcagcgaggccaaggccttcatcagaagatgcctggcctacagaaaggaggacagattcgacgtgcaccagctggccaacgacccctacctgctgccccacatgagaagaagcaacagcagcggcaacctgcacatggccggcctgaccgccagccccaccccccccagcagcagcatcatcacctactag

SEQ ID NO: 9812 - DNA, 2013 bp, Artificial Sequence
  Description of Artificial Sequence: Synthetic coding sequence
atggccgtgctgttcctgtacgacctgaagaccaccggcaagacccccgagaagaagcagagcgagagcagcagaggcagaaagagaaaggccgagaaccagaacgagagcagccagggcaagagcatcggcggcagaggccacaagatcagcgactacttcgagtaccagggcggcaacggcagcagccccgtgagaggcatcccccccgccatcagaagcccccagaacagccacagccacagcacccccagcagcagcgtgagacccaacagccccagccccaccgccctggccttcggcgaccaccccatcgtgcagcccaagcagctgagcttcaagatcatccagaccgacctgaccatgctgaagctggccgccctggagagcaacaagatccaggacctggagaagaaggagggcagaatcgacgacctgctgagagccaactgcgacctgagaagacagatcgacgagcagcagaagctgctggagaagtacaaggagagactgaacaagtgcatcagcatgagcaagaagctgctgatcgagaagagcacccaggagaagctgagcagcagagagaagagcatgcaggacagactgagactgggccacttcaccaccgtgagacacggcgccagcttcaccgagcagtggaccgacggcttcgccttccagaacctggtgaagcagcaggagtgggtgaaccagcagagagaggacatcgagagacagagaaagctgctggccaagagaaagccccccaccgccaacaacagccaggcccccagcaccaacagcgagcccaagcagagaaagaacaaggccgtgaacggcgccgagaacgaccccttcgtgagacccaacctgccccagctgctgaccctggccgagtaccacgagcaggaggagatcttcaagctgagactgggccacctgaagaaggaggaggccgagatccaggccgagctggagagactggagagagtgagaaacctgcacatcagagagctgaagagaatcaacaacgaggacaacagccagttcaaggaccaccccaccctgaacgagagatacctgctgctgcacctgctgggcagaggcggcttcagcgaggtgtacaaggccttcgacctgtacgagcagagatacgccgccgtgaagatccaccagctgaacaagagctggagagacgagaagaaggagaactaccacaagcacgcctgcagagagtacagaatccacaaggagctggaccaccccagaatcgtgaagctgtacgactacttcagcctggacaccgacaccttctgcaccgtgctggagtactgcgagggcaacgacctggacttctacctgaagcagcacaagctgatgagcgagaaggaggccagaagcatcgtgatgcagatcgtgaacgccctgagatacctgaacgagatcaagccccccatcatccactacgacctgaagcccggcaacatcctgctggtggacggcaccgcctgcggcgagatcaagatcaccgacttcggcctgagcaagatcatggacgacgacagctacggcgtggacggcatggacctgaccagccagggcgccggcacctactggtacctgccccccgagtgcttcgtggtgggcaaggagccccccaagatcagcaacaaggtggacgtgtggagcgtgggcgtgatcttcttccagtgcctgtacggcagaaagcccttcggccacaaccagagccagcaggacatcctgcaggagaacaccatcctgaaggccaccgaggtgcagttccccgtgaagcccgtggtgagcagcgaggccaaggccttcatcagaagatgcctggcctacagaaaggaggacagattcgacgtgcaccagctggccaacgacccctacctgctgccccacatgagaagaagcaacagcagcggcaacctgcacatggccggcctgaccgccagccccaccccccccagcagcagcatcatcacctactag

SEQ ID NO: 9813 - DNA, 2157 bp, Artificial Sequence
  Description of Artificial Sequence: Synthetic coding sequence
atggacgagctgcacagcctggaccccagaagacaggagctgctggaggccagattcaccggcgtggccagcggcagcaccggcagcaccggcagctgcagcgtgggcgccaaggccagcaccaacaacgagagcagcaaccacagcttcggcagcctgggcagcctgagcgacaaggagagcgagacccccgagaagaagcagagcgagagcagcagaggcagaaagagaaaggccgagaaccagaacgagagcagccagggcaagagcatcggcggcagaggccacaagatcagcgactacttcgagtaccagggcggcaacggcagcagccccgtgagaggcatcccccccgccatcagaagcccccagaacagccacagccacagcacccccagcagcagcgtgagacccaacagccccagccccaccgccctggccttcggcgaccaccccatcgtgcagcccaagcagctgagcttcaagatcatccagaccgacctgaccatgctgaagctggccgccctggagagcaacaagatccaggacctggagaagaaggagggcagaatcgacgacctgctgagagccaactgcgacctgagaagacagatcgacgagcagcagaagctgctggagaagtacaaggagagactgaacaagtgcatcagcatgagcaagaagctgctgatcgagaagagcacccaggagaagctgagcagcagagagaagagcatgcaggacagactgagactgggccacttcaccaccgtgagacacggcgccagcttcaccgagcagtggaccgacggcttcgccttccagaacctggtgaagcagcaggagtgggtgaaccagcagagagaggacatcgagagacagagaaagctgctggccaagagaaagccccccaccgccaacaacagccaggcccccagcaccaacagcgagcccaagcagagaaagaacaaggccgtgaacggcgccgagaacgaccccttcgtgagacccaacctgccccagctgctgaccctggccgagtaccacgagcaggaggagatcttcaagctgagactgggccacctgaagaaggaggaggccgagatccaggccgagctggagagactggagagagtgagaaacctgcacatcagagagctgaagagaatcaacaacgaggacaacagccagttcaaggaccaccccaccctgaacgagagatacctgctgctgcacctgctgggcagaggcggcttcagcgaggtgtacaaggccttcgacctgtacgagcagagatacgccgccgtgaagatccaccagctgaacaagagctggagagacgagaagaaggagaactaccacaagcacgcctgcagagagtacagaatccacaaggagctggaccaccccagaatcgtgaagctgtacgactacttcagcctggacaccgacaccttctgcaccgtgctggagtactgcgagggcaacgacctggacttctacctgaagcagcacaagctgatgagcgagaaggaggccagaagcatcgtgatgcagatcgtgaacgccctgagatacctgaacgagatcaagccccccatcatccactacgacctgaagcccggcaacatcctgctggtggacggcaccgcctgcggcgagatcaagatcaccgacttcggcctgagcaagatcatggacgacgacagctacggcgtggacggcatggacctgaccagccagggcgccggcacctactggtacctgccccccgagtgcttcgtggtgggcaaggagccccccaagatcagcaacaaggtggacgtgtggagcgtgggcgtgatcttcttccagtgcctgtacggcagaaagcccttcggccacaaccagagccagcaggacatcctgcaggagaacaccatcctgaaggccaccgaggtgcagttccccgtgaagcccgtggtgagcagcgaggccaaggccttcatcagaagatgcctggcctacagaaaggaggacagattcgacgtgcaccagctggccaacgacccctacctgctgccccacatgagaagaagcaacagcagcggcaacctgcacatggccggcctgaccgccagccccaccccccccagcagcagcatcatcacctactag

SEQ ID NO: 9814 - DNA, 2157 bp, Artificial Sequence; identical to SEQ ID NO: 9813
  Description of Artificial Sequence: Synthetic coding sequence

SEQ ID NO: 9815 - DNA, 2319 bp, Artificial Sequence
  Description of Artificial Sequence: Synthetic coding sequence
atgatggaggagctgcacagcctggaccccagaagacaggagctgctggaggccagattcaccggcgtgggcgtgagcaagggccccctgaacagcgagagcagcaaccagagcctgtgcagcgtgggcagcctgagcgacaaggaggtggagacccccgagaagaagcagaacgaccagagaaacagaaagagaaaggccgagccctacgagaccagccagggcaagggcacccccagaggccacaagatcagcgactacttcgagttcgccggcggcagcgcccccggcaccagccccggcagaagcgtgccccccgtggccagaagcagcccccagcacagcctgagcaaccccctgcccagaagagtggagcagcccctgtacggcctggacggcagcgccgccaaggaggccaccgaggagcagagcgccctgcccaccctgatgagcgtgatgctggccaagcccagactggacaccgagcagctggcccagagaggcgccggcctgtgcttcaccttcgtgagcgcccagcagaacagccccagcagcaccggcagcggcaacaccgagcacagctgcagcagccagaagcagatcagcatccagcacagacagacccagagcgacctgaccatcgagaagatcagcgccctggagaacagcaagaacagcgacctggagaagaaggagggcagaatcgacgacctgctgagagccaactgcgacctgagaagacagatcgacgagcagcagaagatgctggagaagtacaaggagagactgaacagatgcgtgaccatgagcaagaagctgctgatcgagaagagcaagcaggagaagatggcctgcagagacaagagcatgcaggacagactgagactgggccacttcaccaccgtgagacacggcgccagcttcaccgagcagtggaccgacggctacgccttccagaacctgatcaagcagcaggagagaatcaacagccagagagaggagatcgagagacagagaaagatgctggccaagagaaagccccccgccatgggccaggccccccccgccaccaacgagcagaagcagagaaagagcaagaccaacggcgccgagaacgagacccccagcagcggcaacaccgagctgaaggacaccgcccccgccctgggcgcccacagcctgctgagactgaccctggccgagtaccacgagcaggaggagatcttcaagctgagactgggccacctgaagaaggaggaggccgagatccaggccgagctggagagactggagagagtgagaaacctgcacatcagagagctgaagagaatccacaacgaggacaacagccagttcaaggaccaccccaccctgaacgacagatacctgctgctgcacctgctgggcagaggcggcttcagcgaggtgtacaaggccttcgacctgaccgagcagagatacgtggccgtgaagatccaccagctgaacaagaactggagagacgagaagaaggagaactaccacaagcacgcctgcagagagtacagaatccacaaggagctggaccaccccagaatcgtgaagctgtacgactacttcagcctggacaccgacagcttctgcaccgtgctggagtactgcgagggcaacgacctggacttctacctgaagcagcacaagctgatgagcgagaaggaggccagaagcatcatcatgcagatcgtgaacgccctgaagtacctgaacgagatcaagccccccatcatccactacgacctgaagcccggcaacatcctgctggtgaacggcaccgcctgcggcgagatcaagatcaccgacttcggcctgagcaagatcatggacgacgacagctacaacagcgtggacggcatggagctgaccagccagggcgccggcacctactggtacctgccccccgagtgcttcgtggtgggcaaggagccccccaagatcagcaacaaggtggacgtgtggagcgtgggcgtgatcttctaccagtgcctgtacggcagaaagcccttcggccacaaccagagccagcaggacatcctgcaggagaacaccatcctgaaggccaccgaggtgcagttcccccccaagcccgtggtgacccccgaggccaaggccttcatcagaagatgcctggcctacagaaaggaggacagaatcgacgtgcagcagctggcctgcgacccctacctgctgccccacatcagaaagagcgtgagcaccagcagccccgccggcgccgccatcgccagcaccagcggcgccagcaacaacagcagcagcaactag

SEQ ID NO: 9816 - DNA, 2157 bp, Artificial Sequence
  Description of Artificial Sequence: Synthetic coding sequence
atgatggaggagctgcacagcctggaccccagaagacaggagctgctggaggccagattcaccggcgtgggcgtgagcaagggccccctgaacagcgagagcagcaaccagagcctgtgcagcgtgggcagcctgagcgacaaggaggtggagacccccgagaagaagcagaacgaccagagaaacagaaagagaaaggccgagccctacgagaccagccagggcaagggcacccccagaggccacaagatcagcgactacttcgagagaagagtggagcagcccctgtacggcctggacggcagcgccgccaaggaggccaccgaggagcagagcgccctgcccaccctgatgagcgtgatgctggccaagcccagactggacaccgagcagctggcccagagaggcgccggcctgtgcttcaccttcgtgagcgcccagcagaacagccccagcagcaccggcagcggcaacaccgagcacagctgcagcagccagaagcagatcagcatccagcacagacagacccagagcgacctgaccatcgagaagatcagcgccctggagaacagcaagaacagcgacctggagaagaaggagggcagaatcgacgacctgctgagagccaactgcgacctgagaagacagatcgacgagcagcagaagatgctggagaagtacaaggagagactgaacagatgcgtgaccatgagcaagaagctgctgatcgagaagagcaagcaggagaagatggcctgcagagacaagagcatgcaggacagactgagactgggccacttcaccaccgtgagacacggcgccagcttcaccgagcagtggaccgacggctacgccttccagaacctgatcaagcagcaggagagaatcaacagccagagagaggagatcgagagacagagaaagatgctggccaagagaaagccccccgccatgggccaggccccccccgccaccaacgagcagaagcagagaaagagcaagaccaacggcgccgagaacgagaccctgaccctggccgagtaccacgagcaggaggagatcttcaagctgagactgggccacctgaagaaggaggaggccgagatccaggccgagctggagagactggagagagtgagaaacctgcacatcagagagctgaagagaatccacaacgaggacaacagccagttcaaggaccaccccaccctgaacgacagatacctgctgctgcacctgctgggcagaggcggcttcagcgaggtgtacaaggccttcgacctgaccgagcagagatacgtggccgtgaagatccaccagctgaacaagaactggagagacgagaagaaggagaactaccacaagcacgcctgcagagagtacagaatccacaaggagctggaccaccccagaatcgtgaagctgtacgactacttcagcctggacaccgacagcttctgcaccgtgctggagtactgcgagggcaacgacctggacttctacctgaagcagcacaagctgatgagcgagaaggaggccagaagcatcatcatgcagatcgtgaacgccctgaagtacctgaacgagatcaagccccccatcatccactacgacctgaagcccggcaacatcctgctggtgaacggcaccgcctgcggcgagatcaagatcaccgacttcggcctgagcaagatcatggacgacgacagctacaacagcgtggacggcatggagctgaccagccagggcgccggcacctactggtacctgccccccgagtgcttcgtggtgggcaaggagccccccaagatcagcaacaaggtggacgtgtggagcgtgggcgtgatcttctaccagtgcctgtacggcagaaagcccttcggccacaaccagagccagcaggacatcctgcaggagaacaccatcctgaaggccaccgaggtgcagttcccccccaagcccgtggtgacccccgaggccaaggccttcatcagaagatgcctggcctacagaaaggaggacagaatcgacgtgcagcagctggcctgcgacccctacctgctgccccacatcagaaagagcgtgagcaccagcagccccgccggcgccgccatcgccagcaccagcggcgccagcaacaacagcagcagcaactag

SEQ ID NO: 9817 - DNA, 2253 bp, Artificial Sequence
  Description of Artificial Sequence: Synthetic coding sequence
atgatggaggagctgcacagcctggaccccagaagacaggagctgctggaggccagattcaccggcgtgggcgtgagcaagggccccctgaacagcgagagcagcaaccagagcctgtgcagcgtgggcagcctgagcgacaaggaggtggagacccccgagaagaagcagaacgaccagagaaacagaaagagaaaggccgagccctacgagaccagccagggcaagggcacccccagaggccacaagatcagcgactacttcgagttcgccggcggcagcgcccccggcaccagccccggcagaagcgtgccccccgtggccagaagcagcccccagcacagcctgagcaaccccctgcccagaagagtggagcagcccctgtacggcctggacggcagcgccgccaaggaggccaccgaggagcagagcgccctgcccaccctgatgagcgtgatgctggccaagcccagactggacaccgagcagctggcccagagaggcgccggcctgtgcttcaccttcgtgagcgcccagcagaacagccccagcagcaccggcagcggcaacaccgagcacagctgcagcagccagaagcagatcagcatccagcacagacagacccagagcgacctgaccatcgagaagatcagcgccctggagaacagcaagaacagcgacctggagaagaaggagggcagaatcgacgacctgctgagagccaactgcgacctgagaagacagatcgacgagcagcagaagatgctggagaagtacaaggagagactgaacagatgcgtgaccatgagcaagaagctgctgatcgagaagagcaagcaggagaagatggcctgcagagacaagagcatgcaggacagactgagactgggccacttcaccaccgtgagacacggcgccagcttcaccgagcagtggaccgacggctacgccttccagaacctgatcaagcagcaggagagaatcaacagccagagagaggagatcgagagacagagaaagatgctggccaagagaaagccccccgccatgggccaggccccccccgccaccaacgagcagaagcagagaaagagcaagaccaacggcgccgagaacgagaccctgaccctggccgagtaccacgagcaggaggagatcttcaagctgagactgggccacctgaagaaggaggaggccgagatccaggccgagctggagagactggagagagtgagaaacctgcacatcagagagctgaagagaatccacaacgaggacaacagccagttcaaggaccaccccaccctgaacgacagatacctgctgctgcacctgctgggcagaggcggcttcagcgaggtgtacaaggccttcgacctgaccgagcagagatacgtggccgtgaagatccaccagctgaacaagaactggagagacgagaagaaggagaactaccacaagcacgcctgcagagagtacagaatccacaaggagctggaccaccccagaatcgtgaagctgtacgactacttcagcctggacaccgacagcttctgcaccgtgctggagtactgcgagggcaacgacctggacttctacctgaagcagcacaagctgatgagcgagaaggaggccagaagcatcatcatgcagatcgtgaacgccctgaagtacctgaacgagatcaagccccccatcatccactacgacctgaagcccggcaacatcctgctggtgaacggcaccgcctgcggcgagatcaagatcaccgacttcggcctgagcaagatcatggacgacgacagctacaacagcgtggacggcatggagctgaccagccagggcgccggcacctactggtacctgccccccgagtgcttcgtggtgggcaaggagccccccaagatcagcaacaaggtggacgtgtggagcgtgggcgtgatcttctaccagtgcctgtacggcagaaagcccttcggccacaaccagagccagcaggacatcctgcaggagaacaccatcctgaaggccaccgaggtgcagttcccccccaagcccgtggtgacccccgaggccaaggccttcatcagaagatgcctggcctacagaaaggaggacagaatcgacgtgcagcagctggcctgcgacccctacctgctgccccacatcagaaagagcgtgagcaccagcagccccgccggcgccgccatcgccagcaccagcggcgccagcaacaacagcagcagcaactag

SEQ ID NO: 9818 - DNA, 2157 bp, Artificial Sequence; identical to SEQ ID NO: 9816
  Description of Artificial Sequence: Synthetic coding sequence

SEQ ID NO: 9819 - DNA, 1521 bp, Artificial Sequence
  Description of Artificial Sequence: Synthetic coding sequence
atggacgtgagactgtaccccagcgcccccgccgtgggcgccagacccggcgccgagcccgccggcctggcccacctggactactaccacggcggcaagttcgacggcgacagcgcctacgtgggcatgagcgacggcaaccccgagctgctgagcaccagccagacctacaacggccagagcgagaacaacgaggactacgagatcccccccatcaccccccccaacctgcccgagcccagcctgctgcacctgggcgaccacgaggccagctaccacagcctgtgccacggcctgacccccaacggcctgctgcccgcctacagctaccaggccatggacctgcccgccatcatggtgagcaacatgctggcccaggacagccacctgctgagcggccagctgcccaccatccaggagatggtgcacagcgaggtggccgcctacgacagcggcagacccggccccctgctgggcagacccgccatgctggccagccacatgagcgccctgagccagagccagctgatcagccagatgggcatcagaagcagcatcgcccacagcagccccagcccccccggcagcaagagcgccacccccagccccagcagcagcacccaggaggaggagagcgaggtgcacttcaagatcagcggcgagaagagacccagcgccgaccccggcaagaaggccaagaaccccaagaagaagaagaagaaggaccccaacgagccccagaagcccgtgagcgcctacgccctgttcttcagagacacccaggccgccatcaagggccagaaccccagcgccaccttcggcgacgtgagcaagatcgtggccagcatgtgggacagcctgggcgaggagcagaagcaggcctacaagagaaagaccgaggccgccaagaaggagtacctgaaggccctggccgcctacagagccagcctggtgagcaagagcagccccgaccagggcgagaccaagagcacccaggccaacccccccgccaagatgctgccccccaagcagcccatgtacgccatgcccggcctggccagcttcctgacccccagcgacctgcaggccttcagaagcggcgccagccccgccagcctggccagaaccctgggcagcaagagcctgctgcccggcctgagcgccagccccccccccccccccagcttccccctgagccccaccctgcaccagcagctgagcctgcccccccacgcccagggcgccctgctgagcccccccgtgagcatgagccccgccccccagccccccgtgctgcccacccccatggccctgcaggtgcagctggccatgagccccagcccccccggcccccaggacttcccccacatcagcgagttccccagcagcagcggcagctgcagccccggccccagcaaccccaccagcagcggcgactgggacagcagctaccccagcggcgagtgcggcatcagcacctgcagcctgctgcccagagacaagagcctgtacctgacctag

SEQ ID NO: 9820 - DNA, 1467 bp, Artificial Sequence
  Description of Artificial Sequence: Synthetic coding sequence
atgcagcagaccagaaccgaggccgtggccggcgccttcagcagatgcctgggcttctgcggcatgagactgggcctgctgctgctggccagacactggtgcatcgccggcgtgttcccccagaagttcgacggcgacagcgcctacgtgggcatgagcgacggcaaccccgagctgctgagcaccagccagacctacaacggccagagcgagaacaacgaggactacgagatcccccccatcaccccccccaacctgcccgagcccagcctgctgcacctgggcgaccacgaggccagctaccacagcctgtgccacggcctgacccccaacggcctgctgcccgcctacagctaccaggccatggacctgcccgccatcatggtgagcaacatgctggcccaggacagccacctgctgagcggccagctgcccaccatccaggagatggtgcacagcgaggtggccgcctacgacagcggcagacccggccccctgctgggcagacccgccatgctggccagccacatgagcgccctgagccagagccagctgatcagccagatgggcatcagaagcagcatcgcccacagcagccccagcccccccggcagcaagagcgccacccccagccccagcagcagcacccaggaggaggagagcgaggtgcacttcaagatcagcggcgagaagagacccagcgccgaccccggcaagaaggccaagaaccccaagaagaagaagaagaaggaccccaacgagccccagaagcccgtgagcgcctacgccctgttcttcagagacacccaggccgccatcaagggccagaaccccagcgccaccttcggcgacgtgagcaagatcgtggccagcatgtgggacagcctgggcgaggagcagaagcagagcagccccgaccagggcgagaccaagagcacccaggccaacccccccgccaagatgctgccccccaagcagcccatgtacgccatgcccggcctggccagcttcctgacccccagcgacctgcaggccttcagaagcggcgccagccccgccagcctggccagaaccctgggcagcaagagcctgctgcccggcctgagcgccagccccccccccccccccagcttccccctgagccccaccctgcaccagcagctgagcctgcccccccacgcccagggcgccctgctgagcccccccgtgagcatgagccccgccccccagccccccgtgctgcccacccccatggccctgcaggtgcagctggccatgagccccagcccccccggcccccaggacttcccccacatcagcgagttccccagcagcagcggcagctgcagccccggccccagcaaccccaccagcagcggcgactgggacagcagctaccccagcggcgagtgcggcatcagcacctgcagcctgctgcccagagacaagagcctgtacctgacctag

SEQ ID NO: 9821 - DNA, 591 bp, Artificial Sequence
  Description of Artificial Sequence: Synthetic coding sequence
agaagaagaagaaagagaagaacccccatgagcagaagaagcctgtgcagacccacccacagcagcagcgagaccctgagaccccccagcagagtgagaacccccgtgcccctgagcgtgacctgccccaagagctggcccccctgcggcaccgcctgggagagaaacagaagcagaaccagcagaaccagcctgagcagccccgccgccagagaccccgcccacctggcccaccccaccccccccgccgccggcaccggcaccgccgccacccccgtgggcagcgtggccagcgcccccgccgcctgcagccccggcaccaacagaagcaccagccccaaccccgccagcctgcccagcctgagactggccggcagacactgcagcgagcccgagggcctgaccgccgagaagagaccctggcccgaggccggctggcccatcggcgagagcagcgacacccccatcgccagaggcctgagcctgttcctgaacctgccccccgacagcgccgaggccgcccactgccccccccccgcccagagaacctgcagaaacctgccccccgccgacctgctggcccccggctag

SEQ ID NO: 9822 - DNA, 1395 bp, Artificial Sequence
  Description of Artificial Sequence: Synthetic coding sequence
atgagcgacggcaaccccgagctgctgagcaccagccagacctacaacggccagagcgagaacaacgaggactacgagatcccccccatcaccccccccaacctgcccgagcccagcctgctgcacctgggcgaccacgaggccagctaccacagcctgtgccacggcctgacccccaacggcctgctgcccgcctacagctaccaggccatggacctgcccgccatcatggtgagcaacatgctggcccaggacagccacctgctgagcggccagctgcccaccatccaggagatggtgcacagcgaggtggccgcctacgacagcggcagacccggccccctgctgggcagacccgccatgctggccagccacatgagcgccctgagccagagccagctgatcagccagatgggcatcagaagcagcatcgcccacagcagccccagcccccccggcagcaagagcgccacccccagccccagcagcagcacccaggaggaggagagcgaggtgcacttcaagatcagcggcgagaagagacccagcgccgaccccggcaagaaggccaagaaccccaagaagaagaagaagaaggaccccaacgagccccagaagcccgtgagcgcctacgccctgttcttcagagacacccaggccgccatcaagggccagaaccccagcgccaccttcggcgacgtgagcaagatcgtggccagcatgtgggacagcctgggcgaggagcagaagcaggcctacaagagaaagaccgaggccgccaagaaggagtacctgaaggccctggccgcctacagagccagcctggtgagcaagagcagccccgaccagggcgagaccaagagcacccaggccaacccccccgccaagatgctgccccccaagcagcccatgtacgccatgcccggcctggccagcttcctgacccccagcgacctgcaggccttcagaagcggcgccagccccgccagcctggccagaaccctgggcagcaagagcctgctgcccggcctgagcgccagccccccccccccccccagcttccccctgagccccaccctgcaccagcagctgagcctgcccccccacgcccagggcgccctgctgagcccccccgtgagcatgagccccgccccccagccccccgtgctgcccacccccatggccctgcaggtgcagctggccatgagccccagcccccccggcccccaggacttcccccacatcagcgagttccccagcagcagcggcagctgcagccccggccccagcaaccccaccagcagcggcgactgggacagcagctaccccagcggcgagtgcggcatcagcacctgcagcctgctgcccagagacaagagcctgtacctgacctag

SEQ ID NO: 9823 - DNA, 591 bp, Artificial Sequence; identical to SEQ ID NO: 9821
  Description of Artificial Sequence: Synthetic coding sequence

SEQ ID NO: 9824 - DNA, 1395 bp, Artificial Sequence; identical to SEQ ID NO: 9822
  Description of Artificial Sequence: Synthetic coding sequence

SEQ ID NO: 9825 - DNA, 1155 bp, Artificial Sequence
  Description of Artificial Sequence: Synthetic coding sequence
atggagcaggagagagagggcttcagcgaggaggtgaccttccagatccaggagatggtgcacagcgaggtggccgcctacgacagcggcagacccggccccctgctgggcagacccgccatgctggccagccacatgagcgccctgagccagagccagctgatcagccagatgggcatcagaagcagcatcgcccacagcagccccagcccccccggcagcaagagcgccacccccagccccagcagcagcacccaggaggaggagagcgaggtgcacttcaagatcagcggcgagaagagacccagcgccgaccccggcaagaaggccaagaaccccaagaagaagaagaagaaggaccccaacgagccccagaagcccgtgagcgcctacgccctgttcttcagagacacccaggccgccatcaagggccagaaccccagcgccaccttcggcgacgtgagcaagatcgtggccagcatgtgggacagcctgggcgaggagcagaagcaggcctacaagagaaagaccgaggccgccaagaaggagtacctgaaggccctggccgcctacagagccagcctggtgagcaagagcagccccgaccagggcgagaccaagagcacccaggccaacccccccgccaagatgctgccccccaagcagcccatgtacgccatgcccggcctggccagcttcctgacccccagcgacctgcaggccttcagaagcggcgccagccccgccagcctggccagaaccctgggcagcaagagcctgctgcccggcctgagcgccagccccccccccccccccagcttccccctgagccccaccctgcaccagcagctgagcctgcccccccacgcccagggcgccctgctgagcccccccgtgagcatgagccccgccccccagccccccgtgctgcccacccccatggccctgcaggtgcagctggccatgagccccagcccccccggcccccaggacttcccccacatcagcgagttccccagcagcagcggcagctgcagccccggccccagcaaccccaccagcagcggcgactgggacagcagctaccccagcggcgagtgcggcatcagcacctgcagcctgctgcccagagacaagagcctgtacctgacctag

SEQ ID NO: 9826 - DNA, 537 bp, Artificial Sequence
  Description of Artificial Sequence: Synthetic coding sequence
atgagcgacggcaaccccgagctgctgagcaccagccagacctacaacggccagagcgagaacaacgaggactacgagatcccccccatcaccccccccaacctgcccgagcccagcctgctgcacctgggcgaccacgaggccagctaccacagcctgtgccacggcctgacccccaacggcctgctgcccgcctacagctaccaggccatggacctgcccgccatcatggtgagcaacatgctggcccaggacagccacctgctgagcggccagctgcccaccatccaggagatggtgcacagcgaggtggccgcctacgacagcggcagacccggccccctgctgggcagacccgccatgctggccagccacatgagcgccctgagccagagccagctgatcagccagatgggcatcagaagcagcatcgcccacagcagccccagcccccccggcagcaagagcgccacccccagccccagcagcagcacccaggaggaggagagcgaggtgcacttcaagatcagcggctag

SEQ ID NO: 9827 - DNA, 366 bp, Artificial Sequence
  Description of Artificial Sequence: Synthetic coding sequence
atggccgccgccagagccaccacccccgccgacggcgaggagcccgcccccgaggccgaggccctggccgccgccagagagagaagcagcagattcctgagcggcctggagctggtgaagcagggcgccgaggccagagtgttcagaggcagattccagggcagagccgccgtgatcaagcacagattccccaagggctacagacaccccgccctggaggccagactgggcagaagaagaaccgtgcaggaggccagagccctgctgagatgcagaagagccggcaaggagtacctgccccagctgagcttcctgtggaccatgctgcccaccgcctacatctggaagaagctgaaggcccagtag

SEQ ID NO: 9828 - DNA, 762 bp, Artificial Sequence
  Description of Artificial Sequence: Synthetic coding sequence
atggccgccgccagagccaccacccccgccgacggcgaggagcccgcccccgaggccgaggccctggccgccgccagagagagaagcagcagattcctgagcggcctggagctggtgaagcagggcgccgaggccagagtgttcagaggcagattccagggcagagccgccgtgatcaagcacagattccccaagggctacagacaccccgccctggaggccagactgggcagaagaagaaccgtgcaggaggccagagccctgctgagatgcagaagagccggcatcagcgcccccgtggtgttcttcgtggactacgccagcaactgcctgtacatggaggagatcgagggcagcgtgaccgtgagagactacatccagagcaccatggagaccgagaagaccccccagggcctgagcaacctggccaagaccatcggccaggtgctggccagaatgcacgacgaggacctgatccacggcgacctgaccaccagcaacatgctgctgaagccccccctggagcagctgaacatcgtgctgatcgacttcggcctgagcttcatcagcgccctgcccgaggacaagggcgtggacctgtacgtgctggagaaggccttcctgagcacccaccccaacaccgagaccgtgttcgaggccttcctgaagagctacagcaccagcagcaagaaggccagacccgtgctgaagaagctggacgaggtgagactgagaggcagaaagagaagcatggtgggctag

SEQ ID NO: 9829 - DNA, 1146 bp, Artificial Sequence
  Description of Artificial Sequence: Synthetic coding sequence
atgatcagcgcccacagaaagctgtgcctgcccggcagcagcaacagccccgccagcgccttcagagtggccggcaccaccgccgtgaagatgagcgacaagaaccagatcgccgccagagccagcctgatcgagcagctgatgagcaagagaaacttcgaggacctgggcaaccacctgaccgagctggagaccatctacgtgaccaaggagcacctgcaggagaccgacgtggtgagagccgtgtacagagtgctgaagaactgccccagcgtggccctgaagaagaaggccaagtgcctgctgagcaagtggaaggccgtgtacaagcagacccacagcaaggccagaaacagccccaagctgttccccgtgagaggcaacaaggaggagaacagcggccccagccacgaccccagccagaacgagaccctgggcatctgcagcagcaacagcctgagcagccaggacgtggccaagctgagcgagatgatcgtgcccgagaacagagccatccagctgaagcccaaggaggagcacttcggcgacggcgaccccgagagcaccggcaagagaagcagcgagctgctggaccccaccacccccatgagaaccaagtgcatcgagctgctgtacgccgccctgaccagcagcagcaccgaccagcccaaggccgacctgtggcagaacttcgccagagagatcgaggagcacgtgttcaccctgtacagcaagaacatcaagaagtacaagacctgcatcagaagcaaggtggccaacctgaagaaccccagaaacagccacctgcagcagaacctgctgagcggcaccaccagccccagagagttcgccgagatgaccgtgatggagatggccaacaaggagctgaagcagctgagagccagctacaccgagagctgcatccaggagcactacctgccccaggtgatcgacggcacccagaccaacaagatcaagtgcagaagatgcgagaagtacaactgcaaggtgaccgtgatcgacagaggcaccctgttcctgcccagctgggtgagaaacagcaaccccgacgagcagatgatgacctacgtgatctgcaacgagtgcggcgagcagtggtaccacagcaagtgggtgtgctggtag

SEQ ID NO: 9830 - DNA, 1056 bp, Artificial Sequence
  Description of Artificial Sequence: Synthetic coding sequence
atgagcgacaagaaccagatcgccgccagagccagcctgatcgagcagctgatgagcaagagaaacttcgaggacctgggcaaccacctgaccgagctggagaccatctacgtgaccaaggagcacctgcaggagaccgacgtggtgagagccgtgtacagagtgctgaagaactgccccagcgtggccctgaagaagaaggccaagtgcctgctgagcaagtggaaggccgtgtacaagcagacccacagcaaggccagaaacagccccaagctgttccccgtgagaggcaacaaggaggagaacagcggccccagccacgaccccagccagaacgagaccctgggcatctgcagcagcaacagcctgagcagccaggacgtggccaagctgagcgagatgatcgtgcccgagaacagagccatccagctgaagcccaaggaggagcacttcggcgacggcgaccccgagagcaccggcaagagaagcagcgagctgctggaccccaccacccccatgagaaccaagtgcatcgagctgctgtacgccgccctgaccagcagcagcaccgaccagcccaaggccgacctgtggcagaacttcgccagagagatcgaggagcacgtgttcaccctgtacagcaagaacatcaagaagtacaagacctgcatcagaagcaaggtggccaacctgaagaaccccagaaacagccacctgcagcagaacctgctgagcggcaccaccagccccagagagttcgccgagatgaccgtgatggagatggccaacaaggagctgaagcagctgagagccagctacaccgagagctgcatccaggagcactacctgccccaggtgatcgacggcacccagaccaacaagatcaagtgcagaagatgcgagaagtacaactgcaaggtgaccgtgatcgacagaggcaccctgttcctgcccagctgggtgagaaacagcaaccccgacgagcagatgatgacctacgtgatctgcaacgagtgcggcgagcagtggtaccacagcaagtgggtgtgctggtag

SEQ ID NO: 9831 - DNA, 1056 bp, Artificial Sequence; identical to SEQ ID NO: 9830
  Description of Artificial Sequence: Synthetic coding sequence

SEQ ID NO: 9832 - DNA, 1056 bp, Artificial Sequence; identical to SEQ ID NO: 9830
  Description of Artificial Sequence: Synthetic coding sequence

SEQ ID NO: 9833 - DNA, 1476 bp, Artificial Sequence
  Description of Artificial Sequence: Synthetic coding sequence
atgaagaccttcacctggaccctgggcgtgctgttcttcctgctggtggacaccggccactgcagaggcggccagttcaagatcaagaagatcaaccagagaagataccccagagccaccgacggcaaggaggaggccaagaagtgcgcctacaccttcctggtgcccgagcagagaatcaccggccccatctgcgtgaacaccaagggccaggacgccagcaccatcaaggacatgatcaccagaatggacctggagaacctgaaggacgtgctgagcagacagaagagagagatcgacgtgctgcagctggtggtggacgtggacggcaacatcgtgaacgaggtgaagctgctgagaaaggagagcagaaacatgaacagcagagtgacccagctgtacatgcagctgctgcacgagatcatcagaaagagagacaacagcctggagctgagccagctggagaacaagatcctgaacgtgaccaccgagatgctgaagatggccaccagatacagagagctggaggtgaagtacgccagcctgaccgacctggtgaacaaccagagcgtgatgatcaccctgctggaggagcagtgcctgagaatcttcagcagacaggacacccacgtgagcccccccctggtgcaggtggtgccccagcacatccccaacagccagcagtacacccccggcctgctgggcggcaacgagatccagagagaccccggctaccccagagacctgatgcccccccccgacctggccaccagccccaccaagagccccttcaagatcccccccgtgaccttcatcaacgagggccccttcaaggactgccagcaggccaaggaggccggccacagcgtgagcggcatctacatgatcaagcccgagaacagcaacggccccatgcagctgtggtgcgagaacagcctggaccccggcggctggaccgtgatccagaagagaaccgacggcagcgtgaacttcttcagaaactgggagaactacaagaagggcttcggcaacatcgacggcgagtactggctgggcctggagaacatctacatgctgagcaaccaggacaactacaagctgctgatcgagctggaggactggagcgacaagaaggtgtacgccgagtacagcagcttcagactggagcccgagagcgagttctacagactgagactgggcacctaccagggcaacgccggcgacagcatgatgtggcacaacggcaagcagttcaccaccctggacagagacaaggacatgtacgccggcaactgcgcccacttccacaagggcggctggtggtacaacgcctgcgcccacagcaacctgaacggcgtgtggtacagaggcggccactacagaagcaagcaccaggacggcatcttctgggccgagtacagaggcggcagctacagcctgagagccgtgcagatgatgatcaagcccatcgactag

SEQ ID NO: 9834 - DNA, 717 bp, Artificial Sequence
  Description of Artificial Sequence: Synthetic coding sequence
atggccgtgttcagcggcgtgctggagagcgccctgttcctggaccagaacaccctgcaggccagacagggcagcagaagccccctgaccatggacaagttcgtgatcagaacccccagaatccagaacagcccccagaagaaggacagcggcggcaaggtgtacaagcaggccaccatcgagagcctgaagagagtggtggtggtggaggacatcaagagatggaagaccatgctggagctgcccgaccagaccaaggagaacctggtggaggccctgcaggagctgaagaagaagatccccagcagagaggtgctgaagagcaccagaatcggccacaccgtgaacaagatgagaaagcacagcgacagcgaggtggccagcctggccagagaggtgtacaccgagtggaagaccttcaccgagaagcacagcaacagacccagcatcgaggtgagaagcgaccccaagaccgagagcctgagaaagaacgcccagaagctgctgagcgaggccctggagctgaagatggaccacctgctggtggagaacatcgagagagagaccttccacctgtgcagcagactgatcaacggcccctacagaagaaccgtgagagccctggtgttcaccctgaagcacagagccgagatcagagcccaggtgaagagcggcagcctgcccgtgggcaccttcgtgcagacccacaagaagtag

SEQ ID NO: 9835 - DNA, 741 bp, Artificial Sequence
  Description of Artificial Sequence: Synthetic coding sequence
atggacctgctgagagagctgaaggccatgcccatcaccctgcacctgctgcagagcaccagagtgggcatgagcgtgaacgccctgagaaagcagagcagcgacgaggaggtgatcgccctggccaagagcctgatcaagagctggaagaagctgctggacgccagcgacgccaaggccagagagagaggcagaggcatgcccctgcccaccagcagcagagacgccagcgaggcccccgaccccagcagaaagagacccgagctgcccagagcccccagcacccccagaatcaccaccttcccccccgtgcccgtgacctgcgacgccgtgagaaacaagtgcagagagatgctgaccgccgccctgcagaccgaccacgaccacgtggccatcggcgccgactgcgagagactgagcgcccagatcgaggagtgcatcttcagagacgtgggcaacaccgacatgaagtacaagaacagagtgagaagcagaatcagcaacctgaaggacgccaagaaccccgacctgagaagaaacgtgctgtgcggcgccatcaccccccagcagatcgccgtgatgaccagcgaggagatggccagcgacgagctgaaggagatcagaaaggccatgaccaaggaggccatcagagagcaccagatggccagaaccggcggcacccagaccgacctgttcacctgcggcaagtgcagaaagaagaactgcacctacacccagtag

SEQ ID NO: 9836 - DNA, 900 bp, Artificial Sequence
  Description of Artificial Sequence: Synthetic coding sequence
atgatgggcaaggaggaggagatcgccagaatcgccagaagactggacaagatggtgaccaagaagagcgccgagggcgccatggacctgctgagagagctgaaggccatgcccatcaccctgcacctgctgcagagcaccagagtgggcatgagcgtgaacgccctgagaaagcagagcagcgacgaggaggtgatcgccctggccaagagcctgatcaagagctggaagaagctgctggacgccagcgacgccaaggccagagagagaggcagaggcatgcccctgcccaccagcagcagagacgccagcgaggcccccgaccccagcagaaagagacccgagctgcccagagcccccagcacccccagaatcaccaccttcccccccgtgcccgtgacctgcgacgccgtgagaaacaagtgcagagagatgctgaccgccgccctgcagaccgaccacgaccacgtggccatcggcgccgactgcgagagactgagcgcccagatcgaggagtgcatcttcagagacgtgggcaacaccgacatgaagtacaagaacagagtgagaagcagaatcagcaacctgaaggacgccaagaaccccgacctgagaagaaacgtgctgtgcggcgccatcaccccccagcagatcgccgtgatgaccagcgaggagatggccagcgacgagctgaaggagatcagaaaggccatgaccaaggaggccatcagagagcaccagatggccagaaccggcggcacccagaccgacctgttcacctgcggcaagtgcagaaagaagaactgcacctacacccaggtgcagaccagaagcagcgacgagcccatgaccaccttcgtggtgtgcaacgagtgcggcaacagatggaagttctgctag

SEQ ID NO: 9837 - DNA, 819 bp, Artificial Sequence
  Description of Artificial Sequence: Synthetic coding sequence
atggacctgctgagagagctgaaggccatgcccatcaccctgcacctgctgcagagcaccagagtgggcatgagcgtgaacgccctgagaaagcagagcagcgacgaggaggtgatcgccctggccaagagcctgatcaagagctggaagaagctgctggacgccagcgacgccaaggccagagagagaggcagaggcatgcccctgcccaccagcagcagagacgccagcgaggcccccgaccccagcagaaagagacccgagctgcccagagcccccagcacccccagaatcaccaccttcccccccgtgcccgtgacctgcgacgccgtgagaaacaagtgcagagagatgctgaccgccgccctgcagaccgaccacgaccacgtggccatcggcgccgactgcgagagactgagcgcccagatcgaggagtgcatcttcagagacgtgggcaacaccgacatgaagtacaagaacagagtgagaagcagaatcagcaacctgaaggacgccaagaaccccgacctgagaagaaacgtgctgtgcggcgccatcaccccccagcagatcgccgtgatgaccagcgaggagatggccagcgacgagctgaaggagatcagaaaggccatgaccaaggaggccatcagagagcaccagatggccagaaccggcggcacccagaccgacctgttcacctgcggcaagtgcagaaagaagaactgcacctacacccaggtgcagaccagaagcagcgacgagcccatgaccaccttcgtggtgtgcaacgagtgcggcaacagatggaagttctgctag

SEQ ID NO: 9838 - DNA, 729 bp, Artificial Sequence
  Description of Artificial Sequence: Synthetic coding sequence
atgatgggcaaggaggaggagatcgccagaatcgccagaagactggacaagatggtgaccaagaagagcgccgagggcgccatggacctgctgagagagctgaaggccatgcccatcaccctgcacctgctgcagagcaccagagtgggcatgagcgtgaacgccctgagaaagcagagcagcgacgaggaggtgatcgccctggccaagagcctgatcaagagctggaagaagctgctggacgccagcgacgccaaggccagagagagaggcagaggcatgcccctgcccaccagcagcagagacgccagcgaggcccccgaccccagcagaaagagacccgagctgcccagagcccccagcacccccagaatcaccaccttcccccccgtgcccgtgacctgcgacgccgtgagaaacaagtgcagagagatgctgaccgccgccctgcagaccgaccacgaccacgtggccatcggcgccgactgcgagagactgagcgcccagatcgaggagtacatcctgtgggtgggcgccgtgggcctgggcttctggtggagccaggaggccgcctggcccggcgccctgtggtggctgctggacgccaccgcccagctgagcagaggccacctgcccggctggagccccgcctgggtggtgagactgagccacctgagaagagcccccggccccgccgagggcctgatcctgagcgcctgcggcgcctag

SEQ ID NO: 9839 - DNA, 249 bp, Artificial Sequence
  Description of Artificial Sequence: Synthetic coding sequence
atggacctgctgagagagctgaaggccatgcccatcaccctgcacctgctgcagagcaccagagtgggcatgagcgtgaacgccctgagaaagcagagcagcgacgaggaggtgatcgccctggccaagagcctgatcaagagctggaagaagctgctggacgccagcgacgccaaggccagagagagaggcagaggcatgcccctgcccaccagcagcagagacgccagcgaggcccccgacccctag

SEQ ID NO: 9840 - DNA, 741 bp, Artificial Sequence; identical to SEQ ID NO: 9835
  Description of Artificial Sequence: Synthetic coding sequence

SEQ ID NO: 9841 - DNA, 813 bp, Artificial Sequence
  Description of Artificial Sequence: Synthetic coding sequence
atggacctgctgagagagctgaaggccatgcccatcaccctgcacctgctgcagagcaccagagtgggcatgagcgtgaacgccctgagaaagcagagcagcgacgaggaggtgatcgccctggccaagagcctgatcaagagctggaagaagctgctggacgccagcgacgccaaggccagagagagaggcagaggcatgcccctgcccaccagcagcagagacgccagcgaggcccccgaccccagcagaaagagacccgagctgcccagagcccccagcacccccagaatcaccaccttcccccccgtgcccgtgacctgcgacgccgtgagaaacaagtgcagagagatgctgaccgccgccctgcagaccgaccacgaccacgtggccatcggcgccgactgcgagagactgagcgcccagatcgaggagtgcatcttcagagacgtgggcaacaccgacatgaagtacaagaacagagtgagaagcagaatcagcaacctgaaggacgccaagaaccccgacctgagaagaaacgtgctgtgcggcgccatcaccccccagcagatcgccgtgatgaccagcgaggagatggccagcgacgagctgaaggagatcagaaaggccatgaccaaggaggccatcagagagcaccagatggccagaaccggcggcacccagaccgacctgttcacctgcggcaagtgcagaaagaagaactgcacctacacccaggtgcagaccagaagcagcgacgagcccatgaccaccttcgtggtgtgcaacgagtgcggcaacagatggaagtag

SEQ ID NO: 9842 - DNA, 465 bp, Artificial Sequence
  Description of Artificial Sequence: Synthetic coding sequence
atgggccaggaggaggagctgctgagaatcgccaagaagctggagaagatggtggccagaaagaacaccgagggcgccctggacctgctgaagaagctgcacagctgccagatgagcatccagctgctgcagaccaccagaatcggcgtggccgtgaacggcgtgagaaagcactgcagcgacaaggaggtggtgagcctggccaaggtgctgatcaagaactggaagagactgctggacagccccggcccccccaagggcgagaagggcgaggagagagagaaggccaagaagaaggagaagggcctggagtgcagcgactggaagcccgaggccggcctgagcccccccagaaagaagagagaggaccccaagaccagaagagacagcgtggacagcaagagcagcgccagcagcagccccaagagacccagcgtggagagagcctgcagcctgatgcagtag

SEQ ID NO: 9843 - DNA, 1047 bp, Artificial Sequence
  Description of Artificial Sequence: Synthetic coding sequence
atgggccaggaggaggagctgctgagaatcgccaagaagctggagaagatggtggccagaaagaacaccgagggcgccctggacctgctgaagaagctgcacagctgccagatgagcatccagctgctgcagaccaccagaatcggcgtggccgtgaacggcgtgagaaagcactgcagcgacaaggaggtggtgagcctggccaaggtgctgatcaagaactggaagagactgctggacagccccggcccccccaagggcgagaagggcgaggagagagagaaggccaagaagaaggagaagggcctggagtgcagcgactggaagcccgaggccggcctgagcccccccagaaagaagagagaggaccccaagaccagaagagacagcgtggacagcaagagcagcgccagcagcagccccaagagacccagcgtggagagaagcaacagcagcaagagcaaggccgagagccccaagacccccagcagccccctgacccccaccttcgccagcagcatgtgcctgctggccccctgctacctgaccggcgacagcgtgagagacaagtgcgtggagatgctgagcgccgccctgaaggccgacgacgactacaaggactacggcgtgaactgcgacaagatggccagcgagatcgaggaccacatctaccaggagctgaagagcaccgacatgaagtacagaaacagagtgagaagcagaatcagcaacctgaaggaccccagaaaccccggcctgagaagaaacgtgctgagcggcgccatcagcgccggcctgatcgccaagatgaccgccgaggagatggccagcgacgagctgagagagctgagaaacgccatgacccaggaggccatcagagagcaccagatggccaagaccggcggcaccaccaccgacctgttccagtgcagcaagtgcaagaagaagaactgcacctacaaccaggtgcagaccagaagcgccgacgagcccatgaccaccttcgtgctgtgcaacgagtgcggcaacagatggaagttctgctag

SEQ ID NO: 9844 - DNA, 684 bp, Artificial Sequence
  Description of Artificial Sequence: Synthetic coding sequence
atggagaagctgttcaacgagaacgagggcatgcccagcaaccagggcaagatcgacaacgaggagcagcccccccacgagggcaagcccgaggtggcctgcatcctggaggacaagaagctggagaacgagggcaacaccgagaacaccggcaagagagtggaggagcccctgaaggacaaggagaagcccgagagcgccggcaaggccaagggcgagggcaagagcgagagaaagggcaagagcgagatgcagggcggcagcaagaccgagggcaagcccgagagaggcggcagagccgagggcgagggcgagcccgacagcgagagagagcccgagagcgagggcgagcccgagagcgagaccagagccgccggcaagagacccgccgaggacgacatccccagaaaggccaagagaaagaccaacaagggcctggcccagtacctgaagcagtacaaggaggccatccacgacatgaacttcagcaacgaggacatgatcagagagttcgacaacatggccagagtggaggacaagagaagaaagagcaagcagaagctgggcgccttcctgtggatgcagagaaacctgcaggaccccttctaccccagaggccccagagagttcagaggcggctgcagagcccccagaagagacaccgaggacatcccctacgtgtag

SEQ ID NO: 9845 - DNA, 684 bp, Artificial Sequence; identical to SEQ ID NO: 9844
  Description of Artificial Sequence: Synthetic coding sequence

SEQ ID NO: 9846 - DNA, 603 bp, Artificial Sequence
  Description of Artificial Sequence: Synthetic coding sequence
atggagaagccctacaacaagaacgagggcaacctggagaacgagggcaagcccgaggacgaggtggagcccgacgacgagggcaagagcgacgaggaggagaagcccgacgtggagggcaagaccgagtgcgagggcaagagagaggacgagggcgagcccggcgacgagggccagctggaggacgagggcagccaggagaagcagggcagaagcgagggcgagggcaagccccagggcgagggcaagcccgccagccaggccaagcccgagagccagcccagagccgccgagaagagacccgccgaggactacgtgcccagaaaggccaagagaaagaccgacagaggcaccgacgacagccccaaggacagccaggaggacctgcaggagagacacctgagcagcgaggagatgatgagagagtgcggcgacgtgagcagagcccaggaggagctgagaaagaagcagaagatgggcggcttccactggatgcagagagacgtgcaggaccccttcgcccccagaggccagagaggcgtgagaggcgtgagaggcggcggcagaggccagagaggcctgcacgacatcccctacctgtag

SEQ ID NO: 9847 - DNA, 603 bp, Artificial Sequence; identical to SEQ ID NO: 9846
  Description of Artificial Sequence: Synthetic coding sequence

SEQ ID NO: 9848 - DNA, 603 bp, Artificial Sequence; identical to SEQ ID NO: 9846
  Description of Artificial Sequence: Synthetic coding sequence

SEQ ID NO: 9849 - DNA, 1077 bp, Artificial Sequence
  Description of Artificial Sequence: Synthetic coding sequence
atgcccgccggcggccaggccccccagctgacccccgtgatccccgccttctgggaggccagaggcctgcccaacagcaagggcagagacaaggtgcacatctgccagtgcgaggagtggaagggccacatcagctacgtggagagagacatcaccaccagcgagatcaagagcctgccccaggtgagcgtgagagccttccacgccgccagcggcaccctggagtggagaaagggcaacggctacggcagaggcaagggctggggctggggcagagtggagagcagagaggccggccccagcgtggacagagacggcggcctgagagtgtgctgcagccagagaagcgccaagcccgagaaggaggagcagcccgtgcagaaccccagaagaagcgtgaaggacagaaagagaagaggcaacctggacatggagaagctgtacagcgagaacgagggcatggccagcaaccagggcaagatggagaacgaggagcagccccaggacgagagaaagcccgaggtgacctgcaccctggaggacaagaagctggagaacgagggcaagaccgagaacaagggcaagaccggcgacgaggagatgctgaaggacaagggcaagcccgagagcgagggcgaggccaaggagggcaagagcgagagagagggcgagagcgagatggagggcggcagcgagagagagggcaagcccgagatcgagggcaagcccgagagcgagggcgagcccggcagcgagaccagagccgccggcaagagacccgccgaggacgacgtgcccagaaaggccaagagaaagaccaacaagggcctggcccactacctgaaggagtacaaggaggccatccacgacatgaacttcagcaacgaggacatgatcagagagttcgacaacatggccaaggtgcaggacgagaagagaaagagcaagcagaagctgggcgccttcctgtggatgcagagaaacctgcaggaccccttctaccccagaggccccagagagttcagaggcggctgcagagcccccagaagagacatcgaggacatcccctacgtgtag

SEQ ID NO: 9850 - DNA, 561 bp, Artificial Sequence
  Description of Artificial Sequence: Synthetic coding sequence
atggagaagctgtacagcgagaacgagggcatggccagcaaccagggcaagatggagaacgaggagcagccccaggacgagagaaagcccgaggtgacctgcaccctggaggacaagaagctggagaacgagggcaagaccgagaacaagggcaagaccggcgacgaggagatgctgaaggacaagggcaagcccgagatcgagggcaagcccgagagcgagggcgagcccggcagcgagaccagagccgccggcaagagacccgccgaggacgacgtgcccagaaaggccaagagaaagaccaacaagggcctggcccactacctgaaggagtacaaggaggccatccacgacatgaacttcagcaacgaggacatgatcagagagttcgacaacatggccaaggtgcaggacgagaagagaaagagcaagcagaagctgggcgccttcctgtggatgcagagaaacctgcaggaccccttctaccccagaggccccagagagttcagaggcggctgcagagcccccagaagagacatcgaggacatcccctacgtgtag

SEQ ID NO: 9851 - DNA, 648 bp, Artificial Sequence
  Description of Artificial Sequence: Synthetic coding sequence
atggagaagctgtacagcgagaacgagggcatggccagcaaccagggcaagatggagaacgaggagcagccccaggacgagagaaagcccgaggtgacctgcaccctggaggacaagaagctggagaacgagggcaagaccgagaacaagggcaagaccggcgacgaggagatgctgaaggacaagggcaagcccgagagcgagggcgaggccaaggagggcaagagcgagagagagggcgagagcgagatggagggcggcagcgagagagagggcaagcccgagatcgagggcaagcccgagagcgagggcgagcccggcagcgagaccagagccgccggcaagagacccgccgaggacgacgtgcccagaaaggccaagagaaagaccaacaagggcctggcccactacctgaaggagtacaaggaggccatccacgacatgaacttcagcaacgaggacatgatcagagagttcgacaacatggccaaggtgcaggacgagaagagaaagagcaagcagaagctgggcgccttcctgtggatgcagagaaacctgcaggaccccttctaccccagaggccccagagagttcagaggcggctgcagagcccccagaagagacatcgaggacatcccctacgtgtag

SEQ ID NO: 9852 - DNA, 177 bp, Artificial Sequence
  Description of Artificial Sequence: Synthetic coding sequence
atggagaagctgtacagcgagaacgagggcatggccagcaaccagggcaagatggagaacgaggagcagccccaggacgagagaaagcccgaggtgacctgcaccctggaggacaagaagctggagaacgagggcaagaccgagaacaagggcaagaccggcgacgaggagatgtag

SEQ ID NO: 9853 - DNA, 153 bp, Artificial Sequence
  Description of Artificial Sequence: Synthetic coding sequence
atggagaagctgtacagcgagaacgagggcatggccagcaaccagggcaagatggagaacgaggagcagccccaggacgagagaaagcccgaggtgacctgcaccctggaggacaagaagctggagaacgagggcaagaccgagaacaagtag

SEQ ID NO: 9854 - DNA, 276 bp, Artificial Sequence
  Description of Artificial Sequence: Synthetic coding sequence
atggagaagctgtacagcgagaacgagggcatggccagcaaccagggcaagatggagaacgaggagcagccccaggacgagagaaagcccgaggtgacctgcaccctggaggacaagaagctggagaacgagggcaagaccgagaacaagggcaagaccggcgacgaggagatgctgaaggacaagggcaagcccgagagcgagggcgaggccaaggagggcaagagcgagagagagggcgagagcgagatggagggcggcagcgagagagagtag

SEQ ID NO: 9855 - DNA, 648 bp, Artificial Sequence; identical to SEQ ID NO: 9851
  Description of Artificial Sequence: Synthetic coding sequence

SEQ ID NO: 9856 - DNA, 390 bp, Artificial Sequence
  Description of Artificial Sequence: Synthetic coding sequence
atggagaagctgtacagcgagaacgagggcatggccagcaaccagggcaagatggagaacgaggagcagccccaggacgagagaaagcccgaggtgacctgcaccctggaggacaagaagctggagaacgagggcaagaccgagaacaagggcaagaccggcgacgaggagatgctgaaggacaagggcaagcccgagagcgagggcgaggccaaggagggcaagagcgagagagagggcgagagcgagatggagggcggcagcgagagagagggcaagcccgagatcgagggcaagcccgagagcgagggcgagcccggcagcgagaccagagccgccggcaagagacccgccgaggacgacgtgcccagaaaggccaagagaaagtag

SEQ ID NO: 9857 - DNA, 648 bp, Artificial Sequence; identical to SEQ ID NO: 9851
  Description of Artificial Sequence: Synthetic coding sequence

SEQ ID NO: 9858 - DNA, 648 bp, Artificial Sequence; identical to SEQ ID NO: 9851
  Description of Artificial Sequence: Synthetic coding sequence

SEQ ID NO: 9859 - DNA, 231 bp, Artificial Sequence
  Description of Artificial Sequence: Synthetic coding sequence
atggagaagctgtacagcgagaacgagggcatggccagcaaccagggcaagatggagaacgaggagcagccccaggacgagagaaagcccgaggtgacctgcaccctggaggacaagaagctggagaacgagggcaagaccgagaacaagggcaagaccggcgacgaggagatgctgaaggacaagggcaagcccgagagcgagggcgaggccaaggagggcaagagctag

SEQ ID NO: 9860 - DNA, 648 bp, Artificial Sequence; identical to SEQ ID NO: 9851
  Description of Artificial Sequence: Synthetic coding sequence

SEQ ID NO: 9861 - DNA, 621 bp, Artificial Sequence
  Description of Artificial Sequence: Synthetic coding sequence
atggagaagctgtacaaggagaacgagggcaagcccgagaacgagagaaacctggagagcgagggcaagcccgaggacgagggcagcaccgaggacgagggcaagagcgacgaggaggagaagcccgacatggagggcaagaccgagtgcgagggcaagagagaggacgagggcgagcccggcgacgagggccagctggaggacgagggcaaccaggagaagcagggcaagagcgagggcgaggacaagccccagagcgagggcaagcccgccagccaggccaagcccgagagccagcccagagccgccgagaagagacccgccgaggactacgtgcccagaaaggccaagagaaagaccgacagaggcaccgacgacagccccaaggacagccaggaggacctgcaggagagacacctgagcagcgaggagatgatgagagagtgcggcgacgtgagcagagcccaggaggagctgagaaagaagcagaagatgggcggcttccactggatgcagagagacgtgcaggaccccttcgcccccagaggccagagaggcgtgagaggcgtgagaggcggcggcagaggccagaaggacctggaggacgtgccctacgtgtag

SEQ ID NO: 9862 - DNA, 552 bp, Artificial Sequence
  Description of Artificial Sequence: Synthetic coding sequence
atggagaagccctacaacaagaacgagggcaacctggagaacgagggcaagcccgaggacgaggtggagcccgacgacgagggcaagagcgacgaggaggagaagcccgacgccgagggcaagaccgagtgcgagggcaagagaaaggccgagggcgagcccggcgacgagggccagctggaggacaagggcagccaggagaagcagggcaagagcgagggcgagggcaagccccagggcgagggcaagcccgccagccaggccaagcccgagggccagcccagagccgccgagaagagacccgccggcgactacgtgcccagaaaggccaagagaaagaccgacagaggcaccgacgacagccccaaggacagccaggaggacctgcaggagagacacctgagcagcgaggagatgatgagagagtgcggcgacgtgagcagagcccaggaggagctgagaaagaagcagaagatgggcggcttccactggatgcagagagacgtgcaggaccccttcgcccagggcgacaacggcgtgagcggcgagtag

SEQ ID NO: 9863 - DNA, 552 bp, Artificial Sequence; identical to SEQ ID NO: 9862
  Description of Artificial Sequence: Synthetic coding sequence

SEQ ID NO: 9864 - DNA, 600 bp, Artificial Sequence
  Description of Artificial Sequence: Synthetic coding sequence
atggagaagccctacaacaagaacgagggcaacctggagaacgagggcaagcccgaggacgaggtggagcccgacgacgagggcaagagcgacgaggaggagaagcccgacgccgagggcaagaccgagtgcgagggcaagagaaaggccgagggcgagcccggcgacgagggccagctggaggacaagggcagccaggagaagcagggcaagagcgagggcgagggcaagccccagggcgagggcaagcccgccagccaggccaagcccgagggccagcccagagccgccgagaagagacccgccggcgactacgtgcccagaaaggccaagagaaagaccgacagaggcaccgacgacagccccaaggacagccaggaggacctgcaggagagacacctgagcagcgaggagatgatgagagagtgcggcgacgtgagcagagcccaggaggagctgagaaagaagcagaagatgggcggcttccactggatgcagagagacgtgcaggaccccttccccagaggccagagaggcgtgagaggcgtgagaggcggcggcagaggccagagaggcctgcacgacatcccctacctgtag

SEQ ID NO: 9865 - DNA, 354 bp, Artificial Sequence
  Description of Artificial Sequence: Synthetic coding sequence
atgcagaagagctgcgaggagaacgagggcaagccccagaacatgcccaaggccgaggaggacagacccctggaggacgtgccccaggaggccgagggcaacccccagcccagcgaggagggcgtgagccaggaggccgagggcaaccccagaggcggccccaaccagcccggccagggcttcaaggaggacacccccgtgagacacctggaccccgaggagatgatcagaggcgtggacgagctggagagactgagagaggagatcagaagagtgagaaacaagttcgtgatgatgcactggaagcagagacacagcagaagcagaccctaccccgtgtgcttcagaccctag

SEQ ID NO: 9866 - DNA, 354 bp, Artificial Sequence; identical to SEQ ID NO: 9865
  Description of Artificial Sequence: Synthetic coding sequence

SEQ ID NO: 9867 - DNA, 225 bp, Artificial Sequence
  Description of Artificial Sequence: Synthetic coding sequence
atgcagaagagctgcgaggagaacgagggcaagccccagaacatgcccaaggccgaggaggacagacccctggaggacgtgccccaggaggacacccccgtgagacacctggaccccgaggagatgatcagaggcgtggacgagctggagagactgagagaggagatcagaagagtgagaaacaagttcgtgatgatgcactggaagcagagacacagcagatag

SEQ ID NO: 9868 - DNA, 1155 bp, Artificial Sequence
  Description of Artificial Sequence: Synthetic coding sequence
atgccccagctggacagcggcggcggcggcgccggcggcggcgacgacctgggcgcccccgacgagctgctggccttccaggacgagggcgaggagcaggacgacaagagcagagacagcgccgccggccccgagagagacctggccgagctgaagagcagcctggtgaacgagagcgagggcgccgccggcggcgccggcatccccggcgtgcccggcgccggcgccggcgccagaggcgaggccgaggccctgggcagagagcacgccgcccagagactgttccccgacaagctgcccgagcccctggaggacggcctgaaggcccccgagtgcaccagcggcatgtacaaggagaccgtgtacagcgccttcaacctgctgatgcactaccccccccccagcggcgccggccagcacccccagccccagccccccctgcacaaggccaaccagcccccccacggcgtgccccagctgagcctgtacgagcacttcaacagcccccaccccacccccgcccccgccgacatcagccagaagcaggtgcacagacccctgcagacccccgacctgagcggcttctacagcctgaccagcggcagcatgggccagctgccccacaccgtgagctggttcacccaccccagcctgatgctgggcagcggcgtgcccggccaccccgccgccatcccccaccccgccatcgtgccccccagcggcaagcaggagctgcagcccttcgacagaaacctgaagacccaggccgagagcaaggccgagaaggaggccaagaagcccaccatcaagaagcccctgaacgccttcatgctgtacatgaaggagatgagagccaaggtgatcgccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagagaagaagcagagagaagcaccaggagagcaccaccgagaccaactggcccagagagctgaaggacggcaacggccaggagagcctgagcatgagcagcagcagcagccccgcctag

SEQ ID NO: 9869 - DNA, 1098 bp, Artificial Sequence
  Description of Artificial Sequence: Synthetic coding sequence
atgccccagctggacagcggcggcggcggcgccggcggcggcgacgacctgggcgcccccgacgagctgctggccttccaggacgagggcgaggagcaggacgacaagagcagagacagcgccgccggccccgagagagacctggccgagctgaagagcagcctggtgaacgagagcgagggcgccgccggcggcgccggcatccccggcgtgcccggcgccggcgccggcgccagaggcgaggccgaggccctgggcagagagcacgccgcccagagactgttccccgacaagctgcccgagcccctggaggacggcctgaaggcccccgagtgcaccagcggcatgtacaaggagaccgtgtacagcgccttcaacctgctgatgcactaccccccccccagcggcgccggccagcacccccagccccagccccccctgcacaaggccaaccagcccccccacggcgtgccccagctgagcctgtacgagcacttcaacagcccccaccccacccccgcccccgccgacatcagccagaagcaggtgcacagacccctgcagacccccgacctgagcggcttctacagcctgaccagcggcagcatgggccagctgccccacaccgtgagctggttcacccaccccagcctgatgctgggcagcggcgtgcccggccaccccgccgccatcccccaccccgccatcgtgccccccagcggcaagcaggagctgcagcccttcgacagaaacctgaagacccaggccgagagcaaggccgagaaggaggccaagaagcccaccatcaagaagcccctgaacgccttcatgctgtacatgaaggagatgagagccaaggtgatcgccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagagaagaagcagagagaagcaccaggagagcaccaccgacaacagcctgcactacagctag

SEQ ID NO: 9870 - DNA, 1155 bp, Artificial Sequence
  Description of Artificial Sequence: Synthetic coding sequence
atgccccagctggacagcggcggcggcggcgccggcggcggcgacgacctgggcgcccccgacgagctgctggccttccaggacgagggcgaggagcaggacgacaagagcagagacagcgccgccggccccgagagagacctggccgagctgaagagcagcctggtgaacgagagcgagggcgccgccggcggcgccggcatccccggcgtgcccggcgccggcgccggcgccagaggcgaggccgaggccctgggcagagagcacgccgcccagagactgttccccgacaagctgcccgagcccctggaggacggcctgaaggcccccgagtgcaccagcggcatgtacaaggagaccgtgtacagcgccttcaacctgctgatgcactaccccccccccagcggcgccggccagcacccccagccccagccccccctgcacaaggccaaccagcccccccacggcgtgccccagctgagcctgtacgagcacttcaacagcccccaccccacccccgcccccgccgacatcagccagaagcaggtgcacagacccctgcagacccccgacctgagcggcttctacagcctgaccagcggcagcatgggccagctgccccacaccgtgagctggttcacccaccccagcctgatgctgggcagcggcgtgcccggccaccccgccgccatcccccaccccgccatcgtgccccccagcggcaagcaggagctgcagcccttcgacagaaacctgaagacccaggccgagagcaaggccgagaaggaggccaagaagcccaccatcaagaagcccctgaacgccttcatgctgtacatgaaggagatgagagccaaggtgatcgccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagagaagaagcagagagaagcaccaggagagcaccaccggcggcaagagaaacgccttcggcacctaccccgagaaggccgccgcccccgcccccttcctgcccatgaccgtgctgtag

SEQ ID NO: 9871 - DNA, 1485 bp, Artificial Sequence
  Description of Artificial Sequence: Synthetic coding sequence
atgccccagctggacagcggcggcggcggcgccggcggcggcgacgacctgggcgcccccgacgagctgctggccttccaggacgagggcgaggagcaggacgacaagagcagagacagcgccgccggccccgagagagacctggccgagctgaagagcagcctggtgaacgagagcgagggcgccgccggcggcgccggcatccccggcgtgcccggcgccggcgccggcgccagaggcgaggccgaggccctgggcagagagcacgccgcccagagactgttccccgacaagctgcccgagcccctggaggacggcctgaaggcccccgagtgcaccagcggcatgtacaaggagaccgtgtacagcgccttcaacctgctgatgcactaccccccccccagcggcgccggccagcacccccagccccagccccccctgcacaaggccaaccagcccccccacggcgtgccccagctgagcctgtacgagcacttcaacagcccccaccccacccccgcccccgccgacatcagccagaagcaggtgcacagacccctgcagacccccgacctgagcggcttctacagcctgaccagcggcagcatgggccagctgccccacaccgtgagctggttcacccaccccagcctgatgctgggcagcggcgtgcccggccaccccgccgccatcccccaccccgccatcgtgccccccagcggcaagcaggagctgcagcccttcgacagaaacctgaagacccaggccgagagcaaggccgagaaggaggccaagaagcccaccatcaagaagcccctgaacgccttcatgctgtacatgaaggagatgagagccaaggtgatcgccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagagaagaagcagagagaagcaccaggagagcaccaccgaccccggcagccccaagaagtgcagagccagattcggcctgaaccagcagaccgactggtgcggcccctgcagaagaaagaagaagtgcatcagatacctgcccggcgagggcagatgccccagccccgtgcccagcgacgacagcgccctgggctgccccggcagccccgccccccaggacagccccagctaccacctgctgcccagattccccaccgagctgctgaccagccccgccagacacctgcacccccaggtgagccccctgctgagcgccagccagccccagggcccccacagaccccccgccgccccctgcagagcccacagatacagcaacagaaacctgagagacagatggcccagcagacacagaacccccggcagactgcaggagcccaccccctag

SEQ ID NO: 9872 - DNA, 807 bp, Artificial Sequence
  Description of Artificial Sequence: Synthetic coding sequence
atgtacaaggagaccgtgtacagcgccttcaacctgctgatgcactaccccccccccagcggcgccggccagcacccccagccccagccccccctgcacaaggccaaccagcccccccacggcgtgccccagctgagcctgtacgagcacttcaacagcccccaccccacccccgcccccgccgacatcagccagaagcaggtgcacagacccctgcagacccccgacctgagcggcttctacagcctgaccagcggcagcatgggccagctgccccacaccgtgagctggttcacccaccccagcctgatgctgggcagcggcgtgcccggccaccccgccgccatcccccaccccgccatcgtgccccccagcggcaagcaggagctgcagcccttcgacagaaacctgaagacccaggccgagagcaaggccgagaaggaggccaagaagcccaccatcaagaagcccctgaacgccttcatgctgtacatgaaggagatgagagccaaggtgatcgccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagagaagaagcagagagaagcaccaggagagcaccaccgaccccggcagccccaagaagtgcagagccagattcggcctgaaccagcagaccgactggtgcggcccctgcagatag

SEQ ID NO: 9873 - DNA, 1110 bp, Artificial Sequence
  Description of Artificial Sequence: Synthetic coding sequence
atgccccagctggacagcggcggcggcggcgccggcggcggcgacgacctgggcgcccccgacgagctgctggccttccaggacgagggcgaggagcaggacgacaagagcagagacagcgccgccggccccgagagagacctggccgagctgaagagcagcctggtgaacgagagcgagggcgccgccggcggcgccggcatccccggcgtgcccggcgccggcgccggcgccagaggcgaggccgaggccctgggcagagagcacgccgcccagagactgttccccgacaagctgcccgagcccctggaggacggcctgaaggcccccgagtgcaccagcggcatgtacaaggagaccgtgtacagcgccttcaacctgctgatgcactaccccccccccagcggcgccggccagcacccccagccccagccccccctgcacaaggccaaccagcccccccacggcgtgccccagctgagcctgtacgagcacttcaacagcccccaccccacccccgcccccgccgacatcagccagaagcaggtgcacagacccctgcagacccccgacctgagcggcttctacagcctgaccagcggcagcatgggccagctgccccacaccgtgagctggttcacccaccccagcctgatgctgggcagcggcgtgcccggccaccccgccgccatcccccaccccgccatcgtgccccccagcggcaagcaggagctgcagcccttcgacagaaacctgaagacccaggccgagagcaaggccgagaaggaggccaagaagcccaccatcaagaagcccctgaacgccttcatgctgtacatgaaggagatgagagccaaggtgatcgccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagagaagaagcagagagaagcaccaggagagcaccaccgacggcatccccgcctgcaccatcctgagcccctag

SEQ ID NO: 9874 - DNA, 810 bp, Artificial Sequence
  Description of Artificial Sequence: Synthetic coding sequence
atgtacaaggagaccgtgtacagcgccttcaacctgctgatgcactaccccccccccagcggcgccggccagcacccccagccccagccccccctgcacaaggccaaccagcccccccacggcgtgccccagctgagcctgtacgagcacttcaacagcccccaccccacccccgcccccgccgacatcagccagaagcaggtgcacagacccctgcagacccccgacctgagcggcttctacagcctgaccagcggcagcatgggccagctgccccacaccgtgagctggttcacccaccccagcctgatgctgggcagcggcgtgcccggccaccccgccgccatcccccaccccgccatcgtgccccccagcggcaagcaggagctgcagcccttcgacagaaacctgaagacccaggccgagagcaaggccgagaaggaggccaagaagcccaccatcaagaagcccctgaacgccttcatgctgtacatgaaggagatgagagccaaggtgatcgccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagagaagaagcagagagaagcaccaggagagcaccaccggcggcaagagaaacgccttcggcacctaccccgagaaggccgccgcccccgcccccttcctgcccatgaccgtgctgtag

SEQ ID NO: 9875 - DNA, 1446 bp, Artificial Sequence
  Description of Artificial Sequence: Synthetic coding sequence
atgccccagctggacagcggcggcggcggcgccggcggcggcgacgacctgggcgcccccgacgagctgctggccttccaggacgagggcgaggagcaggacgacaagagcagagacagcgccgccggccccgagagagacctggccgagctgaagagcagcctggtgaacgagagcgagggcgccgccggcggcgccggcatccccggcgtgcccggcgccggcgccggcgccagaggcgaggccgaggccctgggcagagagcacgccgcccagagactgttccccgacaagctgcccgagcccctggaggacggcctgaaggcccccgagtgcaccagcggcatgtacaaggagaccgtgtacagcgccttcaacctgctgatgcactaccccccccccagcggcgccggccagcacccccagccccagccccccctgcacaaggccaaccagcccccccacggcgtgccccagctgagcctgtacgagcacttcaacagcccccaccccacccccgcccccgccgacatcagccagaagcaggtgcacagacccctgcagacccccgacctgagcggcttctacagcctgaccagcggcagcatgggccagctgccccacaccgtgagctggttcacccaccccagcctgatgctgggcagcggcgtgcccggccaccccgccgccatcccccaccccgccatcgtgccccccagcggcaagcaggagctgcagcccttcgacagaaacctgaagacccaggccgagagcaaggccgagaaggaggccaagaagcccaccatcaagaagcccctgaacgccttcatgctgtacatgaaggagatgagagccaaggtgatcgccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagagaagaagcagagagaagcaccaggagagcaccaccgaccccggcagccccaagaagtgcagagccagattcggcctgaaccagcagaccgactggtgcggcccctgcagaagaaagaagaagtgcatcagatacctgcccggcgagggcagatgccccagccccgtgcccagcgacgacagcgccctgggctgccccggcagccccgccccccaggacagccccagctaccacctgctgcccagattccccaccgagctgctgaccagccccgccgagcccgcccccaccagccccggcctgagcaccgccctgagcctgcccacccccggccccccccaggcccccagaagcaccctgcagagcacccaggtgcagcagcaggagagccagagacaggtggcctag

SEQ ID NO: 9876 - DNA, 1101 bp, Artificial Sequence
  Description of Artificial Sequence: Synthetic coding sequence
atgtacaaggagaccgtgtacagcgccttcaacctgctgatgcactaccccccccccagcggcgccggccagcacccccagccccagccccccctgcacaaggccaaccagcccccccacggcgtgccccagctgagcctgtacgagcacttcaacagcccccaccccacccccgcccccgccgacatcagccagaagcaggtgcacagacccctgcagacccccgacctgagcggcttctacagcctgaccagcggcagcatgggccagctgccccacaccgtgagctggttcacccaccccagcctgatgctgggcagcggcgtgcccggccaccccgccgccatcccccaccccgccatcgtgccccccagcggcaagcaggagctgcagcccttcgacagaaacctgaagacccaggccgagagcaaggccgagaaggaggccaagaagcccaccatcaagaagcccctgaacgccttcatgctgtacatgaaggagatgagagccaaggtgatcgccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagagaagaagcagagagaagcaccaggagagcaccaccgaccccggcagccccaagaagtgcagagccagattcggcctgaaccagcagaccgactggtgcggcccctgcagaagaaagaagaagtgcatcagatacctgcccggcgagggcagatgccccagccccgtgcccagcgacgacagcgccctgggctgccccggcagccccgccccccaggacagccccagctaccacctgctgcccagattccccaccgagctgctgaccagccccgccgagcccgcccccaccagccccggcctgagcaccgccctgagcctgcccacccccggccccccccaggcccccagaagcaccctgcagagcacccaggtgcagcagcaggagagccagagacaggtggcctag

SEQ ID NO: 9877 - DNA, 372 bp, Artificial Sequence
  Description of Artificial Sequence: Synthetic coding sequence
atgtacaaggagaccgtgtacagcgccttcaacctgctgatgcactaccccccccccagcggcgccggccagcacccccagccccagccccccctgcacaaggccaaccagcccccccacggcgtgccccagctgagcctgtacgagcacttcaacagcccccaccccacccccgcccccgccgacatcagccagaagcaggtgcacagacccctgcagacccccgacctgagcggcttctacagcctgaccagcggcagcatgggccagctgccccacaccgtgagctggttcacccaccccagcctgatgctgggcagcggcgtgcccggccaccccgccgccatcccccaccccgccatcgtgccctag

SEQ ID NO: 9878 - DNA, 810 bp, Artificial Sequence
  Description of Artificial Sequence: Synthetic coding sequence
atgtacaaggagaccgtgtacagcgccttcaacctgctgatgcactaccccccccccagcggcgccggccagcacccccagccccagccccccctgcacaaggccaaccagcccccccacggcgtgccccagctgagcctgtacgagcacttcaacagcccccaccccacccccgcccccgccgacatcagccagaagcaggtgcacagacccctgcagacccccgacctgagcggcttctacagcctgaccagcggcagcatgggccagctgccccacaccgtgagctggttcacccaccccagcctgatgctgggcagcggcgtgcccggccaccccgccgccatcccccaccccgccatcgtgccccccagcggcaagcaggagctgcagcccttcgacagaaacctgaagacccaggccgagagcaaggccgagaaggaggccaagaagcccaccatcaagaagcccctgaacgccttcatgctgtacatgaaggagatgagagccaaggtgatcgccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagagaagaagcagagagaagcaccaggagagcaccaccgagaccaactggcccagagagctgaaggacggcaacggccaggagagcctgagcatgagcagcagcagcagccccgcctag

SEQ ID NO: 9879 - DNA, 444 bp, Artificial Sequence
  Description of Artificial Sequence: Synthetic coding sequence
atgtacaaggagaccgtgtacagcgccttcaacctgctgatgcactaccccccccccagcggcgccggccagcacccccagccccagccccccctgcacaaggccaaccagcccccccacggcgtgccccagctgagcctgtacgagcacttcaacagcccccaccccacccccgcccccgccgacatcagccagaagcaggtgcacagacccctgcagacccccgacctgagcggcttctacagcctgaccagcggcagcatgggccagctgccccacaccgtgagctggttcacccaccccagcctgatgctgggcagcggcgtgcccggccaccccgccgccatcccccaccccgccatcgtgccccccagcggcaagcaggagctgcagcccttcgacagaaacctgaagacccaggccgagagcaaggccgagaagtag

SEQ ID NO: 9880 - DNA, 1767 bp, Artificial Sequence
  Description of Artificial Sequence: Synthetic coding sequence
atgccccagctgggcggcggcggcggcggcggcggcggcggcagcggcggcggcggcggcagcagcgccggcgccgccggcggcggcgacgacctgggcgccaacgacgagctgatccccttccaggacgagggcggcgaggagcaggagcccagcagcgacagcgccagcgcccagagagacctggacgaggtgaagagcagcctggtgaacgagagcgagaaccagagcagcagcagcgacagcgaggccgagagaagaccccagcccgtgagagacaccttccagaagcccagagactacttcgccgaggtgagaagaccccaggacagcgccttcttcaagggccccccctaccccggctaccccttcctgatgatccccgacctgagcagcccctacctgagcaacggccccctgagccccggcggcgccagaacctacctgcagatgaagtggcccctgctggacgtgcccagcagcgccaccgtgaaggacaccagaagccccagccccgcccacctgagcaacaaggtgcccgtggtgcagcacccccaccacatgcaccccctgacccccctgatcacctacagcaacgaccacttcagccccggcagcccccccacccacctgagccccgagatcgaccccaagaccggcatccccagacccccccaccccagcgagctgagcccctactaccccctgagccccggcgccgtgggccagatcccccaccccctgggctggctggtgccccagcagggccagcccatgtacagcctgccccccggcggcttcagacacccctaccccgccctggccatgaacgccagcatgagcagcctggtgagcagcagattcagcccccacatggtggcccccgcccaccccggcctgcccaccagcggcatcccccaccccgccatcgtgagccccatcgtgaagcaggagcccgccccccccagcctgagccccgccgtgagcgtgaagagccccgtgaccgtgaagaaggaggaggagaagaagccccacgtgaagaagcccctgaacgccttcatgctgtacatgaaggagatgagagccaaggtggtggccgagtgcaccctgaaggagagcgccgccatcaaccagatcctgggcagaaagtggcacaacctgagcagagaggagcaggccaagtactacgagctggccagaaaggagagacagctgcacagccagctgtaccccacctggagcgccagagacaactacggcaagaagaagaagagaaagagagagaagcagctgagccagacccagagccagcagcaggtgcaggaggccgagggcgccctggccagcaagagcaagaagccctgcgtgcagtacctgccccccgagaagccctgcgacagccccgccagcagccacggcagcatgctggacagccccgccacccccagcgccgccctggccagccccgccgcccccgccgccacccacagcgagcaggcccagcccctgagcctgaccaccaagcccgagaccagagcccagctggccctgcacagcgccgccttcctgagcgccaaggccgccgccagcagcagcggccagatgggcagccagccccccctgctgagcagacccctgcccctgggcagcatgcccaccgccctgctggccagcccccccagcttccccgccaccctgcacgcccaccaggccctgcccgtgctgcaggcccagcccctgagcctggtgaccaagagcgcccactag

SEQ ID NO: 9881 - DNA, 1017 bp, Artificial Sequence
  Description of Artificial Sequence: Synthetic coding sequence
atggagtacttcatggtgcccacccagaaggtgcccagcctgcagcacttcagaaagaccgagaaggaggtgatcggcggcctgtgcagcctggccaacatccccctgacccccgagacccagagagaccaggagagaagaatcagaagagagatcgccaacagcaacgagagaagaagaatgcagagcatcaacgccggcttccagagcctgaagaccctgatcccccacaccgacggcgagaagctgagcaaggccgccatcctgcagcagaccgccgagtacatcttcagcctggagcaggagaagaccagactgctgcagcagaacacccagctgaagagattcatccaggagctgagcggcagcagccccaagagaagaagagccgaggacaaggacgagggcatcggcagccccgacatctgggaggacgagaaggccgaggacctgagaagagagatgatcgagctgagacagcagctggacaaggagagaagcgtgagaatgatgctggaggagcaggtgagaagcctggaggcccacatgtaccccgagaagctgaaggtgatcgcccagcaggtgcagctgcagcagcagcaggagcaggtgagactgctgcaccaggagaagctggagagagagcagcagcagctgagaacccagctgctgcccccccccgcccccacccaccaccccaccgtgatcgtgcccgcccccccccccccccccagccaccacatcaacgtggtgaccatgggccccagcagcgtgatcaacagcgtgagcaccagcagacagaacctggacaccatcgtgcaggccatccagcacatcgagggcacccaggagaagcaggagctggaggaggagcagagaagagccgtgatcgtgaagcccgtgagaagctgccccgaggcccccaccagcgacaccgccagcgacagcgaggccagcgacagcgacgccatggaccagagcagagaggagcccagcggcgacggcgagctgccctag

SEQ ID NO: 9882 - DNA, 741 bp, Artificial Sequence
  Description of Artificial Sequence: Synthetic coding sequence
atgtaccaggtgagcggccagagacccagcggctgcgacgccccctacggcgcccccagcgccgcccccggccccgcccagaccctgagcctgctgcccggcctggaggtggtgaccggcagcacccaccccgccgaggccgcccccgaggagggcagcctggaggaggccgccacccccatgccccagggcaacggccccggcatcccccagggcctggacagcaccgacctggacgtgcccaccgaggccgtgacctgccagccccagggcaaccccctgggctgcacccccctgctgcccaacgacagcggccaccccagcgagctgggcggcaccagaagagccggcaacggcgccctgggcggccccaaggcccacagaaagctgcagacccaccccagcctggccagccagggcagcaagaagagcaagagcagcagcaagagcaccaccagccagatccccctgcaggcccaggaggactgctgcgtgcactgcatcctgagctgcctgttctgcgagttcctgaccctgtgcaacatcgtgctggactgcgccacctgcggcagctgcagcagcgaggacagctgcctgtgctgctgctgctgcggcagcggcgagtgcgccgactgcgacctgccctgcgacctggactgcggcatcctggacgcctgctgcgagagcgccgactgcctggagatctgcatggagtgctgcggcctgtgcttcagcagctag

SEQ ID NO: 9883 - DNA, 1689 bp, Artificial Sequence
  Description of Artificial Sequence: Synthetic coding sequence
atgagcgaggaggacagaaccttcagcttcggccccggcaccagaaagctgggcttcatgagccagctgagccccgcctgcagcgtgaccctgggcaagagcctgcccctgagcggcctgggcgtgttcagcagcaagatggacgccgtgcccgtgatcctggccagcccctgccagcccctgtgcttcgaggaggacacctgcctgatctacctgctgcccctgctgatccacagagagcccgcccccgccgccaccatggccagcagaatcggcctgagaatgcagctgatgagagagcaggcccagcaggaggagcagagagagagaatgcagcagcaggccgtgatgcactacatgcagcagcagcagcagcagcagcagcagcagctgggcggcccccccacccccgccatcaacacccccgtgcacttccagagccccccccccgtgcccggcgaggtgctgaaggtgcagagctacctggagaaccccaccagctaccacctgcagcagagccagcaccagaaggtgagagagtacctgagcgagacctacggcaacaagttcgccgcccacatcagccccgcccagggcagccccaagcccccccccgccgccagccccggcgtgagagccggccacgtgctgagcagcagcgccggcaacagcgcccccaacagccccatggccatgctgcacatcggcagcaaccccgagagagagctggacgacgtgatcgacaacatcatgagactggacgacgtgctgggctacatcaaccccgagatgcagatgcccaacaccctgcccctgagcagcagccacctgaacgtgtacagcagcgacccccaggtgaccgccagcctggtgggcgtgaccagcagcagctgccccgccgacctgacccagaagagagagctgaccgacgccgagagcagagccctggccaaggagagacagaagaaggacaaccacaacctgatcgagagaagaagaagattcaacatcaacgacagaatcaaggagctgggcatgctgatccccaaggccaacgacctggacgtgagatggaacaagggcaccatcctgaaggccagcgtggactacatcagaagaatgcagaaggacctgcagaagagcagagagctggagaaccacagcagaagactggagatgaccaacaagcagctgtggctgagaatccaggagctggagatgcaggccagagtgcacggcctgcccaccaccagccccagcggcatgaacatggccgagctggcccagcaggtggtgaagcaggagctgcccagcgaggagggccccggcgaggccctgatgctgggcgccgaggtgcccgaccccgagcccctgcccgccctgcccccccaggcccccctgcccctgcccacccagccccccagccccttccaccacctggacttcagccacagcctgagcttcggcggcagagaggacgagggcccccccggctaccccgagcccctggcccccggccacggcagccccttccccagcctgagcaagaaggacctggacctgatgctgctggacgacagcctgctgcccctggccagcgaccccctgctgagcaccatgagccccgaggccagcaaggccagcagcagaagaagcagcttcagcatggaggagggcgacgtgctgtag

SEQ ID NO: 9884 - DNA, 1473 bp, Artificial Sequence
  Description of Artificial Sequence: Synthetic coding sequence
atgaccgccagcagcggctgggagcccgcccccgccgccaccatggccagcagaatcggcctgagaatgcagctgatgagagagcaggcccagcaggaggagcagagagagagaatgcagcagcaggccgtgatgcactacatgcagcagcagcagcagcagcagcagcagcagctgggcggcccccccacccccgccatcaacacccccgtgcacttccagagccccccccccgtgcccggcgaggtgctgaaggtgcagagctacctggagaaccccaccagctaccacctgcagcagagccagcaccagaaggtgagagagtacctgagcgagacctacggcaacaagttcgccgcccacatcagccccgcccagggcagccccaagcccccccccgccgccagccccggcgtgagagccggccacgtgctgagcagcagcgccggcaacagcgcccccaacagccccatggccatgctgcacatcggcagcaaccccgagagagagctggacgacgtgatcgacaacatcatgagactggacgacgtgctgggctacatcaaccccgagatgcagatgcccaacaccctgcccctgagcagcagccacctgaacgtgtacagcagcgacccccaggtgaccgccagcctggtgggcgtgaccagcagcagctgccccgccgacctgacccagaagagagagctgaccgacgccgagagcagagccctggccaaggagagacagaagaaggacaaccacaacctgatcgagagaagaagaagattcaacatcaacgacagaatcaaggagctgggcatgctgatccccaaggccaacgacctggacgtgagatggaacaagggcaccatcctgaaggccagcgtggactacatcagaagaatgcagaaggacctgcagaagagcagagagctggagaaccacagcagaagactggagatgaccaacaagcagctgtggctgagaatccaggagctggagatgcaggccagagtgcacggcctgcccaccaccagccccagcggcatgaacatggccgagctggcccagcaggtggtgaagcaggagctgcccagcgaggagggccccggcgaggccctgatgctgggcgccgaggtgcccgaccccgagcccctgcccgccctgcccccccaggcccccctgcccctgcccacccagccccccagccccttccaccacctggacttcagccacagcctgagcttcggcggcagagaggacgagggcccccccggctaccccgagcccctggcccccggccacggcagccccttccccagcctgagcaagaaggacctggacctgatgctgctggacgacagcctgctgcccctggccagcgaccccctgctgagcaccatgagccccgaggccagcaaggccagcagcagaagaagcagcttcagcatggaggagggcgacgtgctgtag

SEQ ID NO: 9885 - DNA, 1431 bp, Artificial Sequence
  Description of Artificial Sequence: Synthetic coding sequence
atggccagcagaatcggcctgagaatgcagctgatgagagagcaggcccagcaggaggagcagagagagagaatgcagcagcaggccgtgatgcactacatgcagcagcagcagcagcagcagcagcagcagctgggcggcccccccacccccgccatcaacacccccgtgcacttccagagccccccccccgtgcccggcgaggtgctgaaggtgcagagctacctggagaaccccaccagctaccacctgcagcagagccagcaccagaaggtgagagagtacctgagcgagacctacggcaacaagttcgccgcccacatcagccccgcccagggcagccccaagcccccccccgccgccagccccggcgtgagagccggccacgtgctgagcagcagcgccggcaacagcgcccccaacagccccatggccatgctgcacatcggcagcaaccccgagagagagctggacgacgtgatcgacaacatcatgagactggacgacgtgctgggctacatcaaccccgagatgcagatgcccaacaccctgcccctgagcagcagccacctgaacgtgtacagcagcgacccccaggtgaccgccagcctggtgggcgtgaccagcagcagctgccccgccgacctgacccagaagagagagctgaccgacgccgagagcagagccctggccaaggagagacagaagaaggacaaccacaacctgatcgagagaagaagaagattcaacatcaacgacagaatcaaggagctgggcatgctgatccccaaggccaacgacctggacgtgagatggaacaagggcaccatcctgaaggccagcgtggactacatcagaagaatgcagaaggacctgcagaagagcagagagctggagaaccacagcagaagactggagatgaccaacaagcagctgtggctgagaatccaggagctggagatgcaggccagagtgcacggcctgcccaccaccagccccagcggcatgaacatggccgagctggcccagcaggtggtgaagcaggagctgcccagcgaggagggccccggcgaggccctgatgctgggcgccgaggtgcccgaccccgagcccctgcccgccctgcccccccaggcccccctgcccctgcccacccagccccccagccccttccaccacctggacttcagccacagcctgagcttcggcggcagagaggacgagggcccccccggctaccccgagcccctggcccccggccacggcagccccttccccagcctgagcaagaaggacctggacctgatgctgctggacgacagcctgctgcccctggccagcgaccccctgctgagcaccatgagccccgaggccagcaaggccagcagcagaagaagcagcttcagcatggaggagggcgacgtgctgtag

SEQ ID NO: 9886 - DNA, 807 bp, Artificial Sequence
  Description of Artificial Sequence: Synthetic coding sequence
atggccagcagaatcggcctgagaatgcagctgatgagagagcaggcccagcaggaggagcagagagagagaatgcagcagcaggccgtgatgcactacatgcagcagcagcagcagcagcagcagcagcagctgggcggcccccccacccccgccatcaacacccccgtgcacttccagagccccccccccgtgcccggcgaggtgctgaaggtgcagagctacctggagaaccccaccagctaccacctgcagcagagccagcaccagaaggtgagagagtacctgagcgagacctacggcaacaagttcgccgcccacatcagccccgcccagggcagccccaagcccccccccgccgccagccccggcgtgagagccggccacgtgctgagcagcagcgccggcaacagcgcccccaacagccccatggccatgctgcacatcggcagcaaccccgagagagagctggacgacgtgatcgacaacatcatgagactggacgacgtgctgggctacatcaaccccgagatgcagatgcccaacaccctgcccctgagcagcagccacctgaacgtgtacagcagcgacccccaggtgaccgccagcctggtgggcgtgaccagcagcagctgccccgccgacctgacccagaagagagagctgaccgacgccgagagcagagccctggccaaggagagacagaagaaggacaaccacaacctgatcgagagaagaagaagattcaacatcaacgacagaatcaaggagctgggcatgctgatccccaaggccaacgacctgtag

SEQ ID NO: 9887 - DNA, 1431 bp, Artificial Sequence; identical to SEQ ID NO: 9885
  Description of Artificial Sequence: Synthetic coding sequence

SEQ ID NO: 9888 - DNA, 735 bp, Artificial Sequence
  Description of Artificial Sequence: Synthetic coding sequence
atggccagcagaatcggcctgagaatgcagctgatgagagagcaggcccagcaggaggagcagagagagagaatgcagcagcaggccgtgatgcactacatgcagcagcagcagcagcagcagcagcagcagctgggcggcccccccacccccgccatcaacacccccgtgcacttccagagccccccccccgtgcccggcgaggtgctgaaggtgcagagctacctggagaaccccaccagctaccacctgcagcagagccagcaccagaaggtgagagagtacctgagcgagacctacggcaacaagttcgccgcccacatcagccccgcccagggcagccccaagcccccccccgccgccagccccggcgtgagagccggccacgtgctgagcagcagcgccggcaacagcgcccccaacagccccatggccatgctgcacatcggcagcaaccccgagagagagctggacgacgtgatcgacaacatcatgagactggacgacgtgctgggctacatcaaccccgagatgcagatgcccaacaccctgcccctgagcagcagccacctgaacgtgtacagcagcgacccccaggtgaccgccagcctggtgggcgtgaccagcagcagctgccccgccgacctgacccagaagagagagctgaccgacgccgagagcagagccctggccaaggagagacagaagaaggacaaccacaacctgatcgagtag

SEQ ID NO: 9889 - DNA, 807 bp, Artificial Sequence; identical to SEQ ID NO: 9886
  Description of Artificial Sequence: Synthetic coding sequence

SEQ ID NO: 9890 - DNA, 672 bp, Artificial Sequence
  Description of Artificial Sequence: Synthetic coding sequence
atggccagcagaatcggcctgagaatgcagctgatgagagagcaggcccagcaggaggagcagagagagagaatgcagcagcaggccgtgatgcactacatgcagcagcagcagcagcagcagcagcagcagctgggcggcccccccacccccgccatcaacacccccgtgcacttccagagccccccccccgtgcccggcgaggtgctgaaggtgcagagctacctggagaaccccaccagctaccacctgcagcagagccagcaccagaaggtgagagagtacctgagcgagacctacggcaacaagttcgccgcccacatcagccccgcccagggcagccccaagcccccccccgccgccagccccggcgtgagagccggccacgtgctgagcagcagcgccggcaacagcgcccccaacagccccatggccatgctgcacatcggcagcaaccccgagagagagctggacgacgtgatcgacaacatcatgagactggacgacgtgctgggctacatcaaccccgagatgcagatgcccaacaccctgcccctgagcagcagccacctgaacgtgtacagcagcgacccccaggtgaccgccagcctggtgggcgtgaccagcagcagctgccccgccgacctgacccagaagagagagctgacctag

SEQ ID NO: 9891 - DNA, 216 bp, Artificial Sequence
  Description of Artificial Sequence: Synthetic coding sequence
atggccagcagaatcggcctgagaatgcagctgatgagagagcaggcccagcaggaggagcagagagagagaatgcagcagcaggccgtgatgcactacatgcagcagcagcagcagcagcagcagcagcagctgggcggcccccccacccccgccatcaacacccccgtgcacttccagagccccccccccgtgcccggcgaggtgctgaagtag

SEQ ID NO: 9892 - DNA, 1176 bp, Artificial Sequence
  Description of Artificial Sequence: Synthetic coding sequence
atggccagcagaatcggcctgagaatgcagctgatgagagagcaggcccagcaggaggagcagagagagagaatgcagcagcaggccgtgatgcactacatgcagcagcagcagcagcagcagcagcagcagctgggcggcccccccacccccgccatcaacacccccgtgcacttccagagccccccccccgtgcccggcgaggtgctgaagctggacgacgtgatcgacaacatcatgagactggacgacgtgctgggctacatcaaccccgagatgcagatgcccaacaccctgcccctgagcagcagccacctgaacgtgtacagcagcgacccccaggtgaccgccagcctggtgggcgtgaccagcagcagctgccccgccgacctgacccagaagagagagctgaccgacgccgagagcagagccctggccaaggagagacagaagaaggacaaccacaacctgatcgagagaagaagaagattcaacatcaacgacagaatcaaggagctgggcatgctgatccccaaggccaacgacctggacgtgagatggaacaagggcaccatcctgaaggccagcgtggactacatcagaagaatgcagaaggacctgcagaagagcagagagctggagaaccacagcagaagactggagatgaccaacaagcagctgtggctgagaatccaggagctggagatgcaggccagagtgcacggcctgcccaccaccagccccagcggcatgaacatggccgagctggcccagcaggtggtgaagcaggagctgcccagcgaggagggccccggcgaggccctgatgctgggcgccgaggtgcccgaccccgagcccctgcccgccctgcccccccaggcccccctgcccctgcccacccagccccccagccccttccaccacctggacttcagccacagcctgagcttcggcggcagagaggacgagggcccccccggctaccccgagcccctggcccccggccacggcagccccttccccagcctgagcaagaaggacctggacctgatgctgctggacgacagcctgctgcccctggccagcgaccccctgctgagcaccatgagccccgaggccagcaaggccagcagcagaagaagcagcttcagcatggaggagggcgacgtgctgtag

SEQ ID NO: 9893 - DNA, 240 bp, Artificial Sequence
  Description of Artificial Sequence: Synthetic coding sequence
atggccagcagaatcggcctgagaatgcagctgatgagagagcaggcccagcaggaggagcagagagagagaatgcagcagcaggccgtgatgcactacatgcagcagcagcagcagcagcagcagcagcagctgggcggcccccccacccccgccatcaacacccccgtgcacttccagagccccccccccgtgcccggcgaggtgctgaaggtgcagagctacctggagaacccctag

SEQ ID NO: 9894 - DNA, 99 bp, Artificial Sequence
  Description of Artificial Sequence: Synthetic coding sequence
atggccagcagaatcggcctgagaatgcagctgatgagagagcaggcccagcaggaggagcagagagagagaatgcagcagcaggccgtgatgcactag

SEQ ID NO: 9895 - DNA, 39 bp, Artificial Sequence
  Description of Artificial Sequence: Synthetic coding sequence
atggccagcagaatcggcctgagaatgcagctgatgtag

SEQ ID NO: 9896 - DNA, 216 bp, Artificial Sequence; identical to SEQ ID NO: 9891
  Description of Artificial Sequence: Synthetic coding sequence

SEQ ID NO: 9897 - DNA, 39 bp, Artificial Sequence; identical to SEQ ID NO: 9895
  Description of Artificial Sequence: Synthetic coding sequence

SEQ ID NO: 9898 - DNA, 1044 bp, Artificial Sequence
  Description of Artificial Sequence: Synthetic coding sequence
atgaccctggaccaccagatcatcaaccccaccctgaagtggagccagcccgccgtgcccagcggcggccccctggtgcagcacgcccacaccaccctggacagcgacgccggcctgaccgagaaccccctgaccaagctgctggccatcggcaaggaggacgacaacgcccagtggcacatggaggacgtgatcgaggacatcatcggcatggagagcagcttcaaggaggagggcgccgacagccccctgctgatgcagagaaccctgagcggcagcatcctggacgtgtacagcggcgagcagggcatcagccccatcaacatgggcctgaccagcgccagctgccccagcagcctgcccatgaagagagagatcaccgagaccgacaccagagccctggccaaggagagacagaagaaggacaaccacaacctgatcgagagaagaagaagatacaacatcaactacagaatcaaggagctgggcaccctgatccccaagagcaacgaccccgacatgagatggaacaagggcaccatcctgaaggccagcgtggagtacatcaagtggctgcagaaggagcagcagagagccagagagctggagcacagacagaagaagctggagcaggccaacagaagactgctgctgagaatccaggagctggagatccaggccagaacccacggcctgcccaccctggccagcctgggcaccgtggacctgggcgcccacgtgaccaagcagcagagccaccccgagcagaacagcgtggactactgccagcagctgaccgtgagccagggccccagccccgagctgtgcgaccaggccatcgccttcagcgaccccctgagctacttcaccgacctgagcttcagcgccgccctgaaggaggagcagagactggacggcatgctgctggacgacaccatcagccccttcggcaccgaccccctgctgagcgccaccagccccgccgtgagcaaggagagcagcagaagaagcagcttcagcagcgacgacggcgacgagctgtag

SEQ ID NO: 9899 - DNA, 957 bp, Artificial Sequence
  Description of Artificial Sequence: Synthetic coding sequence
atgaccctggaccaccagatcatcaaccccaccctgaagtggagccagcccgccgtgcccagcggcggccccctggtgcagcacgcccacaccaccctggacagcgacgccggcctgaccgagaaccccctgaccaagctgctggccatcggcaaggaggacgacaacgcccagtggcacctgagcggcagcatcctggacgtgtacagcggcgagcagggcatcagccccatcaacatgggcctgaccagcgccagctgccccagcagcctgcccatgaagagagagatcaccgagaccgacaccagagccctggccaaggagagacagaagaaggacaaccacaacctgatcgagagaagaagaagatacaacatcaactacagaatcaaggagctgggcaccctgatccccaagagcaacgaccccgacatgagatggaacaagggcaccatcctgaaggccagcgtggagtacatcaagtggctgcagaaggagcagcagagagccagagagctggagcacagacagaagaagctggagcaggccaacagaagactgctgctgagaatccaggagctggagatccaggccagaacccacggcctgcccaccctggccagcctgggcaccgtggacctgggcgcccacgtgaccaagcagcagagccaccccgagcagaacagcgtggactactgccagcagctgaccgtgagccagggccccagccccgagctgtgcgaccaggccatcgccttcagcgaccccctgagctacttcaccgacctgagcttcagcgccgccctgaaggaggagcagagactggacggcatgctgctggacgacaccatcagccccttcggcaccgaccccctgctgagcgccaccagccccgccgtgagcaaggagagcagcagaagaagcagcttcagcagcgacgacggcgacgagctgtag

SEQ ID NO: 9900 - DNA, 594 bp, Artificial Sequence
  Description of Artificial Sequence: Synthetic coding sequence
atgaccctggaccaccagatcatcaaccccaccctgaagtggagccagcccgccgtgcccagcggcggccccctggtgcagcacgcccacaccaccctggacagcgacgccggcctgaccgagaaccccctgaccaagctgctggccatcggcaaggaggacgacaacgcccagtggcacctgagcggcagcatcctggacgtgtacagcggcgagcagggcatcagccccatcaacatgggcctgaccagcgccagctgccccagcagcctgcccatgaagagagagatcaccgagaccgacaccagagccctggccaaggagagacagaagaaggacaaccacaacctgatcgagagaagaagaagatacaacatcaactacagaatcaaggagctgggcaccctgatccccaagagcaacgaccccgacatgagatggaacaagggcaccatcctgaaggccagcgtggagtacatcaagtggctgcagaaggagcagcagagagccagagagctggagcacagacagaagaagctggagcaggccaacagaagactgctgctgagaatccaggtgttcatcagaatgtag

SEQ ID NO: 9901 - DNA, 843 bp, Artificial Sequence
  Description of Artificial Sequence: Synthetic coding sequence
atgatgaaggagaaggagaagaccatcgccatcgtgaaggtgatcgacaccagcaagctgaagctgctgagcggcagcatcctggacgtgtacagcggcgagcagggcatcagccccatcaacatgggcctgaccagcgccagctgccccagcagcctgcccatgaagagagagatcaccgagaccgacaccagagccctggccaaggagagacagaagaaggacaaccacaacctgatcgagagaagaagaagatacaacatcaactacagaatcaaggagctgggcaccctgatccccaagagcaacgaccccgacatgagatggaacaagggcaccatcctgaaggccagcgtggagtacatcaagtggctgcagaaggagcagcagagagccagagagctggagcacagacagaagaagctggagcaggccaacagaagactgctgctgagaatccaggagctggagatccaggccagaacccacggcctgcccaccctggccagcctgggcaccgtggacctgggcgcccacgtgaccaagcagcagagccaccccgagcagaacagcgtggactactgccagcagctgaccgtgagccagggccccagccccgagctgtgcgaccaggccatcgccttcagcgaccccctgagctacttcaccgacctgagcttcagcgccgccctgaaggaggagcagagactggacggcatgctgctggacgacaccatcagccccttcggcaccgaccccctgctgagcgccaccagccccgccgtgagcaaggagagcagcagaagaagcagcttcagcagcgacgacggcgacgagctgtag

SEQ ID NO: 9902 - DNA, 951 bp, Artificial Sequence
  Description of Artificial Sequence: Synthetic coding sequence
atgctgcaggccctgaccggcctgcagttccagctgaaggagcagctgggcgagaaggagagaagactgcagatcagccaggagatcagcgcccacagaaccgagttccacatgcagttcagctacaagcccgtgctgcacagactggtgcccgccagaccccagatctacagcagccagctgcccagcttcaccagagtgcccgcccacctggagagcagcgccagaccccagctgcagaaggcccagagacagaaggtgaacagcttcatgaccctggaccaccagatcatcaaccccaccctgaagtggagccagcccgccgtgcccagcggcggccccctggtgcagcacgcccacaccaccctggacagcgacgccggcctgaccgagaaccccctgaccaagctgctggccatcggcaaggaggacgacaacgcccagtggcacatggaggacgtgatcgaggacatcatcggcatggagagcagcttcaaggaggagggcgccgacagccccctgctgatgcagagaaccctgagcggcagcatcctggacgtgtacagcggcgagcagggcatcagccccatcaacatgggcctgaccagcgccagctgccccagcagcctgcccatgaagagagagatcaccgagaccgacaccagagccctggccaaggagagacagaagaaggacaaccacaacctgatcgagagaagaagaagatacaacatcaactacagaatcaaggagctgggcaccctgatccccaagagcaacgaccccgacatgagatggaacaagggcaccatcctgaaggccagcgtggagtacatcaagtggctgcagaaggagcagcagagagccagagagctggagcacagacagaagaagctggagcaggccaacagaagactgctgctgagaatccaggtgttcatcagaatgtag

SEQ ID NO: 9903 - DNA, 2169 bp, Artificial Sequence
  Description of Artificial Sequence: Synthetic coding sequence
atgcccctgcaccagctgggcgacaagcccctgaccttccccagccccaacagcgccatggagaacggcctggaccacaccccccccagcagaagagccagccccggcacccccctgagccccggcagcctgagaagcgccgcccacagccccctggacaccagcaagcagcccctgtgccagctgtgggccgagaagcacggcgccagaggcacccacgaggtgagatacgtgagcgccggccagagcgtggcctgcggctggtgggccttcgcccccccctgcctgcaggtgctgaacacccccaagggcatcctgttcttcctgtgcgccgccgccttcctgcagggcatgaccgtgaacggcttcatcaacaccgtgatcaccagcctggagagaagatacgacctgcacagctaccagagcggcctgatcgccagcagctacgacatcgccgcctgcctgtgcctgaccttcgtgagctacttcggcggcagcggccacaagcccagatggctgggctggggcgtgctgctgatgggcaccggcagcctggtgttcgccctgccccacttcaccgccggcagatacgaggtggagctggacgccggcgtgagaacctgccccgccaaccccggcgccgtgtgcgccgacagcaccagcggcctgagcagataccagctggtgttcatgctgggccagttcctgcacggcgtgggcgccacccccctgtacaccctgggcgtgacctacctggacgagaacgtgaagagcagctgcagccccgtgtacatcgccatcttctacaccgccgccatcctgggccccgccgccggctacctgatcggcggcgccctgctgaacatctacaccgagatgggcagaagaaccgagctgaccaccgagagccccctgtgggtgggcgcctggtgggtgggcttcctgggcagcggcgccgccgccttcttcaccgccgtgcccatcctgggctaccccagacagctgcccggcagccagagatacgccgtgatgagagccgccgagatgcaccagctgaaggacagcagcagaggcgaggccagcaaccccgacttcggcaagaccatcagagacctgcccctgagcatctggctgctgctgaagaaccccaccttcatcctgctgtgcctggccggcgccaccgaggccaccctgatcaccggcatgagcaccttcagccccaagttcctggagagccagttcagcctgagcgccagcgaggccgccaccctgttcggctacctggtggtgcccgccggcggcggcggcaccttcctgggcggcttcttcgtgaacaagctgagactgagaggcagcgccgtgatcaagttctgcctgttctgcaccgtggtgagcctgctgggcatcctggtgttcagcctgcactgccccagcgtgcccatggccggcgtgaccgccagctacggcggcagcctgctgcccgagggccacctgaacctgaccgccccctgcaacgccgcctgcagctgccagcccgagcactacagccccgtgtgcggcagcgacggcctgatgtacttcagcctgtgccacgccggctgccccgccgccaccgagaccaacgtggacggccagaaggtgtacagagactgcagctgcatcccccagaacctgagcagcggcttcggccacgccaccgccggcaagtgcaccagcacctgccagagaaagcccctgctgctggtgttcatcttcgtggtgatcttcttcaccttcctgagcagcatccccgccctgaccgccaccctgagatgcgtgagagacccccagagaagcttcgccctgggcatccagtggatcgtggtgagaatcctgggcggcatccccggccccatcgccttcggctgggtgatcgacaaggcctgcctgctgtggcaggaccagtgcggccagcagggcagctgcctggtgtaccagaacagcgccatgagcagatacatcctgatcatgggcctgctgtacaaggtgctgggcgtgctgttcttcgccatcgcctgcttcctgtacaagcccctgagcgagagcagcgacggcctggagacctgcctgcccagccagagcagcgcccccgacagcgccaccgacagccagctgcagagcagcgtgtag

SEQ ID NO: 9904 - DNA, 1503 bp, Artificial Sequence
  Description of Artificial Sequence: Synthetic coding sequence
atgagcggccccggccccagagagcccccccccgaggccggcgccgccggcggcgaggccgccgtggagggcgccggcggcggcgacgccgccctgggcgagcccggcctgagcttcaccaccaccgacctgagcctggtggagatgaccgaggtggagtacacccagctgcagcacatcctgtgcagccacatggaggccgccgccgacggcgagctggagaccagactgaacagcgccctgctggccgccgccggccccggcgccggcgccggcggcttcgccgccggcggccagggcggcgccgcccccgtgtaccccgtgctgtgccccagcgccctggccgccgacgccccctgcctgggccacatcgacttccaggagctgagaatgatgctgctgagcgaggccggcgccgccgagaagaccagcggcggcggcgacggcgccagagccagagccgacggcgccgccaaggagggcgccggcgccgccgccgccgccgccggccccgacggcgcccccgaggccagagccaagcccgccgtgagagtgagactggaggacagattcaacagcatccccgccgagcccccccccgcccccagaggccccgagccccccgagcccggcggcgccctgaacaacctggtgaccctgatcagacaccccagcgagctgatgaacgtgcccctgcagcagcagaacaagtgcaccgccctggtgaagaacaagaccgccgccaccaccaccgccctgcagttcacctaccccctgttcaccaccaacgcctgcagcaccagcggcaacagcaacctgagccagacccagagcagcagcaacagctgcagcgtgctggaggccgccaagcaccaggacatcggcctgcccagagccttcagcttctgctaccagcaggagatcgagagcaccaagcagaccctgggcagcagaaacaaggtgctgcccgagcaggtgtggatcaaggtgggcgaggccgccctgtgcaagcaggccctgaagagaaacagaagcagaatgagacagctggacaccaacgtggagagaagagccctgggcgagatccagaacgtgggcgagggcgccaccgccacccagggcgcctggcagagcagcgagagcagccaggccaacctgggcgagcaggcccagagcggcccccagggcggcagaagccagagaagagagagacacaacagaatggagagagacagaagaagaagaatcagaatctgctgcgacgagctgaacctgctggtgcccttctgcaacgccgagaccgacaaggccaccaccctgcagtggaccaccgccttcctgaagtacatccaggagagacacggcgacagcctgaagaaggagttcgagagcgtgttctgcggcaagaccggcagaagactgaagctgaccagacccgacagcctggtgacctgccccgcccagggcagcctgcagagcagccccagcatggagatcaagtag

SEQ ID NO: 9905 - DNA, 1008 bp, Artificial Sequence
  Description of Artificial Sequence: Synthetic coding sequence
atggccaccttcgtgagcgagctggaggccgccaagaagaacctgagcgaggccctgggcgacaacgtgaagcagtactgggccaacctgaagctgtggttcaagcagaagatcagcaaggaggagttcgacctggaggcccacagactgctgacccaggacaacgtgcacagccacaacgacttcctgctggccatcctgaccagatgccagatcctggtgagcacccccgacggcgccggcagcctgccctggcccggcggcagcgccgccaagcccggcaagcccaagggcaagaagaagctgagcagcgtgagacagaagttcgaccacagattccagccccagaaccccctgagcggcgcccagcagttcgtggccaaggacccccaggacgacgacgacctgaagctgtgcagccacaccatgatgctgcccaccagaggccagctggagggcagaatgatcgtgaccgcctacgagcacggcctggacaacgtgaccgaggaggccgtgagcgccgtggtgtacgccgtggagaaccacctgaaggacatcctgaccagcgtggtgagcagaagaaaggcctacagactgagagacggccacttcaagtacgccttcggcagcaacgtgaccccccagccctacctgaagaacagcgtggtggcctacaacaacctgatcgagagcccccccgccttcaccgccccctgcgccggccagaaccccgccagccaccccccccccgacgacgccgagcagcaggccgccctgctgctggcctgcagcggcgacaccctgcccgccagcctgccccccgtgaacatgtacgacctgttcgaggccctgcaggtgcacagagaggtgatccccacccacaccgtgtacgccctgaacatcgagagaatcatcaccaagctgtggcaccccaaccacgaggagctgcagcaggacaaggtgcacagacagagactggccgccaaggagggcctgctgctgtgctag

SEQ ID NO: 9906 - DNA, 2286 bp, Artificial Sequence
  Description of Artificial Sequence: Synthetic coding sequence
atgagcagaaagggccccagagccgaggtgtgcgccgactgcagcgcccccgaccccggctgggccagcatcagcagaggcgtgctggtgtgcgacgagtgctgcagcgtgcacagaagcctgggcagacacatcagcatcgtgaagcacctgagacacagcgcctggccccccaccctgctgcagatggtgcacaccctggccagcaacggcgccaacagcatctgggagcacagcctgctggaccccgcccaggtgcagagcggcagaagaaaggccaacccccaggacaaggtgcaccccatcaagagcgagttcatcagagccaagtaccagatgctggccttcgtgcacaagctgccctgcagagacgacgacggcgtgaccgccaaggacctgagcaagcagctgcacagcagcgtgagaaccggcaacctggagacctgcctgagactgctgagcctgggcgcccaggccaacttcttccaccccgagaagggcaccacccccctgcacgtggccgccaaggccggccagaccctgcaggccgagctgctggtggtgtacggcgccgaccccggcagccccgacgtgaacggcagaacccccatcgactacgccagacaggccggccaccacgagctggccgagagactggtggagtgccagtacgagctgaccgacagactggccttctacctgtgcggcagaaagcccgaccacaagaacggccactacatcatcccccagatggccgacagcctggacctgagcgagctggccaaggccgccaagaagaagctgcaggccctgagcaacagactgttcgaggagctggccatggacgtgtacgacgaggtggacagaagagagaacgacgccgtgtggctggccacccagaaccacagcaccctggtgaccgagagaagcgccgtgcccttcctgcccgtgaaccccgagtacagcgccaccagaaaccagggcagacagaagctggccagattcaacgccagagagttcgccaccctgatcatcgacatcctgagcgaggccaagagaagacagcagggcaagagcctgagcagccccaccgacaacctggagctgagcctgagaagccagagcgacctggacgaccagcacgactacgacagcgtggccagcgacgaggacaccgaccaggagcccctgagaagcaccggcgccaccagaagcaacagagccagaagcatggacagcagcgacctgagcgacggcgccgtgaccctgcaggagtacctggagctgaagaaggccctggccaccagcgaggccaaggtgcagcagctgatgaaggtgaacagcagcctgagcgacgagctgagaagactgcagagagagatccacaagctgcaggccgagaacctgcagctgagacagccccccggccccgtgcccaccccccccctgcccagcgagagagccgagcacacccccatggcccccggcggcagcacccacagaagagacagacaggccttcagcatgtacgagcccggcagcgccctgaagcccttcggcggcccccccggcgacgagctgaccaccagactgcagcccttccacagcaccgagctggaggacgacgccatctacagcgtgcacgtgcccgccggcctgtacagaatcagaaagggcgtgagcgccagcgccgtgcccttcacccccagcagccccctgctgagctgcagccaggagggcagcagacacaccagcaagctgagcagacacggcagcggcgccgacagcgactacgagaacacccagagcggcgaccccctgctgggcctggagggcaagagattcctggagctgggcaaggaggaggacttccaccccgagctggagagcctggacggcgacctggaccccggcctgcccagcaccgaggacgtgatcctgaagaccgagcaggtgaccaagaacatccaggagctgctgagagccgcccaggagttcaagcacgacagcttcgtgccctgcagcgagaagatccacctggccgtgaccgagatggccagcctgttccccaagagacccgccctggagcccgtgagaagcagcctgagactgctgaacgccagcgcctacagactgcagagcgagtgcagaaagaccgtgccccccgagcccggcgcccccgtggacttccagctgctgacccagcaggtgatccagtgcgcctacgacatcgccaaggccgccaagcagctggtgaccatcaccaccagagagaagaagcagtag

SEQ ID NO: 9907 - DNA, 1332 bp, Artificial Sequence
  Description of Artificial Sequence: Synthetic coding sequence
atggacagactgggccccttcagcaacgaccccagcgacaagcccccctgcagaggctgcagcagctacctgatggagccctacatcaagtgcgccgagtgcggccccccccccttcttcctgtgcctgcagtgcttcaccagaggcttcgagtacaagaagcaccagagcgaccacacctacgagatcatgaccagcgacttccccgtgctggaccccagctggaccgcccaggaggagatggccctgctggaggccgtgatggactgcggcttcggcaactggcaggacgtggccaaccagatgtgcaccaagaccaaggaggagtgcgagaagcactacatgaagcacttcatcaacaaccccctgttcgccagcaccctgctgaacctgaagcaggccgaggaggccaagaccgccgacaccgccatccccttccacagcaccgacgacccccccagacccaccttcgacagcctgctgagcagagacatggccggctacatgcccgccagagccgacttcatcgaggagttcgacaactacgccgagtgggacctgagagacatcgacttcgtggaggacgacagcgacatcctgcacgccctgaagatggccgtggtggacatctaccacagcagactgaaggagagacagagaagaaagaagatcatcagagaccacggcctgatcaacctgagaaagttccagctgatggagagaagataccccaaggaggtgcaggacctgtacgagaccatgagaagattcgccagaatcgtgggccccgtggagcacgacaagttcatcgagagccacgccctggagttcgagctgagaagagagatcaagagactgcaggagtacagaaccgccggcatcaccaacttctgcagcgccagaacctacgaccacctgaagaagaccagagaggaggagagactgaagagaaccatgctgagcgaggtgctgcagtacatccaggacagcagcgcctgccagcagtggctgagaagacaggccgacatcgacagcggcctgagccccagcatccccatggccagcaacagcggcagaagaagcgccccccccctgaacctgaccggcctgcccggcaccgagaagctgaacgagaaggagaaggagctgtgccagatggtgagactggtgcccggcgcctacctggagtacaagagcgccctgctgaacgagtgcaacaagcagggcggcctgagactggcccaggccagagccctgatcaagatcgacgtgaacaagaccagaaagatctacgacttcctgatcagagagggctacatcaccaagggctag

SEQ ID NO: 9908 - DNA, 918 bp, Artificial Sequence
  Description of Artificial Sequence: Synthetic coding sequence
atggacagactgggccccttcagcaacgaccccagcgacaagcccccctgcagaggctgcagcagctacctgatggagccctacatcaagtgcgccgagtgcggccccccccccttcttcctgtgcctgcagtgcttcaccagaggcttcgagtacaagaagcaccagagcgaccacacctacgagatcatgaccagcgacttccccgtgctggaccccagctggaccgcccaggaggagatggccctgctggaggccgtgatggactgcggcttcggcaactggcaggacgtggccaaccagatgtgcaccaagaccaaggaggagtgcgagaagcactacatgaagcacttcatcaacaaccccctgttcgccagcaccctgctgaacctgaagcaggccgaggaggccaagaccgccgacaccgccatccccttccacagcaccgacgacccccccagacccaccttcgacagcctgctgagcagagacatggccggctacatgcccgccagagccgacttcatcgaggagttcgacaactacgccgagtgggacctgagagacatcgacttcgtggaggacgacagcgacatcctgcacgccctgaagatggccgtggtggacatctaccacagcagactgaaggagagacagagaagaaagaagatcatcagagaccacggcctgatcaacctgagaaagttccagctgatggagagaagataccccaaggaggtgcaggacctgtacgagaccatgagaagattcgccagaatcgtgggccccgtggagcacgacaagttcatcgagagccacgcctgcagatggttcctgagcctggagcagtacctgtgcgtgtacatctacatcaacagaagagacaacggcgtgttctacgtgaagttctacaagtag

SEQ ID NO: 9909 - DNA, 1029 bp, Artificial Sequence
  Description of Artificial Sequence: Synthetic coding sequence
atgtgcaccaagaccaaggaggagtgcgagaagcactacatgaagcacttcatcaacaaccccctgttcgccagcaccctgctgaacctgaagcaggccgaggaggccaagaccgccgacaccgccatccccttccacagcaccgacgacccccccagacccaccttcgacagcctgctgagcagagacatggccggctacatgcccgccagagccgacttcatcgaggagttcgacaactacgccgagtgggacctgagagacatcgacttcgtggaggacgacagcgacatcctgcacgccctgaagatggccgtggtggacatctaccacagcagactgaaggagagacagagaagaaagaagatcatcagagaccacggcctgatcaacctgagaaagttccagctgatggagagaagataccccaaggaggtgcaggacctgtacgagaccatgagaagattcgccagaatcgtgggccccgtggagcacgacaagttcatcgagagccacgccctggagttcgagctgagaagagagatcaagagactgcaggagtacagaaccgccggcatcaccaacttctgcagcgccagaacctacgaccacctgaagaagaccagagaggaggagagactgaagagaaccatgctgagcgaggtgctgcagtacatccaggacagcagcgcctgccagcagtggctgagaagacaggccgacatcgacagcggcctgagccccagcatccccatggccagcaacagcggcagaagaagcgccccccccctgaacctgaccggcctgcccggcaccgagaagctgaacgagaaggagaaggagctgtgccagatggtgagactggtgcccggcgcctacctggagtacaagagcgccctgctgaacgagtgcaacaagcagggcggcctgagactggcccaggccagagccctgatcaagatcgacgtgaacaagaccagaaagatctacgacttcctgatcagagagggctacatcaccaagggctag

SEQ ID NO: 9910 - DNA, 1332 bp, Artificial Sequence; identical to SEQ ID NO: 9907
  Description of Artificial Sequence: Synthetic coding sequence

SEQ ID NO: 9911 - DNA, 3390 bp, Artificial Sequence
  Description of Artificial Sequence: Synthetic coding sequence
atgggcgaccagcagctgtacaagaccaaccacgtggcccacggcagcgagaacctgttctaccagcagccccccctgggcgtgcacagcggcctgaaccacaactacggcaacgccgtgaccggcggcggcatggacgccccccaggccagccccatcagcccccacttcccccaggacaccagagacggcctgggcctgcccgtgggcagcaagaacctgggccagatggacaccagcagacagggcggctggggcagccacgccggccccggcaaccacgtgcagctgagaggcaacctggccaacagcaacatgatgtggggcgcccccgcccaggccgagcccaccgacggctaccagtacacctacagccaggccagcgagatcagaacccagaagctgaccagcggcgtgctgcacaagctggacagcttcacccaggtgttcgccaaccagaacctgagaatccaggtgaacaacatggcccaggtgctgcacacccagagcgccgtgatggacggcgcccccgacagcgccctgagacagctgctgagccagaagcccatggagccccccgcccccgccatccccagcagataccagcaggtgccccagcagccccaccccggcttcaccggcggcctgagcaagcccgccctgcaggtgggccagcaccccacccagggccacctgtactacgactaccagcagcccctggcccaggtgcccgtgcagggcggccagcccctgcaggccccccagatgctgagccagcacatgcagcagatgcagcagcaccagtactaccccccccagcagcagcagcaggccggccagcagagaatcagcatgcaggagatccagacccagccccagcagatcagacccagccagccccagccccccccccagcagcagcagccccagcagctgcagctgcagcagagacagggcagcatgcagatcccccagtactaccagccccagcccatgatgcagcacctgcaggagcagcagcagcagcagatgcacctgcagccccccagctaccacagagacccccaccagtacacccccgagcaggcccacaccgtgcagctgatccccctgggcagcatgagccagtactactaccaggagccccagcagccctacagccaccccctgtaccagcagagccacctgagccagcaccagcagagagaggacagccagctgaagacctacagcagcgacagacaggcccaggccatgctgagcagccacggcgacctgggcccccccgacaccggcatgggcgaccccgccagcagcgacctgaccagagtgagcagcaccctgccccacagacccctgctgagccccagcggcatccacctgaacaacatgggcccccagcaccagcagctgagccccagcgccatgtggccccagatgcacctgcccgacggcagagcccagcccggcagccccgagagcagcggccagcccaagggcgccttcggcgagcagttcgacgccaagaacaagctgacctgcagcatctgcctgaaggagttcaagaacctgcccgccctgaacggccacatgagaagccacggcggcatgagagccagccccaacctgaagcaggagatccccagaaagcaccagcccagcgtgcccaaggccgaggagcccctgaagaccgtgcaggagaagaagaagttcagacacagacccgagcccctgttcatcccccccccccccagctacaaccccaaccccgccgccagctacagcggcgccaccctgtaccagagccagctgagaagccccagagtgctgggcgaccacctgctgctggaccccacccacgagctgcccccctacacccccccccccatgctgagccccgtgagacagggcagcggcctgttcagcaacgtgctgatcagcggccacggccccggcgcccacccccagctgcccctgacccccctgacccccacccccagagtgctgctgtgcagaagcaacagcatcgacggcagcaacgtgaccgtgacccccggccccggcgagcagaccgtggacgtggagcccagaatcaacatcggcctgagattccaggccgagatccccgagctgcaggacatcagcgccctggcccaggacacccacaaggccaccctggtgtggaagccctggcccgagctggagaaccacgacctgcagcagagagtggagaacctgctgaacctgtgctgcagcagcgccctgcccggcggcggcaccaacagcgagttcgccctgcacagcctgttcgaggccaagggcgacgtgatggtggccctggagatgctgctgctgagaaagcccgtgagactgaagtgccaccccctggccaactaccactacgccggcagcgacaagtggaccagcctggagagaaagctgttcaacaaggccctggccacctacagcaaggacttcatcttcgtgcagaagatggtgaagagcaagaccgtggcccagtgcgtggagtactactacacctggaagaagatcatgagactgggcagaaagcacagaaccagactggccgagatcatcgacgactgcgtgaccagcgaggaggaggaggagctggaggaggaggaggaggaggaccccgaggaggacagaaagagcaccaaggaggaggagagcgaggtgcccaagagccccgagcccccccccgtgcccgtgctggcccccaccgagggcccccccctgcaggccctgggccagcccagcggcagcttcatctgcgagatgcccaactgcggcgccgactgcagatgccacgtgacccccttcctgccccaggtgttcagcagcagacaggccctgaacggccacgccagaatccacggcggcaccaaccaggtgaccaaggccagaggcgccatccccagcggcaagcagaagcccggcggcacccagagcggctactgcagcgtgaagagcagccccagccacagcaccaccagcggcgagaccgaccccaccaccatcttcccctgcaaggagtgcggcaaggtgttcttcaagatcaagagcagaaacgcccacatgaagacccacagacagcaggaggagcagcagagacagaaggcccagaaggccgccttcgccgccgagatggccgccaccatcgagagaaccaccggccccgtgggcgcccccggcctgctgcccctggaccagctgagcctgatcaagcccatcaaggacgtggacatcctggacgacgacgtggtgcagcagctgggcggcgtgatggaggaggccgaggtggtggacaccgacctgctgctggacgaccaggacagcgtgctgctgcagggcgacgccgagctgtag

SEQ ID NO: 9912 - DNA, 3603 bp, Artificial Sequence
  Description of Artificial Sequence: Synthetic coding sequence
atgggcgaccagcagctgtacaagaccaaccacgtggcccacggcagcgagaacctgttctaccagcagccccccctgggcgtgcacagcggcctgaaccacaactacggcaacgccgtgaccggcggcggcatggacgccccccaggccagccccatcagcccccacttcccccaggacaccagagacggcctgggcctgcccgtgggcagcaagaacctgggccagatggacaccagcagacagggcggctggggcagccacgccggccccggcaaccacgtgcagctgagaggcaacctggccaacagcaacatgatgtggggcgcccccgcccaggccgagcccaccgacggctaccagtacacctacagccaggccagcgagatcagaacccagaagctgaccagcggcgtgctgcacaagctggacagcttcacccaggtgttcgccaaccagaacctgagaatccaggtgaacaacatggcccaggtgctgcacacccagagcgccgtgatggacggcgcccccgacagcgccctgagacagctgctgagccagaagcccatggagccccccgcccccgccatccccagcagataccagcaggtgccccagcagccccaccccggcttcaccggcggcctgagcaagcccgccctgcaggtgggccagcaccccacccagggccacctgtactacgactaccagcagcccctggcccaggtgcccgtgcagggcggccagcccctgcaggccccccagatgctgagccagcacatgcagcagatgcagcagcaccagtactaccccccccagcagcagcagcaggccggccagcagagaatcagcatgcaggagatccagacccagccccagcagatcagacccagccagccccagccccccccccagcagcagcagccccagcagctgcagctgcagcagagacagggcagcatgcagatcccccagtactaccagccccagcccatgatgcagcacctgcaggagcagcagcagcagcagatgcacctgcagccccccagctaccacagagacccccaccagtacacccccgagcaggcccacaccgtgcagctgatccccctgggcagcatgagccagtactactaccaggagccccagcagccctacagccaccccctgtaccagcagagccacctgagccagcaccagcagagagaggacagccagctgaagacctacagcagcgacagacaggcccaggccatgctgagcagccacggcgacctgggcccccccgacaccggcatgggcgaccccgccagcagcgacctgaccagagtgagcagcaccctgccccacagacccctgctgagccccagcggcatccacctgaacaacatgggcccccagcaccagcagctgagccccagcgccatgtggccccagatgcacctgcccgacggcagagcccagcccggcagccccgagagcagcggccagcccaagggcgccttcggcgagcagttcgacgccaagaacaagctgacctgcagcatctgcctgaaggagttcaagaacctgcccgccctgaacggccacatgagaagccacggcggcatgagagccagccccaacctgaagcaggaggagggcgagaaggtgctgcccccccagccccagccccccctgcccccccccccccccccccccccccccccccagctgccccccgaggccgagagcctgacccccatggtgatgcccgtgagcgtgcccgtgaagctgctgccccccaagcccagcagccagggcttcaccaacagcaccgtggccgcccccagcgccagagacaagcccgccagcagcatgagcgacgacgagatgcccgtgctggagatccccagaaagcaccagcccagcgtgcccaaggccgaggagcccctgaagaccgtgcaggagaagaagaagttcagacacagacccgagcccctgttcatcccccccccccccagctacaaccccaaccccgccgccagctacagcggcgccaccctgtaccagagccagctgagaagccccagagtgctgggcgaccacctgctgctggaccccacccacgagctgcccccctacacccccccccccatgctgagccccgtgagacagggcagcggcctgttcagcaacgtgctgatcagcggccacggccccggcgcccacccccagctgcccctgacccccctgacccccacccccagagtgctgctgtgcagaagcaacagcatcgacggcagcaacgtgaccgtgacccccggccccggcgagcagaccgtggacgtggagcccagaatcaacatcggcctgagattccaggccgagatccccgagctgcaggacatcagcgccctggcccaggacacccacaaggccaccctggtgtggaagccctggcccgagctggagaaccacgacctgcagcagagagtggagaacctgctgaacctgtgctgcagcagcgccctgcccggcggcggcaccaacagcgagttcgccctgcacagcctgttcgaggccaagggcgacgtgatggtggccctggagatgctgctgctgagaaagcccgtgagactgaagtgccaccccctggccaactaccactacgccggcagcgacaagtggaccagcctggagagaaagctgttcaacaaggccctggccacctacagcaaggacttcatcttcgtgcagaagatggtgaagagcaagaccgtggcccagtgcgtggagtactactacacctggaagaagatcatgagactgggcagaaagcacagaaccagactggccgagatcatcgacgactgcgtgaccagcgaggaggaggaggagctggaggaggaggaggaggaggaccccgaggaggacagaaagagcaccaaggaggaggagagcgaggtgcccaagagccccgagcccccccccgtgcccgtgctggcccccaccgagggcccccccctgcaggccctgggccagcccagcggcagcttcatctgcgagatgcccaactgcggcgccgtgttcagcagcagacaggccctgaacggccacgccagaatccacggcggcaccaaccaggtgaccaaggccagaggcgccatccccagcggcaagcagaagcccggcggcacccagagcggctactgcagcgtgaagagcagccccagccacagcaccaccagcggcgagaccgaccccaccaccatcttcccctgcaaggagtgcggcaaggtgttcttcaagatcaagagcagaaacgcccacatgaagacccacagacagcaggaggagcagcagagacagaaggcccagaaggccgccttcgccgccgagatggccgccaccatcgagagaaccaccggccccgtgggcgcccccggcctgctgcccctggaccagctgagcctgatcaagcccatcaaggacgtggacatcctggacgacgacgtggtgcagcagctgggcggcgtgatggaggaggccgaggtggtggacaccgacctgctgctggacgaccaggacagcgtgctgctgcagggcgacgccgagctgtag

SEQ ID NO: 9913 - DNA, 3663 bp, Artificial Sequence
  Description of Artificial Sequence: Synthetic coding sequence
atgggcgaccagcagctgtacaagaccaaccacgtggcccacggcagcgagaacctgttctaccagcagccccccctgggcgtgcacagcggcctgaaccacaactacggcaacgccgtgaccggcggcggcatggacgccccccaggccagccccatcagcccccacttcccccaggacaccagagacggcctgggcctgcccgtgggcagcaagaacctgggccagatggacaccagcagacagggcggctggggcagccacgccggccccggcaaccacgtgcagctgagaggcaacctggccaacagcaacatgatgtggggcgcccccgcccaggccgagcccaccgacggctaccagtacacctacagccaggccagcgagatcagaacccagaagctgaccagcggcgtgctgcacaagctggacagcttcacccaggtgttcgccaaccagaacctgagaatccaggtgaacaacatggcccaggtgctgcacacccagagcgccgtgatggacggcgcccccgacagcgccctgagacagctgctgagccagaagcccatggagccccccgcccccgccatccccagcagataccagcaggtgccccagcagccccaccccggcttcaccggcggcctgagcaagcccgccctgcaggtgggccagcaccccacccagggccacctgtactacgactaccagcagcccctggcccaggtgcccgtgcagggcggccagcccctgcaggccccccagatgctgagccagcacatgcagcagatgcagcagcaccagtactaccccccccagcagcagcagcaggccggccagcagagaatcagcatgcaggagatccagacccagccccagcagatcagacccagccagccccagccccccccccagcagcagcagccccagcagctgcagctgcagcagagacagggcagcatgcagatcccccagtactaccagccccagcccatgatgcagcacctgcaggagcagcagcagcagcagatgcacctgcagccccccagctaccacagagacccccaccagtacacccccgagcaggcccacaccgtgcagctgatccccctgggcagcatgagccagtactactaccaggagccccagcagccctacagccaccccctgtaccagcagagccacctgagccagcaccagcagagagaggacagccagctgaagacctacagcagcgacagacaggcccaggccatgctgagcagccacggcgacctgggcccccccgacaccggcatgggcgaccccgccagcagcgacctgaccagagtgagcagcaccctgccccacagacccctgctgagccccagcggcatccacctgaacaacatgggcccccagcaccagcagctgagccccagcgccatgtggccccagatgcacctgcccgacggcagagcccagcccggcagccccgagagcagcggccagcccaagggcgccttcggcgagcagttcgacgccaagaacaagctgacctgcagcatctgcctgaaggagttcaagaacctgcccgccctgaacggccacatgagaagccacggcggcatgagagccagccccaacctgaagcaggaggagggcgagaaggtgctgcccccccagccccagccccccctgcccccccccccccccccccccccccccccccagctgccccccgaggccgagagcctgacccccatggtgatgcccgtgagcgtgcccgtgaagctgctgccccccaagcccagcagccagggcttcaccaacagcaccgtggccgcccccagcgccagagacaagcccgccagcagcatgagcgacgacgagatgcccgtgctggtgagaatgaccctgagccccccccacagcccccagggcgccgcccccagaacccccgccgagatccccagaaagcaccagcccagcgtgcccaaggccgaggagcccctgaagaccgtgcaggagaagaagaagttcagacacagacccgagcccctgttcatcccccccccccccagctacaaccccaaccccgccgccagctacagcggcgccaccctgtaccagagccagctgagaagccccagagtgctgggcgaccacctgctgctggaccccacccacgagctgcccccctacacccccccccccatgctgagccccgtgagacagggcagcggcctgttcagcaacgtgctgatcagcggccacggccccggcgcccacccccagctgcccctgacccccctgacccccacccccagagtgctgctgtgcagaagcaacagcatcgacggcagcaacgtgaccgtgacccccggccccggcgagcagaccgtggacgtggagcccagaatcaacatcggcctgagattccaggccgagatccccgagctgcaggacatcagcgccctggcccaggacacccacaaggccaccctggtgtggaagccctggcccgagctggagaaccacgacctgcagcagagagtggagaacctgctgaacctgtgctgcagcagcgccctgcccggcggcggcaccaacagcgagttcgccctgcacagcctgttcgaggccaagggcgacgtgatggtggccctggagatgctgctgctgagaaagcccgtgagactgaagtgccaccccctggccaactaccactacgccggcagcgacaagtggaccagcctggagagaaagctgttcaacaaggccctggccacctacagcaaggacttcatcttcgtgcagaagatggtgaagagcaagaccgtggcccagtgcgtggagtactactacacctggaagaagatcatgagactgggcagaaagcacagaaccagactggccgagatcatcgacgactgcgtgaccagcgaggaggaggaggagctggaggaggaggaggaggaggaccccgaggaggacagaaagagcaccaaggaggaggagagcgaggtgcccaagagccccgagcccccccccgtgcccgtgctggcccccaccgagggcccccccctgcaggccctgggccagcccagcggcagcttcatctgcgagatgcccaactgcggcgccgtgttcagcagcagacaggccctgaacggccacgccagaatccacggcggcaccaaccaggtgaccaaggccagaggcgccatccccagcggcaagcagaagcccggcggcacccagagcggctactgcagcgtgaagagcagccccagccacagcaccaccagcggcgagaccgaccccaccaccatcttcccctgcaaggagtgcggcaaggtgttcttcaagatcaagagcagaaacgcccacatgaagacccacagacagcaggaggagcagcagagacagaaggcccagaaggccgccttcgccgccgagatggccgccaccatcgagagaaccaccggccccgtgggcgcccccggcctgctgcccctggaccagctgagcctgatcaagcccatcaaggacgtggacatcctggacgacgacgtggtgcagcagctgggcggcgtgatggaggaggccgaggtggtggacaccgacctgctgctggacgaccaggacagcgtgctgctgcagggcgacgccgagctgtag

SEQ ID NO: 9914 - DNA, 2247 bp, Artificial Sequence
  Description of Artificial Sequence: Synthetic coding sequence
atgatcagagacctgagcaagatgtacccccagaccagacaccccgccccccaccagcccgcccagcccttcaagttcaccatcagcgagagctgcgacagaatcaaggaggagttccagttcctgcaggcccagtaccacagcctgaagctggagtgcgagaagctggccagcgagaagaccgagatgcagagacactacgtgatgtactacgagatgagctacggcctgaacatcgagatgcacaagcaggccgagatcgtgaagagactgaacgccatctgcgcccaggtgatccccttcctgagccaggagcagcagctgcaggcccagcacctgagccacggccacggcctgcccgtgcccctgaccccccaccccagcggcctgcagccccccgccatcccccccatcggcagcagcgccggcctgctggccctgagcagcgccctgggcggccagagccacctgcccatcaaggacgagaagaagcaccacgacaacgaccaccagagagacagagacagcatcaagagcagcagcgtgagccccagcgccagcttcagaggcgccgagaagcacagaaacagcgccgactacagcagcgagagcaagaagcagaagaccgaggagaaggagatcgccgccagatacgacagcgacggcgagaagagcgacgacaacctggtggtggacgtgagcaacgaggaccccagcagccccagaggcagccccgcccacagccccagagagaacggcctggacaagaccagactgctgaagaaggacgcccccatcagccccgccagcatcgccagcagcagcagcacccccagcagcaagagcaaggagctgagcctgaacgagaagagcaccacccccgtgagcaagagcaacacccccacccccagaaccgacgcccccacccccggcagcaacagcacccccggcctgagacccgtgcccggcaagccccccggcgtggaccccctggccagcagcctgagaacccccatggccgtgccctgcccctaccccacccccttcggcatcgtgccccacgccggcatgaacggcgagctgaccagccccggcgccgcctacgccggcctgcacaacatcagcccccagatgagcgccgccgccgccgccgccgccgccgccgccgcctacggcagaagccccgtggtgggcttcgacccccaccaccacatgagagtgcccgccatcccccccaacctgaccggcatccccggcggcaagcccgcctacagcttccacgtgagcgccgacggccagatgcagcccgtgcccttcccccccgacgccctgatcggccccggcatccccagacacgccagacagatcaacaccctgaaccacggcgaggtggtgtgcgccgtgaccatcagcaaccccaccagacacgtgtacaccggcggcaagggctgcgtgaaggtgtgggacatcagccaccccggcaacaagagccccgtgagccagctggactgcctgaacagagacaactacatcagaagctgcagactgctgcccgacggcagaaccctgatcgtgggcggcgaggccagcaccctgagcatctgggacctggccgcccccacccccagaatcaaggccgagctgaccagcagcgcccccgcctgctacgccctggccatcagccccgacagcaaggtgtgcttcagctgctgcagcgacggcaacatcgccgtgtgggacctgcacaaccagaccctggtgagacagttccagggccacaccgacggcgccagctgcatcgacatcagcaacgacggcaccaagctgtggaccggcggcctggacaacaccgtgagaagctgggacctgagagagggcagacagctgcagcagcacgacttcaccagccagatcttcagcctgggctactgccccaccggcgagtggctggccgtgggcatggagaacagcaacgtggaggtgctgcacgtgaccaagcccgacaagtaccagctgcacctgcacgagagctgcgtgctgagcctgaagttcgcccactgcggcaagtggttcgtgagcaccggcaaggacaacctgctgaacgcctggagaaccccctacggcgccagcatcttccagagcaaggagagcagcagcgtgctgagctgcgacatcagcgtggacgacaagtacatcgtgaccggcagcggcgacaagaaggccaccgtgtacgaggtgatctactag

SEQ ID NO: 9915 - DNA, 2418 bp, Artificial Sequence
  Description of Artificial Sequence: Synthetic coding sequence
atgatcagagacctgagcaagatgtacccccagaccagacaccccgccccccaccagcccgcccagcccttcaagttcaccatcagcgagagctgcgacagaatcaaggaggagttccagttcctgcaggcccagtaccacagcctgaagctggagtgcgagaagctggccagcgagaagaccgagatgcagagacactacgtgatgtactacgagatgagctacggcctgaacatcgagatgcacaagcaggccgagatcgtgaagagactgaacgccatctgcgcccaggtgatccccttcctgagccaggagcaccagcagcaggtggtgcaggccgtggagagagccaagcaggtgaccatggccgagctgaacgccatcatcggccagcagctgcaggcccagcacctgagccacggccacggcctgcccgtgcccctgaccccccaccccagcggcctgcagccccccgccatcccccccatcggcagcagcgccggcctgctggccctgagcagcgccctgggcggccagagccacctgcccatcaaggacgagaagaagcaccacgacaacgaccaccagagagagagagacaagctgaaccacaagagcctgagccccagcgccagcttcagaggcgccgagaagcacagaaacagcgccgactacagcagcgagagcaagaagcagaagaccgaggagaaggagatcgccgccagatacgacagcgacggcgagaagagcgacgacaacctggtggtggacgtgagcaacgaggaccccagcagccccagaggcagccccgcccacagccccagagagaacggcctggacaagaccagactgctgaagaaggacgcccccatcagccccgccagcatcgccagcagcagcagcacccccagcagcaagagcaaggagctgagcctgaagagagacatgggcaagctgagcgagaccagactgagcgaggacgagcagtgcaccctgggcctgcagagatggttctgcagactgtggttcatgaacgagaagagcaccacccccgtgagcaagagcaacacccccacccccagaaccgacgcccccacccccggcagcaacagcacccccggcctgagacccgtgcccggcaagccccccggcgtggaccccctggccagcagcctgagaacccccatggccgtgccctgcccctaccccacccccttcggcatcgtgccccacgccggcatgaacggcgagctgaccagccccggcgccgcctacgccggcctgcacaacatcagcccccagatgagcgccgccgccgccgccgccgccgccgccgccgcctacggcagaagccccgtggtgggcttcgacccccaccaccacatgagagtgcccgccatcccccccaacctgaccggcatccccggcggcaagcccgcctacagcttccacgtgagcgccgacggccagatgcagcccgtgcccttcccccccgacgccctgatcggccccggcatccccagacacgccagacagatcaacaccctgaaccacggcgaggtggtgtgcgccgtgaccatcagcaaccccaccagacacgtgtacaccggcggcaagggctgcgtgaaggtgtgggacatcagccaccccggcaacaagagccccgtgagccagctggactgcctgaacagagacaactacatcagaagctgcagactgctgcccgacggcagaaccctgatcgtgggcggcgaggccagcaccctgagcatctgggacctggccgcccccacccccagaatcaaggccgagctgaccagcagcgcccccgcctgctacgccctggccatcagccccgacagcaaggtgtgcttcagctgctgcagcgacggcaacatcgccgtgtgggacctgcacaaccagaccctggtgagacagttccagggccacaccgacggcgccagctgcatcgacatcagcaacgacggcaccaagctgtggaccggcggcctggacaacaccgtgagaagctgggacctgagagagggcagacagctgcagcagcacgacttcaccagccagatcttcagcctgggctactgccccaccggcgagtggctggccgtgggcatggagaacagcaacgtggaggtgctgcacgtgaccaagcccgacaagtaccagctgcacctgcacgagagctgcgtgctgagcctgaagttcgcccactgcggcaagtggttcgtgagcaccggcaaggacaacctgctgaacgcctggagaaccccctacggcgccagcatcttccagagcaaggagagcagcagcgtgctgagctgcgacatcagcgtggacgacaagtacatcgtgaccggcagcggcgacaagaaggccaccgtgtacgaggtgatctactag

SEQ ID NO: 9916 - DNA, 1233 bp, Artificial Sequence
  Description of Artificial Sequence: Synthetic coding sequence
atggccgtgccctgcccctaccccacccccttcggcatcgtgccccacgccggcatgaacggcgagctgaccagccccggcgccgcctacgccggcctgcacaacatcagcccccagatgagcgccgccgccgccgccgccgccgccgccgccgcctacggcagaagccccgtggtgggcttcgacccccaccaccacatgagagtgcccgccatcccccccaacctgaccggcatccccggcggcaagcccgcctacagcttccacgtgagcgccgacggccagatgcagcccgtgcccttcccccccgacgccctgatcggccccggcatccccagacacgccagacagatcaacaccctgaaccacggcgaggtggtgtgcgccgtgaccatcagcaaccccaccagacacgtgtacaccggcggcaagggctgcgtgaaggtgtgggacatcagccaccccggcaacaagagccccgtgagccagctggactgcctgaacagagacaactacatcagaagctgcagactgctgcccgacggcagaaccctgatcgtgggcggcgaggccagcaccctgagcatctgggacctggccgcccccacccccagaatcaaggccgagctgaccagcagcgcccccgcctgctacgccctggccatcagccccgacagcaaggtgtgcttcagctgctgcagcgacggcaacatcgccgtgtgggacctgcacaaccagaccctggtgagacagttccagggccacaccgacggcgccagctgcatcgacatcagcaacgacggcaccaagctgtggaccggcggcctggacaacaccgtgagaagctgggacctgagagagggcagacagctgcagcagcacgacttcaccagccagatcttcagcctgggctactgccccaccggcgagtggctggccgtgggcatggagaacagcaacgtggaggtgctgcacgtgaccaagcccgacaagtaccagctgcacctgcacgagagctgcgtgctgagcctgaagttcgcccactgcggcaagtggttcgtgagcaccggcaaggacaacctgctgaacgcctggagaaccccctacggcgccagcatcttccagagcaaggagagcagcagcgtgctgagctgcgacatcagcgtggacgacaagtacatcgtgaccggcagcggcgacaagaaggccaccgtgtacgaggtgatctactag

SEQ ID NO: 9917 - DNA, 2418 bp, Artificial Sequence
  Description of Artificial Sequence: Synthetic coding sequence
atgatcagagacctgagcaagatgtacccccagaccagacaccccgccccccaccagcccgcccagcccttcaagttcaccatcagcgagagctgcgacagaatcaaggaggagttccagttcctgcaggcccagtaccacagcctgaagctggagtgcgagaagctggccagcgagaagaccgagatgcagagacactacgtgatgtactacgagatgagctacggcctgaacatcgagatgcacaagcaggccgagatcgtgaagagactgaacgccatctgcgcccaggtgatccccttcctgagccaggagcaccagcagcaggtggtgcaggccgtggagagagccaagcaggtgaccatggccgagctgaacgccatcatcggccagcagctgcaggcccagcacctgagccacggccacggcctgcccgtgcccctgaccccccaccccagcggcctgcagccccccgccatcccccccatcggcagcagcgccggcctgctggccctgagcagcgccctgggcggccagagccacctgcccatcaaggacgagaagaagcaccacgacaacgaccaccagagagacagagacagcatcaagagcagcagcgtgagccccagcgccagcttcagaggcgccgagaagcacagaaacagcgccgactacagcagcgagagcaagaagcagaagaccgaggagaaggagatcgccgccagatacgacagcgacggcgagaagagcgacgacaacctggtggtggacgtgagcaacgaggaccccagcagccccagaggcagccccgcccacagccccagagagaacggcctggacaagaccagactgctgaagaaggacgcccccatcagccccgccagcatcgccagcagcagcagcacccccagcagcaagagcaaggagctgagcctgaagagagacatgggcaagctgagcgagaccagactgagcgaggacgagcagtgcaccctgggcctgcagagatggttctgcagactgtggttcatgaacgagaagagcaccacccccgtgagcaagagcaacacccccacccccagaaccgacgcccccacccccggcagcaacagcacccccggcctgagacccgtgcccggcaagccccccggcgtggaccccctggccagcagcctgagaacccccatggccgtgccctgcccctaccccacccccttcggcatcgtgccccacgccggcatgaacggcgagctgaccagccccggcgccgcctacgccggcctgcacaacatcagcccccagatgagcgccgccgccgccgccgccgccgccgccgccgcctacggcagaagccccgtggtgggcttcgacccccaccaccacatgagagtgcccgccatcccccccaacctgaccggcatccccggcggcaagcccgcctacagcttccacgtgagcgccgacggccagatgcagcccgtgcccttcccccccgacgccctgatcggccccggcatccccagacacgccagacagatcaacaccctgaaccacggcgaggtggtgtgcgccgtgaccatcagcaaccccaccagacacgtgtacaccggcggcaagggctgcgtgaaggtgtgggacatcagccaccccggcaacaagagccccgtgagccagctggactgcctgaacagagacaactacatcagaagctgcagactgctgcccgacggcagaaccctgatcgtgggcggcgaggccagcaccctgagcatctgggacctggccgcccccacccccagaatcaaggccgagctgaccagcagcgcccccgcctgctacgccctggccatcagccccgacagcaaggtgtgcttcagctgctgcagcgacggcaacatcgccgtgtgggacctgcacaaccagaccctggtgagacagttccagggccacaccgacggcgccagctgcatcgacatcagcaacgacggcaccaagctgtggaccggcggcctggacaacaccgtgagaagctgggacctgagagagggcagacagctgcagcagcacgacttcaccagccagatcttcagcctgggctactgccccaccggcgagtggctggccgtgggcatggagaacagcaacgtggaggtgctgcacgtgaccaagcccgacaagtaccagctgcacctgcacgagagctgcgtgctgagcctgaagttcgcccactgcggcaagtggttcgtgagcaccggcaaggacaacctgctgaacgcctggagaaccccctacggcgccagcatcttccagagcaaggagagcagcagcgtgctgagctgcgacatcagcgtggacgacaagtacatcgtgaccggcagcggcgacaagaaggccaccgtgtacgaggtgatctactag

SEQ ID NO: 9918 - DNA, 2115 bp, Artificial Sequence
  Description of Artificial Sequence: Synthetic coding sequence
atgatcagagacctgagcaagatgtacccccagaccagacaccccgccccccaccagcccgcccagcccttcaagttcaccatcagcgagagctgcgacagaatcaaggaggagttccagttcctgcaggcccagtaccacagcctgaagctggagtgcgagaagctggccagcgagaagaccgagatgcagagacactacgtgatgtactacgagatgagctacggcctgaacatcgagatgcacaagcaggccgagatcgtgaagagactgaacgccatctgcgcccaggtgatccccttcctgagccaggagcaccagcagcaggtggtgcaggccgtggagagagccaagcaggtgaccatggccgagctgaacgccatcatcggccagcagctgcaggcccagcacctgagccacggccacggcctgcccgtgcccctgaccccccaccccagcggcctgcagccccccgccatcccccccatcggcagcagcgccggcctgctggccctgagcagcgccctgggcggccagagccacctgcccatcaaggacgagaagaagcaccacgacaacgaccaccagagagagagagacaagctgaaccacaagagcctgagccccagcgccagcttcagaggcgccgagaagcacagaaacagcgccgactacagcagcgagagcaagaagcagaagaccgaggagaaggagatcgccgccagatacaacgagaagagcaccacccccgtgagcaagagcaacacccccacccccagaaccgacgcccccacccccggcagcaacagcacccccggcctgagacccgtgcccggcaagccccccggcgtggaccccctggccagcagcctgagaacccccatggccgtgccctgcccctaccccacccccttcggcatcgtgccccacgccggcatgaacggcgagctgaccagccccggcgccgcctacgccggcctgcacaacatcagcccccagatgagcgccgccgccgccgccgccgccgccgccgccgcctacggcagaagccccgtggtgggcttcgacccccaccaccacatgagagtgcccgccatcccccccaacctgaccggcatccccggcggcaagcccgcctacagcttccacgtgagcgccgacggccagatgcagcccgtgcccttcccccccgacgccctgatcggccccggcatccccagacacgccagacagatcaacaccctgaaccacggcgaggtggtgtgcgccgtgaccatcagcaaccccaccagacacgtgtacaccggcggcaagggctgcgtgaaggtgtgggacatcagccaccccggcaacaagagccccgtgagccagctggactgcctgaacagagacaactacatcagaagctgcagactgctgcccgacggcagaaccctgatcgtgggcggcgaggccagcaccctgagcatctgggacctggccgcccccacccccagaatcaaggccgagctgaccagcagcgcccccgcctgctacgccctggccatcagccccgacagcaaggtgtgcttcagctgctgcagcgacggcaacatcgccgtgtgggacctgcacaaccagaccctggtgagacagttccagggccacaccgacggcgccagctgcatcgacatcagcaacgacggcaccaagctgtggaccggcggcctggacaacaccgtgagaagctgggacctgagagagggcagacagctgcagcagcacgacttcaccagccagatcttcagcctgggctactgccccaccggcgagtggctggccgtgggcatggagaacagcaacgtggaggtgctgcacgtgaccaagcccgacaagtaccagctgcacctgcacgagagctgcgtgctgagcctgaagttcgcccactgcggcaagtggttcgtgagcaccggcaaggacaacctgctgaacgcctggagaaccccctacggcgccagcatcttccagagcaaggagagcagcagcgtgctgagctgcgacatcagcgtggacgacaagtacatcgtgaccggcagcggcgacaagaaggccaccgtgtacgaggtgatctactag

SEQ ID NO: 9919 - DNA, 2322 bp, Artificial Sequence
  Description of Artificial Sequence: Synthetic coding sequence
atgatcagagacctgagcaagatgtacccccagaccagacaccccgccccccaccagcccgcccagcccttcaagttcaccatcagcgagagctgcgacagaatcaaggaggagttccagttcctgcaggcccagtaccacagcctgaagctggagtgcgagaagctggccagcgagaagaccgagatgcagagacactacgtgatgtactacgagatgagctacggcctgaacatcgagatgcacaagcaggccgagatcgtgaagagactgaacgccatctgcgcccaggtgatccccttcctgagccaggagcaccagcagcaggtggtgcaggccgtggagagagccaagcaggtgaccatggccgagctgaacgccatcatcggccagcagctgcaggcccagcacctgagccacggccacggcctgcccgtgcccctgaccccccaccccagcggcctgcagccccccgccatcccccccatcggcagcagcgccggcctgctggccctgagcagcgccctgggcggccagagccacctgcccatcaaggacgagaagaagcaccacgacaacgaccaccagagagacagagacagcatcaagagcagcagcgtgagccccagcgccagcttcagaggcgccgagaagcacagaaacagcgccgactacagcagcgagagcaagaagcagaagaccgaggagaaggagatcgccgccagatacgacagcgacggcgagaagagcgacgacaacctggtggtggacgtgagcaacgaggaccccagcagccccagaggcagccccgcccacagccccagagagaacggcctggacaagaccagactgctgaagaaggacgcccccatcagccccgccagcatcgccagcagcagcagcacccccagcagcaagagcaaggagctgagcctgaacgagaagagcaccacccccgtgagcaagagcaacacccccacccccagaaccgacgcccccacccccggcagcaacagcacccccggcctgagacccgtgcccggcaagccccccggcgtggaccccctggccagcagcctgagaacccccatggccgtgccctgcccctaccccacccccttcggcatcgtgccccacgccggcatgaacggcgagctgaccagccccggcgccgcctacgccggcctgcacaacatcagcccccagatgagcgccgccgccgccgccgccgccgccgccgccgcctacggcagaagccccgtggtgggcttcgacccccaccaccacatgagagtgcccgccatcccccccaacctgaccggcatccccggcggcaagcccgcctacagcttccacgtgagcgccgacggccagatgcagcccgtgcccttcccccccgacgccctgatcggccccggcatccccagacacgccagacagatcaacaccctgaaccacggcgaggtggtgtgcgccgtgaccatcagcaaccccaccagacacgtgtacaccggcggcaagggctgcgtgaaggtgtgggacatcagccaccccggcaacaagagccccgtgagccagctggactgcctgaacagagacaactacatcagaagctgcagactgctgcccgacggcagaaccctgatcgtgggcggcgaggccagcaccctgagcatctgggacctggccgcccccacccccagaatcaaggccgagctgaccagcagcgcccccgcctgctacgccctggccatcagccccgacagcaaggtgtgcttcagctgctgcagcgacggcaacatcgccgtgtgggacctgcacaaccagaccctggtgagacagttccagggccacaccgacggcgccagctgcatcgacatcagcaacgacggcaccaagctgtggaccggcggcctggacaacaccgtgagaagctgggacctgagagagggcagacagctgcagcagcacgacttcaccagccagatcttcagcctgggctactgccccaccggcgagtggctggccgtgggcatggagaacagcaacgtggaggtgctgcacgtgaccaagcccgacaagtaccagctgcacctgcacgagagctgcgtgctgagcctgaagttcgcccactgcggcaagtggttcgtgagcaccggcaaggacaacctgctgaacgcctggagaaccccctacggcgccagcatcttccagagcaaggagagcagcagcgtgctgagctgcgacatcagcgtggacgacaagtacatcgtgaccggcagcggcgacaagaaggccaccgtgtacgaggtgatctactag

SEQ ID NO: 9920 - DNA, 642 bp, Artificial Sequence
  Description of Artificial Sequence: Synthetic coding sequence
atgatcagagacctgagcaagatgtacccccagaccagacaccccgccccccaccagcccgcccagcccttcaagttcaccatcagcgagagctgcgacagaatcaaggaggagttccagttcctgcaggcccagtaccacagcctgaagctggagtgcgagaagctggccagcgagaagaccgagatgcagagacactacgtgatgtactacgagatgagctacggcctgaacatcgagatgcacaagcaggccgagatcgtgaagagactgaacgccatctgcgcccaggtgatccccttcctgagccaggagcaccagcagcaggtggtgcaggccgtggagagagccaagcaggtgaccatggccgagctgaacgccatcatcggcgagaagaagaacaagagcgacacccccggcagcctgaagcagcagcagctgcaggcccagcacctgagccacggccacggcctgcccgtgcccctgaccccccaccccagcggcctgcagccccccgccatcccccccatcggcagcagcgccggcctgctggccctgagcagcgccctgggcggccagagccacctgcccatcaaggacgagaagaagcaccacgacaacgaccaccagagaggcgagtag

SEQ ID NO: 9921 - DNA, 849 bp, Artificial Sequence
  Description of Artificial Sequence: Synthetic coding sequence
atgagcgacgtggaggagaacaacttcgagggcagagagagcagaagccagagcaagagccccaccggcacccccgccagagtgaagagcgagagcagaagcggcagcagaagccccagcagagtgagcaagcacagcgagagccacagcagaagcagaagcaagagcagaagcagaagcagaagacacagccacagaagatacaccagaagcagaagccacagccacagccacagaagaagaagcagaagcagaagctacacccccgagtacagaagaagaagaagcagaagccacagccccatgagcaacagaagaagacacaccggcagcagagccaaccccgaccccaacacctgcctgggcgtgttcggcctgagcctgtacaccaccgagagagacctgagagaggtgttcagcagatacggccccctgagcggcgtgaacgtggtgtacgaccagagaaccggcagaagcagaggcttcgccttcgtgtacttcgagagaatcgacgacagcaaggaggccatggagagagccaacggcatggagctggacggcagaagaatcagagtggactacagcatcaccaagagagcccacacccccacccccggcatctacatgggcagacccacccacagcggcggcggcggcggcggcggcggcggcggcggcggcggcggcggcggcagaagaagagacagctactacgacagaggctacgacagaggctacgacagatacgaggactacgactacagatacagaagaagaagccccagcccctactacagcagatacagaagcagaagcagaagcagaagctacagccccagaagatactag

SEQ ID NO: 9922 - DNA, 543 bp, Artificial Sequence
  Description of Artificial Sequence: Synthetic coding sequence
atgagcaacagaagaagacacaccggcagcagagccaaccccgaccccaacacctgcctgggcgtgttcggcctgagcctgtacaccaccgagagagacctgagagaggtgttcagcagatacggccccctgagcggcgtgaacgtggtgtacgaccagagaaccggcagaagcagaggcttcgccttcgtgtacttcgagagaatcgacgacagcaaggaggccatggagagagccaacggcatggagctggacggcagaagaatcagagtggactacagcatcaccaagagagcccacacccccacccccggcatctacatgggcagacccacccacagcggcggcggcggcggcggcggcggcggcggcggcggcggcggcggcggcagaagaagagacagctactacgacagaggctacgacagaggctacgacagatacgaggactacgactacagatacagaagaagccccagcccctactacagcagatacagaagcagaagcagaagcagaagctacagccccagaagatactag

SEQ ID NO: 9923 - DNA, 546 bp, Artificial Sequence
  Description of Artificial Sequence: Synthetic coding sequence
atgagcaacagaagaagacacaccggcagcagagccaaccccgaccccaacacctgcctgggcgtgttcggcctgagcctgtacaccaccgagagagacctgagagaggtgttcagcagatacggccccctgagcggcgtgaacgtggtgtacgaccagagaaccggcagaagcagaggcttcgccttcgtgtacttcgagagaatcgacgacagcaaggaggccatggagagagccaacggcatggagctggacggcagaagaatcagagtggactacagcatcaccaagagagcccacacccccacccccggcatctacatgggcagacccacccacagcggcggcggcggcggcggcggcggcggcggcggcggcggcggcggcggcagaagaagagacagctactacgacagaggctacgacagaggctacgacagatacgaggactacgactacagatacagaagaagaagccccagcccctactacagcagatacagaagcagaagcagaagcagaagctacagccccagaagatactag

SEQ ID NO: 9924 - DNA, 2508 bp, Artificial Sequence
  Description of Artificial Sequence: Synthetic coding sequence
atggccgccagcgccgccgccgccagcgccgccgccgccagcgccgccagcggcagccccggccccggcgagggcagcgccggcggcgagaagagaagcaccgcccccagcgccgccgccagcgccagcgccagcgccgccgccagcagccccgccggcggcggcgccgaggccctggagctgctggagcactgcggcgtgtgcagagagagactgagacccgagagagagcccagactgctgccctgcctgcacagcgcctgcagcgcctgcctgggccccgccgcccccgccgccgccaacagcagcggcgacggcggcgccgccggcgacggcaccgtggtggactgccccgtgtgcaagcagcagtgcttcagcaaggacatcgtggagaactacttcatgagagacagcggcagcaaggccgccaccgacgcccaggacgccaaccagtgctgcaccagctgcgaggacaacgcccccgccaccagctactgcgtggagtgcagcgagcccctgtgcgagacctgcgtggaggcccaccagagagtgaagtacaccaaggaccacaccgtgagaagcaccggccccgccaagagcagagacggcgagagaaccgtgtactgcaacgtgcacaagcacgagcccctggtgctgttctgcgagagctgcgacaccctgacctgcagagactgccagctgaacgcccacaaggaccaccagtaccagttcctggaggacgccgtgagaaaccagagaaagctgctggccagcctggtgaagagactgggcgacaagcacgccaccctgcagaagagcaccaaggaggtgagaagcagcatcagacaggtgagcgacgtgcagaagagagtgcaggtggacgtgaagatggccatcctgcagatcatgaaggagctgaacaagagaggcagagtgctggtgaacgacgcccagaaggtgaccgagggccagcaggagagactggagagacagcactggaccatgaccaagatccagaagcaccaggagcacatcctgagattcgccagctgggccctggagagcgacaacaacaccgccctgctgctgagcaagaagctgatctacttccagctgcacagagccctgaagatgatcgtggaccccgtggagccccacggcgagatgaagttccagtgggacctgaacgcctggaccaagagcgccgaggccttcggcaagatcgtggccgagagacccggcaccaacagcaccggccccgcccccatggccccccccagagcccccggccccctgagcaagcagggcagcggcagcagccagcccatggaggtgcaggagggctacggcttcggcagcggcgacgacccctacagcagcgccgagccccacgtgagcggcgtgaagagaagcagaagcggcgagggcgaggtgagcggcctgatgagaaaggtgcccagagtgagcctggagagactggacctggacctgaccgccgacagccagccccccgtgttcaaggtgttccccggcagcaccaccgaggactacaacctgatcgtgatcgagagaggcgccgccgccgccgccaccggccagcccggcaccgcccccgccggcacccccggcgccccccccctggccggcatggccatcgtgaaggaggaggagaccgaggccgccatcggcgccccccccaccgccaccgagggccccgagaccaagcccgtgctgatggccctggccgagggccccggcgccgagggccccagactggccagccccagcggcagcaccagcagcggcctggaggtggtggcccccgagggcaccagcgcccccggcggcggccccggcaccctggacgacagcgccaccatctgcagagtgtgccagaagcccggcgacctggtgatgtgcaaccagtgcgagttctgcttccacctggactgccacctgcccgccctgcaggacgtgcccggcgaggagtggagctgcagcctgtgccacgtgctgcccgacctgaaggaggaggacggcagcctgagcctggacggcgccgacagcaccggcgtggtggccaagctgagccccgccaaccagagaaagtgcgagagagtgctgctggccctgttctgccacgagccctgcagacccctgcaccagctggccaccgacagcaccttcagcctggaccagcccggcggcaccctggacctgaccctgatcagagccagactgcaggagaagctgagccccccctacagcagcccccaggagttcgcccaggacgtgggcagaatgttcaagcagttcaacaagctgaccgaggacaaggccgacgtgcagagcatcatcggcctgcagagattcttcgagaccagaatgaacgaggccttcggcgacaccaagttcagcgccgtgctggtggagcccccccccatgagcctgcccggcgccggcctgagcagccaggagctgagcggcggccccggcgacggcccctag

SEQ ID NO: 9925 - DNA, 2262 bp, Artificial Sequence
  Description of Artificial Sequence: Synthetic coding sequence
atggccgccagcgccgccgccgccagcgccgccgccgccagcgccgccagcggcagccccggccccggcgagggcagcgccggcggcgagaagagaagcaccgcccccagcgccgccgccagcgccagcgccagcgccgccgccagcagccccgccggcggcggcgccgaggccctggagctgctggagcactgcggcgtgtgcagagagagactgagacccgagagagagcccagactgctgccctgcctgcacagcgcctgcagcgcctgcctgggccccgccgcccccgccgccgccaacagcagcggcgacggcggcgccgccggcgacggcaccggccccgccaagagcagagacggcgagagaaccgtgtactgcaacgtgcacaagcacgagcccctggtgctgttctgcgagagctgcgacaccctgacctgcagagactgccagctgaacgcccacaaggaccaccagtaccagttcctggaggacgccgtgagaaaccagagaaagctgctggccagcctggtgaagagactgggcgacaagcacgccaccctgcagaagagcaccaaggaggtgagaagcagcatcagacaggtgagcgacgtgcagaagagagtgcaggtggacgtgaagatggccatcctgcagatcatgaaggagctgaacaagagaggcagagtgctggtgaacgacgcccagaaggtgaccgagggccagcaggagagactggagagacagcactggaccatgaccaagatccagaagcaccaggagcacatcctgagattcgccagctgggccctggagagcgacaacaacaccgccctgctgctgagcaagaagctgatctacttccagctgcacagagccctgaagatgatcgtggaccccgtggagccccacggcgagatgaagttccagtgggacctgaacgcctggaccaagagcgccgaggccttcggcaagatcgtggccgagagacccggcaccaacagcaccggccccgcccccatggccccccccagagcccccggccccctgagcaagcagggcagcggcagcagccagcccatggaggtgcaggagggctacggcttcggcagcggcgacgacccctacagcagcgccgagccccacgtgagcggcgtgaagagaagcagaagcggcgagggcgaggtgagcggcctgatgagaaaggtgcccagagtgagcctggagagactggacctggacctgaccgccgacagccagccccccgtgttcaaggtgttccccggcagcaccaccgaggactacaacctgatcgtgatcgagagaggcgccgccgccgccgccaccggccagcccggcaccgcccccgccggcacccccggcgccccccccctggccggcatggccatcgtgaaggaggaggagaccgaggccgccatcggcgccccccccaccgccaccgagggccccgagaccaagcccgtgctgatggccctggccgagggccccggcgccgagggccccagactggccagccccagcggcagcaccagcagcggcctggaggtggtggcccccgagggcaccagcgcccccggcggcggccccggcaccctggacgacagcgccaccatctgcagagtgtgccagaagcccggcgacctggtgatgtgcaaccagtgcgagttctgcttccacctggactgccacctgcccgccctgcaggacgtgcccggcgaggagtggagctgcagcctgtgccacgtgctgcccgacctgaaggaggaggacggcagcctgagcctggacggcgccgacagcaccggcgtggtggccaagctgagccccgccaaccagagaaagtgcgagagagtgctgctggccctgttctgccacgagccctgcagacccctgcaccagctggccaccgacagcaccttcagcctggaccagcccggcggcaccctggacctgaccctgatcagagccagactgcaggagaagctgagccccccctacagcagcccccaggagttcgcccaggacgtgggcagaatgttcaagcagttcaacaagctgaccgaggacaaggccgacgtgcagagcatcatcggcctgcagagattcttcgagaccagaatgaacgaggccttcggcgacaccaagttcagcgccgtgctggtggagcccccccccatgagcctgcccggcgccggcctgagcagccaggagctgagcggcggccccggcgacggcccctag

SEQ ID NO: 9926 - DNA, 1503 bp, Artificial Sequence
  Description of Artificial Sequence: Synthetic coding sequence
atggaggtgagcaccaaccccagcagcaacatcgaccccggcgactacgtggagatgaacgacagcatcacccacctgcccagcaaggtggtgatccaggacatcaccatggagctgcactgccccctgtgcaacgactggttcagagaccccctgatgctgagctgcggccacaacttctgcgaggcctgcatccaggacttctggagactgcaggccaaggagaccttctgccccgagtgcaagatgctgtgccagtacaacaactgcaccttcaaccccgtgctggacaagctggtggagaagatcaagaagctgcccctgctgaagggccacccccagtgccccgagcacggcgagaacctgaagctgttcagcaagcccgacggcaagctgatctgcttccagtgcaaggacgccagactgagcgtgggccagagcaaggagttcctgcagatcagcgacgccgtgcacttcttcaccgaggagctggccatccagcagggccagctggagaccaccctgaaggagctgcagaccctgagaaacatgcagaaggaggccatcgccgcccacaaggagaacaagctgcacctgcagcagcacgtgagcatggagttcctgaagctgcaccagttcctgcacagcaaggagaaggacatcctgaccgagctgagagaggagggcaaggccctgaacgaggagatggagctgaacctgagccagctgcaggagcagtgcctgctggccaaggacatgctggtgagcatccaggccaagaccgagcagcagaacagcttcgacttcctgaaggacatcaccaccctgctgcacagcctggagcagggcatgaaggtgctggccaccagagagctgatcagcagaaagctgaacctgggccagtacaagggccccatccagtacatggtgtggagagagatgcaggacaccctgtgccccggcctgagccccctgaccctggaccccaagaccgcccaccccaacctggtgctgagcaagagccagaccagcgtgtggcacggcgacatcaagaagatcatgcccgacgaccccgagagattcgacagcagcgtggccgtgctgggcagcagaggcttcaccagcggcaagtggtactgggaggtggaggtggccaagaagaccaagtggaccgtgggcgtggtgagagagagcatcatcagaaagggcagctgccccctgacccccgagcagggcttctggctgctgagactgagaaaccagaccgacctgaaggccctggacctgcccagcttcagcctgaccctgaccaacaacctggacaaggtgggcatctacctggactacgagggcggccagctgagcttctacaacgccaagaccatgacccacatctacaccttcagcaacaccttcatggagaagctgtacccctacttctgcccctgcctgaacgacggcggcgagaacaaggagcccctgcacatcctgcacccccagtag

SEQ ID NO: 9927 - DNA, 1026 bp, Artificial Sequence
  Description of Artificial Sequence: Synthetic coding sequence
atggaggaggagctggccatccagcagggccagctggagaccaccctgaaggagctgcagaccctgagaaacatgcagaaggaggccatcgccgcccacaaggagaacaagctgcacctgcagcagcacgtgagcatggagttcctgaagctgcaccagttcctgcacagcaaggagaaggacatcctgaccgagctgagagaggagggcaaggccctgaacgaggagatggagctgaacctgagccagctgcaggagcagtgcctgctggccaaggacatgctggtgagcatccaggccaagaccgagcagcagaacagcttcgacttcctgaaggacatcaccaccctgctgcacagcctggagcagggcatgaaggtgctggccaccagagagctgatcagcagaaagctgaacctgggccagtacaagggccccatccagtacatggtgtggagagagatgcaggacaccctgtgccccggcctgagccccctgaccctggaccccaagaccgcccaccccaacctggtgctgagcaagagccagaccagcgtgtggcacggcgacatcaagaagatcatgcccgacgaccccgagagattcgacagcagcgtggccgtgctgggcagcagaggcttcaccagcggcaagtggtactgggaggtggaggtggccaagaagaccaagtggaccgtgggcgtggtgagagagagcatcatcagaaagggcagctgccccctgacccccgagcagggcttctggctgctgagactgagaaaccagaccgacctgaaggccctggacctgcccagcttcagcctgaccctgaccaacaacctggacaaggtgggcatctacctggactacgagggcggccagctgagcttctacaacgccaagaccatgacccacatctacaccttcagcaacaccttcatggagaagctgtacccctacttctgcccctgcctgaacgacggcggcgagaacaaggagcccctgcacatcctgcacccccagtag

SEQ ID NO: 9928 - DNA, 891 bp, Artificial Sequence
  Description of Artificial Sequence: Synthetic coding sequence
atggagttcctgaagctgcaccagttcctgcacagcaaggagaaggacatcctgaccgagctgagagaggagggcaaggccctgaacgaggagatggagctgaacctgagccagctgcaggagcagtgcctgctggccaaggacatgctggtgagcatccaggccaagaccgagcagcagaacagcttcgacttcctgaaggacatcaccaccctgctgcacagcctggagcagggcatgaaggtgctggccaccagagagctgatcagcagaaagctgaacctgggccagtacaagggccccatccagtacatggtgtggagagagatgcaggacaccctgtgccccggcctgagccccctgaccctggaccccaagaccgcccaccccaacctggtgctgagcaagagccagaccagcgtgtggcacggcgacatcaagaagatcatgcccgacgaccccgagagattcgacagcagcgtggccgtgctgggcagcagaggcttcaccagcggcaagtggtactgggaggtggaggtggccaagaagaccaagtggaccgtgggcgtggtgagagagagcatcatcagaaagggcagctgccccctgacccccgagcagggcttctggctgctgagactgagaaaccagaccgacctgaaggccctggacctgcccagcttcagcctgaccctgaccaacaacctggacaaggtgggcatctacctggactacgagggcggccagctgagcttctacaacgccaagaccatgacccacatctacaccttcagcaacaccttcatggagaagctgtacccctacttctgcccctgcctgaacgacggcggcgagaacaaggagcccctgcacatcctgcacccccagtag

SEQ ID NO: 9929 - DNA, 840 bp, Artificial Sequence
  Description of Artificial Sequence: Synthetic coding sequence
atggagttcctgaagctgcaccagttcctgcacagcaaggagaaggacatcctgaccgagctgagagaggagggcaaggccctgaacgaggagatggagctgaacctgagccagctgcaggagcagtgcctgctggccaaggacatgctggacatcaccaccctgctgcacagcctggagcagggcatgaaggtgctggccaccagagagctgatcagcagaaagctgaacctgggccagtacaagggccccatccagtacatggtgtggagagagatgcaggacaccctgtgccccggcctgagccccctgaccctggaccccaagaccgcccaccccaacctggtgctgagcaagagccagaccagcgtgtggcacggcgacatcaagaagatcatgcccgacgaccccgagagattcgacagcagcgtggccgtgctgggcagcagaggcttcaccagcggcaagtggtactgggaggtggaggtggccaagaagaccaagtggaccgtgggcgtggtgagagagagcatcatcagaaagggcagctgccccctgacccccgagcagggcttctggctgctgagactgagaaaccagaccgacctgaaggccctggacctgcccagcttcagcctgaccctgaccaacaacctggacaaggtgggcatctacctggactacgagggcggccagctgagcttctacaacgccaagaccatgacccacatctacaccttcagcaacaccttcatggagaagctgtacccctacttctgcccctgcctgaacgacggcggcgagaacaaggagcccctgcacatcctgcacccccagtag

SEQ ID NO: 9930 - DNA, 1503 bp, Artificial Sequence; identical to SEQ ID NO: 9926
  Description of Artificial Sequence: Synthetic coding sequence

SEQ ID NO: 9931 - DNA, 891 bp, Artificial Sequence; identical to SEQ ID NO: 9928
  Description of Artificial Sequence: Synthetic coding sequence

SEQ ID NO: 9932 - DNA, 1494 bp, Artificial Sequence
  Description of Artificial Sequence: Synthetic coding sequence
atggagggcagcggcgagcagcccggcccccagccccagcaccccggcgaccacagaatcagagacggcgacttcgtggtgctgaagagagaggacgtgttcaaggccgtgcaggtgcagagaagaaagaaggtgaccttcgagaagcagtggttctacctggacaacgtgatcggccacagctacggcaccgccttcgaggtgaccagcggcggcagcctgcagcccaagaagaagagagaggagcccaccgccgagaccaaggaggccggcaccgacaacagaaacatcgtggacgacggcaagagccagaagctgacccaggacgacatcaaggccctgaaggacaagggcatcaagggcgaggagatcgtgcagcagctgatcgagaacagcaccaccttcagagacaagaccgagttcgcccaggacaagtacatcaagaagaagaagaagaagtacgaggccatcatcaccgtggtgaagcccagcaccagaatcctgagcatcatgtactacgccagagagcccggcaagatcaaccacatgagatacgacaccctggcccagatgctgaccctgggcaacatcagagccggcaacaagatgatcgtgatggagacctgcgccggcctggtgctgggcgccatgatggagagaatgggcggcttcggcagcatcatccagctgtaccccggcggcggccccgtgagagccgccaccgcctgcttcggcttccccaagagcttcctgagcggcctgtacgagttccccctgaacaaggtggacagcctgctgcacggcaccttcagcgccaagatgctgagcagcgagcccaaggacagcgccctggtggaggagagcaacggcaccctggaggagaagcaggccagcgagcaggagaacgaggacagcatggccgaggcccccgagagcaaccaccccgaggaccaggagaccatggagaccatcagccaggaccccgagcacaagggccccaaggagagaggcagcaagaaggactacatccaggagaagcagagaagacaggaggagcagagaaagagacacctggaggccgccgccctgctgagcgagagaaacgccgacggcctgatcgtggccagcagattccaccccacccccctgctgctgagcctgctggacttcgtggcccccagcagacccttcgtggtgtactgccagtacaaggagcccctgctggagtgctacaccaagctgagagagagaggcggcgtgatcaacctgagactgagcgagacctggctgagaaactaccaggtgctgcccgacagaagccaccccaagctgctgatgagcggcggcggcggctacctgctgagcggcttcaccgtggccatggacaacctgaaggccgacaccagcctgaagagcaacgccagcaccctggagagccacgagaccgaggagcccgccgccaagaagagaaagtgccccgagagcgacagctag

SEQ ID NO: 9933 - DNA, 984 bp, Artificial Sequence
  Description of Artificial Sequence: Synthetic coding sequence
atgtactacgccagagagcccggcaagatcaaccacatgagatacgacaccctggcccagatgctgaccctgggcaacatcagagccggcaacaagatgatcgtgatggagacctgcgccggcctggtgctgggcgccatgatggagagaatgggcggcttcggcagcatcatccagctgtaccccggcggcggccccgtgagagccgccaccgcctgcttcggcttccccaagagcttcctgagcggcctgtacgagttccccctgaacaaggtggacagcctgctgcacggcaccttcagcgccaagatgctgagcagcgagcccaaggacagcgccctggtggaggagagcaacggcaccctggaggagaagcaggccagcgagcaggagaacgaggacagcatggccgaggcccccgagagcaaccaccccgaggaccaggagaccatggagaccatcagccaggaccccgagcacaagggccccaaggagagaggcagcaagaaggactacatccaggagaagcagagaagacaggaggagcagagaaagagacacctggaggccgccgccctgctgagcgagagaaacgccgacggcctgatcgtggccagcagattccaccccacccccctgctgctgagcctgctggacttcgtggcccccagcagacccttcgtggtgtactgccagtacaaggagcccctgctggagtgctacaccaagctgagagagagaggcggcgtgatcaacctgagactgagcgagacctggctgagaaactaccaggtgctgcccgacagaagccaccccaagctgctgatgagcggcggcggcggctacctgctgagcggcttcaccgtggccatggacaacctgaaggccgacaccagcctgaagagcaacgccagcaccctggagagccacgagaccgaggagcccgccgccaagaagagaaagtgccccgagagcgacagctag

SEQ ID NO: 9934 - DNA, 963 bp, Artificial Sequence
  Description of Artificial Sequence: Synthetic coding sequence
atgagcttcgtggcctacgaggagctgatcaaggagggcgacaccgccatcctgagcctgggccacggcgccatggtggccgtgagagtgcagagaggcgcccagacccagaccagacacggcgtgctgagacacagcgtggacctgatcggcagacccttcggcagcaaggtgacctgcggcagaggcggctgggtgtacgtgctgcaccccacccccgagctgtggaccctgaacctgccccacagaacccagatcctgtacagcaccgacatcgccctgatcaccatgatgctggagctgagacccggcagcgtggtgtgcgagagcggcaccggcagcggcagcgtgagccacgccatcatcagaaccatcgcccccaccggccacctgcacaccgtggagttccaccagcagagagccgagaaggccagagaggagttccaggagcacagagtgggcagatgggtgaccgtgagaacccaggacgtgtgcagaagcggcttcggcgtgagccacgtggccgacgccgtgttcctggacatccccagcccctgggaggccgtgggccacgcctgggacgccctgaaggtggagggcggcagattctgcagcttcagcccctgcatcgagcaggtgcagagaacctgccaggccctggccgccagaggcttcagcgagctgagcaccctggaggtgctgccccaggtgtacaacgtgagaaccgtgagcctgcccccccccgacctgggcaccggcaccgacggccccgccggcagcgacaccagccccttcagaagcggcacccccatgaaggaggccgtgggccacaccggctacctgaccctggccagaagctggggcgagctgacccagaacccctgccccgccctgcccagcgccagaagacccggccagcccagaaaccagggcggcgaccccgccctgtggccccccggctag

SEQ ID NO: 9935 - DNA, 870 bp, Artificial Sequence
  Description of Artificial Sequence: Synthetic coding sequence
atgagcttcgtggcctacgaggagctgatcaaggagggcgacaccgccatcctgagcctgggccacggcgccatggtggccgtgagagtgcagagaggcgcccagacccagaccagacacggcgtgctgagacacagcgtggacctgatcggcagacccttcggcagcaaggtgacctgcggcagaggcggctgggtgtacgtgctgcaccccacccccgagctgtggaccctgaacctgccccacagaacccagatcctgtacagcaccgacatcgccctgatcaccatgatgctggagctgagacccggcagcgtggtgtgcgagagcggcaccggcagcggcagcgtgagccacgccatcatcagaaccatcgcccccaccggccacctgcacaccgtggagttccaccagcagagagccgagaaggccagagaggagttccaggagcacagagtgggcagatgggtgaccgtgagaacccaggacgtgtgcagaagcggcttcggcgtgagccacgtggccgacgccgtgttcctggacatccccagcccctgggaggccgtgggccacgcctgggacgccctgaaggtggagggcggcagattctgcagcttcagcccctgcatcgagcaggtgcagagaacctgccaggccctggccgccagaggcttcagcgagctgagcaccctggaggtgctgccccaggtgtacaacgtgagaaccgtgagcctgcccccccccgacctgggcaccggcaccgacggccccgccggcagcgacaccagccccttcagaagcggcacccccatgaaggaggccgtgggccacaccggctacctgaccttcgccaccaagacccccggctag

SEQ ID NO: 9936 - DNA, 1245 bp, Artificial Sequence
  Description of Artificial Sequence: Synthetic coding sequence
atgagcggcctggacggcggcaacaagctgcccctggcccagaccggcggcctggccgcccccgaccacgccagcggcgaccccgacagagaccagtgccagggcctgagagaggagaccgaggccacccaggtgatggccaacaccggcggcggcagcctggagaccgtggccgagggcggcgccagccaggaccccgtggactgcggccccgccctgagagtgcccgtggccggcagcagaggcggcgccgccaccaaggccggccaggaggacgccccccccagcaccaagggcctggaggccgccagcgccgccgaggccgccgacagcagccagaagaacggctgccagctgggcgagcccagaggccccgccggccagaaggccctggaggcctgcggcgccggcggcctgggcagccagatgatccccggcaagaaggccaaggaggtgaccaccaagaagagagccatcagcgccgccgtggagaaggagggcgaggccggcgccgccatggaggagaagaaggtggtgcagaaggagaagaaggtggccggcggcgtgaaggaggagaccagacccagagcccccaagatcaacaactgcatggacagcctggaggccatcgaccaggagctgagcaacgtgaacgcccaggccgacagagccttcctgcagctggagagaaagttcggcagaatgagaagactgcacatgcagagaagaagcttcatcatccagaacatccccggcttctgggtgaccgccttcagaaaccacccccagctgagccccatgatcagcggccaggacgaggacatgctgagatacatgatcaacctggaggtggaggagctgaagcaccccagagccggctgcaagttcaagttcatcttccagggcaacccctacttcagaaacgagggcctggtgaaggagtacgagagaagaagcagcggcagagtggtgagcctgagcacccccatcagatggcacagaggccaggacccccaggcccacatccacagaaacagagagggcaacaccatccccagcttcttcaactggttcagcgaccacagcctgctggagttcgacagaatcgccgagatcatcaagggcgagctgtggcccaaccccctgcagtactacctgatgggcgagggccccagaagaggcatcagaggcccccccagacagcccgtggagagcgccagaagcttcagattccagagcggctag

SEQ ID NO: 9937 - DNA, 1254 bp, Artificial Sequence
  Description of Artificial Sequence: Synthetic coding sequence
atgagcggcagaagcagaggcagaaagagcagcagagccaagaacagaggcaagggcagagccaaggccagagtgagacccgcccccgacgacgcccccagagaccccgaccccagccagtaccagagcctgggcgaggacacccaggccgcccaggtgcaggccggcgccggctggggcggcctggaggccgccgccagcgcccagctgctgagactgggcgaggaggccgcctgcagactgcccctggactgcggcctggccctgagagccagagccgccggcgaccacggccaggccgccgccagacccggccccggcaaggccgccagcctgagcgagagactggccgccgacaccgtgttcgtgggcaccgccggcaccgtgggcagacccaagaacgcccccagagtgggcaacagaagaggccccgccggcaagaaggcccccgagacctgcagcaccgccggcagaggcccccaggtgatcgccggcggcagacagaagaagggcgccgccggcgagaacaccagcgtgagcgccggcgaggagaagaaggaggagagagacgccggcagcggcccccccgccaccgagggcagcatggacaccctggagaacgtgcagctgaagctggagaacatgaacgcccaggccgacagagcctacctgagactgagcagaaagttcggccagctgagactgcagcacctggagagaagaaaccacctgatccagaacatccccggcttctggggccaggccttccagaaccacccccagctggccagcttcctgaacagccaggagaaggaggtgctgagctacctgaacagcctggaggtggaggagctgggcctggccagactgggctacaagatcaagttctacttcgacagaaacccctacttccagaacaaggtgctgatcaaggagtacggctgcggccccagcggccaggtggtgagcagaagcacccccatccagtggctgcccggccacgacctgcagagcctgagccagggcaaccccgagaacaacagaagcttcttcggctggttcagcaaccacagcagcatcgagagcgacaagatcgtggagatcatcaacgaggagctgtggcccaaccccctgcagttctacctgctgagcgagggcgccagagtggagaagggcaaggagaaggagggcagacagggccccggcaagcagcccatggagaccacccagcccggcgtgagccagagcaactag

SEQ ID NO: 9938 - DNA, 1233 bp, Artificial Sequence
  Description of Artificial Sequence: Synthetic coding sequence
atgagcctgcccgagagcccccacagccccgccaccctggactacgccctggaggacccccaccagggccagagaagcagagagaagagcaaggccaccgaggtgatggccgacatgttcgacggcagactggagcccatcgtgttccccccccccagactgcccgaggagggcgtggccccccaggaccccgccgacggcggccacaccttccacatcctggtggacgccggcagaagccacggcgccatcaaggccggccaggaggtgacccccccccccgccgagggcctggaggccgccagcgccagcctgaccaccgacggcagcctgaagaacggcttccccggcgaggagacccacggcctgggcggcgagaaggccctggagacctgcggcgccggcagaagcgagagcgaggtgatcgccgagggcaaggccgaggacgtgaagcccgaggagtgcgccatgttcagcgcccccgtggacgagaagcccggcggcgaggagatggacgtggccgaggagaacagagccatcgacgaggtgaacagagaggccggccccggccccggccccggccccctgaacgtgggcctgcacctgaaccccctggagagcatccagctggagctggacagcgtgaacgccgaggccgacagagccctgctgcaggtggagagaagattcggccagatccacgagtactacctggagcagagaaacgacatcatcagaaacatccccggcttctgggtgaccgccttcagacaccacccccagctgagcgccatgatcagaggccaggacgccgagatgctgagctacctgaccaacctggaggtgaaggagctgagacaccccagaaccggctgcaagttcaagttcttcttccagagaaacccctacttcagaaacaagctgatcgtgaaggtgtacgaggtgagaagcttcggccaggtggtgagcttcagcaccctgatcatgtggagaagaggccacggcccccagagcttcatccacagaaacagacacgtgatctgcagcttcttcacctggttcagcgaccacagcctgcccgagagcgacagaatcgcccagatcatcaaggaggacctgtggagcaaccccctgcagtactacctgctgggcgaggacgcccacagagccagaagaagactggtgagagagcccgtggagatccccagacccttcggcttccagtgcggctag

SEQ ID NO: 9939 - DNA, 2415 bp, Artificial Sequence
  Description of Artificial Sequence: Synthetic coding sequence
atggccgcccacagacccggccccctgaagcagcagaacaaggcccacaagggcggcagacacagaggcagaggcagcgcccagagagacggcaagggcagactggccctgaagaccctgagcaagaaggtgagaaaggagctgagcagagtggaccagagacacagagccagccagctgagaaagcagaagaaggaggccgtgctggccgagaagagacagctgggcggcaaggacggccccccccaccaggtgctggtggtgcccctgcacagcagaatcagcctgcccgaggccatgcagctgctgcaggacagagacaccggcaccgtgcacctgaacgagctgggcaacacccagaacttcatgctgctgtgccccagactgaagcacagatggttcttcaccagcgccagacccggcgacctgcacgtggtgctggacatggccaaggtggccgacaccatcctgttcctgctggaccccctggagggctgggacagcaccggcgactactgcctgagctgcctgttcgcccagggcctgcccacctacaccctggccgtgcagggcatcagcggcctgcccctgaagaagcagatcgacaccagaaagaagctgagcaaggccgtggagaagagattcccccacgacaagctgctgctgctggacacccagcaggaggccggcatgctgctgagacagctggccaaccagaagcagcagcacctggccttcagagacagaagagcctacctgttcgcccacgccgtggacttcgtgcccagcgaggagaacaacctggtgggcaccctgaagatcagcggctacgtgagaggccagaccctgaacgtgaacagactgctgcacatcgtgggctacggcgacttccagatgaagcagatcgacgcccccggcgaccccttccccctgaaccccagaggcatcaagccccagaaggaccccgacatggccatggagatctgcgccaccgacgccgtggacgacatggaggagggcctgaaggtgctgatgaaggccgaccccggcagacaggagagcctgcaggccgaggtgatccccgaccccatggagggcgagcagacctggcccaccgaggaggagctgagcgaggccaaggacttcctgaaggagagcagcaaggtggtgaagaaggtgcccaagggcaccagcagctaccaggccgagtggatcctggacggcggcagccagagcggcggcgagggcgacgagtacgagtacgacgacatggagcacgaggacttcatggaggaggagagccaggacgagagcagcgaggaggaggaggagtacgagaccatgaccatcggcgagagcgtgcacgacgacctgtacgacaagaaggtggacgaggaggccgaggccaagatgctggagaagtacaagcaggagagactggaggagatgttccccgacgaggtggacacccccagagacgtggccgccagaatcagattccagaagtacagaggcctgaagagcttcagaaccagcccctgggaccccaaggagaacctgccccaggactacgccagaatcttccagttccagaacttcaccaacaccagaaagagcatcttcaaggaggtggaggagaaggaggtggagggcgccgaggtgggctggtacgtgaccctgcacgtgagcgaggtgcccgtgagcgtggtggagtgcttcagacagggcacccccctgatcgccttcagcctgctgccccacgagcagaagatgagcgtgctgaacatggtggtgagaagagaccccggcaacaccgagcccgtgaaggccaaggaggagctgatcttccactgcggcttcagaagattcagagccagccccctgttcagccagcacaccgccgccgacaagcacaagctgcagagattcctgaccgccgacatggccctggtggccaccgtgtacgcccccatcaccttcccccccgccagcgtgctgctgttcaagcagaagagcaacggcatgcacagcctgatcgccaccggccacctgatgagcgtggaccccgacagaatggtgatcaagagagtggtgctgagcggccaccccttcaagatcttcaccaagatggccgtggtgagatacatgttcttcaacagagaggacgtgctgtggttcaagcccgtggagctgagaaccaagtggggcagaagaggccacatcaaggagcccctgggcacccacggccacatgaagtgcagcttcgacggcaagctgaagagccaggacaccgtgctgatgaacctgtacaagagagtgttccccaagtggacctacgacccctacgtgcccgagcccgtgccctggctgaagagcgagatcagcagcaccgtgccccagggcggcatggagtag

SEQ ID NO: 9940 - DNA, 57 bp, Artificial Sequence
  Description of Artificial Sequence: Synthetic coding sequence
tgcaagcagagctgcgtgagcatcgccagctgcgaggccgccgagctgaacctgtag

SEQ ID NO: 9941 - DNA, 2319 bp, Artificial Sequence
  Description of Artificial Sequence: Synthetic coding sequence
atgaacagactgagaaacgccaagatctacgtggagagagccgtgaagcagaagaagatcttcaccatccagggctgctaccccgtgatcagatgcctgctgagaagaagaggctgggtggagaagaagatggtgcacagaagcggccccaccctgctgcccccccagaaggacctggacagcagcgccatgggcgacagcgacaccaccgaggacgaggacgaggacgaggacgaggagttccagcccagccagctgttcgacttcgacgacctgctgaagttcgacgacctggacggcacccacgccctgatggtgggcctgtgcctgaacctgagaaacctgccctggttcgacgaggtggacgccaacagcttcttccccagatgctactgcctgggcgccgaggacgacaagaaggccttcatcgaggacttctggctgaccgccgccagaaacgtgctgaagctggtggtgaagagcgagtggaagagctaccccatccaggccgtggaggaggaggccagcggcgacaagcagcccaagaagcaggagaagaaccccgtgctggtgagccccgagttcgtggacgaggccctgtgcgcctgcgaggagtacctgagcaacctggcccacatggacatcgacaaggacctggaggcccccctgtacctgacccccgagggctggagcctgttcctgcagagatactaccaggtggtgcacgagggcgccgagctgagacacctggacacccaggtgcagagatgcgaggacatcctgcagcagctgcaggccgtggtgccccagatcgacatggagggcgacagaaacatctggatcgtgaagcccggcgccaagagcagaggcagaggcatcatgtgcatggaccacctggaggagatgctgaagctggtgaacggcaaccccgtggtgatgaaggacggcaagtgggtggtgcagaagtacatcgagagacccctgctgatcttcggcaccaagttcgacctgagacagtggttcctggtgaccgactggaaccccctgaccgtgtggttctacagagacagctacatcagattcagcacccagcccttcagcctgaagaacctggacaacagcgtgcacctgtgcaacaacagcatccagaagcacctggagaacagctgccacagacaccccctgctgccccccgacaacatgtggagcagccagagattccaggcccacctgcaggagatgggcgcccccaacgcctggagcaccatcatcgtgcccggcatgaaggacgccgtgatccacgccctgcagaccagccaggacaccgtgcagtgcagaaaggccagcttcgagctgtacggcgccgacttcgtgttcggcgaggacttccagccctggctgatcgagatcaacgccagccccaccatggcccccagcaccgccgtgaccgccagactgtgcgccggcgtgcaggccgacaccctgagagtggtgatcgacagaatgctggacagaaactgcgacaccggcgccttcgagctgatctacaagcagcccgccgtggaggtgccccagtacgtgggcatcagactgctggtggagggcttcaccatcaagaagcccatggccatgtgccacagaagaatgggcgtgagacccgccgtgcccctgctgacccagagaggcagcggcgaggccagacaccacttccccagcctgcacaccaaggcccagctgcccagcccccacgtgctgagacaccagggccaggtgctgagaagacagcacagcaagctggtgggcaccaaggccctgagcaccaccggcaaggccctgagaaccctgcccaccgccaaggtgttcatcagcctgccccccaacctggacttcaaggtggcccccagcatcctgaagcccagaaaggcccccgccctgctgtgcctgagaggcccccagctggaggtgccctgctgcctgtgccccctgaagagcgagcagttcctggcccccgtgggcagaagcagacccaaggccaacagcagacccgactgcgacaagcccagagccgaggcctgccccatgaagagactgagccccctgaagcccctgcccctggtgggcaccttccagagaagaagaggcctgggcgacatgaagctgggcaagcccctgctgagattccccaccgccctggtgctggaccccacccccaacaagaagaagcaggtgaagtacctgggcctggacagcatcgccgtgggcggcagcagagtggacggcgccagaccctgcacccccggcagcaccgccagagcctag

SEQ ID NO: 9942 - DNA, 723 bp, Artificial Sequence
  Description of Artificial Sequence: Synthetic coding sequence
atgttccagagactgaacaagatgttcgtgggcgaggtgagcagcagcagcaaccaggagcccgagttcaacgagaaggaggacgacgagtggatcctggtggacttcatcgacacctgcaccggcttcagcgccgaggaggaggaggaggaggaggacatcagcgaggagagccccaccgagcaccccagcgtgttcagctgcctgcccgccagcctggagtgcctggccgacaccagcgacagctgcttcctgcagttcgagagctgccccatggaggagagctggttcatcaccccccccccctgcttcaccgccggcggcctgaccaccatcaaggtggagaccagccccatggagaacctgctgatcgagcaccccagcatgagcgtgtacgccgtgcacaacagctgccccggcctgagcgaggccaccagaggcaccgacgagctgcacagccccagcagccccagagtggaggcccagaacgagatgggccagcacatccactgctacgtggccgccctggccgcccacaccaccttcctggagcagcccaagagcttcagacccagccagtggatcaaggagcacagcgagagacagcccctgaacagaaacagcctgagaagacagaacctgaccagagactgccaccccagacaggtgaagcacaacggctgggtggtgcaccagccctgccccagacagtacaactactag

SEQ ID NO: 9943 - DNA, 558 bp, Artificial Sequence
  Description of Artificial Sequence: Synthetic coding sequence
atgttccagagactgaacaagatgttcgtgggcgaggtgagcagcagcagcaaccaggagcccgagttcaacgagaaggaggacgacgagtggatcctggtggacttcatcgacacctgcaccggcttcagcgccgaggaggaggaggaggaggaggacatcagcgaggagagccccaccgagcaccccagcgtgttcagctgcctgcccgccagcctggagtgcctggccgacaccagcgacagctgcttcctgcagttcgagagctgccccatggaggagagctggttcatcaccccccccccctgcttcaccgccggcggcctgaccaccatcaaggtggagaccagccccatggagaacctgctgatcgagcaccccagcatgagcgtgtacgccgtgcacaacagctgccccggcctgagcgaggccaccagaggcaccgacgagctgcacagccccagcagccccagatacagccaggactgccaccccagacaggtgaagcacaacggctgggtggtgcaccagccctgccccagacagtacaactactag

SEQ ID NO: 9944 - DNA, 495 bp, Artificial Sequence
  Description of Artificial Sequence: Synthetic coding sequence
atgttccagagactgaacaagatgttcgtgggcgaggtgagcagcagcagcaaccaggagcccgagttcaacgagaaggaggacgacgagtggatcctggtggacttcatcgacacctgcaccggcttcagcgccgaggaggaggaggaggaggaggacatcagcgaggagagccccaccgagcaccccagcgtgttcagctgcctgcccgccagcctggagtgcctggccgacaccagcgacagctgcttcctgcagttcgagagctgccccatggaggagagctggttcatcaccccccccccctgcttcaccgccggcggcctgaccaccatcaaggtggagaccagccccatggagaacctgctgatcgagcaccccagcatgagcgtgtacgccgtgcacaacagctgccccggcctgagcgaggccaccagaggcaccgacgagctgcacagccccagcagccccagagccagaaagagctgcctgtag

SEQ ID NO: 9945 - DNA, 663 bp, Artificial Sequence
  Description of Artificial Sequence: Synthetic coding sequence
atgttccagagactgagcagcctgttcttcagcacccccagcccccccgaggaccccgactgccccagagccttcgtgagcgaggaggacgaggtggacggctggctgatcatcgacctgcccgacagctacgccgccccccccagccccggcgccgcccccgcccccgccggcagacccccccccgcccccagcctgatggacgagagctggttcgtgaccccccccgcctgcttcaccgccgagggccccggcctgggccccgccagactgcagagcagccccctggaggacctgctgatcgagcaccccagcatgagcgtgtacgtgaccggcagcaccatcgtgctggagcccggcagccccagccccctgcccgacgccgccctgcccgacggcgacctgagcgagggcgagctgacccccgccagaagagagcccagagccgccagacacgccgcccccctgcccgccagagccgccctgctggagaaggccggccaggtgagaagactgcagagagccagacagagagccgagagacacgccctgagcgccaaggccgtgcagagacagaacagagccagagagagcagacccagaagaagcaagaaccagagcagcttcatctaccagccctgccagagacagttcaactactag

SEQ ID NO: 9946 - DNA, 663 bp, Artificial Sequence; identical to SEQ ID NO: 9945
  Description of Artificial Sequence: Synthetic coding sequence

SEQ ID NO: 9947 - DNA, 234 bp, Artificial Sequence
  Description of Artificial Sequence: Synthetic coding sequence
atgttccagagactgagcagcctgttcttcagcacccccagcccccccgaggaccccgactgccccagagccttcgtgagcgaggaggacgaggtggacggctggctgatcatcgacctgcccgacagctacgccgccccccccagccccggcgccgcccccgcccccgccggcagacccccccccgcccccagcctgatggacgagagctggttcgtgaccccccccgcctag

SEQ ID NO: 9948 - DNA, 267 bp, Artificial Sequence
  Description of Artificial Sequence: Synthetic coding sequence
atgttccagagactgagcagcctgttcttcagcacccccagcccccccgaggaccccgactgccccagagccttcgtgagcgaggaggacgaggtggacggctggctgatcatcgacctgcccgagggccccggcctgggccccgccagactgcagagcagccccctggaggacctgctgatcgagcaccccagcatgagcgtgtacgtgaccggcagcaccatcgtgctggagcccggcagccccagccccctgcccgacgcctag

SEQ ID NO: 9949 - DNA, 915 bp, Artificial Sequence
  Description of Artificial Sequence: Synthetic coding sequence
atggccacctggaagagcccctgcttcctgtactgcctgttcatcctgggccccagactgaccggccagaacaacagcgtggacctgaccaacgaggagaccaccgacagcaccaccagcaagatcagccccagcgaggacacccagcaggagaacggcagcatgttcagcctgatcacctggaacatcgacggcctggacctgaacaacctgagcgagagagccagaggcgtgtgcagctacctggccctgtacagccccgacgtgatcttcctgcaggaggtgatccccccctactacagctacctgaagaagagaagcagcaactacgagatcatcaccggccacgaggagggctacttcaccgccatcatgctgaagaagagcagagtgaagctgaagagccaggagatcatccccttccccagcaccaagatgatgagaaacctgctgtgcgtgcacgtgaacgtgagcggcaacgagctgtgcctgatgaccagccacctggagagcaccagaggccacgccgccgagagaatgaaccagctgaagatggtgctgaagaagatgcaggaggcccccgagagcgccaccgtgatcttcgccggcgacaccaacctgagagacagagaggtgaccagatgcggcggcctgcccaacaacatcgtggacgtgtgggagttcctgggcaagcccaagcactgccagtacacctgggacacccagatgaacagcaacctgggcatcaccgccgcctgcaagctgagattcgacagaatcttcttcagagccgccgccgaggagggccacatcatccccagaagcctggacctgctgggcctggagaagctggactgcggcagattccccagcgaccactggggcctgctgtgcaacctggacatcatcctgtag

SEQ ID NO: 9950 - DNA, 1089 bp, Artificial Sequence
  Description of Artificial Sequence: Synthetic coding sequence
atggagctgggcagctgcctggagggcggcagagaggccgccgaggaggagggcgagcccgaggtgaagaagagaagactgctgtgcgtggagttcgccagcgtggccagctgcgacgccgccgtggcccagtgcttcctggccgagaacgactgggagatggagagagccctgaacagctacttcgagccccccgtggaggagagcgccctggagagaagacccgagaccatcagcgagcccaagacctacgtggacctgaccaacgaggagaccaccgacagcaccaccagcaagatcagccccagcgaggacacccagcaggagaacggcagcatgttcagcctgatcacctggaacatcgacggcctggacctgaacaacctgagcgagagagccagaggcgtgtgcagctacctggccctgtacagccccgacgtgatcttcctgcaggaggtgatccccccctactacagctacctgaagaagagaagcagcaactacgagatcatcaccggccacgaggagggctacttcaccgccatcatgctgaagaagagcagagtgaagctgaagagccaggagatcatccccttccccagcaccaagatgatgagaaacctgctgtgcgtgcacgtgaacgtgagcggcaacgagctgtgcctgatgaccagccacctggagagcaccagaggccacgccgccgagagaatgaaccagctgaagatggtgctgaagaagatgcaggaggcccccgagagcgccaccgtgatcttcgccggcgacaccaacctgagagacagagaggtgaccagatgcggcggcctgcccaacaacatcgtggacgtgtgggagttcctgggcaagcccaagcactgccagtacacctgggacacccagatgaacagcaacctgggcatcaccgccgcctgcaagctgagattcgacagaatcttcttcagagccgccgccgaggagggccacatcatccccagaagcctggacctgctgggcctggagaagctggactgcggcagattccccagcgaccactggggcctgctgtgcaacctggacatcatcctgtag

SEQ ID NO: 9951 - DNA, 855 bp, Artificial Sequence
  Description of Artificial Sequence: Synthetic coding sequence
atggagctgggcagctgcctggagggcggcagagaggccgccgaggaggagggcgagcccgaggtgaagaagagaagactgctgtgcgtggagttcgccagcgtggccagctgcgacgccgccgtggcccagtgcttcctggccgagaacgactgggagatggagagagccctgaacagctacttcgagccctacagccccgacgtgatcttcctgcaggaggtgatccccccctactacagctacctgaagaagagaagcagcaactacgagatcatcaccggccacgaggagggctacttcaccgccatcatgctgaagaagagcagagtgaagctgaagagccaggagatcatccccttccccagcaccaagatgatgagaaacctgctgtgcgtgcacgtgaacgtgagcggcaacgagctgtgcctgatgaccagccacctggagagcaccagaggccacgccgccgagagaatgaaccagctgaagatggtgctgaagaagatgcaggaggcccccgagagcgccaccgtgatcttcgccggcgacaccaacctgagagacagagaggtgaccagatgcggcggcctgcccaacaacatcgtggacgtgtgggagttcctgggcaagcccaagcactgccagtacacctgggacacccagatgaacagcaacctgggcatcaccgccgcctgcaagctgagattcgacagaatcttcttcagagccgccgccgaggagggccacatcatccccagaagcctggacctgctgggcctggagaagctggactgcggcagattccccagcgaccactggggcctgctgtgcaacctggacatcatcctgtag

SEQ ID NO: 9952 - DNA, 1179 bp, Artificial Sequence
  Description of Artificial Sequence: Synthetic coding sequence
atgagagagagacacgacaccggcgcctgcgccgagcccagagtgggcctgctgttcagactgaagggcagatgcagaggcggcagaaagatggagctgggcagctgcctggagggcggcagagaggccgccgaggaggagggcgagcccgaggtgaagaagagaagactgctgtgcgtggagttcgccagcgtggccagctgcgacgccgccgtggcccagtgcttcctggccgagaacgactgggagatggagagagccctgaacagctacttcgagccccccgtggaggagagcgccctggagagaagacccgagaccatcagcgagcccaagacctacgtggacctgaccaacgaggagaccaccgacagcaccaccagcaagatcagccccagcgaggacacccagcaggagaacggcagcatgttcagcctgatcacctggaacatcgacggcctggacctgaacaacctgagcgagagagccagaggcgtgtgcagctacctggccctgtacagccccgacgtgatcttcctgcaggaggtgatccccccctactacagctacctgaagaagagaagcagcaactacgagatcatcaccggccacgaggagggctacttcaccgccatcatgctgaagaagagcagagtgaagctgaagagccaggagatcatccccttccccagcaccaagatgatgagaaacctgctgtgcgtgcacgtgaacgtgagcggcaacgagctgtgcctgatgaccagccacctggagagcaccagaggccacgccgccgagagaatgaaccagctgaagatggtgctgaagaagatgcaggaggcccccgagagcgccaccgtgatcttcgccggcgacaccaacctgagagacagagaggtgaccagatgcggcggcctgcccaacaacatcgtggacgtgtgggagttcctgggcaagcccaagcactgccagtacacctgggacacccagatgaacagcaacctgggcatcaccgccgcctgcaagctgagattcgacagaatcttcttcagagccgccgccgaggagggccacatcatccccagaagcctggacctgctgggcctggagaagctggactgcggcagattccccagcgaccactggggcctgctgtgcaacctggacatcatcctgtag

SEQ ID NO: 9953 - DNA, 1428 bp, Artificial Sequence
  Description of Artificial Sequence: Synthetic coding sequence
atgagcgacttcgacgagttcgagagacagctgaacgagaacaagcaggagagagacaaggagaacagacacagaaagagaagccacagcagaagcagaagcagagacagaaagagaagaagcagaagcagagacagaagaaacagagaccagagaagcgccagcagagacagaagaagaagaagcaagcccctgaccagaggcgccaaggaggagcacggcggcctgatcagaagccccagacacgagaagaagaagaaggtgagaaagtactgggacgtgcccccccccggcttcgagcacatcacccccatgcagtacaaggccatgcaggccgccggccagatccccgccaccgccctgctgcccaccatgacccccgacggcctggccgtgacccccacccccgtgcccgtggtgggcagccagatgaccagacaggccagaagactgtacgtgggcaacatccccttcggcatcaccgaggaggccatgatggacttcttcaacgcccagatgagactgggcggcctgacccaggcccccggcaaccccgtgctggccgtgcagatcaaccaggacaagaacttcgccttcctggagttcagaagcgtggacgagaccacccaggccatggccttcgacggcatcatcttccagggccagagcctgaagatcagaagaccccacgactaccagcccctgcccggcatgagcgagaaccccagcgtgtacgtgcccggcgtggtgagcaccgtggtgcccgacagcgcccacaagctgttcatcggcggcctgcccaactacctgaacgacgaccaggtgaaggagctgctgaccagcttcggccccctgaaggccttcaacctggtgaaggacagcgccaccggcctgagcaagggctacgccttctgcgagtacgtggacatcaacgtgaccgaccaggccatcgccggcctgaacggcatgcagctgggcgacaagaagctgctggtgcagagagccagcgtgggcgccaagaacgccaccctggtgagcccccccagcaccatcaaccagacccccgtgaccctgcaggtgcccggcctgatgagcagccaggtgcagatgggcggccaccccaccgaggtgctgtgcctgatgaacatggtgctgcccgaggagctgctggacgacgaggagtacgaggagatcgtggaggacgtgagagacgagtgcagcaagtacggcctggtgaagagcatcgagatccccagacccgtggacggcgtggaggtgcccggctgcggcaagatcttcgtggagttcaccagcgtgttcgactgccagaaggccatgcagggcctgaccggcagaaagttcgccaacagagtggtggtgaccaagtactgcgaccccgacagctaccacagaagagacttctggtag

SEQ ID NO: 9954 - DNA, 3090 bp, Artificial Sequence
  Description of Artificial Sequence: Synthetic coding sequence
atggccgacaagacccccggcggcagccagaaggccagcagcaagaccagaagcagcgacgtgcacagcagcggcagcagcgacgcccacatggacgccagcggccccagcgacagcgacatgcccagcagaaccagacccaagagccccagaaagcacaactacagaaacgagagcgccagagagagcctgtgcgacagcccccaccagaacctgagcagacccctgctggagaacaagctgaaggccttcagcatcggcaagatgagcaccgccaagagaaccctgagcaagaaggagcaggaggagctgaagaagaaggaggacgagaaggccgccgccgagatctacgaggagttcctggccgccttcgagggcagcgacggcaacaaggtgaagaccttcgtgagaggcggcgtggtgaacgccgccaaggaggagcacgagaccgacgagaagagaggcaagatctacaagcccagcagcagattcgccgaccagaagaacccccccaaccagagcagcaacgagagaccccccagcctgctggtgatcgagaccaagaagccccccctgaagaagggcgagaaggagaagaagaagagcaacctggagctgttcaaggaggagctgaagcagatccaggaggagagagacgagagacacaagaccaagggcagactgagcagattcgagcccccccagagcgacagcgacggccagagaagaagcatggacgcccccagcagaagaaacagaagcagcggcgtgctggacgactacgcccccggcagccacgacgtgggcgaccccagcaccaccaacctgtacctgggcaacatcaacccccagatgaacgaggagatgctgtgccaggagttcggcagattcggccccctggccagcgtgaagatcatgtggcccagaaccgacgaggagagagccagagagagaaactgcggcttcgtggccttcatgaacagaagagacgccgagagagccctgaagaacctgaacggcaagatgatcatgagcttcgagatgaagctgggctggggcaaggccgtgcccatccccccccaccccatctacatcccccccagcatgatggagcacaccctgccccccccccccagcggcctgcccttcaacgcccagcccagagagagactgaagaaccccaacgcccccatgctgcccccccccaagaacaaggaggacttcgagaagaccctgagccaggccatcgtgaaggtggtgatccccaccgagagaaacctgctggccctgatccacagaatgatcgagttcgtggtgagagagggccccatgttcgaggccatgatcatgaacagagagatcaacaaccccatgttcagattcctgttcgagaaccagacccccgcccacgtgtactacagatggaagctgtacagcatcctgcagggcgacagccccaccaagtggagaaccgaggacttcagaatgttcaagaacggcagcttctggagacccccccccctgaacccctacctgcacggcatgagcgaggagcaggagaccgaggccttcgtggaggagcccagcaagaagggcgccctgaaggaggagcagagagacaagctggaggagatcctgagaggcctgacccccagaaagaacgacatcggcgacgccatggtgttctgcctgaacaacgccgaggccgccgaggagatcgtggactgcatcaccgagagcctgagcatcctgaagacccccctgcccaagaagatcgccagactgtacctggtgagcgacgtgctgtacaacagcagcgccaaggtggccaacgccagctactacagaaagttcttcgagaccaagctgtgccagatcttcagcgacctgaacgccacctacagaaccatccagggccacctgcagagcgagaacttcaagcagagagtgatgacctgcttcagagcctgggaggactgggccatctaccccgagcccttcctgatcaagctgcagaacatcttcctgggcctggtgaacatcatcgaggagaaggagaccgaggacgtgcccgacgacctggacggcgcccccatcgaggaggagctggacggcgcccccctggaggacgtggacggcatccccatcgacgccacccccatcgacgacctggacggcgtgcccatcaagagcctggacgacgacctggacggcgtgcccctggacgccaccgaggacagcaagaagaacgagcccatcttcaaggtggcccccagcaagtgggaggccgtggacgagagcgagctggaggcccaggccgtgaccaccagcaagtgggagctgttcgaccagcacgaggagagcgaggaggaggagaaccagaaccaggaggaggagagcgaggacgaggaggacacccagagcagcaagagcgaggagcaccacctgtacagcaaccccatcaaggaggagatgaccgagagcaagttcagcaagtacagcgagatgagcgaggagaagagagccaagctgagagagatcgagctgaaggtgatgaagttccaggacgagctggagagcggcaagagacccaagaagcccggccagagcttccaggagcaggtggagcactacagagacaagctgctgcagagagagaaggagaaggagctggagagagagagagagagagacaagaaggacaaggagaagctggagagcagaagcaaggacaagaaggagaaggacgagtgcacccccaccagaaaggagagaaagagaagacacagcaccagccccagccccagcagaagcagcagcggcagaagagtgaagagccccagccccaagagcgagagaagcgagagaagcgagagaagccacaaggagagcagcagaagcagaagcagccacaaggacagccccagagacgtgagcaagaaggccaagagaagccccagcggcagcagaacccccaagagaagcagaagaagcagaagcagaagccccaagaagagcggcaagaagagcagaagccagagcagaagcccccacagaagccacaagaagagcaagaagaacaagcactag

SEQ ID NO: 9955 - DNA, 1863 bp, Artificial Sequence
  Description of Artificial Sequence: Synthetic coding sequence
atgctgctgtgctacagacacctgaagaccaagagaatcctgagaagaaacctgctggccctgatccacagaatgatcgagttcgtggtgagagagggccccatgttcgaggccatgatcatgaacagagagatcaacaaccccatgttcagattcctgttcgagaaccagacccccgcccacgtgtactacagatggaagctgtacagcatcctgcagggcgacagccccaccaagtggagaaccgaggacttcagaatgttcaagaacggcagcttctggagacccccccccctgaacccctacctgcacggcatgagcgaggagcaggagaccgaggccttcgtggaggagcccagcaagaagggcgccctgaaggaggagcagagagacaagctggaggagatcctgagaggcctgacccccagaaagaacgacatcggcgacgccatggtgttctgcctgaacaacgccgaggccgccgaggagatcgtggactgcatcaccgagagcctgagcatcctgaagacccccctgcccaagaagatcgccagactgtacctggtgagcgacgtgctgtacaacagcagcgccaaggtggccaacgccagctactacagaaagttcttcgagaccaagctgtgccagatcttcagcgacctgaacgccacctacagaaccatccagggccacctgcagagcgagaacttcaagcagagagtgatgacctgcttcagagcctgggaggactgggccatctaccccgagcccttcctgatcaagctgcagaacatcttcctgggcctggtgaacatcatcgaggagaaggagaccgaggacgtgcccgacgacctggacggcgcccccatcgaggaggagctggacggcgcccccctggaggacgtggacggcatccccatcgacgccacccccatcgacgacctggacggcgtgcccatcaagagcctggacgacgacctggacggcgtgcccctggacgccaccgaggacagcaagaagaacgagcccatcttcaaggtggcccccagcaagtgggaggccgtggacgagagcgagctggaggcccaggccgtgaccaccagcaagtgggagctgttcgaccagcacgaggagagcgaggaggaggagaaccagaaccaggaggaggagagcgaggacgaggaggacacccagagcagcaagagcgaggagcaccacctgtacagcaaccccatcaaggaggagatgaccgagagcaagttcagcaagtacagcgagatgagcgaggagaagagagccaagctgagagagatcgagctgaaggtgatgaagttccaggacgagctggagagcggcaagagacccaagaagcccggccagagcttccaggagcaggtggagcactacagagacaagctgctgcagagagagaaggagaaggagctggagagagagagagagagagacaagaaggacaaggagaagctggagagcagaagcaaggacaagaaggagaaggacgagtgcacccccaccagaaaggagagaaagagaagacacagcaccagccccagccccagcagaagcagcagcggcagaagagtgaagagccccagccccaagagcgagagaagcgagagaagcgagagaagccacaaggagagcagcagaagcagaagcagccacaaggacagccccagagacgtgagcaagaaggccaagagaagccccagcggcagcagaacccccaagagaagcagaagaagcagaagcagaagccccaagaagagcggcaagaagagcagaagccagagcagaagcccccacagaagccacaagaagagcaagaagaacaagcactag

SEQ ID NO: 9956 - DNA, 3090 bp, Artificial Sequence; identical to SEQ ID NO: 9954
  Description of Artificial Sequence: Synthetic coding sequence

SEQ ID NO: 9957 - DNA, 3087 bp, Artificial Sequence
  Description of Artificial Sequence: Synthetic coding sequence
atggccgacaagacccccggcggcagccagaaggccagcagcaagaccagaagcagcgacgtgcacagcagcggcagcagcgacgcccacatggacgccagcggccccagcgacagcgacatgcccagcagaaccagacccaagagccccagaaagcacaactacagaaacgagagcgccagagagagcctgtgcgacagcccccaccagaacctgagcagacccctgctggagaacaagctgaaggccttcagcatcggcaagatgagcaccgccaagagaaccctgagcaagaaggagcaggaggagctgaagaagaaggaggacgagaaggccgccgccgagatctacgaggagttcctggccgccttcgagggcagcgacggcaacaaggtgaagaccttcgtgagaggcggcgtggtgaacgccgccaaggaggagcacgagaccgacgagaagagaggcaagatctacaagcccagcagcagattcgccgaccagaagaacccccccaaccagagcagcaacgagagaccccccagcctgctggtgatcgagaccaagaagccccccctgaagaagggcgagaaggagaagaagaagagcaacctggagctgttcaaggaggagctgaagcagatccaggaggagagagacgagagacacaagaccaagggcagactgagcagattcgagcccccccagagcgacagcgacggccagagaagaagcatggacgcccccagcagaagaaacagaagcagcgtgctggacgactacgcccccggcagccacgacgtgggcgaccccagcaccaccaacctgtacctgggcaacatcaacccccagatgaacgaggagatgctgtgccaggagttcggcagattcggccccctggccagcgtgaagatcatgtggcccagaaccgacgaggagagagccagagagagaaactgcggcttcgtggccttcatgaacagaagagacgccgagagagccctgaagaacctgaacggcaagatgatcatgagcttcgagatgaagctgggctggggcaaggccgtgcccatccccccccaccccatctacatcccccccagcatgatggagcacaccctgccccccccccccagcggcctgcccttcaacgcccagcccagagagagactgaagaaccccaacgcccccatgctgcccccccccaagaacaaggaggacttcgagaagaccctgagccaggccatcgtgaaggtggtgatccccaccgagagaaacctgctggccctgatccacagaatgatcgagttcgtggtgagagagggccccatgttcgaggccatgatcatgaacagagagatcaacaaccccatgttcagattcctgttcgagaaccagacccccgcccacgtgtactacagatggaagctgtacagcatcctgcaggccaacagccccaccaagtggagaaccgaggacttcagaatgttcaagaacggcagcttctggagacccccccccctgaacccctacctgcacggcatgagcgaggagcaggagaccgaggccttcgtggaggagcccagcaagaagggcgccctgaaggaggagcagagagacaagctggaggagatcctgagaggcctgacccccagaaagaacgacatcggcgacgccatggtgttctgcctgaacaacgccgaggccgccgaggagatcgtggactgcatcaccgagagcctgagcatcctgaagacccccctgcccaagaagatcgccagactgtacctggtgagcgacgtgctgtacaacagcagcgccaaggtggccaacgccagctactacagaaagttcttcgagaccaagctgtgccagatcttcagcgacctgaacgccacctacagaaccatccagggccacctgcagagcgagaacttcaagcagagagtgatgacctgcttcagagcctgggaggactgggccatctaccccgagcccttcctgatcaagctgcagaacatcttcctgggcctggtgaacatcatcgaggagaaggagaccgaggacgtgcccgacgacctggacggcgcccccatcgaggaggagctggacggcgcccccctggaggacgtggacggcatccccatcgacgccacccccatcgacgacctggacggcgtgcccatcaagagcctggacgacgacctggacggcgtgcccctggacgccaccgaggacagcaagaagaacgagcccatcttcaaggtggcccccagcaagtgggaggccgtggacgagagcgagctggaggcccaggccgtgaccaccagcaagtgggagctgttcgaccagcacgaggagagcgaggaggaggagaaccagaaccaggaggaggagagcgaggacgaggaggacacccagagcagcaagagcgaggagcaccacctgtacagcaaccccatcaaggaggagatgaccgagagcaagttcagcaagtacagcgagatgagcgaggagaagagagccaagctgagagagatcgagctgaaggtgatgaagttccaggacgagctggagagcggcaagagacccaagaagcccggccagagcttccaggagcaggtggagcactacagagacaagctgctgcagagagagaaggagaaggagctggagagagagagagagagagacaagaaggacaaggagaagctggagagcagaagcaaggacaagaaggagaaggacgagtgcacccccaccagaaaggagagaaagagaagacacagcaccagccccagccccagcagaagcagcagcggcagaagagtgaagagccccagccccaagagcgagagaagcgagagaagcgagagaagccacaaggagagcagcagaagcagaagcagccacaaggacagccccagagacgtgagcaagaaggccaagagaagccccagcggcagcagaacccccaagagaagcagaagaagcagaagcagaagccccaagaagagcggcaagaagagcagaagccagagcagaagcccccacagaagccacaagaagagcaagaagaacaagcactag

SEQ ID NO: 9958 - DNA, 486 bp, Artificial Sequence
  Description of Artificial Sequence: Synthetic coding sequence
atggccgacaagacccccggcggcagccagaaggccagcagcaagaccagaagcagcgacgtgcacagcagcggcagcagcgacgcccacatggacgccagcggccccagcgacagcgacatgcccagcagaaccagacccaagagccccagaaagcacaactacagaaacgagagcgccagagagagcctgtgcgacagcccccaccagaacctgagcagacccctgctggagaacaagctgaaggccttcagcatcggcaagatgagcaccgccaagagaaccctgagcaagaaggagcaggaggagctgaagaagaaggaggacgagaaggccgccgccgagatctacgaggagttcctggccgccttcgagggcagcgacggcaacaaggtgaagaccttcgtgagaggcggcgtggtgaacgccgccaaggaggagcacgagaccgacgagaagagaggcaagatctacaagcccagctag

SEQ ID NO: 9959 - DNA, 3237 bp, Artificial Sequence
  Description of Artificial Sequence: Synthetic coding sequence
atgatgaccagcgtgggcaccaacagagccagaggcaactgggagcagccccagaaccagaaccagacccagcacaagcagagaccccaggccaccgccgagcagatcagactggcccagatgatcagcgaccacaacgacgccgacttcgaggagaaggtgaagcagctgatcgacatcaccggcaagaaccaggacgagtgcgtgatcgccctgcacgactgcaacggcgacgtgaacagagccatcaacgtgctgctggagggcaaccccgacacccacagctgggagatggtgggcaagaagaagggcgtgagcggccagaaggacggcggccagaccgagagcaacgaggagggcaaggagaacagagacagagacagagactacagcagaagaagaggcggcccccccagaagaggcagaggcgccagcagaggcagagagtgcatgcacggcgccctgagcaagcccgccgtggtgagaggccaggagaacggcctggacggcaccaagagcggcggccccagcggcagaggcaccgagagaggcagaagaggcagaggcagaggcagaggcggcagcggcagaagaggcggcagattcagcgcccagggcatgggcaccttcaaccccgccgactacgccgagcccgccaacaccgacgacaactacggcaacagcagcggcaacacctggaacaacaccggccacttcgagcccgacgacggcaccagcgcctggagaaccgccaccgaggagtggggcaccgaggactggaacgaggacctgagcgagaccaagatcttcaccgccagcaacgtgagcagcgtgcccctgcccgccgagaacgtgaccatcaccgccggccagagaatcgacctggccgtgctgctgggcaagacccccagcaccatggagaacgacagcagcaacctggaccccagccaggcccccagcctggcccagcccctggtgttcagcaacagcaagcagaccgccatcagccagcccgccagcggcaacaccttcagccaccacagcatggtgagcatgctgggcaagggcttcggcgacgtgggcgaggccaagggcggcagcaccaccggcagccagttcctggagcagttcaagaccgcccaggccctggcccagctggccgcccagcacagccagagcggcagcaccaccaccagcagctgggacatgggcagcaccacccagagccccagcctggtgcagtacgacctgaagaaccccagcgacagcgccgtgcacagccccttcaccaagagacaggccttcacccccagcagcaccatgatggaggtgttcctgcaggagaagagccccgccgtggccaccagcaccgccgccccccccccccccagcagccccctgcccagcaagagcaccagcgccccccagatgagccccggcagcagcgacaaccagagcagcagcccccagcccgcccagcagaagctgaagcagcagaagaagaaggccagcctgaccagcaagatccccgccctggccgtggagatgcccggcagcgccgacatcagcggcctgaacctgcagttcggcgccctgcagttcggcagcgagcccgtgctgagcgactacgagagcacccccaccaccagcgccagcagcagccaggcccccagcagcctgtacaccagcaccgccagcgagagcagcagcaccatcagcagcaaccagagccaggagagcggctaccagagcggccccatccagagcaccacctacaccagccagaacaacgcccagggccccctgtacgagcagagaagcacccagaccagaagataccccagcagcatcagcagcagcccccagaaggacctgacccaggccaagaacggcttcagcagcgtgcaggccacccagctgcagaccacccagagcgtggagggcgccaccggcagcgccgtgaagagcgacagccccagcaccagcagcatcccccccctgaacgagaccgtgagcgccgccagcctgctgaccaccaccaaccagcacagcagcagcctgggcggcctgagccacagcgaggagatccccaacaccaccaccacccagcacagcagcaccctgagcacccagcagaacaccctgagcagcagcaccagcagcggcagaaccagcaccagcaccctgctgcacaccagcgtggagagcgaggccaacctgcacagcagcagcagcaccttcagcaccaccagcagcaccgtgagcgcccccccccccgtggtgagcgtgagcagcagcctgaacagcggcagcagcctgggcctgagcctgggcagcaacagcaccgtgaccgccagcaccagaagcagcgtggccaccaccagcggcaaggccccccccaacctgccccccggcgtgccccccctgctgcccaacccctacatcatggcccccggcctgctgcacgcctaccccccccaggtgtacggctacgacgacctgcagatgctgcagaccagattccccctggactactacagcatccccttccccacccccaccacccccctgaccggcagagacggcagcctggccagcaacccctacagcggcgacctgaccaagttcggcagaggcgacgccagcagccccgcccccgccaccaccctggcccagccccagcagaaccagacccagacccaccacaccacccagcagaccttcctgaaccccgccctgccccccggctacagctacaccagcctgccctactacaccggcgtgcccggcctgcccagcaccttccagtacggccccgccgtgttccccgtggcccccaccagcagcaagcagcacggcgtgaacgtgagcgtgaacgccagcgccacccccttccagcagcccagcggctacggcagccacggctacaacaccggcgtgagcgtgaccagcagcaacaccggcgtgcccgacatcagcggcagcgtgtacagcaagacccagagcttcgagaagcagggcttccacagcggcacccccgccgccagcttcaacctgcccagcgccctgggcagcggcggccccatcaaccccgccaccgccgccgcctacccccccgcccccttcatgcacatcctgaccccccaccagcagccccacagccagatcctgcaccaccacctgcagcaggacggccaggacatcctgaacttcgtggacgaccagctgggcgagtag

SEQ ID NO: 9960 - DNA, 2952 bp, Artificial Sequence
  Description of Artificial Sequence: Synthetic coding sequence
atgatgaccagcgtgggcaccaacagagccagaggcaactgggagcagccccagaaccagaaccagacccagcacaagcagagaccccaggccaccgccgagcagatcagactggcccagatgatcagcgaccacaacgacgccgacttcgaggagaaggtgaagcagctgatcgacatcaccggcaagaaccaggacgagtgcgtgatcgccctgcacgactgcaacggcgacgtgaacagagccatcaacgtgctgctggagggcaaccccgacacccacagctgggagatggtgggcaagaagaagggcgtgagcggccagaaggacggcggccagaccgagagcaacgaggagggcaaggagaacagagacagagacagagactacagcagaagaagaggcggcccccccagaagaggcagaggcgccagcagaggcagagagttcagaggccaggagaacggcctggacggcaccaagagcggcggccccagcggcagaggcaccgagagaggcagaagaggcagaggcagaggcagaggcggcagcggcagaagaggcggcagattcagcgcccagggcatgggcaccttcaaccccgccgactacgccgagcccgccaacaccgacgacaactacggcaacagcagcggcaacacctggaacaacaccggccacttcgagcccgacgacggcaccagcgcctggagaaccgccaccgaggagtggggcaccgaggactggaacgaggacctgagcgagaccaagatcttcaccgccagcaacgtgagcagcgtgcccctgcccgccgagaacgtgaccatcaccgccggccagagaatcgacctggccgtgctgctgggcaagacccccagcaccatggagaacgacagcagcaacctggaccccagccaggcccccagcctggcccagcccctggtgttcagcaacagcaagcagaccgccatcagccagcccgccagcggcaacaccttcagccaccacagcatggtgagcatgctgggcaagggcttcggcgacgtgggcgaggccaagggcggcagcaccaccggcagccagttcctggagcagttcaagaccgcccaggccctggcccagctggccgcccagcacagccagagcggcagcaccaccaccagcagctgggacatgggcagcaccacccagagccccagcctggtgcagtacgacctgaagaaccccagcgacagcgccgtgcacagccccttcaccaagagacaggccttcacccccagcagcaccatgatggaggtgttcctgcaggagaagagccccgccgtggccaccagcaccgccgccccccccccccccagcagccccctgcccagcaagagcaccagcgccccccagatgagccccggcagcagcgacaaccagagcagcagcccccagcccgcccagcagaagctgaagcagcagaagaagaaggccagcctgaccagcaagatccccgccctggccgtggagatgcccggcagcgccgacatcagcggcctgaacctgcagttcggcgccctgcagttcggcagcgagcccgtgctgagcgactacgagagcacccccaccaccagcgccagcagcagccaggcccccagcagcctgtacaccagcaccgccagcgagagcagcagcaccatcagcagcaaccagagccaggagagcggctaccagagcggccccatccagagcaccacctacaccagccagaacaacgcccagggccccctgtacgagcagagaagcacccagaccagaagataccccagcagcatcagcagcagcccccagaaggacctgacccaggccaagaacggcttcagcagcgtgcaggccacccagctgcagaccacccagagcgtggagggcgccaccggcagcgccgtgaagagcgacagccccagcaccagcagcatcccccccctgaacgagaccgtgagcgccgccagcctgctgaccaccaccaaccagcacagcagcagcctgggcggcctgagccacagcgaggagatccccaacaccaccaccacccagcacagcagcaccctgagcacccagcagaacaccctgagcagcagcaccagcagcggcagaaccagcaccagcaccctgctgcacaccagcgtggagagcgaggccaacctgcacagcagcagcagcaccttcagcaccaccagcagcaccgtgagcgcccccccccccgtggtgagcgtgagcagcagcctgaacagcggcagcagcctgggcctgagcctgggcagcaacagcaccgtgaccgccagcaccagaagcagcgtggccaccaccagcggcaaggccccccccaacctgccccccggcgtgccccccctgctgcccaacccctacatcatggcccccggcctgctgcacgcctaccccccccaggtgtacggctacgacgacctgcagatgctgcagaccagattccccctggactactacagcatccccttccccacccccaccacccccctgaccggcagagacggcagcctggccagcaacccctacagcggcgacctgaccaagttcggcagaggcgacgccagcagccccgcccccgccaccaccctggcccagccccagcagaaccagacccagacccaccacaccacccagcagaccttcctgaaccccgccctgccccccggctacagctacaccagcctgccctactacaccggcgtgcccggcctgcccagcaccttccagtacggccccgccgtgttccccgtggcccccaccagcagcaagcagcacggcgtgaacgtgagcgtgaacgccagcgccacccccttccagcagcccagcggctacggcagccacggctacaacaccggcagaaagtacccccccccctacaagcacttctggaccgccgagagctag

SEQ ID NO: 9961 - DNA, 3264 bp, Artificial Sequence
  Description of Artificial Sequence: Synthetic coding sequence
atgatgaccagcgtgggcaccaacagagccagaggcaactgggagcagccccagaaccagaaccagacccagcacaagcagagaccccaggccaccgccgagcagatcagactggcccagatgatcagcgaccacaacgacgccgacttcgaggagaaggtgaagcagctgatcgacatcaccggcaagaaccaggacgagtgcgtgatcgccctgcacgactgcaacggcgacgtgaacagagccatcaacgtgctgctggagggcaaccccgacacccacagctgggagatggtgggcaagaagaagggcgtgagcggccagaaggacggcggccagaccgagagcaacgaggagggcaaggagaacagagacagagacagagactacagcagaagaagaggcggcccccccagaagaggcagaggcgccagcagaggcagagagttcagaggccaggagaacggcctggacggcaccaagagcggcggccccagcggcagaggcaccgagagaggcagaagaggcagaggcagaggcagaggcggcagcggcagaagaggcggcagattcagcgcccagggcatgggcaccttcaaccccgccgactacgccgagcccgccaacaccgacgacaactacggcaacagcagcggcaacacctggaacaacaccggccacttcgagcccgacgacggcaccagcgcctggagaaccgccaccgaggagtggggcaccgaggactggaacgaggacctgagcgagaccaagatcttcaccgccagcaacgtgagcagcgtgcccctgcccgccgagaacgtgaccatcaccgccggccagagaatcgacctggccgtgctgctgggcaagacccccagcaccatggagaacgacagcagcaacctggaccccagccaggcccccagcctggcccagcccctggtgttcagcaacagcaagcagaccgccatcagccagcccgccagcggcaacaccttcagccaccacagcatggtgagcatgctgggcaagggcttcggcgacgtgggcgaggccaagggcggcagcaccaccggcagccagttcctggagcagttcaagaccgcccaggccctggcccagctggccgcccagcacagccagagcggcagcaccaccaccagcagctgggacatgggcagcaccacccagagccccagcctggtgcagtacgacctgaagaaccccagcgacagcgccgtgcacagccccttcaccaagagacaggccttcacccccagcagcaccatgatggaggtgttcctgcaggagaagagccccgccgtggccaccagcaccgccgccccccccccccccagcagccccctgcccagcaagagcaccagcgccccccagatgagccccggcagcagcgacaaccagagcagcagcccccagcccgcccagcagaagctgaagcagcagaagaagaaggccagcctgaccagcaagatccccgccctggccgtggagatgcccggcagcgccgacatcagcggcctgaacctgcagttcggcgccctgcagttcggcagcgagcccgtgctgagcgactacgagagcacccccaccaccagcgccagcagcagccaggcccccagcagcctgtacaccagcaccgccagcgagagcagcagcaccatcagcagcaaccagagccaggagagcggctaccagagcggccccatccagagcaccacctacaccagccagaacaacgcccagggccccctgtacgagcagagaagcacccagaccagaagataccccagcagcatcagcagcagcccccagaaggacctgacccaggccaagaacggcttcagcagcgtgcaggccacccagctgcagaccacccagagcgtggagggcgccaccggcagcgccgtgaagagcgacagccccagcaccagcagcatcccccccctgaacgagaccgtgagcgccgccagcctgctgaccaccaccaaccagcacagcagcagcctgggcggcctgagccacagcgaggagatccccaacaccaccaccacccagcacagcagcaccctgagcacccagcagaacaccctgagcagcagcaccagcagcggcagaaccagcaccagcaccctgctgcacaccagcgtggagagcgaggccaacctgcacagcagcagcagcaccttcagcaccaccagcagcaccgtgagcgcccccccccccgtggtgagcgtgagcagcagcctgaacagcggcagcagcctgggcctgagcctgggcagcaacagcaccgtgaccgccagcaccagaagcagcgtggccaccaccagcggcaaggccccccccaacctgccccccggcgtgccccccctgctgcccaacccctacatcatggcccccggcctgctgcacgcctaccccccccaggtgtacggctacgacgacctgcagatgctgcagaccagattccccctggactactacagcatccccttccccacccccaccacccccctgaccggcagagacggcagcctggccagcaacccctacagcggcgacctgaccaagttcggcagaggcgacgccagcagccccgcccccgccaccaccctggcccagccccagcagaaccagacccagacccaccacaccacccagcagaccttcctgaaccccgccctgccccccggctacagctacaccagcctgccctactacaccggcgtgcccggcctgcccagcaccttccagtacggccccgccgtgttccccgtggcccccaccagcagcaagcagcacggcgtgaacgtgagcgtgaacgccagcgccacccccttccagcagcccagcggctacggcagccacggctacaacaccggcgtgagcgtgaccagcagcaacaccggcgtgcccgacatcagcggcagcgtgtacagcaagacccagcagagcttcgagaagcagggcttccacagcggcacccccgccgccagcttcaacctgcccagcgccctgggcagcggcggccccatcaaccccgccaccgccgccgcctacccccccgcccccttcatgcacatcctgaccccccaccagcagccccacagccagatcctgcaccaccacctgcagcaggacggccagaccggcagcggccagagaagccagaccagcagcatcccccagaagccccagaccaacaagagcgcctacaacagctacagctggggcgccaactag

SEQ ID NO: 9962 - DNA, 1053 bp, Artificial Sequence
  Description of Artificial Sequence: Synthetic coding sequence
atgatgaccagcgtgggcaccaacagagccagaggcaactgggagcagccccagaaccagaaccagacccagcacaagcagagaccccaggccaccgccgagcagatcagactggcccagatgatcagcgaccacaacgacgccgacttcgaggagaaggtgaagcagctgatcgacatcaccggcaagaaccaggacgagtgcgtgatcgccctgcacgactgcaacggcgacgtgaacagagccatcaacgtgctgctggagggcaaccccgacacccacagctgggagatggtgggcaagaagaagggcgtgagcggccagaaggacggcggccagaccgagagcaacgaggagggcaaggagaacagagacagagacagagactacagcagaagaagaggcggcccccccagaagaggcagaggcgccagcagaggcagagagtgcatgcacggcgccctgagcaagcccgccgtggtgagaggccaggagaacggcctggacggcaccaagagcggcggccccagcggcagaggcaccgagagaggcagaagaggcagaggcagaggcagaggcggcagcggcagaagaggcggcagattcagcgcccagggcatgggcaccttcaaccccgccgactacgccgagcccgccaacaccgacgacaactacggcaacagcagcggcaacacctggaacaacaccggccacttcgagcccgacgacggcaccagcgcctggagaaccgccaccgaggagtggggcaccgaggactggaacgaggacctgagcgagaccaagatcttcaccgccagcaacgtgagcagcgtgcccctgcccgccgagaacgtgaccatcaccgccggccagagaatcgacctggccgtgctgctgggcaagacccccagcaccatggagaacgacagcagcaacctggaccccagccaggcccccagcctggcccagcccctggtgttcagcaacagcaagcagaccgccatcagccagcccgccagcggcaacaccttcagccaccacagcatggtgtag

SEQ ID NO: 9963 - DNA, 843 bp, Artificial Sequence
  Description of Artificial Sequence: Synthetic coding sequence
atgatgaccagcgtgggcaccaacagagccagaggcaactgggagcagccccagaaccagaaccagacccagcacaagcagagaccccaggccaccgccgagcagatcagactggcccagatgatcagcgaccacaacgacgccgacttcgaggagaaggtgaagcagctgatcgacatcaccggcaagaaccaggacgagtgcgtgatcgccctgcacgactgcaacggcgacgtgaacagagccatcaacgtgctgctggagggcaaccccgacacccacagctgggagatggtgggcaagaagaagggcgtgagcggccagaaggacggcggccagaccgagagcaacgaggagggcaaggagaacagagacagagacagagactacagcagaagaagaggcggcccccccagaagaggcagaggcgccagcagaggcagagagttcagaggccaggagaacggcctggacggcaccaagagcggcggccccagcggcagaggcaccgagagaggcagaagaggcagaggcagaggcagaggcggcagcggcagaagaggcggcagattcagcgcccagggcatgggcaccttcaaccccgccgactacgccgagcccgccaacaccgacgacaactacggcaacagcagcggcaacacctggaacaacaccggccacttcgagcccgacgacggcaccagcgcctggagaaccgccaccgaggagtggggcaccgaggactggaacgaggacctgagcgagaccaagatcttcaccgccagcaacgtgagcagcgtgcccctgcccgccgagaacgtgaccatcaccgccggccagtag

SEQ ID NO: 9964 - DNA, 1152 bp, Artificial Sequence
  Description of Artificial Sequence: Synthetic coding sequence
tgagtggagagcgaggccaacctgcacagcagcagcagcaccttcagcaccaccagcagcaccgtgagcgcccccccccccgtggtgagcgtgagcagcagcctgaacagcggcagcagcctgggcctgagcctgggcagcaacagcaccgtgaccgccagcaccagaagcagcgtggccaccaccagcggcaaggccccccccaacctgccccccggcgtgccccccctgctgcccaacccctacatcatggcccccggcctgctgcacgcctaccccccccaggtgtacggctacgacgacctgcagatgctgcagaccagattccccctggactactacagcatccccttccccacccccaccacccccctgaccggcagagacggcagcctggccagcaacccctacagcggcgacctgaccaagttcggcagaggcgacgccagcagccccgcccccgccaccaccctggcccagccccagcagaaccagacccagacccaccacaccacccagcagaccttcctgaaccccgccctgccccccggctacagctacaccagcctgccctactacaccggcgtgcccggcctgcccagcaccttccagtacggccccgccgtgttccccgtggcccccaccagcagcaagcagcacggcgtgaacgtgagcgtgaacgccagcgccacccccttccagcagcccagcggctacggcagccacggctacaacaccggcgtgagcgtgaccagcagcaacaccggcgtgcccgacatcagcggcagcgtgtacagcaagacccagcagagcttcgagaagcagggcttccacagcggcacccccgccgccagcttcaacctgcccagcgccctgggcagcggcggccccatcaaccccgccaccgccgccgcctacccccccgcccccttcatgcacatcctgaccccccaccagcagccccacagccagatcctgcaccaccacctgcagcaggacggccagctgccctacctgcagatgatcctgtgctgccagagacagcaggaggagcagaccggcagcggccagagaagccagaccagcagcatcccccagaagccccagaccaacaagagcgcctacaacagctacagctggggcgccaactag

SEQ ID NO: 9965 - DNA, 3264 bp, Artificial Sequence; identical to SEQ ID NO: 9961
  Description of Artificial Sequence: Synthetic coding sequence

SEQ ID NO: 9966 - DNA, 1803 bp, Artificial Sequence
  Description of Artificial Sequence: Synthetic coding sequence
atgcccggcagcgccgacatcagcggcctgaacctgcagttcggcgccctgcagttcggcagcgagcccgtgctgagcgactacgagagcacccccaccaccagcgccagcagcagccaggcccccagcagcctgtacaccagcaccgccagcgagagcagcagcaccatcagcagcaaccagagccaggagagcggctaccagagcggccccatccagagcaccacctacaccagccagaacaacgcccagggccccctgtacgagcagagaagcacccagaccagaagataccccagcagcatcagcagcagcccccagaaggacctgacccaggccaagaacggcttcagcagcgtgcaggccacccagctgcagaccacccagagcgtggagggcgccaccggcagcgccgtgaagagcgacagccccagcaccagcagcatcccccccctgaacgagaccgtgagcgccgccagcctgctgaccaccaccaaccagcacagcagcagcctgggcggcctgagccacagcgaggagatccccaacaccaccaccacccagcacagcagcaccctgagcacccagcagaacaccctgagcagcagcaccagcagcggcagaaccagcaccagcaccctgctgcacaccagcgtggagagcgaggccaacctgcacagcagcagcagcaccttcagcaccaccagcagcaccgtgagcgcccccccccccgtggtgagcgtgagcagcagcctgaacagcggcagcagcctgggcctgagcctgggcagcaacagcaccgtgaccgccagcaccagaagcagcgtggccaccaccagcggcaaggccccccccaacctgccccccggcgtgccccccctgctgcccaacccctacatcatggcccccggcctgctgcacgcctaccccccccaggtgtacggctacgacgacctgcagatgctgcagaccagattccccctggactactacagcatccccttccccacccccaccacccccctgaccggcagagacggcagcctggccagcaacccctacagcggcgacctgaccaagttcggcagaggcgacgccagcagccccgcccccgccaccaccctggcccagccccagcagaaccagacccagacccaccacaccacccagcagaccttcctgaaccccgccctgccccccggctacagctacaccagcctgccctactacaccggcgtgcccggcctgcccagcaccttccagtacggccccgccgtgttccccgtggcccccaccagcagcaagcagcacggcgtgaacgtgagcgtgaacgccagcgccacccccttccagcagcccagcggctacggcagccacggctacaacaccggcgtgagcgtgaccagcagcaacaccggcgtgcccgacatcagcggcagcgtgtacagcaagacccagcagagcttcgagaagcagggcttccacagcggcacccccgccgccagcttcaacctgcccagcgccctgggcagcggcggccccatcaaccccgccaccgccgccgcctacccccccgcccccttcatgcacatcctgaccccccaccagcagccccacagccagatcctgcaccaccacctgcagcaggacggccagctgccctacctgcagatgatcctgtgctgccagagacagcaggaggagcagaccggcagcggccagagaagccagaccagcagcatcccccagaagccccagaccaacaagagcgcctacaacagctacagctggggcgccaactag

SEQ ID NO: 9967 - DNA, 1200 bp, Artificial Sequence
  Description of Artificial Sequence: Synthetic coding sequence
tgacagcacagcagcagcctgggcggcctgagccacagcgaggagatccccaacaccaccaccacccagcacagcagcaccctgagcacccagcagaacaccctgagcagcagcaccagcagcggcagaaccagcaccagcaccctgctgcacaccagcgtggagagcgaggccaacctgcacagcagcagcagcaccttcagcaccaccagcagcaccgtgagcgcccccccccccgtggtgagcgtgagcagcagcctgaacagcggcagcagcctgggcctgagcctgggcagcaacagcaccgtgaccgccagcaccagaagcagcgtggccaccaccagcggcaaggccccccccaacctgccccccggcgtgccccccctgctgcccaacccctacatcatggcccccggcctgctgcacgcctaccccccccaggtgtacggctacgacgacctgcagatgctgcagaccagattccccctggactactacagcatccccttccccacccccaccacccccctgaccggcagagacggcagcctggccagcaacccctacagcggcgacctgaccaagttcggcagaggcgacgccagcagccccgcccccgccaccaccctggcccagccccagcagaaccagacccagacccaccacaccacccagcagaccttcctgaaccccgccctgccccccggctacagctacaccagcctgccctactacaccggcgtgcccggcctgcccagcaccttccagtacggccccgccgtgttccccgtggcccccaccagcagcaagcagcacggcgtgaacgtgagcgtgaacgccagcgccacccccttccagcagcccagcggctacggcagccacggctacaacaccggcgtgagcgtgaccagcagcaacaccggcgtgcccgacatcagcggcagcgtgtacagcaagacccagcagagcttcgagaagcagggcttccacagcggcacccccgccgccagcttcaacctgcccagcgccctgggcagcggcggccccatcaaccccgccaccgccgccgcctacccccccgcccccttcatgcacatcctgaccccccaccagcagccccacagccagatcctgcaccaccacctgcagcaggacggccaggacatcctgaacttcgtggacgaccagctgggcgagtag

SEQ ID NO: 9968 - DNA, 798 bp, Artificial Sequence
  Description of Artificial Sequence: Synthetic coding sequence
atgatgaccagcgtgggcaccaacagagccagaggcaactgggagcagccccagaaccagaaccagacccagcacaagcagagaccccaggccaccgccgagcagatcagactggcccagatgatcagcgaccacaacgacgccgacttcgaggagaaggtgaagcagctgatcgacatcaccggcaagaaccaggacgagtgcgtgatcgccctgcacgactgcaacggcgacgtgaacagagccatcaacgtgctgctggagggcaaccccgacacccacagctgggagatggtgggcaagaagaagggcgtgagcggccagaaggacggcggccagaccgagagcaacgaggagggcaaggagaacagagacagagacagagactacagcagaagaagaggcggcccccccagaagaggcagagtgagaggccaggagaacggcctggacggcaccaagagcggcggccccagcggcagaggcaccgagagaggcagaagaggcagaggcagaggcagaggcggcagcggcagaagaggcggcagattcagcgcccagggcatgggcaccttcaaccccgccgactacgccgagcccgccaacaccgacgacaactacggcaacagcagcggcaacacctggaacaacaccggccacttcgagcccgacgacggcaccagcgcctggagaaccgccaccgaggagtggggcaccgaggactggaacgaggacctgagcgagaccaagatcttcaccgccagcaacgtgagcagcgtgcccctgcccgccgagtag

SEQ ID NO: 9969 - DNA, 549 bp, Artificial Sequence
  Description of Artificial Sequence: Synthetic coding sequence
atgatgaccagcgtgggcaccaacagagccagaggcaactgggagcagccccagaaccagaaccagacccagcacaagcagagaccccaggccaccgccgagcagatcagactggcccagatgatcagcgaccacaacgacgccgacttcgaggagaaggtgaagcagctgatcgacatcaccggcaagaaccaggacgagtgcgtgatcgccctgcacgactgcaacggcgacgtgaacagagccatcaacgtgctgctggagggcaaccccgacacccacagctgggagatggtgggcaagaagaagggcgtgagcggccagaaggacggcggccagaccgagagcaacgaggagggcaaggagaacagagacagagacagagactacagcagaagaagaggcggcccccccagaagaggcagaggcgccagcagaggcagagagttcagaggccaggagaacggcctggacggcaccaagagcggcggccccagcggcagaggcaccgagagaggcagaagaggcagaggcagaggcagaggctag

SEQ ID NO: 9970 - DNA, 705 bp, Artificial Sequence
  Description of Artificial Sequence: Synthetic coding sequence
atgatgaccagcgtgggcaccaacagagccagaggcaactgggagcagccccagaaccagaaccagacccagcacaagcagagaccccaggccaccgccgagcagatcagactggcccagatgatcagcgaccacaacgacgccgacttcgaggagaaggtgaagcagctgatcgacatcaccggcaagaaccaggacgagtgcgtgatcgccctgcacgactgcaacggcgacgtgaacagagccatcaacgtgctgctggagggcaaccccgacacccacagctgggagatggtgggcaagaagaagggcgtgagcggccagaaggacggcggccagaccgagagcaacgaggagggcaaggagaacagagacagagacagagactacagcagaagaagaggcggcccccccagaagaggcagaggcgccagcagaggcagagagttcagaggccaggagaacggcctggacggcaccaagagcggcggccccagcggcagaggcaccgagagaggcagaagaggcagaggcagaggcagaggcggcagcggcagaagaggcggcagattcagcgcccagggcatgggcaccttcaaccccgccgactacgccgagcccgccaacaccgacgacaactacggcaacagcagcggcaacacctggaacaacaccggccacttcgagcccgacgacggcacctag

SEQ ID NO: 9971 - DNA, 1989 bp, Artificial Sequence
  Description of Artificial Sequence: Synthetic coding sequence
atgcccggcagcgccgacatcagcggcctgaacctgcagttcggcgccctgcagttcggcagcgagcccgtgctgagcgactacgagagcacccccaccaccagcgccagcagcagccaggcccccagcagcctgtacaccagcaccgccagcgagagcagcagcaccatcagcagcaaccagagccaggagagcggctaccagagcggccccatccagagcaccacctacaccagccagaacaacgcccagggccccctgtacgagcagagaagcacccagaccagaagataccccagcagcatcagcagcagcccccagaaggacctgacccaggccaagaacggcttcagcagcgtgcaggccacccagctgcagaccacccagagcgtggagggcgccaccggcagcgccgtgaagagcgacagccccagcaccagcagcatcccccccctgaacgagaccgtgagcgccgccagcctgctgaccaccaccaaccagcacagcagcagcctgggcggcctgagccacagcgaggagatccccaacaccaccaccacccagcacagcagcaccctgagcacccagcagaacaccctgagcagcagcaccagcagcggcagaaccagcaccagcaccctgctgcacaccagcgtggagagcgaggccaacctgcacagcagcagcagcaccttcagcaccaccagcagcaccgtgagcgcccccccccccgtggtgagcgtgagcagcagcctgaacagcggcagcagcctgggcctgagcctgggcagcaacagcaccgtgaccgccagcaccagaagcagcgtggccaccaccagcggcaaggccccccccaacctgccccccggcgtgccccccctgctgcccaacccctacatcatggcccccggcctgctgcacgcctaccccccccaggtgtacggctacgacgacctgcagatgctgcagaccagattccccctggactactacagcatccccttccccacccccaccacccccctgaccggcagagacggcagcctggccagcaacccctacagcggcgacctgaccaagttcggcagaggcgacgccagcagccccgcccccgccaccaccctggcccagccccagcagaaccagacccagacccaccacaccacccagcagaccttcctgaaccccgccctgccccccggctacagctacaccagcctgccctactacaccggcgtgcccggcctgcccagcaccttccagtacggccccgccgtgttccccgtggcccccaccagcagcaagcagcacggcgtgaacgtgagcgtgaacgccagcgccacccccttccagcagcccagcggctacggcagccacggctacaacaccggcgtgagcgtgaccagcagcaacaccggcgtgcccgacatcagcggcagcgtgtacagcaagacccagcagagcttcgagaagcagggcttccacagcggcacccccgccgccagcttcaacctgcccagcgccctgggcagcggcggccccatcaaccccgccaccgccgccgcctacccccccgcccccttcatgcacatcctgaccccccaccagcagccccacagccagatcctgcaccaccacctgcagcaggacggccagctgccctacctgcagatgatcctgtgctgccagagacagcaggaggagcagaccggcagcggccagagaagccagaccagcagcatcccccagaagccccagaccaacaagagcgcctacaacagctacagctggcccaccgaggccctgaccctgttcagcagaagccacctgctgagaggcctgctgagcctggagaccatggagaccgccagcaagagaaaggagtgcggcggcttccccctgccccccacccccagcggccccccccacgccagcgccagctgcctgagccacagctacaccatccccaccctgctgtacgtgctgtag

SEQ ID NO: 9972 - DNA, 1593 bp, Artificial Sequence
  Description of Artificial Sequence: Synthetic coding sequence
atggaggacgacagcctgtacctgagaggcgagtggcagttcaaccacttcagcaagctgaccagcagcagacccgacgccgccttcgccgagatccagagaaccagcctgcccgagaagagccccctgagctgcgagaccagagtggacctgtgcgacgacctggcccccgtggccagacagctggcccccagagagaagctgcccctgagcagcagaagacccgccgccgtgggcgccggcctgcagaacatgggcaacacctgctacgtgaacgccagcctgcagtgcctgacctacaccccccccctggccaactacatgctgagcagagagcacagccagacctgccacagacacaagggctgcatgctgtgcaccatgcaggcccacatcaccagagccctgcacaaccccggccacgtgatccagcccagccaggccctggccgccggcttccacagaggcaagcaggaggacgcccacgagttcctgatgttcaccgtggacgccatgaagaaggcctgcctgcccggccacaagcaggtggaccaccacagcaaggacaccaccctgatccaccagatcttcggcggctactggagaagccagatcaagtgcctgcactgccacggcatcagcgacaccttcgacccctacctggacatcgccctggacatccaggccgcccagagcgtgcagcaggccctggagcagctggtgaagcccgaggagctgaacggcgagaacgcctaccactgcggcgtgtgcctgcagagagcccccgccagcaagaccctgaccctgcacaccagcgccaaggtgctgatcctggtgctgaagagattcagcgacgtgaccggcaacaagatcgccaagaacgtgcagtaccccgagtgcctggacatgcagccctacatgagccagcccaacaccggccccctggtgtacgtgctgtacgccgtgctggtgcacgccggctggagctgccacaacggccactacttcagctacgtgaaggcccaggagggccagtggtacaagatggacgacgccgaggtgaccgccagcagcatcaccagcgtgctgagccagcaggcctacgtgctgttctacatccagaagagcgagtgggagagacacagcgagagcgtgagcagaggcagagagcccagagccctgggcgccgaggacaccgacagaagagccacccagggcgagctgaagagagaccacccctgcctgcaggcccccgagctggacgagcacctggtggagagagccacccaggagagcaccctggaccactggaagttcctgcaggagcagaacaagaccaagcccgagttcaacgtgagaaaggtggagggcaccctgccccccgacgtgctggtgatccaccagagcaagtacaagtgcggcatgaagaaccaccaccccgagcagcagagcagcctgctgaacctgagcagcagcacccccacccaccaggagagcatgaacaccggcaccctggccagcctgagaggcagagccagaagaagcaagggcaagaacaagcacagcaagagagccctgctggtgtgccagtag

SEQ ID NO: 9973 - DNA, 1593 bp, Artificial Sequence; identical to SEQ ID NO: 9972
  Description of Artificial Sequence: Synthetic coding sequence

SEQ ID NO: 9974 - DNA, 1593 bp, Artificial Sequence; identical to SEQ ID NO: 9972
  Description of Artificial Sequence: Synthetic coding sequence

SEQ ID NO: 9975 - DNA, 1593 bp, Artificial Sequence; identical to SEQ ID NO: 9972
  Description of Artificial Sequence: Synthetic coding sequence

SEQ ID NO: 9976 - DNA, 1593 bp, Artificial Sequence; identical to SEQ ID NO: 9972
  Description of Artificial Sequence: Synthetic coding sequence

SEQ ID NO: 9977 - DNA, 1593 bp, Artificial Sequence; identical to SEQ ID NO: 9972
  Description of Artificial Sequence: Synthetic coding sequence

SEQ ID NO: 9978 - DNA, 1593 bp, Artificial Sequence; identical to SEQ ID NO: 9972
  Description of Artificial Sequence: Synthetic coding sequence

SEQ ID NO: 9979 - DNA, 477 bp, Artificial Sequence
  Description of Artificial Sequence: Synthetic coding sequence
atgctgctgttcgccctgctgctggccatggagctgcccctggtggccgccagcgccaccatgagagcccagtggacctacagcctgagatgccacgactgcgccgtgatcaacgacttcaactgccccaacatcagagtgtgcccctaccacatcagaagatgcatgaccatcagcatcagaatcaacagcagagagctgctggtgtacaagaactgcaccaacaactgcaccttcgtgtacgccgccgagcagccccccgaggcccccggcaagatcttcaagaccaacagcttctactgggtgtgctgctgcaacagcatggtgtgcaacgccggcggccccaccaacctggagagagacatgctgcccgacgaggtgaccgaggaggagctgcccgagggcaccgtgagactgggcgtgagcaagctgctgctgagcttcgccagcatcatcgtgagcaacatcctgccctag

SEQ ID NO: 9980 - DNA, 1584 bp, Artificial Sequence
  Description of Artificial Sequence: Synthetic coding sequence
atggccgtgcacagagtgaaggtgaccttcaaggacgagcccggcgagggcagcggcgtggccagaagcttctacaccgccatcgcccaggccttcctgagcaacgagaagctgcccaacctggagtgcatccagaacgccaacaagggcacccacaccagcctgatgcagagactgagaaacagaggcgagagagacagagagagagagagagagagagagatgagaagaagcagcggcctgagagccggcagcagaagagacagagacagagacttcagaagacagctgagcatcgacaccagacccttcagacccgccagcgagggcaaccccagcgacgaccccgagcccctgcccgcccacagacaggccctgggcgagagactgtaccccagagtgcaggccatgcagcccgccttcgccagcaagatcaccggcatgctgctggagctgagccccgcccagctgctgctgctgctggccagcgaggacagcctgagagccagagtggacgaggccatggagctgatcatcgcccacggcagagagaacggcgccgacagcatcctggacctgggcctggtggacagcagcgagaaggtgcaggagaacagaaagagacacggcagcagcagaagcgtggtggacatggacctggacgacaccgacgacggcgacgacaacgcccccctgttctaccagcccggcaagagaggcttctacacccccagacccggcaagaacaccgaggccagactgaactgcttcagaaacatcggcagaatcctgggcctgtgcctgctgcagaacgagctgtgccccatcaccctgaacagacacgtgatcaaggtgctgctgggcagaaaggtgaactggcacgacttcgccttcttcgaccccgtgatgtacgagagcctgagacagctgatcctggccagccagagcagcgacgccgacgccgtgttcagcgccatggacctggccttcgccatcgacctgtgcaaggaggagggcggcggccaggtggagctgatccccaacggcgtgaacatccccgtgaccccccagaacgtgtacgagtacgtgagaaagtacgccgagcacagaatgctggtggtggccgagcagcccctgcacgccatgagaaagggcctgctggacgtgctgcccaagaacagcctggaggacctgaccgccgaggacttcagactgctggtgaacggctgcggcgaggtgaacgtgcagatgctgatcagcttcaccagcttcaacgacgagagcggcgagaacgccgagaagctgctgcagttcaagagatggttctggagcatcgtggagaagatgagcatgaccgagagacaggacctggtgtacttctggaccagcagccccagcctgcccgccagcgaggagggcttccagcccatgcccagcatcaccatcagaccccccgacgaccagcacctgcccaccgccaacacctgcatcagcagactgtacgtgcccctgtacagcagcaagcagatcctgaagcagaagctgctgctggccatcaagaccaagaacttcggcttcgtgtag

SEQ ID NO: 9981 - DNA, 8400 bp, Artificial Sequence
  Description of Artificial Sequence: Synthetic coding sequence
atgaccagcatccacttcgtggtgcaccccctgcccggcaccgaggaccagctgaacgacagactgagagaggtgagcgagaagctgaacaagtacaacctgaacagccacccccccctgaacgtgctggagcaggccaccatcaagcagtgcgtggtgggccccaaccacgccgccttcctgctggaggacggcagagtgtgcagaatcggcttcagcgtgcagcccgacagactggagctgggcaagcccgacaacaacgacggcagcaagctgaacagcaacagcggcgccggcagaaccagcagacccggcagaaccagcgacagcccctggttcctgagcggcagcgagaccctgggcagactggccggcaacaccctgggcagcagatggagcagcggcgtgggcggcagcggcggcggcagcagcggcagaagcagcgccggcgccagagacagcagaagacagaccagagtgatcagaaccggcagagacagaggcagcggcctgctgggcagccagccccagcccgtgatccccgccagcgtgatccccgaggagctgatcagccaggcccaggtggtgctgcagggcaagagcagaagcgtgatcatcagagagctgcagagaaccaacctggacgtgaacctggccgtgaacaacctgctgagcagagacgacgaggacggcgacgacggcgacgacaccgccagcgagagctacctgcccggcgaggacctgatgagcctgctggacgccgacatccacagcgcccaccccagcgtgatcatcgacgccgacgccatgttcagcgaggacatcagctacttcggctaccccagcttcagaagaagcagcctgagcagactgggcagcagcagagtgctgctgctgcccctggagagagacagcgagctgctgagagagagagagagcgtgctgagactgagagagagaagatggctggacggcgccagcttcgacaacgagagaggcagcaccagcaaggagggcgagcccaacctggacaagaagaacacccccgtgcagagccccgtgagcctgggcgaggacctgcagtggtggcccgacaaggacggcaccaagttcatctgcatcggcgccctgtacagcgagctgctggccgtgagcagcaagggcgagctgtaccagtggaagtggagcgagagcgagccctacagaaacgcccagaaccccagcctgcaccaccccagagccaccttcctgggcctgaccaacgagaagatcgtgctgctgagcgccaacagcatcagagccaccgtggccaccgagaacaacaaggtggccacctgggtggacgagaccctgagcagcgtggccagcaagctggagcacaccgcccagacctacagcgagctgcagggcgagagaatcgtgagcctgcactgctgcgccctgtacacctgcgcccagctggagaacagcctgtactggtggggcgtggtgcccttcagccagagaaagaagatgctggagaaggccagagccaagaacaagaagcccaagagcagcgccggcatcagcagcatgcccaacatcaccgtgggcacccaggtgtgcctgagaaacaaccccctgtaccacgccggcgccgtggccttcagcatcagcgccggcatccccaaggtgggcgtgctgatggagagcgtgtggaacatgaacgacagctgcagattccagctgagaagccccgagagcctgaagaacatggagaaggccagcaagaccaccgaggccaagcccgagagcaagcaggagcccgtgaagaccgagatgggccccccccccagccccgccagcacctgcagcgacgccagcagcatcgccagcagcgccagcatgccctacaagagaagaagaagcacccccgcccccaaggaggaggagaaggtgaacgaggagcagtggagcctgagagaggtggtgttcgtggaggacgtgaagaacgtgcccgtgggcaaggtgctgaaggtggacggcgcctacgtggccgtgaagttccccggcaccagcagcaacaccaactgccagaacagcagcggccccgacgccgaccccagcagcctgctgcaggactgcagactgctgagaatcgacgagctgcaggtggtgaagaccggcggcacccccaaggtgcccgactgcttccagagaacccccaagaagctgtgcatccccgagaagaccgagatcctggccgtgaacgtggacagcaagggcgtgcacgccgtgctgaagaccggcaactgggtgagatactgcatcttcgacctggccaccggcaaggccgagcaggagaacaacttccccaccagcagcatcgccttcctgggccagaacgagagaaacgtggccatcttcaccgccggccaggagagccccatcatcctgagagacggcaacggcaccatctaccccatggccaaggactgcatgggcggcatcagagaccccgactggctggacctgccccccatcagcagcctgggcatgggcgtgcacagcctgatcaacctgcccgccaacagcaccatcaagaagaaggccgccgtgatcatcatggccgtggagaagcagaccctgatgcagcacatcctgagatgcgactacgaggcctgcagacagtacctgatgaacctggagcaggccgtggtgctggagcagaacctgcagatgctgcagaccttcatcagccacagatgcgacggcaacagaaacatcctgcacgcctgcgtgagcgtgtgcttccccaccagcaacaaggagaccaaggaggaggaggaggccgagagaagcgagagaaacaccttcgccgagagactgagcgccgtggaggccatcgccaacgccatcagcgtggtgagcagcaacggccccggcaacagagccggcagcagcagcagcagaagcctgagactgagagagatgatgagaagaagcctgagagccgccggcctgggcagacacgaggccggcgccagcagcagcgaccaccaggaccccgtgagcccccccatcgccccccccagctgggtgcccgacccccccgccatggaccccgacggcgacatcgacttcatcctggcccccgccgtgggcagcctgaccaccgccgccaccggcaccggccagggccccagcaccagcaccatccccggccccagcaccgagcccagcgtggtggagagcaaggacagaaaggccaacgcccacttcatcctgaagctgctgtgcgacagcgtggtgctgcagccctacctgagagagctgctgagcgccaaggacgccagaggcatgacccccttcatgagcgccgtgagcggcagagcctaccccgccgccatcaccatcctggagaccgcccagaagatcgccaaggccgagatcagcagcagcgagaaggaggaggacgtgttcatgggcatggtgtgccccagcggcaccaaccccgacgacagccccctgtacgtgctgtgctgcaacgacacctgcagcttcacctggaccggcgccgagcacatcaaccaggacatcttcgagtgcagaacctgcggcctgctggagagcctgtgctgctgcaccgagtgcgccagagtgtgccacaagggccacgactgcaagctgaagagaaccagccccaccgcctactgcgactgctgggagaagtgcaagtgcaagaccctgatcgccggccagaagagcgccagactggacctgctgtacagactgctgaccgccaccaacctggtgaccctgcccaacagcagaggcgagcacctgctgctgttcctggtgcagaccgtggccagacagaccgtggagcactgccagtacagaccccccagaatcagagaggacagaaacagaaagaccgccagccccgaggacagcgacatgcccgaccacgacctggagccccccagattcgcccagctggccctggagagagtgctgcaggactggaacgccctgaagagcatgatcatgttcggcagccaggagaacaaggaccccctgagcgccagcagcagaatcggccacctgctgcccgaggagcaggtgtacctgaaccagcagagcggcaccatcagactggactgcttcacccactgcctgatcgtgaagtgcaccgccgacatcctgctgctggacaccctgctgggcaccctggtgaaggagctgcagaacaagtacacccccggcagaagagaggaggccatcgccgtgaccatgagattcctgagaagcgtggccagagtgttcgtgatcctgagcgtggagatggccagcagcaagaagaagaacaacttcatcccccagcccatcggcaagtgcaagagagtgttccaggccctgctgccctacgccgtggaggagctgtgcaacgtggccgagagcctgatcgtgcccgtgagaatgggcatcgccagacccaccgcccccttcaccctggccagcaccagcatcgacgccatgcagggcagcgaggagctgttcagcgtggagcccctgccccccagacccagcagcgaccagagcagcagcagcagccagagccagagcagctacatcatcagaaacccccagcagagaagaatcagccagagccagcccgtgagaggcagagacgaggagcaggacgacatcgtgagcgccgacgtggaggaggtggaggtggtggagggcgtggccggcgaggaggaccaccacgacgagcaggaggagcacggcgaggagaacgccgaggccgagggccagcacgacgagcacgacgaggacggcagcgacatggagctggacctgctggccgccgccgagaccgagagcgacagcgagagcaaccacagcaaccaggacaacgccagcggcagaagaagcgtggtgaccgccgccaccgccggcagcgaggccggcgccagcagcgtgcccgccttcttcagcgaggacgacagccagagcaacgacagcagcgacagcgacagcagcagcagccagagcgacgacatcgagcaggagaccttcatgctggacgagcccctggagagaaccaccaacagcagccacgccaacggcgccgcccaggcccccagaagcatgcagtgggccgtgagaaacacccagcaccagagagccgccagcaccgcccccagcagcaccagcacccccgccgccagcagcgccggcctgatctacatcgaccccagcaacctgagaagaagcggcaccatcagcaccagcgccgccgccgccgccgccgccctggaggccagcaacgccagcagctacctgaccagcgccagcagcctggccagagcctacagcatcgtgatcagacagatcagcgacctgatgggcctgatccccaagtacaaccacctggtgtacagccagatccccgccgccgtgaagctgacctaccaggacgccgtgaacctgcagaactacgtggaggagaagctgatccccacctggaactggatggtgagcatcatggacagcaccgaggcccagctgagatacggcagcgccctggccagcgccggcgaccccggccaccccaaccaccccctgcacgccagccagaacagcgccagaagagagagaatgaccgccagagaggaggccagcctgagaaccctggagggcagaagaagagccaccctgctgagcgccagacagggcatgatgagcgccagaggcgacttcctgaactacgccctgagcctgatgagaagccacaacgacgagcacagcgacgtgctgcccgtgctggacgtgtgcagcctgaagcacgtggcctacgtgttccaggccctgatctactggatcaaggccatgaaccagcagaccaccctggacaccccccagctggagagaaagagaaccagagagctgctggagctgggcatcgacaacgaggacagcgagcacgagaacgacgacgacaccaaccagagcgccaccctgaacgacaaggacgacgacagcctgcccgccgagaccggccagaaccaccccttcttcagaagaagcgacagcatgaccttcctgggctgcatcccccccaaccccttcgaggtgcccctggccgaggccatccccctggccgaccagccccacctgctgcagcccaacgccagaaaggaggacctgttcggcagacccagccagggcctgtacagcagcagcgccagcagcggcaagtgcctgatggaggtgaccgtggacagaaactgcctggaggtgctgcccaccaagatgagctacgccgccaacctgaagaacgtgatgaacatgcagaacagacagaagaaggagggcgaggagcagcccgtgctgcccgaggagaccgagagcagcaagcccggccccagcgcccacgacctggccgcccagctgaagagcagcctgctggccgagatcggcctgaccgagagcgagggcccccccctgaccagcttcagaccccagtgcagcttcatgggcatggtgatcagccacgacatgctgctgggcagatggagactgagcctggagctgttcggcagagtgttcatggaggacgtgggcgccgagcccggcagcatcctgaccgagctgggcggcttcgaggtgaaggagagcaagttcagaagagagatggagaagctgagaaaccagcagagcagagacctgagcctggaggtggacagagacagagacctgctgatccagcagaccatgagacagctgaacaaccacttcggcagaagatgcgccaccacccccatggccgtgcacagagtgaaggtgaccttcaaggacgagcccggcgagggcagcggcgtggccagaagcttctacaccgccatcgcccaggccttcctgagcaacgagaagctgcccaacctggagtgcatccagaacgccaacaagggcacccacaccagcctgatgcagagactgagaaacagaggcgagagagacagagagagagagagagagagagagatgagaagaagcagcggcctgagagccggcagcagaagagacagagacagagacttcagaagacagctgagcatcgacaccagacccttcagacccgccagcgagggcaaccccagcgacgaccccgagcccctgcccgcccacagacaggccctgggcgagagactgtaccccagagtgcaggccatgcagcccgccttcgccagcaagatcaccggcatgctgctggagctgagccccgcccagctgctgctgctgctggccagcgaggacagcctgagagccagagtggacgaggccatggagctgatcatcgcccacggcagagagaacggcgccgacagcatcctggacctgggcctggtggacagcagcgagaaggtgcagcaggagaacagaaagagacacggcagcagcagaagcgtggtggacatggacctggacgacaccgacgacggcgacgacaacgcccccctgttctaccagcccggcaagagaggcttctacacccccagacccggcaagaacaccgaggccagactgaactgcttcagaaacatcggcagaatcctgggcctgtgcctgctgcagaacgagctgtgccccatcaccctgaacagacacgtgatcaaggtgctgctgggcagaaaggtgaactggcacgacttcgccttcttcgaccccgtgatgtacgagagcctgagacagctgatcctggccagccagagcagcgacgccgacgccgtgttcagcgccatggacctggccttcgccatcgacctgtgcaaggaggagggcggcggccaggtggagctgatccccaacggcgtgaacatccccgtgaccccccagaacgtgtacgagtacgtgagaaagtacgccgagcacagaatgctggtggtggccgagcagcccctgcacgccatgagaaagggcctgctggacgtgctgcccaagaacagcctggaggacctgaccgccgaggacttcagactgctggtgaacggctgcggcgaggtgaacgtgcagatgctgatcagcttcaccagcttcaacgacgagagcggcgagaacgccgagaagctgctgcagttcaagagatggttctggagcatcgtggagaagatgagcatgaccgagagacaggacctggtgtacttctggaccagcagccccagcctgcccgccagcgaggagggcttccagcccatgcccagcatcaccatcagaccccccgacgaccagcacctgcccaccgccaacacctgcatcagcagactgtacgtgcccctgtacagcagcaagcagatcctgaagcagaagctgctgctggccatcaagaccaagaacttcggcttcgtgtag

SEQ ID NO: 9982 - DNA, 8379 bp, Artificial Sequence
  Description of Artificial Sequence: Synthetic coding sequence
atgaccagcatccacttcgtggtgcaccccctgcccggcaccgaggaccagctgaacgacagactgagagaggtgagcgagaagctgaacaagtacaacctgaacagccacccccccctgaacgtgctggagcaggccaccatcaagcagtgcgtggtgggccccaaccacgccgccttcctgctggaggacggcagagtgtgcagaatcggcttcagcgtgcagcccgacagactggagctgggcaagcccgacaacaacgacggcagcaagctgaacagcaacagcggcgccggcagaaccagcagacccggcagaaccagcgacagcccctggttcctgagcggcagcgagaccctgggcagactggccggcaacaccctgggcagcagatggagcagcggcgtgggcggcagcggcggcggcagcagcggcagaagcagcgccggcgccagagacagcagaagacagaccagagtgatcagaaccggcagagacagaggcagcggcctgctgggcagccagccccagcccgtgatccccgccagcgtgatccccgaggagctgatcagccaggcccaggtggtgctgcagggcaagagcagaagcgtgatcatcagagagctgcagagaaccaacctggacgtgaacctggccgtgaacaacctgctgagcagagacgacgaggacggcgacgacggcgacgacaccgccagcgagagctacctgcccggcgaggacctgatgagcctgctggacgccgacatccacagcgcccaccccagcgtgatcatcgacgccgacgccatgttcagcgaggacatcagctacttcggctaccccagcttcagaagaagcagcctgagcagactgggcagcagcagagagagagacagcgagctgctgagagagagagagagcgtgctgagactgagagagagaagatggctggacggcgccagcttcgacaacgagagaggcagcaccagcaaggagggcgagcccaacctggacaagaagaacacccccgtgcagagccccgtgagcctgggcgaggacctgcagtggtggcccgacaaggacggcaccaagttcatctgcatcggcgccctgtacagcgagctgctggccgtgagcagcaagggcgagctgtaccagtggaagtggagcgagagcgagccctacagaaacgcccagaaccccagcctgcaccaccccagagccaccttcctgggcctgaccaacgagaagatcgtgctgctgagcgccaacagcatcagagccaccgtggccaccgagaacaacaaggtggccacctgggtggacgagaccctgagcagcgtggccagcaagctggagcacaccgcccagacctacagcgagctgcagggcgagagaatcgtgagcctgcactgctgcgccctgtacacctgcgcccagctggagaacagcctgtactggtggggcgtggtgcccttcagccagagaaagaagatgctggagaaggccagagccaagaacaagaagcccaagagcagcgccggcatcagcagcatgcccaacatcaccgtgggcacccaggtgtgcctgagaaacaaccccctgtaccacgccggcgccgtggccttcagcatcagcgccggcatccccaaggtgggcgtgctgatggagagcgtgtggaacatgaacgacagctgcagattccagctgagaagccccgagagcctgaagaacatggagaaggccagcaagaccaccgaggccaagcccgagagcaagcaggagcccgtgaagaccgagatgggccccccccccagccccgccagcacctgcagcgacgccagcagcatcgccagcagcgccagcatgccctacaagagaagaagaagcacccccgcccccaaggaggaggagaaggtgaacgaggagcagtggagcctgagagaggtggtgttcgtggaggacgtgaagaacgtgcccgtgggcaaggtgctgaaggtggacggcgcctacgtggccgtgaagttccccggcaccagcagcaacaccaactgccagaacagcagcggccccgacgccgaccccagcagcctgctgcaggactgcagactgctgagaatcgacgagctgcaggtggtgaagaccggcggcacccccaaggtgcccgactgcttccagagaacccccaagaagctgtgcatccccgagaagaccgagatcctggccgtgaacgtggacagcaagggcgtgcacgccgtgctgaagaccggcaactgggtgagatactgcatcttcgacctggccaccggcaaggccgagcaggagaacaacttccccaccagcagcatcgccttcctgggccagaacgagagaaacgtggccatcttcaccgccggccaggagagccccatcatcctgagagacggcaacggcaccatctaccccatggccaaggactgcatgggcggcatcagagaccccgactggctggacctgccccccatcagcagcctgggcatgggcgtgcacagcctgatcaacctgcccgccaacagcaccatcaagaagaaggccgccgtgatcatcatggccgtggagaagcagaccctgatgcagcacatcctgagatgcgactacgaggcctgcagacagtacctgatgaacctggagcaggccgtggtgctggagcagaacctgcagatgctgcagaccttcatcagccacagatgcgacggcaacagaaacatcctgcacgcctgcgtgagcgtgtgcttccccaccagcaacaaggagaccaaggaggaggaggaggccgagagaagcgagagaaacaccttcgccgagagactgagcgccgtggaggccatcgccaacgccatcagcgtggtgagcagcaacggccccggcaacagagccggcagcagcagcagcagaagcctgagactgagagagatgatgagaagaagcctgagagccgccggcctgggcagacacgaggccggcgccagcagcagcgaccaccaggaccccgtgagcccccccatcgccccccccagctgggtgcccgacccccccgccatggaccccgacggcgacatcgacttcatcctggcccccgccgtgggcagcctgaccaccgccgccaccggcaccggccagggccccagcaccagcaccatccccggccccagcaccgagcccagcgtggtggagagcaaggacagaaaggccaacgcccacttcatcctgaagctgctgtgcgacagcgtggtgctgcagccctacctgagagagctgctgagcgccaaggacgccagaggcatgacccccttcatgagcgccgtgagcggcagagcctaccccgccgccatcaccatcctggagaccgcccagaagatcgccaaggccgagatcagcagcagcgagaaggaggaggacgtgttcatgggcatggtgtgccccagcggcaccaaccccgacgacagccccctgtacgtgctgtgctgcaacgacacctgcagcttcacctggaccggcgccgagcacatcaaccaggacatcttcgagtgcagaacctgcggcctgctggagagcctgtgctgctgcaccgagtgcgccagagtgtgccacaagggccacgactgcaagctgaagagaaccagccccaccgcctactgcgactgctgggagaagtgcaagtgcaagaccctgatcgccggccagaagagcgccagactggacctgctgtacagactgctgaccgccaccaacctggtgaccctgcccaacagcagaggcgagcacctgctgctgttcctggtgcagaccgtggccagacagaccgtggagcactgccagtacagaccccccagaatcagagaggacagaaacagaaagaccgccagccccgaggacagcgacatgcccgaccacgacctggagccccccagattcgcccagctggccctggagagagtgctgcaggactggaacgccctgaagagcatgatcatgttcggcagccaggagaacaaggaccccctgagcgccagcagcagaatcggccacctgctgcccgaggagcaggtgtacctgaaccagcagagcggcaccatcagactggactgcttcacccactgcctgatcgtgaagtgcaccgccgacatcctgctgctggacaccctgctgggcaccctggtgaaggagctgcagaacaagtacacccccggcagaagagaggaggccatcgccgtgaccatgagattcctgagaagcgtggccagagtgttcgtgatcctgagcgtggagatggccagcagcaagaagaagaacaacttcatcccccagcccatcggcaagtgcaagagagtgttccaggccctgctgccctacgccgtggaggagctgtgcaacgtggccgagagcctgatcgtgcccgtgagaatgggcatcgccagacccaccgcccccttcaccctggccagcaccagcatcgacgccatgcagggcagcgaggagctgttcagcgtggagcccctgccccccagacccagcagcgaccagagcagcagcagcagccagagccagagcagctacatcatcagaaacccccagcagagaagaatcagccagagccagcccgtgagaggcagagacgaggagcaggacgacatcgtgagcgccgacgtggaggaggtggaggtggtggagggcgtggccggcgaggaggaccaccacgacgagcaggaggagcacggcgaggagaacgccgaggccgagggccagcacgacgagcacgacgaggacggcagcgacatggagctggacctgctggccgccgccgagaccgagagcgacagcgagagcaaccacagcaaccaggacaacgccagcggcagaagaagcgtggtgaccgccgccaccgccggcagcgaggccggcgccagcagcgtgcccgccttcttcagcgaggacgacagccagagcaacgacagcagcgacagcgacagcagcagcagccagagcgacgacatcgagcaggagaccttcatgctggacgagcccctggagagaaccaccaacagcagccacgccaacggcgccgcccaggcccccagaagcatgcagtgggccgtgagaaacacccagcaccagagagccgccagcaccgcccccagcagcaccagcacccccgccgccagcagcgccggcctgatctacatcgaccccagcaacctgagaagaagcggcaccatcagcaccagcgccgccgccgccgccgccgccctggaggccagcaacgccagcagctacctgaccagcgccagcagcctggccagagcctacagcatcgtgatcagacagatcagcgacctgatgggcctgatccccaagtacaaccacctggtgtacagccagatccccgccgccgtgaagctgacctaccaggacgccgtgaacctgcagaactacgtggaggagaagctgatccccacctggaactggatggtgagcatcatggacagcaccgaggcccagctgagatacggcagcgccctggccagcgccggcgaccccggccaccccaaccaccccctgcacgccagccagaacagcgccagaagagagagaatgaccgccagagaggaggccagcctgagaaccctggagggcagaagaagagccaccctgctgagcgccagacagggcatgatgagcgccagaggcgacttcctgaactacgccctgagcctgatgagaagccacaacgacgagcacagcgacgtgctgcccgtgctggacgtgtgcagcctgaagcacgtggcctacgtgttccaggccctgatctactggatcaaggccatgaaccagcagaccaccctggacaccccccagctggagagaaagagaaccagagagctgctggagctgggcatcgacaacgaggacagcgagcacgagaacgacgacgacaccaaccagagcgccaccctgaacgacaaggacgacgacagcctgcccgccgagaccggccagaaccaccccttcttcagaagaagcgacagcatgaccttcctgggctgcatcccccccaaccccttcgaggtgcccctggccgaggccatccccctggccgaccagccccacctgctgcagcccaacgccagaaaggaggacctgttcggcagacccagccagggcctgtacagcagcagcgccagcagcggcaagtgcctgatggaggtgaccgtggacagaaactgcctggaggtgctgcccaccaagatgagctacgccgccaacctgaagaacgtgatgaacatgcagaacagacagaagaaggagggcgaggagcagcccgtgctgcccgaggagaccgagagcagcaagcccggccccagcgcccacgacctggccgcccagctgaagagcagcctgctggccgagatcggcctgaccgagagcgagggcccccccctgaccagcttcagaccccagtgcagcttcatgggcatggtgatcagccacgacatgctgctgggcagatggagactgagcctggagctgttcggcagagtgttcatggaggacgtgggcgccgagcccggcagcatcctgaccgagctgggcggcttcgaggtgaaggagagcaagttcagaagagagatggagaagctgagaaaccagcagagcagagacctgagcctggaggtggacagagacagagacctgctgatccagcagaccatgagacagctgaacaaccacttcggcagaagatgcgccaccacccccatggccgtgcacagagtgaaggtgaccttcaaggacgagcccggcgagggcagcggcgtggccagaagcttctacaccgccatcgcccaggccttcctgagcaacgagaagctgcccaacctggagtgcatccagaacgccaacaagggcacccacaccagcctgatgcagagactgagaaacagaggcgagagagacagagagagagagagagagagagagatgagaagaagcagcggcctgagagccggcagcagaagagacagagacagagacttcagaagacagctgagcatcgacaccagacccttcagacccgccagcgagggcaaccccagcgacgaccccgagcccctgcccgcccacagacaggccctgggcgagagactgtaccccagagtgcaggccatgcagcccgccttcgccagcaagatcaccggcatgctgctggagctgagccccgcccagctgctgctgctgctggccagcgaggacagcctgagagccagagtggacgaggccatggagctgatcatcgcccacggcagagagaacggcgccgacagcatcctggacctgggcctggtggacagcagcgagaaggtgcaggagaacagaaagagacacggcagcagcagaagcgtggtggacatggacctggacgacaccgacgacggcgacgacaacgcccccctgttctaccagcccggcaagagaggcttctacacccccagacccggcaagaacaccgaggccagactgaactgcttcagaaacatcggcagaatcctgggcctgtgcctgctgcagaacgagctgtgccccatcaccctgaacagacacgtgatcaaggtgctgctgggcagaaaggtgaactggcacgacttcgccttcttcgaccccgtgatgtacgagagcctgagacagctgatcctggccagccagagcagcgacgccgacgccgtgttcagcgccatggacctggccttcgccatcgacctgtgcaaggaggagggcggcggccaggtggagctgatccccaacggcgtgaacatccccgtgaccccccagaacgtgtacgagtacgtgagaaagtacgccgagcacagaatgctggtggtggccgagcagcccctgcacgccatgagaaagggcctgctggacgtgctgcccaagaacagcctggaggacctgaccgccgaggacttcagactgctggtgaacggctgcggcgaggtgaacgtgcagatgctgatcagcttcaccagcttcaacgacgagagcggcgagaacgccgagaagctgctgcagttcaagagatggttctggagcatcgtggagaagatgagcatgaccgagagacaggacctggtgtacttctggaccagcagccccagcctgcccgccagcgaggagggcttccagcccatgcccagcatcaccatcagaccccccgacgaccagcacctgcccaccgccaacacctgcatcagcagactgtacgtgcccctgtacagcagcaagcagatcctgaagcagaagctgctgctggccatcaagaccaagaacttcggcttcgtgtag

SEQ ID NO: 9983 - DNA, 1593 bp, Artificial Sequence
  Description of Artificial Sequence: Synthetic coding sequence
atggaggacgacagcctgtacctgggcggcgagtggcagttcaaccacttcagcaagctgaccagcagcagacccgacgccgccttcgccgagatccagagaaccagcctgcccgagaagagccccctgagcagcgaggccagagtggacctgtgcgacgacctggcccccgtggccagacagctggcccccagaaagaagctgcccctgagcagcagaagacccgccgccgtgggcgccggcctgcagaacatgggcaacacctgctacgagaacgccagcctgcagtgcctgacctacaccccccccctggccaactacatgctgagcagagagcacagccagacctgccagagacccaagtgctgcatgctgtgcaccatgcaggcccacatcacctgggccctgcacagccccggccacgtgatccagcccagccaggccctggccgccggcttccacagaggcaagcaggaggacgcccacgagttcctgatgttcaccgtggacgccatgaagaaggcctgcctgcccggccacaagcaggtggaccaccacagcaaggacaccaccctgatccaccagatcttcggcggctgctggagaagccagatcaagtgcctgcactgccacggcatcagcgacaccttcgacccctacctggacatcgccctggacatccaggccgcccagagcgtgaagcaggccctggagcagctggtgaagcccgaggagctgaacggcgagaacgcctaccactgcggcctgtgcctgcagagagcccccgccagcaagaccctgaccctgcacaccagcgccaaggtgctgatcctggtgctgaagagattcagcgacgtgaccggcaacaagctggccaagaacgtgcagtaccccgagtgcctggacatgcagccctacatgagccagcagaacaccggccccctggtgtacgtgctgtacgccgtgctggtgcacgccggctggagctgccacgacggccactacttcagctacgtgaaggcccaggagggccagtggtacaagatggacgacgccaaggtgaccgcctgcagcatcaccagcgtgctgagccagcaggcctacgtgctgttctacatccagaagagcgagtgggagagacacagcgagagcgtgagcagaggcagagagcccagagccctgggcgccgaggacaccgacagaagagccacccagggcgagctgaagagagaccacccctgcctgcaggcccccgagctggacgagagactggtggagagagccacccaggagagcaccctggaccactggaagttcccccaggagcagaacaagaccaagcccgagttcaacgtgagaaaggtggagggcaccctgccccccaacgtgctggtgatccaccagagcaagtacaagtgcggcatgaagaaccaccaccccgagcagcagagcagcctgctgaacctgagcagcaccaccagaaccgaccaggagagcgtgaacaccggcaccctggccagcctgcagggcagaaccagaagaagcaagggcaagaacaagcacagcaagagagccctgctggtgtgccagtag

SEQ ID NO: 9984 - DNA, 2940 bp, Artificial Sequence
  Description of Artificial Sequence: Synthetic coding sequence
atgagccccctgaagatccacggccccatcagaatcagaagcatgcagaccggcatcaccaagtggaaggagggcagcttcgagatcgtggagaaggagaacaaggtgagcctggtggtgcactacaacaccggcggcatccccagaatcttccagctgagccacaacatcaagaacgtggtgctgagacccagcggcgccaagcagagcagactgatgctgaccctgcaggacaacagcttcctgagcatcgacaaggtgcccagcaaggacgccgaggagatgagactgttcctggacgccgtgcaccagaacagactgcccgccgccatgaagcccagccagggcagcggcagcttcggcgccatcctgggcagcagaaccagccagaaggagaccagcagacagctgagctacagcgacaaccaggccagcgccaagagaggcagcctggagaccaaggacgacatccccttcagaaaggtgctgggcaaccccggcagaggcagcatcaagaccgtggccggcagcggcatcgccagaaccatccccagcctgaccagcaccagcacccccctgagaagcggcctgctggagaacagaaccgagaagagaaagagaatgatcagcaccggcagcgagctgaacgaggactaccccaaggagaacgacagcagcagcaacaacaaggccatgaccgaccccagcagaaagtacctgaccagcagcagagagaagcagctgagcctgaagcagagcgaggagaacagaaccagcggcctgctgcccctgcagagcagcagcttctacggcagcagagccggcagcaaggagcacagcagcggcggcaccaacctggacagaaccaacgtgagcagccagacccccagcgccaagagaagcctgggcttcctgccccagcccgtgcccctgagcgtgaagaagctgagatgcaaccaggactacaccggctggaacaagcccagagtgcccctgagcagccaccagcagcagcagctgcagggcttcagcaacctgggcaacacctgctacatgaacgccatcctgcagagcctgttcagcctgcagagcttcgccaacgacctgctgaagcagggcatcccctggaagaagatccccctgaacgccctgatcagaagattcgcccacctgctggtgaagaaggacatctgcaacagcgagaccaagaaggacctgctgaagaaggtgaagaacgccatcagcgccaccgccgagagattcagcggctacatgcagaacgacgcccacgagttcctgagccagtgcctggaccagctgaaggaggacatggagaagctgaacaagacctggaagaccgagcccgtgagcggcgaggagaacagccccgacatcagcgccaccagagcctacacctgccccgtgatcaccaacctggagttcgaggtgcagcacagcatcatctgcaaggcctgcggcgagatcatccccaagagagagcagttcaacgacctgagcatcgacctgcccagaagaaagaagcccctgccccccagaagcatccaggacagcctggacctgttcttcagagccgaggagctggagtacagctgcgagaagtgcggcggcaagtgcgccctggtgagacacaagttcaacagactgcccagagtgctgatcctgcacctgaagagatacagcttcaacgtggccctgagcctgaacaacaagatcggccagcaggtgatcatccccagatacctgaccctgagcagccactgcaccgagaacaccaagccccccttcaccctgggctggagcgcccacatggccatcagcagacccctgaaggccagccagatggtgaacagctgcatcaccagccccagcacccccagcaagaagttcaccttcaagagcaagagcagcctggccctgtgcctggacagcgacagcgaggacgagctgaagagaagcgtggccctgagccagagactgtgcgagatgctgggcaacgagcagcagcaggaggacctggagaaggacagcaagctgtgccccatcgagcccgacaagagcgagctggagaacagcggcttcgacagaatgagcgaggaggagctgctggccgccgtgctggagatcagcaagagagacgccagccccagcctgagccacgaggacgacgacaagcccaccagcagccccgacaccggcttcgccgaggacgacatccaggagatgcccgagaaccccgacaccatggagaccgagaagcccaagaccatcaccgagctggaccccgccagcttcaccgagatcaccaaggactgcgacgagaacaaggagaacaagacccccgagggcagccagggcgaggtggactggctgcagcagtacgacatggagagagagagagaggagcaggagctgcagcaggccctggcccagagcctgcaggagcaggaggcctgggagcagaaggaggacgacgacctgaagagagccaccgagctgagcctgcaggagttcaacaacagcttcgtggacgccctgggcagcgacgaggacagcggcaacgaggacgtgttcgacatggagtacaccgaggccgaggccgaggagctgaagagaaacgccgagaccggcaacctgccccacagctacagactgatcagcgtggtgagccacatcggcagcaccagcagcagcggccactacatcagcgacgtgtacgacatcaagaagcaggcctggttcacctacaacgacctggaggtgagcaagatccaggaggccgccgtgcagagcgacagagacagaagcggctacatcttcttctacatgcacaaggagatcttcgacgagctgctggagaccgagaagaacagccagagcctgagcaccgaggtgggcaagaccaccagacaggccctgtag

SEQ ID NO: 9985 - DNA, 2940 bp, Artificial Sequence; identical to SEQ ID NO: 9984
  Description of Artificial Sequence: Synthetic coding sequence

SEQ ID NO: 9986 - DNA, 2940 bp, Artificial Sequence; identical to SEQ ID NO: 9984
  Description of Artificial Sequence: Synthetic coding sequence

SEQ ID NO: 9987 - DNA, 462 bp, Artificial Sequence
  Description of Artificial Sequence: Synthetic coding sequence
atggccgagctgccccacagaatcatcaaggagacccagagactgctggccgagcccgtgcccggcatcaaggccgagcccgacgagagcaacgccagatacttccacgtggtgatcgccggcgagagcaaggacagccccttcgagggcggcaccttcaagagagagctgctgctggccgaggagtaccccatggccgcccccaaggtgagattcatgaccaagatctaccaccccaacgtggacaagctggagagaatcagcctggacatcctgaaggacaagtggagccccgccctgcagatcagaaccgtgctgctgagcatccaggccctgctgaacgcccccaaccccgacgaccccctggccaacgacgtggtggagcagtggaagaccaacgaggcccaggccatcgagaccgccagagcctggaccagactgtacgccatgaacagcatctag

SEQ ID NO: 9988 - DNA, 1350 bp, Artificial Sequence
  Description of Artificial Sequence: Synthetic coding sequence
atggccgacggcgaggagcccatggccgtggacggcggctgcggcgacaccggcgactgggagggcagatggaaccacgtgaagaagttcctggagagaagcggccccttcacccaccccgacttcgagcccagcaccgagagcctgcagttcctgctggacacctgcaaggtgctggtgatcggcgccggcggcctgggctgcgagctgctgaagaacctggccctgagcggcttcagacagatccacgtgatcgacatggacaccatcgacgtgagcaacctgaacagacagttcctgttcagacccaaggacatcggcagacccaaggccgaggtggccgccgagttcctgaacgacagagtgcccaactgcaacgtggtgccccacttcaacaagatccaggacttcaacgacaccttctacagacagttccacatcatcgtgtgcggcctggacagcatcatcgccagaagatggatcaacggcatgctgatcagcctgctgaactacgaggacggcgtgctggaccccagcagcatcgtgcccctgatcgacggcggcaccgagggcttcaagggcaacgccagagtgatcctgcccggcatgaccgcctgcatcgagtgcaccctggagctgtaccccccccaggtgaacttccccatgtgcaccatcgccagcatgcccagactgcccgagcactgcatcgagtacgtgagaatgctgcagtggcccaaggagcagcccttcggcgagggcgtgcccctggacggcgacgaccccgagcacatccagtggatcttccagaagagcctggagagagccagccagtacaacatcagaggcgtgacctacagactgacccagggcgtggtgaagagaatcatccccgccgtggccagcaccaacgccgtgatcgccgccgtgtgcgccaccgaggtgttcaagatcgccaccagcgcctacatccccctgaacaactacctggtgttcaacgacgtggacggcctgtacacctacaccttcgaggccgagagaaaggagaactgccccgcctgcagccagctgccccagaacatccagttcagccccagcgccaagctgcaggaggtgctggactacctgaccaacagcgccagcctgcagatgaagagccccgccatcaccgccaccctggagggcaagaacagaaccctgtacctgcagagcgtgaccagcatcgaggagagaaccagacccaacctgagcaagaccctgaaggagctgggcctggtggacggccaggagctggccgtggccgacgtgaccaccccccagaccgtgctgttcaagctgcacttcaccagctag

SEQ ID NO: 9989 - DNA, 1392 bp, Artificial Sequence
  Description of Artificial Sequence: Synthetic coding sequence
atggccgacggcgaggagcccgagaagaagagaagaagaatcgaggagctgctggccgagaagatggccgtggacggcggctgcggcgacaccggcgactgggagggcagatggaaccacgtgaagaagttcctggagagaagcggccccttcacccaccccgacttcgagcccagcaccgagagcctgcagttcctgctggacacctgcaaggtgctggtgatcggcgccggcggcctgggctgcgagctgctgaagaacctggccctgagcggcttcagacagatccacgtgatcgacatggacaccatcgacgtgagcaacctgaacagacagttcctgttcagacccaaggacatcggcagacccaaggccgaggtggccgccgagttcctgaacgacagagtgcccaactgcaacgtggtgccccacttcaacaagatccaggacttcaacgacaccttctacagacagttccacatcatcgtgtgcggcctggacagcatcatcgccagaagatggatcaacggcatgctgatcagcctgctgaactacgaggacggcgtgctggaccccagcagcatcgtgcccctgatcgacggcggcaccgagggcttcaagggcaacgccagagtgatcctgcccggcatgaccgcctgcatcgagtgcaccctggagctgtaccccccccaggtgaacttccccatgtgcaccatcgccagcatgcccagactgcccgagcactgcatcgagtacgtgagaatgctgcagtggcccaaggagcagcccttcggcgagggcgtgcccctggacggcgacgaccccgagcacatccagtggatcttccagaagagcctggagagagccagccagtacaacatcagaggcgtgacctacagactgacccagggcgtggtgaagagaatcatccccgccgtggccagcaccaacgccgtgatcgccgccgtgtgcgccaccgaggtgttcaagatcgccaccagcgcctacatccccctgaacaactacctggtgttcaacgacgtggacggcctgtacacctacaccttcgaggccgagagaaaggagaactgccccgcctgcagccagctgccccagaacatccagttcagccccagcgccaagctgcaggaggtgctggactacctgaccaacagcgccagcctgcagatgaagagccccgccatcaccgccaccctggagggcaagaacagaaccctgtacctgcagagcgtgaccagcatcgaggagagaaccagacccaacctgagcaagaccctgaaggagctgggcctggtggacggccaggagctggccgtggccgacgtgaccaccccccagaccgtgctgttcaagctgcacttcaccagctag

SEQ ID NO: 9990 - DNA, 861 bp, Artificial Sequence
  Description of Artificial Sequence: Synthetic coding sequence
atgctgatcagcctgctgaactacgaggacggcgtgctggaccccagcagcatcgtgcccctgatcgacggcggcaccgagggcttcaagggcaacgccagagtgatcctgcccggcatgaccgcctgcatcgagtgcaccctggagctgtaccccccccaggtgaacttccccatgtgcaccatcgccagcatgcccagactgcccgagcactgcatcgagtacgtgagaatgctgcagtggcccaaggagcagcccttcggcgagggcgtgcccctggacggcgacgaccccgagcacatccagtggatcttccagaagagcctggagagagccagccagtacaacatcagaggcgtgacctacagactgacccagggcgtggtgaagagaatcatccccgccgtggccagcaccaacgccgtgatcgccgccgtgtgcgccaccgaggtgttcaagatcgccaccagcgcctacatccccctgaacaactacctggtgttcaacgacgtggacggcctgtacacctacaccttcgaggccgagagaaaggagaactgccccgcctgcagccagctgccccagaacatccagttcagccccagcgccaagctgcaggaggtgctggactacctgaccaacagcgccagcctgcagatgaagagccccgccatcaccgccaccctggagggcaagaacagaaccctgtacctgcagagcgtgaccagcatcgaggagagaaccagacccaacctgagcaagaccctgaaggagctgggcctggtggacggccaggagctggccgtggccgacgtgaccaccccccagaccgtgctgttcaagctgcacttcaccagctag

SEQ ID NO: 9991 - DNA, 2409 bp, Artificial Sequence
  Description of Artificial Sequence: Synthetic coding sequence
atgtggatccaggtgagaaccatcgacggcagcaagacctgcaccatcgaggacgtgagcagaaaggccaccatcgaggagctgagagagagagtgtgggccctgttcgacgtgagacccgagtgccagagactgttctacagaggcaagcagctggagaacggctacaccctgttcgactacgacgtgggcctgaacgacatcatccagctgctggtgagacccgaccccgaccacctgcccggcaccagcacccagatcgaggccaagccctgcagcaacagcccccccaaggtgaagaaggcccccagagtgggccccagcaaccagcccagcaccagcgccagagccagactgatcgaccccggcttcggcatctacaaggtgaacgagctggtggacgccagagacgtgggcctgggcgcctggttcgaggcccacatccacagcgtgaccagagccagcgacggccagagcagaggcaagacccccctgaagaacggcagcagctgcaagagaaccaacggcaacatcaagcacaagagcaaggagaacaccaacaagctggacagcgtgcccagcaccagcaacagcgactgcgtggccgccgacgaggacgtgatctaccacatccagtacgacgagtaccccgagagcggcaccctggagatgaacgtgaaggacctgagacccagagccagaaccatcctgaagtggaacgagctgaacgtgggcgacgtggtgatggtgaactacaacgtggagagccccggccagagaggcttctggttcgacgccgagatcaccaccctgaagaccatcagcagaaccaagaaggagctgagagtgaagatcttcctgggcggcagcgagggcaccctgaacgactgcaagatcatcagcgtggacgagatcttcaagatcgagagacccggcgcccaccccctgagcttcgccgacggcaagttcctgagaagaaacgaccccgagtgcgacctgtgcggcggcgaccccgagaagaagtgccacagctgcagctgcagagtgtgcggcggcaagcacgagcccaacatgcagctgctgtgcgacgagtgcaacgtggcctaccacatctactgcctgaacccccccctggacaaggtgcccgaggaggagtactggtactgccccagctgcaagaccgacagcagcgaggtggtgaaggccggcgagagactgaagatgagcaagaagaaggccaagatgcccagcgccagcaccgagagcagaagagactggggcagaggcatggcctgcgtgggcagaaccagagagtgcaccatcgtgcccagcaaccactacggccccatccccggcatccccgtgggcagcacctggagattcagagtgcaggtgagcgaggccggcgtgcacagaccccacgtgggcggcatccacggcagaagcaacgacggcgcctacagcctggtgctggccggcggcttcgccgacgaggtggacagaggcgacgagttcacctacaccggcagcggcggcaagaacctggccggcaacaagagaatcggcgcccccagcgccgaccagaccctgaccaacatgaacagagccctggccctgaactgcgacgcccccctggacgacaagatcggcgccgagagcagaaactggagagccggcaagcccgtgagagtgatcagaagcttcaagggcagaaagatcagcaagtacgcccccgaggagggcaacagatacgacggcatctacaaggtggtgaagtactggcccgagatcagcagcagccacggcttcctggtgtggagatacctgctgagaagagacgacgtggagcccgccccctggaccagcgagggcatcgagagaagcagaagactgtgcctgagactgcagtaccccgccggctaccccagcgacaaggagggcaagaagcccaagggccagagcaagaagcagcccagcggcaccaccaagagacccatcagcgacgacgactgccccagcgccagcaaggtgtacaaggccagcgacagcgccgaggccatcgaggccttccagctgaccccccagcagcagcacctgatcagagaggactgccagaaccagaagctgtgggacgaggtgctgagccacctggtggagggccccaacttcctgaagaagctggagcagagcttcatgtgcgtgtgctgccaggagctggtgtaccagcccgtgaccaccgagtgcttccacaacgtgtgcaaggactgcctgcagagaagcttcaaggcccaggtgttcagctgccccgcctgcagacacgacctgggccagaactacatcatgatccccaacgagatcctgcagaccctgctggacctgttcttccccggctacagcaagggcagatag

SEQ ID NO: 9992 - DNA, 411 bp, Artificial Sequence
  Description of Artificial Sequence: Synthetic coding sequence
atgtggatccaggtgagaaccatcgacggcagcaagacctgcaccatcgaggacgtgagcagaaaggccaccatcgaggagctgagagagagagtgtgggccctgttcgacgtgagacccgagtgccagagactgttctacagaggcaagcagctggagaacggctacaccctgttcgactacgacgtgggcctgaacgacatcatccagctgctggtgagacccgaccccgaccacctgcccggcaccagcacccagatcgaggccaagccctgcagcaacagcccccccaaggtgaagaaggcccccagagtgggccccagcaaccagcccagcaccagcgccagagccagactgatcgaccccggcttcggcatctacaagggcctggccctgagccccagactgtag

SEQ ID NO: 9993 - DNA, 339 bp, Artificial Sequence
  Description of Artificial Sequence: Synthetic coding sequence
atgaacgtgaaggacctgagacccagagccagaaccatcctgaagtggaacgagctgaacgtgggcgacgtggtgatggtgaactacaacgtggagagccccggccagagaggcttctggttcgacgccgagatcaccaccctgaagaccatcagcagaaccaagaaggagctgagagtgaagatcttcctgggcggcagcgagggcaccctgaacgactgcaagatcatcagcgtggacgagatcttcaagatcgagagacccggcgcccaccccctgagcttcgccgacggcaagttcctgagaagaaacgaccccgagtgcgacctgtgcggctag

SEQ ID NO: 9994 - DNA, 897 bp, Artificial Sequence
  Description of Artificial Sequence: Synthetic coding sequence
atgggccccaaggacagcgccaagtgcctgcacagaggcccccagcccagccactgggccgccggcgacggccccacccaggagagatgcggccccagaagcctgggcagccccgtgctgggcctggacacctgcagagcctgggaccacgtggacggccagatcctgggccagctgagacccctgaccgaggaggaggaggaggagggcgccggcgccaccctgagcagaggccccgccttccccggcatgggcagcgaggagctgagactggccagcttctacgactggcccctgaccgccgaggtgccccccgagctgctggccgccgccggcttcttccacaccggccaccaggacaaggtgagatgcttcttctgctacggcggcctgcagagctggaagagaggcgacgacccctggaccgagcacgccaagtggttccccagctgccagttcctgctgagaagcaagggcagagacttcgtgcacagcgtgcaggagacccacagccagctgctgggcagctgggacccctgggaggagcccgaggacgccgcccccgtggcccccagcgtgcccgccagcggctaccccgagctgcccacccccagaagagaggtgcagagcgagagcgcccaggagcccggcggcgtgagccccgccgaggcccagagagcctggtgggtgctggagccccccggcgccagagacgtggaggcccagctgagaagactgcaggaggagagaacctgcaaggtgtgcctggacagagccgtgagcatcgtgttcgtgccctgcggccacctggtgtgcgccgagtgcgcccccggcctgcagctgtgccccatctgcagagcccccgtgagaagcagagtgagaaccttcctgagctag

SEQ ID NO: 9995 - DNA, 1464 bp, Artificial Sequence
  Description of Artificial Sequence: Synthetic coding sequence
atggtgatcaacctgtgcctgccccagttcagacccagaatccactgcaacaagatcagcgccgacggctacgaggtggagaacctgatcagcgaggacctgaccaagagaagccacggcttcagaaccgagtacttcatcaagccccccgtgtacgtgaccgtgagcttccccttcaacgtggagatctgcagaatcaacatcgacctgaccgccggcggcggccagaacgtgaccggcctggagatgtacaccagcgccagcagcagcagagtgagctggaacaccccccagtgcagaaccctgggccccgccgagcccagcgtgcccgacaaggaggccttcaccctggtgggcaaggtgctgctgaagaaccagagccaggtggtgttcagccacagaggcttcaaggccagaccccccttcggcgccatggaggccaccctgcccagccccgccgtggtggcccaggagctgtggaacaagggcgccctgagcctgagccacgtggcccacctgagaatctgcatcacccacgtgaccggcggcggcatcccctgcatcaagagactggaggtgtggggccagcccgccaagacctgcagccaggaggtgatcgacagcatcctgctggtgaccagcgagaacctgccccaggacgtggccctgcaggcccccgccctgcccatggagagcgactgcgaccccggcgaccagcccgagagccagcaggcccccagcagcctgcagaagctggccgagatcatccaggacgtgcccgaggagttcctggaccccatcaccctggagatcatgccctgccccatgctgctgcccagcggcaaggtgatcgaccagagcaccctggagaagtgcaacagaagcgaggccacctggggcagagtgcccagcgaccccttcaccggcgtggccttcaccccccacagccagcccctgccccaccccagcctgaaggccagaatcgaccacttcctgctgcagcacagcatccccggctgccacctgctgggcagagcccagaccgccctggccgtgatccccagcagcatcgtgctgcccagccagaagagaaagatcgagcaggccgagcacgtgcccgacagcaacttcggcgtgaacgccagctgcttcagcgccaccagccccctggtgctgcccaccaccagcgagcacaccgccaagaagatgaaggccaccaacgagcccagcctgacccacatggactgcagcaccgagcagcccggcagcatcctgggccccgagtgcgccagctgcaagagagtgttcagcccctacttcaagaaggagcccgtgtaccagctgccctgcggccacctgctgtgcagaccctgcctgggcgagaagcagagaagcctgcccatgacctgcaccgcctgccagagacccgtggccagccaggacgtgctgagagtgcacttctag

SEQ ID NO: 9996 - DNA, 267 bp, Artificial Sequence
  Description of Artificial Sequence: Synthetic coding sequence
atggtgatcaacctgtgcctgccccagttcagacccagaatccactgcaacaagatcagcgccgacggctacgaggtggagaacctgatcagcgaggacctgaccaagagaagccacggcttcagaaccgagtacttcatcaagccccccgtgtacgtgaccgtgagcttccccttcaacgtggagatctgcagaatcaacatcgacctgaccgccggcggcggccagaacgtgaccggcctggagatgtacaccagcgccagctag

SEQ ID NO: 9997 - DNA, 1605 bp, Artificial Sequence
  Description of Artificial Sequence: Synthetic coding sequence
atggccagaggcctgcaggtgcccctgcccagactggccaccggcctgctgctgctgctgagcgtgcagccctgggccgagagcggcaaggtgctggtggtgcccaccgacggcagcccctggctgagcatgagagaggccctgagagagctgcacgccagaggccaccaggccgtggtgctgacccccgaggtgaacatgcacatcaaggaggagaagttcttcaccctgaccgcctacgccgtgccctggacccagaaggagttcgacagagtgaccctgggctacacccagggcttcttcgagaccgagcacctgctgaagagatacagcagaagcatggccatcatgaacaacgtgagcctggccctgcacagatgctgcgtggagctgctgcacaacgaggccctgatcagacacctgaacgccaccagcttcgacgtggtgctgaccgaccccgtgaacctgtgcggcgccgtgctggccaagtacctgagcatccccgccgtgttcttctggagatacatcccctgcgacctggacttcaagggcacccagtgccccaaccccagcagctacatccccaagctgctgaccaccaacagcgaccacatgaccttcctgcagagagtgaagaacatgctgtaccccctggccctgagctacatctgccacaccttcagcgccccctacgccagcctggccagcgagctgttccagagagaggtgagcgtggtggacctggtgagctacgccagcgtgtggctgttcagaggcgacttcgtgatggactaccccagacccatcatgcccaacatggtgttcatcggcggcatcaactgcgccaacggcaagcccctgagccaggagttcgaggcctacatcaacgccagcggcgagcacggcatcgtggtgttcagcctgggcagcatggtgagcgagatccccgagaagaaggccatggccatcgccgacgccctgggcaagatcccccagaccgtgctgtggagatacaccggcaccagacccagcaacctggccaacaacaccatcctggtgaagtggctgccccagaacgacctgctgggccaccccatgaccagagccttcatcacccacgccggcagccacggcgtgtacgagagcatctgcaacggcgtgcccatggtgatgatgcccctgttcggcgaccagatggacaacgccaagagaatggagaccaagggcgccggcgtgaccctgaacgtgctggagatgaccagcgaggacctggagaacgccctgaaggccgtgatcaacgacaagagctacaaggagaacatcatgagactgagcagcctgcacaaggacagacccgtggagcccctggacctggccgtgttctgggtggagttcgtgatgagacacaagggcgccccccacctgagacccgccgcccacgacctgacctggtaccagtaccacagcctggacgtgatcggcttcctgctggccgtggtgctgaccgtggccttcatcaccttcaagtgctgcgcctacggctacagaaagtgcctgggcaagaagggcagagtgaagaaggcccacaagagcaagacccactag

SEQ ID NO: 9998 - DNA, 1596 bp, Artificial Sequence
  Description of Artificial Sequence: Synthetic coding sequence
atgatggacggcagactgctggagcacccccacgcccagttcggcggcagcctgggcggcgtggtgggcttcccctaccccctgggccaccaccacgtgtacgagctggccggccaccagctgcagagcgccgccgccgccgccagcgtgcccttcagcatcgacggcctgctgggcggcagctgcgccgccgccgccagcgtggtgaaccccacccccctgctgcccgccgcctgcggcgtgggcggcgacggccagcccttcaagctgagcgacagcggcgaccccgacaaggagagccccggctgcaagagaagaagaaccagaaccaacttcaccggctggcagctggaggagctggagaaggccttcaacgagagccactaccccgacgtgttcatgagagaggccctggccctgagactggacctggtggagagcagagtgcaggtgtggttccagaacagaagagccaagtggagaaagaaggagaacaccaagaagggccccggcagacccgcccacaacagccaccccaccacctgcagcggcgagcccatggaccccgaggagatcgccagaaaggagctggagaagatggagaagaagaagagaaagcacgagaagaagctgctgaagagccagggcagacacctgcacagccccggcggcctgagcctgcacagcgcccccagcagcgacagcgacagcggcggcggcggcctgagccccgagccccccgagccccccccccccgccgccaagggccccggcgcccacgccagcggcgccgccggcaccgcccccgccccccccggcgagccccccgcccccggcacctgcgaccccgccttctaccccagccagagaagcggcgccggcccccagcccagacccggcagacccgccgacaaggacgccgccagctgcggccccggcgccgccgtggccgccgtggagagaggcgccgccggcctgcccaaggccagccccttcagcgtggagagcctgctgagcgacagcccccccagaagaaaggccgccagcaacgccgccgccgccgccgccgccggcctggacttcgcccccggcctgccctgcgcccccagaaccctgatcggcaagggccacttcctgctgtaccccatcacccagcccctgggcttcctggtgccccaggccgccctgaagggcggcgccggcctggagcccgcccccaaggacgccccccccgcccccgccgtgccccccgccccccccgcccaggccagcttcggcgccttcagcggccccggcggcgcccccgacagcgccttcgccagaagaagccccgacgccgtggccagccccggcgcccccgcccccgcccccgcccccttcagagacctggccagcgccgccgccaccgagggcggcggcggcgactgcgccgacgccggcaccgccggccccgccccccccccccccgcccccagccccagacccggccccagaccccccagccccgccgaggagcccgccacctgcggcgtgcccgagcccggcgccgccgccggccccagcccccccgagggcgaggagctggacatggactag

SEQ ID NO: 9999 - DNA, 255 bp, Artificial Sequence
  Description of Artificial Sequence: Synthetic coding sequence
atggccctgagcagccagatctgggccgcctgcctgctgctgctgctgctgctggccagcctgaccagcggcagcgtgttcccccagcagaccggccagctggccgagctgcagccccaggacagagccggcgccagagccagctggatgcccatgttccagagaagaagaagaagagacacccacttccccatctgcatcttctgctgcggctgctgccacagaagcaagtgcggcatgtgctgcaagacctag

SEQ ID NO: 10000 - DNA, 840 bp, Artificial Sequence
  Description of Artificial Sequence: Synthetic coding sequence
atggacatgctggaccccggcctggaccccgccgccagcgccaccgccgccgccgccgccagccacgacaagggccccgaggccgaggagggcgtggagctgcaggagggcggcgacggccccggcgccgaggagcagaccgccgtggccatcaccagcgtgcagcaggccgccttcggcgaccacaacatccagtaccagttcagaaccgagaccaacggcggccaggccgtgatccagaaccccttcagcaacggcggcagccccgccgccgaggccgtgagcggcgaggccagattcgcctacttccccgccagcagcgtgggcgacaccaccgccgtgagcgtgcagaccaccgaccagagcctgcaggccggcggccagttctacgtgatgatgaccccccaggacgtgctgcagaccggcacccagagaaccatcgcccccagaacccacccctacagccccaagatcgacggcaccagaacccccagagacgagagaagaagagcccagcacaacgaggtggagagaagaagaagagacaagatcaacaactggatcgtgcagctgagcaagatcatccccgactgcaacgccgacaacagcaagaccggcgccagcaagggcggcatcctgagcaaggcctgcgactacatcagagagctgagacagaccaaccagagaatgcaggagaccttcaaggaggccgagagactgcagatggacaacgagctgctgagacagcagatcgaggagctgaagaacgagaacgccctgctgagagcccagctgcagcagcacaacctggagatggtgggcgagggcaccagacagtag

SEQ ID NO: 10001 - DNA, 648 bp, Artificial Sequence
  Description of Artificial Sequence: Synthetic coding sequence
atggacatgctggaccccggcctggaccccgccgccagcgccaccgccgccgccgccgccagccacgacaagggccccgaggccgaggagggcgtggagctgcaggagggcggcgacggccccggcgccgaggagcagaccgccgtggccatcaccagcgtgcagcaggccgccttcggcgaccacaacatccagtaccagttcagaaccgagaccaacggcggccagaccggcacccagagaaccatcgcccccagaacccacccctacagccccaagatcgacggcaccagaacccccagagacgagagaagaagagcccagcacaacgaggtggagagaagaagaagagacaagatcaacaactggatcgtgcagctgagcaagatcatccccgactgcaacgccgacaacagcaagaccggcgccagcaagggcggcatcctgagcaaggcctgcgactacatcagagagctgagacagaccaaccagagaatgcaggagaccttcaaggaggccgagagactgcagatggacaacgagctgctgagacagcagatcgaggagctgaagaacgagaacgccctgctgagagcccagctgcagcagcacaacctggagatggtgggcgagggcaccagacagtag

SEQ ID NO: 10002 - DNA, 6816 bp, Artificial Sequence
  Description of Artificial Sequence: Synthetic coding sequence
atgggcgtgcccaagagaaaggccagcggcggccaggacggcgccgccagcagcgccggcgccgccaagagagccagaaaggaggagctgaccggcgtgagattcaaggcccagctgaaggacccccagggccccggccccggcctggaggccttcgtgagcgccgccaagaagctgcccagagaggacgtgtacgacgtggtggagggctacatcaagatcagcgtggagtgcgtggagatcttccagctgctgagcggcgagaagagacccgagagcgagaccatgctgatcttccaggtgttcgaggccatcctgctgagaaccgccagcgacctgagccacttccacgtggtgggcaccaacatcgtgaagaagctgatgaacaaccacatgaagctgatctgcgagagcctgtacgccagcggctacagactggccagagcctgcctgagcctgatgaccgccatggtgacccagggccccgaggccgccagagacgtgtgcagccacttcgacctgaacaagaagaccctgtacaccctggtgaccaagagagacagcaagggcgtgtacgacgtgagacaggcctacgtgcagttcgccctgagcttcctgatcgccggcgacgacagcaccatcgtgcaggtgctggaggtgaaggagttcatcccctgcatcttcagcagcggcatcaaggaggacagaatcagcaccatcaacatcctgctgagcaccctgaagaccaaggtggtgcacaacaagaacatcaccaagacccagaaggtgagattcttcaccggccagctgctgaaccacatcgccagcctgtacaactggaacggcatcaccgacgtgaaccccgagaacgtgaaggtgagcgccgaggaggccggcaagaccatggtgagagagctggtgcacaacttcctgatggacctgtgctgcagcctgaagcacggcatcaacttctacgacgccagcctgggcaccttcggcagaggcggcaacctgaccctgctgcacttcctgctgggcctgaagaccgccgccgacgacgacctggtggccgacctggtggtgaacatcctgaaggtgtgccccgacctgctgaacaagtacttcaaggaggtgaccttcagcttcatccccagagccaagagcacctggctgaacaacatcaagctgctgaacaagatctacgaggcccagcccgagatcagcagagccttccagaccagagagttcatccccctgcccagactgctggccatggtgatggtgaccaccgtgcccctggtgtgcaacaagagcatgttcacccaggccctgaacctggacagcaccagcgtgagacacaccgccctgagcctgatcagcgtgatcctgaagagagccctgaagaccgtggaccactgcctgaacaaggaggtgtggcaggagagcggcgtgtacaccgccgtgatgatggaggagttcgtgcagctgttcagagaggccctgagcaagatcctgcccgacctgaacaccgtggtgtgggtgtggcagagcctgaagaagcaggagaccaagcaggacgacaagaagggccagaagagaagcgacggcccccccgccgcctgcgacgcccaccagtgcgacgacgccgagaccatcctgctgaaggccgtgctgctgcaggtgatctgcctgtaccagaaggtggtgccccacgtggtgatgcagtacaacttcgacttcagcaagctgctgaagggcgtgatcagcgagcagggcctgagagaggaggtgccccccatcctgcagcaccacatgctgaaggtggccctggagctgcccgccagcaagttcctgtggctgaaggcccaggagggccccgacgccgagatcatcggcggcgagagaagcgtgttctacctgctgatgaagatgttcgtgaccagcagccacctgcagctgaagagcctgaccaagctgctgatcatgaagatcctgagagacaccggcgtgttcgagcacacctggaaggagctggagctgtggctggagcacctggagaacaccatggaggaggacaaggagaccgtgatccagttcctggagagaatcctgctgaccctggtggccaacccctacagctacaccgacaaggccagcgacttcgtgcaggaggccagcatgctgcaggccaccatgaccaagcaggaggccgacgacatgagcatccccatcagccacatcgacgacgtgctggacatggtggacgtgctggtggagggcagcgagggcctggacgaggagatcggcttcaccctgagcgaggacatgatcctgctgaccttccccttcagcgccgtggtgcccgccgccctggaggccagaaacaagctgctgctgggcaccggcaacgaggccgccgagaacgtggtgacctacctgaccgccgtgctgaccgacctgctgcacacccagagagaccccctggccctgtgcctgctgctgcaggcctacgacaagctggagcccccctgcctggtgccctgctgccagcagctgagcagattcaacagatactacagcctgtggatccccgagcaggccagagaggcctggctgctgcaggcccagggcagccccagcccccccgccctgcccctggccagcagcttcaccgccctgctgcaggccgcctacgagagccaggccctgagagacgagcacatccaggtgcagctgcaggccaccatgccccacctgagcatgcagcaggtgctgctggccgccaagcaggtgctgctgtacctgagaagcaccgtggagaacttcggccagctgggcagaagcgtgggcccccccctgctgcagctgttcctggacctgctgagaagactggtggtgcactgcgagcagctggacgcccagaaccagcagagatgcgaggccgccagagccgaggccgacctgttcctggacatggagagcgtggccagcctggagctggccaacgaccagaccctggaggaggtgctggtggccatcctgagacaccccaccctggagggctggttcctggccctggagcagcaggccctgcccccccacaccctgagccccgtgctggtgaagctgctggccacccacttcagcgccggcgtgctgcagctgctggccgccagcgcccccatcctgcagaacatcggccagctgggcctgctggccagatacagcgaggccatcacccagagcgtgctgaaggagctgcagaacagaagagccggccccgccaccagcccccccaagacccccccccagctggaggccctgcaggagctgcacccctacatggagggcgcccagctgagagaggtgaccctggccctgctgagcctgcccgagacccacctggtgacccagcagcccaccaagagccccggcaaggagagacacctgaacgccctgggcaagaccctggtgcagctgctgacctgcagcccccaggaccagctgcagagcggcgagctgctgtggagcagcgagtacgtgagaggcctgggcgccctgctgcccaccctggccgtggacgagctggacaccgtgctgctgcacaccctgcagagagaccccgtgctggcccccgccgtgggcgccgacctgctggactactgcctggccagaagaacccaggccgccctgagcatcgccgccctgctgctgcaggagagctgcacccacctgctgtggttcgagcagtggtgcctgcaggccggccccggcctgggcctgcagggcgacctggacgacttcctgcccctgatccacgtgtacctgcagtgcagaaccagaagccacttcaccagacccgccggcgtgagcagcgccgtgatccccgtgctgagaaagaccctgtggagacagctgcagagcagactgctgagcaccgacagcccccccgccagcggcctgtaccaggagatcctggcccagctggtgcccttcgccagagccaaggacctgagcgtgctgatggacagactgcccagcctgctgcacacccccagcagccacaagagatggatcgtggccgacagcatcagcgccgccctggagggcagcgccgaggagctgtgcgcctggagaagaaccctgctggagagctgcgtgaagtggctgatcgtgagcttcagcggcggccagcaggacgacgacaacacccagaaccaggagaaggagatgctgctgagactgaacgccctgctgcacgccctgaacgaggtggaccccggcgactggcagaagttcgtgaagaagggcctgaagttcagataccaggaccacaccttcctgaagatgctgctgaccgccgtgcagctgctgtacagccccgagagcagcgtgagaaccaagctgatccagctgcccgtggtgtacgtgatgctgatgcagcacagcctgttcctgcccaccctgctgaccagcgacggcgaggagagccccgacagccaggtgaaggaggccctggtggacctgatgctgaccgtggtggagatgtgccccagcgtgtgcgagagcagccacttcgccgtgctgctgggcgcctacggcgccaccctgagcgtgctggaccagaagatcctgctgctgctgagagcctacgagcagaacaagctgagcctgatcaacttcagagtgctgctgtggggccccgccgccgtggagcaccacaagacctgcagaagcctgggcagaagcctgtggcagcagcccagcgtgggcgacatcctgagactgctggacagagacagaatgatgcagaccatcctgcacttcccccagaacagaagactgctgccccccgaggacacccaggagctgatcttcaaggacaagagcagagtggacctggacggcctgtacgacccctgcttcctgctgcagctgttcagcgagctgaccagacccgagttcgtggtggactgcagaaagttcctggacagcaacgccctgggcctgaccgtgaccgccctgagcagctacgacccccagatgagagccatcgcctaccacgtgctggccgcctactacagccacctggagggcgccagattccaggagcagagccagctgctgtacctgctggacgtggtgagaaacggcatcagaacccaggacatgagactgaccttcaccctggccctgttcatcgccaaggccgccctgcagatcctgaagcccgaggagcacatgtacctgaaggtgagcaacttcctgctgagccacgagtacctgaacatggacaaggtgcccggcttctaccagttcttctacagcagcgacttcgagcagaagaccgagcagaagtgggtgttcggcgtgctgagacagggcatcagagacaagcagtgctacgagctgtgcgccagaagaggcatcttccacatcatcctgagcttcttccacagccccctgtgcgacgaggccgcccagaactggatcctggagatcctgcagaacgccgcccaggtggccagaagcgcctacgagatcatcagagactacagcctgctgacctggatcctgcacatcctggagagcaagttcctggagacccccctgctgagcaacgtgatcagcctgctgcacaccctgtgggtgaccaacctgggcgacaaggccgtggagtgggagagccagagactgtgccagcccagcagccaggagcccgccaagagactggccctgcacctggtgaacgagttcctgtacgtgctgatcgtgctgatgaagcacctgagacccaccctggcccccgtgcagctgaccaacttcttcggcaccctggacagcgtgctgagatacagagccaccgtgatccaggccttcagagacatgaacagattcaccgtgaacgagaccgtgctgagcaccaaggacgtgctggtgctgctgcacaagtggagcctgatcgagagagacctgaagctgcaggaggacctgagagccgccatcgagaaggcccaggccagagagctgatgaagatgctgaaggacaagaacaagcccgtgatgcccgccagagccaagggccccagaggcagaaagagaagacccggcgaggccgaggagatggccgaccccgagctgatggccagcaccctggagacctgcaagggcctgctgagaagcatcctgacctactggagacccgtgatccccggccccgaccccacccaggagcccgtggacagcgccagccccgagagcgacgcccccggccccgtgtacgccgccgccagcctggccgtgagctgggtgctgagaagcgtggccgagcaccccctgagcagagccgaggccgccggcctgatcggctggctgaagagccacatcctgccccaccccgtggtggtggccgacctgctgaaggacagcgccgtgagaagcagcatcttcagactgtacagcagactgtgcggcgccgagggcctggccggccccgtgcaggaggtggcctgcctgttcaacaccgtgatgctgcagctggtggccgcccagggcagagccggcagccccttccaccccgccatggaggccctgagcctgagcagcctgagcgagaaggacgaggccacccaggccagcgccgccttcctggtgagcctgtacatcaaggacatctggctgggcgcccagagacccgacaccctgctgacccacgtgagaatggtgtgcgaggccgccgacgacgcccccagcagcgaggaggaggccatcgtggtgctgtgcaaggacgccgccagcgccgccagcgacgcctag

SEQ ID NO: 10003 - DNA, 4575 bp, Artificial Sequence
  Description of Artificial Sequence: Synthetic coding sequence
atggccgccgtgtacagcggcatcagcctgaagctgaagagcaagaccaccagctgggaggacaagctgaagctggcccacttcgcctggatcagccaccagtgcttcctgcccaacaaggagcaggtgctgctggactgggccagacagagcctggtggccttctacaagaagaagctggagctgaaggaggacatcgtggagagactgtggatctacatcgacaacatcctgcacagcagaaagctgcagaacctgctgaagaacggcaagaccatcaacctgcagatcagcctggtgaagatcatcaacgagagagtggccgagttcagcctgagcggcagccagagaaacatctgcgccgtgctgagatgctgccagggcatcctgagcacccccgccctggccgtgatctacaccgccaagcaggagctgatggtggccctgctgagccagctgtgctggagcgcctgcagacagcccgagggcgccgtggtggcccagctgttcgaggtgatccacctggccctgggccactacctgctgatcctgcagcagcaggtgaaccccagaagagccttcggcgacgtgaccgcccacctgctgcagccctgcctggtgctgagacacctgctgagcggcggcacctggacccaggccggccagggccagctgagacaggtgctgagcagagacatcagaagccagatcgaggccatgttcagaggcggcatcttccagcccgagctgctgagcagctacaaggagggcctgctggaccagcagcagggcgacgtgaagaccggcgccatgaagaacctgctggcccccatggacaccgtgctgaacagactggtggacgccggctactgcgccgccagcctgcacaccagcgtggtggccaacagcgtggccctgctgtacaagctgttcctggacagctacttcaaggagggcaaccagctgctgtgcttccaggtgctgcccagactgttcggctgcctgaagatcagccacctgcaggaggagcagagcaaggccctgagcaccagcgactggaccaccgagctgctggtggtggagcagctgctgaacagcgtggccaacaacaacatctacaacatcgccgccgacagaatcagacacgaggaggcccagttcagattctacagacacgtggccgagctgctgatcaaccacgcccaggcccccatccccgcctggttcagatgcctgaagaccctgatcagcctgaaccacctgatcctggagcccgacctggacgacctgctggccagcgcctggatcgacgccgaggtgaccgagttcagaaccaagaaggcccaggaggccctgatcagaaccgtgttccagacctacgccaagctgagacaggtgcccagactgttcgaggaggtgctgggcgtgatctgcagacccgccgccgaggccctgagacagcccgtgctggccagcggccccagcaccgtgctgagcgcctgcctgctggagctgccccccagccagatcctggacacctggagcctggtgctggagaagttccagagcctggtgctgccctacctgcagagcgacgccgacatggccctgaagagcctgagcctgagcctgctgctgcactgcatcatgttcaacatgagaagcctggacagcagcacccccctgcccatcgtgagaagaacccagtgcatgatggagagaatgatgagagagctggtgcagcccctgctggccctgctgcccgacacccccggccccgagcccgagctgtggctgcagaaggtgagcgacagcgtgctgctgctgagctacacctgggcccaggtggacgccatgttcagcctgaactgcagccagtaccacagcatgagcggccccctgatcggcgtggccctggagatcagcaacctgcccagcctgctgcccggcgtgaagacccagcactggaagaagatcgagaagttcaccgcccagttcagcagcctgggcacctactgcctggagcagctgtacctgcagaagatgaagagaaccctgatgcagaccagcttcagaagcgagggcgccatccagagcctgagatgcgacgccgccttcatcatcggcagcggcagaaagagcctgaaccagagaaccaccgccagctgggacggccaggtgggcatggtgagcggcctgacctaccccgtggcccactggcacctgatcgtgagcaacctgaccatcctgatcagctacctgtgccccgacgacgtgggctacctggccagcgtgctgctgagaaccctgcccatgggcaaggcccaggaggtgagcatcgacgaggaggcctacatcaccctggagaagatcagcaaggccttcctgcacagccccctgttccccgagatgcagagcctgcacagcgccttcctgacctgcgtgaccaccagctgcagcagcatcctgtgcagcggcgcccagagagacagcggcctggtgagccagcagctgccctggctgttcgagaaggaccacatggtggtgggccactgggagaacagattcgccaaggccggccccgagggcatcgagcccagaggcgagatcgcccagaacctgctgagcctggtgaagagcgacttccccatccagctggagggcgagcagctggagagcatcctgggcctgctggaggtgatcagcgccctgcagctggacagcctgctgcccccctaccacgtgcactacttcctggtgctgctgagcatggccgtgaccaagctgggctgcagctgcagcagcagcctggccctgaagttcctgaccacctgctaccagctgctgggctacctgcagaagggcaagagcgccagaagcgtgttcaagatcatgtacggcagcgacatcttcgaggtggtgctgaccagcctgttcagagccagcagcagattcctgatcgagatggacgaccccgcctggctggagttcctgcaggtgatcggcaccttcctggaggagctgatgcagatgctgatccagatgaagctgagcctggtgctgaacttcagaaagatcaccgccttcctgagcagcagcaagccctacaccgaggccgccagcagcaagcagctggagaaccagaacccccagggcagacagctgctgctggtgagcctgaccagactgtgccacgtgctgggccccttcctgaaggagcagaagctgggccaggaggcccccgccgccctgagcgagctgctgcagcaggtggtgctgcagaccggcgccgtgctgcagctgtgcagcgtgcccggcgccagaggctggagactgcccagcgtgctgatcagcagcgtgagcaccctgctggaggccgacctgggccagcactgcagagacggcggcgccgacatcagccagggcagcgacagaaccctgctgagccacgtggccctgtaccagggcgtgtacagccagatcctgctggagctgcccgccctggccggccacgaccagagcttccaggccgccctgcagttcctgaccctgttcttcctggcccccgagctgcaccccaagaaggacagcgtgttcaccagcatgttccacagcgtgagaagagtgctggccgaccccgagatccccgtgcaggtgacccaggacatcgagccccacctgggcgccctgttcacccagatgctggaggtgggcaccaccgaggacctgagactggtgatgcagtgcatcctgcagggcctggacgtgagcaacatgtggaaggccgacgtgcaggccgtggtgagcgccgtgaccctgctgagactgctgctgaactgccccctgagcggcgagaaggccagcctgctgtggagagcctgcccccagatcgtgaccgccctgaccctgctgaacagagaggccagccaggagcagcccgtgagcctgaccgtggtgggccccgtgctggacgtgctggccgccctgctgagacagggcgaggaggccatcggcaacccccaccacgtgagcctggccttcagcatcctgctgaccgtgcccctggaccacctgaagcccctggagtacggcagcgtgttccccagactgcacaacgtgctgttcagcatcctgcagtgccaccccaaggtgatgctgaaggccatccccagcttcctgaacagcttcaacagactggtgttcagcgtgatgagagagggcagacagaaggacaagggcagcatcgacgacctgcccaccgtgctgaagtgcgccagactggtggagagaatgtacagccacatcgccgccagagccgaggagttcgccgtgttcagccccttcatggtggcccagtacgtgctggaggtgcagaaggtgaccctgtaccccgccgtgaagagcctgctgcaggagggcatctacctgatcctggacctgtgcatcgagcccgacgtgcagttcctgagagccagcctgcagcccggcatgagagacatcttcaaggagctgtacaacgactacctgaagtaccacaaggccaagcacgagggcgagaagagatacaccgcctag

SEQ ID NO: 10004 - DNA, 255 bp, Artificial Sequence
  Description of Artificial Sequence: Synthetic coding sequence
atgctgaaggccatccccagcttcctgaacagcttcaacagactggtgttcagcgtgatgagagagggcagacagaaggacaagggcagcatcgacgacctgcccaccgtgctgaagtgcgccagactggtggagagaatgtacagccacatcgccgccagagccgaggagttcgccgtgttcagccccttcatggtggcccagtacgtgctggaggtgcagaaggtgaccctgtaccccgccgtgaagagctag

SEQ ID NO: 10005 - DNA, 1812 bp, Artificial Sequence
  Description of Artificial Sequence: Synthetic coding sequence
atgaagggcgacttcagaaagaagaagagcgaggccagaacccccctggagcaggagatcttcaacctgctgcacaagaacaagcagcccgtgaccgaccccctgctgacccccgtggagaaggccagcctgagagccatgagcctggaggaggccaagatgagaagagccgagctgcagagagccagagccctgcagagctactacgaggccaaggccagaagagagaagaagatcaagagcaagaagtaccacaaggtggtgaagaagggcaaggccaagaaggccctgaaggagttcgagcagctgagaaaggtgaaccccgccgccgccctggaggagctggagaagatcgagaaggccagaatgatggagagaatgagcctgaagcaccagaacagcggcaagtgggccaagagcaaggccatcatggccaagtacgacctggaggccagacaggccatgcaggagcagctgagcaagaacaaggagctgacccagaagctgcaggtggccagcgagagcgaggaggaggagggcggcaccgaggacgtggaggagctgctggtgcccgacgtggtgaacgaggtgcagatgaacgccgacggccccaacccctggatgctgagaagctgcaccagcgacaccaaggaggccgccacccaggaggaccccgagcagctgcccgagctggaggcccacggcgtgagcgagagcgagggcgaggagagacccgtggccgaggaggagatcctgctgagagagttcgaggagagaagaagcctgagaaagagaagcgagctgagccaggacgccgagcccgccggcagccaggagaccaaggacagcggcagccaggaggtgctgagcgagctgagagtgctgagccagaagctgaaggagaaccaccagagcagaaagcagaaggccagcagcgagggcaccatcccccaggtgcagagagaggagcccgcccccgaggaggaggagcccctgctgctgcagagacccgagagagtgcagaccctggaggagctggaggagctgggcaaggaggagtgcttccagaacaaggagctgcccagacccgtgctggagggccagcagagcgagagaacccccaacaacagacccgacgcccccaaggagaagaagaagaaggagcagatgatcgacctgcagaacctgctgaccacccagagccccagcgtgaagagcctggccgtgcccaccatcgaggagctggaggacgaggaggagagaaaccacagacagatgatcaaggaggccttcgccggcgacgacgtgatcagagacttcctgaaggagaagagagaggccgtggaggccagcaagcccaaggacgtggacctgaccctgcccggctggggcgagtggggcggcgtgggcctgaagcccagcgccaagaagagaagaagattcctgatcaaggcccccgagggcccccccagaaaggacaagaacctgcccaacgtgatcatcaacgagaagagaaacatccacgccgccgcccaccaggtgagagtgctgccctaccccttcacccaccactggcagttcgagagaaccatccagacccccatcggcagcacctggaacacccagagagccttccagaagctgaccacccccaaggtggtgaccaagcccggccacatcatcaaccccatcaaggccgaggacgtgggctacagaagcagcagcagaagcgacctgagcgtgatccagagaaaccccaagagaatcaccaccagacacaagaagcagctgaagaagtgcagcgtggactag

SEQ ID NO: 10006 - DNA, 2154 bp, Artificial Sequence
  Description of Artificial Sequence: Synthetic coding sequence
atgagaggcaccatgatggagagagagagcatcaagagcttctggaagcagagcgtgcccctgatggagagaatcggcagcggcgagaagctggtgctggccgacctgctggagcccgtgaagaccagcagcagcctggccaccgtgaagaagcagctgagcagagtgaagagcaagaagaccgtggagctgcccctgaacaaggaggagatcgagagaatccacagagaggtggccttcaacaagaccgcccaggtgctgagcaagtgggaccccgtggtgctgaagaacagacaggccgagcagctggtgttccccctggagaaggaggagcccgccatcgcccccatcgagcacgtgctgagcggctggaaggccagaacccccctggagcaggagatcttcaacctgctgcacaagaacaagcagcccgtgaccgaccccctgctgacccccgtggagaaggccagcctgagagccatgagcctggaggaggccaagatgagaagagccgagctgcagagagccagagccctgcagagctactacgaggccaaggccagaagagagaagaagatcaagagcaagaagtaccacaaggtggtgaagaagggcaaggccaagaaggccctgaaggagttcgagcagctgagaaaggtgaaccccgccgccgccctggaggagctggagaagatcgagaaggccagaatgatggagagaatgagcctgaagcaccagaacagcggcaagtgggccaagagcaaggccatcatggccaagtacgacctggaggccagacaggccatgcaggagcagctgagcaagaacaaggagctgacccagaagctgcaggtggccagcgagagcgaggaggaggagggcggcaccgaggacgtggaggagctgctggtgcccgacgtggtgaacgaggtgcagatgaacgccgacggccccaacccctggatgctgagaagctgcaccagcgacaccaaggaggccgccacccaggaggaccccgagcagctgcccgagctggaggcccacggcgtgagcgagagcgagggcgaggagagacccgtggccgaggaggagatcctgctgagagagttcgaggagagaagaagcctgagaaagagaagcgagctgagccaggacgccgagcccgccggcagccaggagaccaaggacagcggcagccaggaggtgctgagcgagctgagagtgctgagccagaagctgaaggagaaccaccagagcagaaagcagaaggccagcagcgagggcaccatcccccaggtgcagagagaggagcccgcccccgaggaggaggagcccctgctgctgcagagacccgagagagtgcagaccctggaggagctggaggagctgggcaaggaggagtgcttccagaacaaggagctgcccagacccgtgctggagggccagcagagcgagagaacccccaacaacagacccgacgcccccaaggagaagaagaagaaggagcagatgatcgacctgcagaacctgctgaccacccagagccccagcgtgaagagcctggccgtgcccaccatcgaggagctggaggacgaggaggagagaaaccacagacagatgatcaaggaggccttcgccggcgacgacgtgatcagagacttcctgaaggagaagagagaggccgtggaggccagcaagcccaaggacgtggacctgaccctgcccggctggggcgagtggggcggcgtgggcctgaagcccagcgccaagaagagaagaagattcctgatcaaggcccccgagggcccccccagaaaggacaagaacctgcccaacgtgatcatcaacgagaagagaaacatccacgccgccgcccaccaggtgagagtgctgccctaccccttcacccaccactggcagttcgagagaaccatccagacccccatcggcagcacctggaacacccagagagccttccagaagctgaccacccccaaggtggtgaccaagcccggccacatcatcaaccccatcaaggccgaggacgtgggctacagaagcagcagcagaagcgacctgagcgtgatccagagaaaccccaagagaatcaccaccagacacaagaagcagctgaagaagtgcagcgtggactag

SEQ ID NO: 10007 - DNA, 2316 bp, Artificial Sequence
  Description of Artificial Sequence: Synthetic coding sequence
atgaccgccaacagactggccgagagcctgctggccctgagccagcaggaggagctggccgacctgcccaaggactacctgctgagcgagagcgaggacgagggcgacaacgacggcgagagaaagcaccagaagctgctggaggccatcagcagcctggacggcaagaacagaagaaagctggccgagagaagcgaggccagcctgaaggtgagcgagttcaacgtgagcagcgagggcagcggcgagaagctggtgctggccgacctgctggagcccgtgaagaccagcagcagcctggccaccgtgaagaagcagctgagcagagtgaagagcaagaagaccgtggagctgcccctgaacaaggaggagatcgagagaatccacagagaggtggccttcaacaagaccgcccaggtgctgagcaagtgggaccccgtggtgctgaagaacagacaggccgagcagctggtgttccccctggagaaggaggagcccgccatcgcccccatcgagcacgtgctgagcggctggaaggccagaacccccctggagcaggagatcttcaacctgctgcacaagaacaagcagcccgtgaccgaccccctgctgacccccgtggagaaggccagcctgagagccatgagcctggaggaggccaagatgagaagagccgagctgcagagagccagagccctgcagagctactacgaggccaaggccagaagagagaagaagatcaagagcaagaagtaccacaaggtggtgaagaagggcaaggccaagaaggccctgaaggagttcgagcagctgagaaaggtgaaccccgccgccgccctggaggagctggagaagatcgagaaggccagaatgatggagagaatgagcctgaagcaccagaacagcggcaagtgggccaagagcaaggccatcatggccaagtacgacctggaggccagacaggccatgcaggagcagctgagcaagaacaaggagctgacccagaagctgcaggtggccagcgagagcgaggaggaggagggcggcaccgaggacgtggaggagctgctggtgcccgacgtggtgaacgaggtgcagatgaacgccgacggccccaacccctggatgctgagaagctgcaccagcgacaccaaggaggccgccacccaggaggaccccgagcagctgcccgagctggaggcccacggcgtgagcgagagcgagggcgaggagagacccgtggccgaggaggagatcctgctgagagagttcgaggagagaagaagcctgagaaagagaagcgagctgagccaggacgccgagcccgccggcagccaggagaccaaggacagcggcagccaggaggtgctgagcgagctgagagtgctgagccagaagctgaaggagaaccaccagagcagaaagcagaaggccagcagcgagggcaccatcccccaggtgcagagagaggagcccgcccccgaggaggaggagcccctgctgctgcagagacccgagagagtgcagaccctggaggagctggaggagctgggcaaggaggagtgcttccagaacaaggagctgcccagacccgtgctggagggccagcagagcgagagaacccccaacaacagacccgacgcccccaaggagaagaagaagaaggagcagatgatcgacctgcagaacctgctgaccacccagagccccagcgtgaagagcctggccgtgcccaccatcgaggagctggaggacgaggaggagagaaaccacagacagatgatcaaggaggccttcgccggcgacgacgtgatcagagacttcctgaaggagaagagagaggccgtggaggccagcaagcccaaggacgtggacctgaccctgcccggctggggcgagtggggcggcgtgggcctgaagcccagcgccaagaagagaagaagattcctgatcaaggcccccgagggcccccccagaaaggacaagaacctgcccaacgtgatcatcaacgagaagagaaacatccacgccgccgcccaccaggtgagagtgctgccctaccccttcacccaccactggcagttcgagagaaccatccagacccccatcggcagcacctggaacacccagagagccttccagaagctgaccacccccaaggtggtgaccaagcccggccacatcatcaaccccatcaaggccgaggacgtgggctacagaagcagcagcagaagcgacctgagcgtgatccagagaaaccccaagagaatcaccaccagacacaagaagcagctgaagaagtgcagcgtggactag

SEQ ID NO: 10008 - DNA, 2160 bp, Artificial Sequence
  Description of Artificial Sequence: Synthetic coding sequence
atgaccgccaacagactggccgagagcctgctggccctgagccagcaggaggagctggccgacctgcccaaggactacctgctgagcgagagcgaggacgagggcgacaacgacggcgagagaaagcaccagaagctgctggaggccatcagcagcctggacggcaagaacagaagaaagctggccgagagaagcgaggccagcctgaaggtgagcgagttcaacgtgagcagcgagggcagcggcgagaagctggtgctggccgacctgctggagcccgtgaagaccagcagcagcctggccaccgtgaagaagcagctgagcagagtgaagagcaagaagaccgtggagctgcccctgaacaaggaggagatcgagagagccagaacccccctggagcaggagatcttcaacctgctgcacaagaacaagcagcccgtgaccgaccccctgctgacccccgtggagaaggccagcctgagagccatgagcctggaggaggccaagatgagaagagccgagctgcagagagccagagccctgcagagctactacgaggccaaggccagaagagagaagaagatcaagagcaagaagtaccacaaggtggtgaagaagggcaaggccaagaaggccctgaaggagttcgagcagctgagaaaggtgaaccccgccgccgccctggaggagctggagaagatcgagaaggccagaatgatggagagaatgagcctgaagcaccagaacagcggcaagtgggccaagagcaaggccatcatggccaagtacgacctggaggccagacaggccatgcaggagcagctgagcaagaacaaggagctgacccagaagctgcaggtggccagcgagagcgaggaggaggagggcggcaccgaggacgtggaggagctgctggtgcccgacgtggtgaacgaggtgcagatgaacgccgacggccccaacccctggatgctgagaagctgcaccagcgacaccaaggaggccgccacccaggaggaccccgagcagctgcccgagctggaggcccacggcgtgagcgagagcgagggcgaggagagacccgtggccgaggaggagatcctgctgagagagttcgaggagagaagaagcctgagaaagagaagcgagctgagccaggacgccgagcccgccggcagccaggagaccaaggacagcggcagccaggaggtgctgagcgagctgagagtgctgagccagaagctgaaggagaaccaccagagcagaaagcagaaggccagcagcgagggcaccatcccccaggtgcagagagaggagcccgcccccgaggaggaggagcccctgctgctgcagagacccgagagagtgcagaccctggaggagctggaggagctgggcaaggaggagtgcttccagaacaaggagctgcccagacccgtgctggagggccagcagagcgagagaacccccaacaacagacccgacgcccccaaggagaagaagaagaaggagcagatgatcgacctgcagaacctgctgaccacccagagccccagcgtgaagagcctggccgtgcccaccatcgaggagctggaggacgaggaggagagaaaccacagacagatgatcaaggaggccttcgccggcgacgacgtgatcagagacttcctgaaggagaagagagaggccgtggaggccagcaagcccaaggacgtggacctgaccctgcccggctggggcgagtggggcggcgtgggcctgaagcccagcgccaagaagagaagaagattcctgatcaaggcccccgagggcccccccagaaaggacaagaacctgcccaacgtgatcatcaacgagaagagaaacatccacgccgccgcccaccaggtgagagtgctgccctaccccttcacccaccactggcagttcgagagaaccatccagacccccatcggcagcacctggaacacccagagagccttccagaagctgaccacccccaaggtggtgaccaagcccggccacatcatcaaccccatcaaggccgaggacgtgggctacagaagcagcagcagaagcgacctgagcgtgatccagagaaaccccaagagaatcaccaccagacacaagaagcagctgaagaagtgcagcgtggactag

SEQ ID NO: 10009 - DNA, 963 bp, Artificial Sequence
  Description of Artificial Sequence: Synthetic coding sequence
atgaagggcgacttcagaaagaagaagagcgaggccagaacccccctggagcaggagatcttcaacctgctgcacaagaacaagcagcccgtgaccgaccccctgctgacccccgtggagaaggccagcctgagagccatgagcctggaggaggccaagatgagaagagccgagctgcagagagccagagccctgcagagctactacgaggccaaggccagaagagagaagaagatcaagagcaagaagtaccacaaggtggtgaagaagggcaaggccaagaaggccctgaaggagttcgagcagctgagaaaggtgaaccccgccgccgccctggaggagctggagaagatcgagaaggccagaatgatggagagaatgagcctgaagcaccagaacagcggcaagtgggccaagagcaaggccatcatggccaagtacgacctggaggccagacaggccatgcaggagcagctgagcaagaacaaggagctgacccagaagctgcaggtggccagcgagagcgaggaggaggagggcggcaccgaggacgtggaggagctgctggtgcccgacgtggtgaacgaggtgcagatgaacgccgacggccccaacccctggatgctgagaagctgcaccagcgacaccaaggaggccgccacccaggaggaccccgagcagctgcccgagctggaggcccacggcgtgagcgagagcgagggcgaggagagacccgtggccgaggaggagatcctgctgagagagttcgaggagagaagaagcctgagaaagagaagcgagctgagccaggacgccgagcccgccggcagccaggagaccaaggacagcggcagccaggaggtgctgagcgagctgagagtgctgagccagaagctgaaggagaaccaccagagcagaaagcagaaggccagcagcgagggcaccatcccccaggtgcagtag

SEQ ID NO: 10010 - DNA, 2301 bp, Artificial Sequence
  Description of Artificial Sequence: Synthetic coding sequence
atgaacgtgaaccaggtggccgagaacctggccctgagccaccaggaggagctggtggacctgcccaagaactaccccctgagcgagaacgaggacgagggcgacagcgacggcgagagaaagcaccagaagctgctggaggccatcatcagcctggacggcaagaacagaagaaagctggccgagagaagcgaggccagcctgaaggtgagcgagttcagcgtgagcagcgagggcagcggcgagaagctgggcctggccgacctgctggagcccgtgaagaccagcagcagcctggccaccgtgaagaagcagctgaacagagtgaagagcaagaaggtggtggagctgcccctgaacaaggagaagatcgagcagatccacagagaggtggccttcagcaagaccagccaggtgctgagcaagtgggaccccatcatcctgaagaaccagcaggccgagcagctggtgttccccctgggcaaggagcagcccgccatcgcccccatcgagcacgccctgagcggctggaaggccagaacccccctggagcaggagatcttcaacctgctgcacaagaacaagcagcccgtgaccgaccccctgctgacccccatggagaaggccagcctgcaggccatgagcctggaggaggccaagatgcacagagccgagctgcagagagccagagccctgcagagctactacgaggccaaggccagaaaggagaagaagatcaagagcaagaagtaccacaaggtggtgaagaagggcaaggccaagaaggccctgaaggagttcgagcagctgcagaaggtgaaccccaccgtggccctggaggagatggagaagatcgagaacgccagaatgatggagagaatgagcctgaagcaccagaacagcggcaagtgggccaagagcaaggccatcatggccaagtacgacctggaggccagacaggccatgcaggagcagctggccaagaacaaggagctgacccagaagctgcaggtggccagcgagagcgaggaggaggagggcggcaccgaggtggaggagctgctggtgccccacgtggccaacgaggtgcagatgaacgtggacggccccaacccctggatgttcagaagctgcaccagcgacaccaaggaggccgccacccaggaggaccccgagcaggtgcccgagctggccgcccacgaggtgagcgccagcgaggccgaggagagacccgtggccgaggaggagatcctgctgagagagttcgaggagagacagagcctgagaaagagaagcgagctgaaccaggacgccgagcccgccagcagccaggagaccaaggacagcagcagccaggaggtgctgagcgagctgagagccctgagccagaagctgaaggagaagcaccagagcagaaagcagaaggccagcagcgagggcaccgtgccccaggtgcagagagaggagcccgcccccgaggaggccgagcccctgctgctgcagagaagcgagagagtgcagaccctggaggagctggaggagctgggcaaggaggactgcttccagaacaaggagctgcccagacccgtgctggagggccagcagagcgagagaacccccaacaacagacccgacgcccccaaggagaagaaggagaaggagcagctgatcaacctgcagaacttcctgaccacccagagccccagcgtgagaagcctggccgtgcccaccatcatcgaggagctggaggacgaggaggagagagaccagagacagatgatcaaggaggccttcgccggcgacgacgtgatcagagacttcctgaaggagaagagagaggccgtggaggccagcaagcccaaggacgtggacctgaccctgcccggctggggcgagtggggcggcgtgggcctgaagcccagcgccaagaagagaagacagttcctgatcaaggcccccgagggcccccccagaaaggacaagaacctgcccaacgtgatcatcagcgagaagagaaacatccacgccgccgcccaccaggtgcaggtgctgccctaccccttcacccaccacagacagttcgagagaaccatccagacccccatcggcagcacctggaacacccagagagccttccagaagctgaccacccccaaggtggtgaccaagcccggccacatcatcaagcccatcaaggccgaggacgtgggctaccagagcagcagcagaagcgacctgcccgtgatccagagaaaccccaagagaatcaccaccagacacaacaaggaggagaagctgtag

SEQ ID NO: 10011 - DNA, 1557 bp, Artificial Sequence
  Description of Artificial Sequence: Synthetic coding sequence
atggccggctacaagcccgtggccatccagacctaccccatcctgggcgagaagatcacccaggacaccctgtactggaacaactacaagacccccgtgcagatcaaggagttcggcgccgtgagcaaggtggacttcagcccccagcccccctacaactacgccgtgaccgccagcagcagaatccacatctacggcagatacagccaggagcccatcaagaccttcagcagattcaaggacaccgcctactgcgccaccttcagacaggacggcagactgctggtggccggcagcgaggacggcggcgtgcagctgttcgacatcagcggcagagcccccctgagacagttcgagggccacaccaaggccgtgcacaccgtggacttcaccgccgacaagtaccacgtggtgagcggcgccgacgactacaccgtgaagctgtgggacatccccaacagcaaggagatcctgaccttcaaggagcacagcgactacgtgagatgcggctgcgccagcaagctgaaccccgacctgttcatcaccggcagctacgaccacaccgtgaagatgttcgacgccagaaccagcgagagcgtgctgagcgtggagcacggccagcccgtggagagcgtgctgctgttccccagcggcggcctgctggtgagcgccggcggcagatacgtgaaggtgtgggacatgctgaagggcggccagctgctggtgagcctgaagaaccaccacaagaccgtgacctgcctgtgcctgagcagcagcggccagagactgctgagcggcagcctggacagaaaggtgaaggtgtacagcaccaccagctacaaggtggtgcacagcttcgactacgccgccagcatcctgagcctggccctggcccacgaggacgagaccatcgtggtgggcatgaccaacggcatcctgagcgtgaagcacagaaagagcgaggccaagaaggagagcctgcccagaagaagaagacccgcctacagaaccttcatcaagggcaagaactacatgaagcagagagacgacatcctgatcaacagacccgccaagaagcacctggagctgtacgacagagacctgaagcacttcagaatcagcaaggccctggacagagtgctggaccccacctgcaccatcaagacccccgagatcaccgtgagcatcatcaaggagctgaacagaagaggcgtgctggccaacgccctggccggcagagacgagaaggagatcagccacgtgctgaacttcctgatcagaaacctgagccagcccagattcgcccccgtgctgatcaacgccgccgagatcatcatcgacatctacctgcccgtgatcggccagagccccgtggtggacaagaagttcctgctgctgcagggcctggtggagaaggagatcgactaccagagagagctgctggagaccctgggcatgatggacatgctgttcgccaccatgagaagaaaggagggcaccagcgtgctggagcacaccagcgacggcttccccgagaacaagaagatcgagagctag

SEQ ID NO: 10012 - DNA, 1500 bp, Artificial Sequence
  Description of Artificial Sequence: Synthetic coding sequence
atggccggctacaagcccgtggccatccagacctaccccatcctgggcgagaagatcacccaggacaccctgtactggaacaactacaagcccccctacaactacgccgtgaccgccagcagcagaatccacatctacggcagatacagccaggagcccatcaagaccttcagcagattcaaggacaccgcctactgcgccaccttcagacaggacggcagactgctggtggccggcagcgaggacggcggcgtgcagctgttcgacatcagcggcagagcccccctgagacagttcgagggccacaccaaggccgtgcacaccgtggacttcaccgccgacaagtaccacgtggtgagcggcgccgacgactacaccgtgaagctgtgggacatccccaacagcaaggagatcctgaccttcaaggagcacagcgactacgtgagatgcggctgcgccagcaagctgaaccccgacctgttcatcaccggcagctacgaccacaccgtgaagatgttcgacgccagaaccagcgagagcgtgctgagcgtggagcacggccagcccgtggagagcgtgctgctgttccccagcggcggcctgctggtgagcgccggcggcagatacgtgaaggtgtgggacatgctgaagggcggccagctgctggtgagcctgaagaaccaccacaagaccgtgacctgcctgtgcctgagcagcagcggccagagactgctgagcggcagcctggacagaaaggtgaaggtgtacagcaccaccagctacaaggtggtgcacagcttcgactacgccgccagcatcctgagcctggccctggcccacgaggacgagaccatcgtggtgggcatgaccaacggcatcctgagcgtgaagcacagaaagagcgaggccaagaaggagagcctgcccagaagaagaagacccgcctacagaaccttcatcaagggcaagaactacatgaagcagagagacgacatcctgatcaacagacccgccaagaagcacctggagctgtacgacagagacctgaagcacttcagaatcagcaaggccctggacagagtgctggaccccacctgcaccatcaagacccccgagatcaccgtgagcatcatcaaggagctgaacagaagaggcgtgctggccaacgccctggccggcagagacgagaaggagatcagccacgtgctgaacttcctgatcagaaacctgagccagcccagattcgcccccgtgctgatcaacgccgccgagatcatcatcgacatctacctgcccgtgatcggccagagccccgtggtggacaagaagttcctgctgctgcagggcctggtggagaaggagatcgactaccagagagagctgctggagaccctgggcatgatggacatgctgttcgccaccatgagaagaaaggagggcaccagcgtgctggagcacaccagcgacggcttccccgagaacaagaagatcgagagctag

SEQ ID NO: 10013 - DNA, 24 bp, Artificial Sequence
  Description of Artificial Sequence: Synthetic coding sequence
atggccggctacaagcccgtgtag

SEQ ID NO: 10014 - DNA, 1638 bp, Artificial Sequence
  Description of Artificial Sequence: Synthetic coding sequence
tgagtgatcttcgccagaagaagcgtgagatgcgtgtgcagaagactgctggagggcccctgcgacttctacgccagcgccgccgagctgtgcagagtgggcagctggcacagccccatcaactgcccctgggtggaggtgagcagaagaaccctgtggggcagcgtggagacccccgtgcagatcaaggagttcggcgccgtgagcaaggtggacttcagcccccagcccccctacaactacgccgtgaccgccagcagcagaatccacatctacggcagatacagccaggagcccatcaagaccttcagcagattcaaggacaccgcctactgcgccaccttcagacaggacggcagactgctggtggccggcagcgaggacggcggcgtgcagctgttcgacatcagcggcagagcccccctgagacagttcgagggccacaccaaggccgtgcacaccgtggacttcaccgccgacaagtaccacgtggtgagcggcgccgacgactacaccgtgaagctgtgggacatccccaacagcaaggagatcctgaccttcaaggagcacagcgactacgtgagatgcggctgcgccagcaagctgaaccccgacctgttcatcaccggcagctacgaccacaccgtgaagatgttcgacgccagaaccagcgagagcgtgctgagcgtggagcacggccagcccgtggagagcgtgctgctgttccccagcggcggcctgctggtgagcgccggcggcagatacgtgaaggtgtgggacatgctgaagggcggccagctgctggtgagcctgaagaaccaccacaagaccgtgacctgcctgtgcctgagcagcagcggccagagactgctgagcggcagcctggacagaaaggtgaaggtgtacagcaccaccagctacaaggtggtgcacagcttcgactacgccgccagcatcctgagcctggccctggcccacgaggacgagaccatcgtggtgggcatgaccaacggcatcctgagcgtgaagcacagaaagagcgaggccaagaaggagagcctgcccagaagaagaagacccgcctacagaaccttcatcaagggcaagaactacatgaagcagagagacgacatcctgatcaacagacccgccaagaagcacctggagctgtacgacagagacctgaagcacttcagaatcagcaaggccctggacagagtgctggaccccacctgcaccatcaagacccccgagatcaccgtgagcatcatcaaggagctgaacagaagaggcgtgctggccaacgccctggccggcagagacgagaaggagatcagccacgtgctgaacttcctgatcagaaacctgagccagcccagattcgcccccgtgctgatcaacgccgccgagatcatcatcgacatctacctgcccgtgatcggccagagccccgtggtggacaagaagttcctgctgctgcagggcctggtggagaaggagatcgactaccagagagagctgctggagaccctgggcatgatggacatgctgttcgccaccatgagaagaaaggagggcaccagcgtgctggagcacaccagcgacggcttccccgagaacaagaagatcgagagctag

SEQ ID NO: 10015 - DNA, 198 bp, Artificial Sequence
  Description of Artificial Sequence: Synthetic coding sequence
atggccggctacaagcccgtggccatccagacctaccccatcctgggcgagaagatcacccaggacaccctgtactggaacaactacaagacccccgtgcagatcaaggagttcggcgccgtgagcaaggtggacttcagcccccagcccccctacaactacgccgtgaccgccagcagcagaatccacatctactag

SEQ ID NO: 10016 - DNA, 987 bp, Artificial Sequence
  Description of Artificial Sequence: Synthetic coding sequence
atgttcgacgccagaaccagcgagagcgtgctgagcgtggagcacggccagcccgtggagagcgtgctgctgttccccagcggcggcctgctggtgagcgccggcggcagatacgtgaaggtgtgggacatgctgaagggcggccagctgctggtgagcctgaagaaccaccacaagaccgtgacctgcctgtgcctgagcagcagcggccagagactgctgagcggcagcctggacagaaaggtgaaggtgtacagcaccaccagctacaaggtggtgcacagcttcgactacgccgccagcatcctgagcctggccctggcccacgaggacgagaccatcgtggtgggcatgaccaacggcatcctgagcgtgaagcacagaaagagcgaggccaagaaggagagcctgcccagaagaagaagacccgcctacagaaccttcatcaagggcaagaactacatgaagcagagagacgacatcctgatcaacagacccgccaagaagcacctggagctgtacgacagagacctgaagcacttcagaatcagcaaggccctggacagagtgctggaccccacctgcaccatcaagacccccgagatcaccgtgagcatcatcaaggagctgaacagaagaggcgtgctggccaacgccctggccggcagagacgagaaggagatcagccacgtgctgaacttcctgatcagaaacctgagccagcccagattcgcccccgtgctgatcaacgccgccgagatcatcatcgacatctacctgcccgtgatcggccagagccccgtggtggacaagaagttcctgctgctgcagggcctggtggagaaggagatcgactaccagagagagctgctggagaccctgggcatgatggacatgctgttcgccaccatgagaagaaaggagggcaccagcgtgctggagcacaccagcgacggcttccccgagaacaagaagatcgagagctag

SEQ ID NO: 10017 - DNA, 750 bp, Artificial Sequence
  Description of Artificial Sequence: Synthetic coding sequence
atgaagatcaccagacagaagcacgccaagaagcacctgggcttcttcagaaacaacttcggcgtgagagagccctaccagatcctgctggacggcaccttctgccaggccgccctgagaggcagaatccagctgagagagcagctgcccagatacctgatgggcgagacccagctgtgcaccaccagatgcgtgctgaaggagctggagaccctgggcaaggacctgtacggcgccaagctgatcgcccagaagtgccaggtgagaaactgcccccacttcaagaacgccgtgagcggcagcgagtgcctgctgagcatggtggaggagggcaacccccaccactacttcgtggccacccaggaccagaacctgagcgtgaaggtgaagaagaagcccggcgtgcccctgatgttcatcatccagaacaccatggtgctggacaagcccagccccaagaccatcgccttcgtgaaggccgtggagagcggccagctggtgagcgtgcacgagaaggagagcatcaagcacctgaaggaggagcagggcctggtgaagaacaccgagcagagcagaagaaagaagagaaagaagatcagcggccccaaccccctgagctgcctgaagaagaagaagaaggcccccgacacccagagcagcgccagcgagaagaagagaaagagaaagagaatcagaaacagaagcaaccccaaggtgctgagcgagaagcagaacgccgagggcgagtag

SEQ ID NO: 10018 - DNA, 438 bp, Artificial Sequence
  Description of Artificial Sequence: Synthetic coding sequence
atgaagatcaccagacagaagcacgccaagaagcacctgggcttcttcagaaacaacttcggcgtgagagagccctaccagatcctgctggacggcaccttctgccaggccgccctgagaggcagaatccagctgagagagcagctgcccagatacctgatgggcgagacccagctgtgcaccaccagatgcgtgctgaaggagctggagaccctgggcaaggacctgtacggcgccaagctgatcgcccagaagtgccaggtgagaaactgcccccacttcaagaacgccgtgagcggcagcgagtgcctgctgagcatggtggaggagggcaacccccaccactacttcgtggccacccagtacatccccagaatgtacaccttctgcaccaactacggcggccagcagtacgtgatcgacgccctgatcggctag

SEQ ID NO: 10019 - DNA, 1794 bp, Artificial Sequence
  Description of Artificial Sequence: Synthetic coding sequence
atggccgagatcatccaggagagaatcgaggacagactgcccgagctggagcagctggagagaatcggcctgttcagccacgccgagatcaaggccatcatcaagaaggccagcgacctggagtacaagatccagagaagaaccctgttcaaggaggacttcatcaactacgtgcagtacgagatcaacctgctggagctgatccagagaagaagaaccagaatcggctacagcttcaagaaggacgagatcgagaacagcatcgtgcacagagtgcagggcgtgttccagagagccagcgccaagtggaaggacgacgtgcagctgtggctgagctacgtggccttctgcaagaagtgggccaccaagaccagactgagcaaggtgttcagcgccatgctggccatccacagcaacaagcccgccctgtggatcatggccgccaagtgggagatggaggacagactgagcagcgagagcgccagacagctgttcctgagagccctgagattccaccccgagtgccccaagctgtacaaggagtacttcagaatggagctgatgcacgccgagaagctgagaaaggagaaggaggagttcgagaaggccagcatggacgtggagaaccccgactacagcgaggagatcctgaagggcgagctggcctggatcatctacaagaacagcgtgagcatcatcaagggcgccgagttccacgtgagcctgctgagcatcgcccagctgttcgacttcgccaaggacctgcagaaggagatctacgacgacctgcaggccctgcacaccgacgaccccctgacctgggactacgtggccagaagagagctggagatcgagagccagaccgaggagcagcccaccaccaagcaggccaaggccgtggaggtgggcagaaaggaggagagatgctgcgccgtgtacgaggaggccgtgaagaccctgcccaccgaggccatgtggaagtgctacatcaccttctgcctggagagattcaccaagaagagcaacagcggcttcctgagaggcaagagactggagagaaccatgaccgtgttcagaaaggcccacgagctgaagctgctgagcgagtgccagtacaagcagctgagcgtgagcctgctgtgctacaacttcctgagagaggccctggaggtggccgtggccggcaccgagctgttcagagacagcggcaccatgtggcagctgaagctgcaggtgctgatcgagagcaagagccccgacatcgccatgctgttcgaggaggccttcgtgcacctgaagccccaggtgtgcctgcccctgtggatcagctgggccgagtggagcgagggcgccaagagccaggaggacaccgaggccgtgttcaagaaggccctgctggccgtgatcggcgccgacagcgtgaccctgaagaacaagtacctggactgggcctacagaagcggcggctacaagaaggccagagccgtgttcaagagcctgcaggagagcagacccttcagcgtggacttcttcagaaagatgatccagttcgagaaggagcaggagagctgcaacatggccaacatcagagagtactacgagagagccctgagagagttcggcagcgccgacagcgacctgtggatggactacatgaaggaggagctgaaccaccccctgggcagacccgagaactgcggccagatctactggagagccatgaagatgctgcagggcgagagcgccgaggccttcgtggccaagcacgccatgcaccagaccggccacctgtag

SEQ ID NO: 10020 - DNA, 1425 bp, Artificial Sequence
  Description of Artificial Sequence: Synthetic coding sequence
atgatcagcttctgccccgactgcggcaagagcatccaggccgccttcaagttctgcccctactgcggcaacagcctgcccgtggaggagcacgtgggcagccagaccttcgtgaacccccacgtgagcagcttccagggcagcaagagaggcctgaacagcagcttcgagaccagccccaagaaggtgaagtggagcagcaccgtgaccagccccagactgagcctgttcagcgacggcgacagcagcgagagcgaggacaccctgagcagcagcgagagaagcaagggcagcggcagcagaccccccacccccaagagcagcccccagaagaccagaaagagcccccaggtgaccagaggcagcccccagaagaccagctgcagcccccagaagaccagacagagcccccagaccctgaagagaagcagagtgaccaccagcctggaggccctgcccaccggcaccgtgctgaccgacaagagcggcagacagtggaagctgaagagcttccagaccagagacaaccagggcatcctgtacgaggccgcccccaccagcaccctgacctgcgacagcggcccccagaagcagaagttcagcctgaagctggacgccaaggacggcagactgttcaacgagcagaacttcttccagagagccgccaagcccctgcaggtgaacaagtggaagaagctgtacagcacccccctgctggccatccccacctgcatgggcttcggcgtgcaccaggacaagtacagattcctggtgctgcccagcctgggcagaagcctgcagagcgccctggacgtgagccccaagcacgtgctgagcgagagaagcgtgctgcaggtggcctgcagactgctggacgccctggagttcctgcacgagaacgagtacgtgcacggcaacgtgaccgccgagaacatcttcgtggaccccgaggaccagagccaggtgaccctggccggctacggcttcgccttcagatactgccccagcggcaagcacgtggcctacgtggagggcagcagaagcccccacgagggcgacctggagttcatcagcatggacctgcacaagggctgcggccccagcagaagaagcgacctgcagagcctgggctactgcatgctgaagtggctgtacggcttcctgccctggaccaactgcctgcccaacaccgaggacatcatgaagcagaagcagaagttcgtggacaagcccggccccttcgtgggcccctgcggccactggatcagacccagcgagaccctgcagaagtacctgaaggtggtgatggccctgacctacgaggagaagcccccctacgccatgctgagaaacaacctggaggccctgctgcaggacctgagagtgagcccctacgaccccatcggcctgcccatggtgccctag

SEQ ID NO: 10021 - DNA, 1275 bp, Artificial Sequence
  Description of Artificial Sequence: Synthetic coding sequence
atgatcagcttctgccccgactgcggcaagagcatccaggccgccttcaagttctgcccctactgcggcaacagcctgcccgtggaggagcacgtgggcagccagaccttcgtgaacccccacgtgagcagcttccagggcagcggcagcagaccccccacccccaagagcagcccccagaagaccagaaagagcccccaggtgaccagaggcagcccccagaagaccagctgcagcccccagaagaccagacagagcccccagaccctgaagagaagcagagtgaccaccagcctggaggccctgcccaccggcaccgtgctgaccgacaagagcggcagacagtggaagctgaagagcttccagaccagagacaaccagggcatcctgtacgaggccgcccccaccagcaccctgacctgcgacagcggcccccagaagcagaagttcagcctgaagctggacgccaaggacggcagactgttcaacgagcagaacttcttccagagagccgccaagcccctgcaggtgaacaagtggaagaagctgtacagcacccccctgctggccatccccacctgcatgggcttcggcgtgcaccaggacaagtacagattcctggtgctgcccagcctgggcagaagcctgcagagcgccctggacgtgagccccaagcacgtgctgagcgagagaagcgtgctgcaggtggcctgcagactgctggacgccctggagttcctgcacgagaacgagtacgtgcacggcaacgtgaccgccgagaacatcttcgtggaccccgaggaccagagccaggtgaccctggccggctacggcttcgccttcagatactgccccagcggcaagcacgtggcctacgtggagggcagcagaagcccccacgagggcgacctggagttcatcagcatggacctgcacaagggctgcggccccagcagaagaagcgacctgcagagcctgggctactgcatgctgaagtggctgtacggcttcctgccctggaccaactgcctgcccaacaccgaggacatcatgaagcagaagcagaagttcgtggacaagcccggccccttcgtgggcccctgcggccactggatcagacccagcgagaccctgcagaagtacctgaaggtggtgatggccctgacctacgaggagaagcccccctacgccatgctgagaaacaacctggaggccctgctgcaggacctgagagtgagcccctacgaccccatcggcctgcccatggtgccctag

SEQ ID NO: 10022 - DNA, 855 bp, Artificial Sequence
  Description of Artificial Sequence: Synthetic coding sequence
atgatcagcttctgccccgactgcggcaagagcatccaggccgccttcaagttctgcccctactgcggcaacagcctgcccgtggaggagcacgtgggcagccagaccttcgtgaacccccacgtgagcagcttccagggcagcaagagaggcctgaacagcagcttcgagaccagccccaagaaggtgaagtggagcagcaccgtgaccagccccagactgagcctgttcagcgacggcgacagcagcgagagcgaggacaccctgagcagcagcgagagaagcaagggcagcggcagcagaccccccacccccaagagcagcccccagaagaccagaaagagcccccaggtgaccagaggcagcccccagaagaccagctgcagcccccagaagaccagacagagcccccagaccctgaagagaagcagagtgaccaccagcctggaggccctgcccaccggcaccgtgctgaccgacaagagcggcagacagtggaagctgaagagcttccagaccagagacaaccagggcatcctgtacgaggccgcccccaccagcaccctgacctgcgacagcggcccccagaagcagaagttcagcctgaagctgagcaccagcggcagaagctgcaccagaccccactgctggcccagcctgcccgcctgggtgagcgtgttcaccagaaccaacaccggcagctggtgctaccccgcctggggcggcgccttcagcagaccctggatgagcgcccagagcatgtgctgccagagaggcctgtgctgcagatggcccgccggctgctggatgccctggagcagcagcatgagaatgagcatgttcatggagatgtag

SEQ ID NO: 10023 - DNA, 732 bp, Artificial Sequence
  Description of Artificial Sequence: Synthetic coding sequence
atgaagctgcacccccccccccccagccccgtgacccaggaccacagaagcaagagcagccacagcaactggttcctggtgctgcccagcctgggcagaagcctgcagagcgccctggacgtgagccccaagcacgtgctgagcgagagaagcgtgctgcaggtggcctgcagactgctggacgccctggagttcctgcacgagaacgagtacgtgcacggcaacgtgaccgccgagaacatcttcgtggaccccgaggaccagagccaggtgaccctggccggctacggcttcgccttcagatactgccccagcggcaagcacgtggcctacgtggagggcagcagaagcccccacgagggcgacctggagttcatcagcatggacctgcacaagggctgcggccccagcagaagaagcgacctgcagagcctgggctactgcatgctgaagtggctgtacggcttcctgccctggaccaactgcctgcccaacaccgaggacatcatgaagcagaagcagaagttcgtggacaagcccggccccttcgtgggcccctgcggccactggatcagacccagcgagaccctgcagaagtacctgaaggtggtgatggccctgacctacgaggagaagcccccctacgccatgctgagaaacaacctggaggccctgctgcaggacctgagagtgagcccctacgaccccatcggcctgcccatggtgccctag

SEQ ID NO: 10024 - DNA, 645 bp, Artificial Sequence
  Description of Artificial Sequence: Synthetic coding sequence
atgagccccaagcccagagccagcggcccccccgccaaggccaaggaggccggcaagagaaagagcagcagccagcccagccccagcgaccccaagaagaagaccaccaaggtggccaagaagggcaaggccgtgagaagaggcagaagaggcaagaagggcgccgccaccaagatggccgccgtgaccgcccccgaggccgagagcggccccgccgcccccggccccagcgaccagcccagccaggagctgccccagcacgagctgccccccgaggagcccgtgagcgaggtggaggagcccctgagccaggagagccaggtggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgagatggaggagcccctgagccaggagagccaggtggaggagcccctgagccaggagagcgagatggaggagcccctgagccaggagagcgagatggaggagctgcccagcgtgtag

SEQ ID NO: 10025 - DNA, 561 bp, Artificial Sequence
  Description of Artificial Sequence: Synthetic coding sequence
atgagccccaagcccagagccagcggcccccccgccaaggccaaggaggccggcaagagaaagagcagcagccagcccagccccagcgaccccaagaagaagaccaccaaggtggccaagaagggcaaggccgtgagaagaggcagaagaggcaagaagggcgccgccaccaagatggccgccgtgaccgcccccgaggccgagagcggccccgccgcccccggccccagcgaccagcccagccaggagctgccccagcacgagctgccccccgaggagcccgtgagcgagggcacccagcacgaccccctgagccaggagagcgagctggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgagatggaggagcccctgagccaggagagccaggtggaggagcccctgagccaggagagcgagatggaggagctgcccagcgtgtag

SEQ ID NO: 10026 - DNA, 651 bp, Artificial Sequence
  Description of Artificial Sequence: Synthetic coding sequence
atgagccccaagcccagagccagcggcccccccgccaaggccaaggaggccggcaagagaaagagcagcagccagcccagccccagcgaccccaagaagaagaccaccaaggtggccaagaagggcaaggccgtgagaagaggcagaagaggcaagaagggcgccgccaccaagatggccgccgtgaccgcccccgaggccgagagcggccccgccgcccccggccccagcgaccagcccagccaggagctgccccagcacgagctgccccccgaggagcccgtgagcgagggcacccagcacgaccccctgagccaggagagcgagctggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgagatggaggagcccctgagccaggagagccaggtggaggagcccctgagccaggagagcgagatggaggagcccctgagccaggagagcgagatggaggagctgcccagcgtgtag

SEQ ID NO: 10027 - DNA, 561 bp, Artificial Sequence
  Description of Artificial Sequence: Synthetic coding sequence
atgagccccaagcccagagccagcggcccccccgccaaggccaaggaggccggcaagagaaagagcagcagccagcccagccccagcgaccccaagaagaagaccaccaaggtggccaagaagggcaaggccgtgagaagaggcagaagaggcaagaagggcgccgccaccaagatggccgccgtgaccgcccccgaggccgagagcggccccgccgcccccggccccagcgaccagcccagccaggagctgccccagcacgagctgccccccgaggagcccgtgagcgagggcacccagcacgaccccctgagccaggagagcgagctggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgaggtggaggagcccctgagccaggagagcgaggtggaggagcccctgagccaggagagcgagatggaggagctgcccagcgtgtag

SEQ ID NO: 10028 - DNA, 777 bp, Artificial Sequence
  Description of Artificial Sequence: Synthetic coding sequence
atgagactgagcagcagcccccccagaggcccccagcagctgagcagcttcggcagcgtggactggctgagccagagcagctgcagcggccccacccacacccccagacccgccgacttcagcctgggcagcctgcccggccccggccagaccagcggcgccagagagcccccccaggccgtgagcatcaaggaggccgccggcagcagcaacctgcccgcccccgagagaaccatggccggcctgagcaaggagcccaacaccctgagagcccccagagtgagaaccgccttcaccatggagcaggtgagaaccctggagggcgtgttccagcaccaccagtacctgagccccctggagagaaagagactggccagagagatgcagctgagcgaggtgcagatcaagacctggttccagaacagaagaatgaagcacaagagacagatgcaggacccccagctgcacagccccttcagcggcagcctgcacgccccccccgccttctacagcaccagcagcggcctggccaacggcctgcagctgctgtgcccctgggcccccctgagcggcccccaggccctgatgctgccccccggcagcttctggggcctgtgccaggtggcccaggaggccctggccagcgccggcgccagctgctgcggccagcccctggccagccacccccccacccccggcagacccagcctgggccccgccctgagcaccggccccagaggcctgtgcgccatgccccagaccggcgacgccttctag

SEQ ID NO: 10029 - DNA, 561 bp, Artificial Sequence
  Description of Artificial Sequence: Synthetic coding sequence
atgttcggcaagcccgacaagatggacgtgagatgccacagcgacgccgaggccgccagagtgagcaagaacgcccacaaggagagcagagagagcaagggcgccgagggcaacctgcccgccgccttcctgaaggagccccagggcgccttcagcgccagcggcgccgccgaggactgcaacaagagcaagagcaacagcgccgccgaccccgactactgcagaagaatcctggtgagagacgccaagggcagcatcagagagatcatcctgcccaagggcctggacctggacagacccaagagaaccagaaccagcttcaccgccgagcagctgtacagactggagatggagttccagagatgccagtacgtggtgggcagagagagaaccgagctggccagacagctgaacctgagcgagacccaggccaacagcgaggagaacaacgagagattcaagagaggcatcaagaagcagaagaagaagagaaagaaggagcccgccaacgacgagagcagaagaggcgacagcggcggcagaggctggcagcccctgtag

SEQ ID NO: 10030 - DNA, 1005 bp, Artificial Sequence
  Description of Artificial Sequence: Synthetic coding sequence
atgttcggcaagcccgacaagatggacgtgagatgccacagcgacgccgaggccgccagagtgagcaagaacgcccacaaggagagcagagagagcaagggcgccgagggcaacctgcccgccgccttcctgaaggagccccagggcgccttcagcgccagcggcgccgccgaggactgcaacaagagcaagagcaacagcgccgccgaccccgactactgcagaagaatcctggtgagagacgccaagggcagcatcagagagatcatcctgcccaagggcctggacctggacagacccaagagaaccagaaccagcttcaccgccgagcagctgtacagactggagatggagttccagagatgccagtacgtggtgggcagagagagaaccgagctggccagacagctgaacctgagcgagacccaggtgaaggtgtggttccagaacagaagaaccaagcagaagaaggaccagggcaaggacagcgagctgagaagcgtggtgagcgagaccgccgccacctgcagcgtgctgagactgctggagcagggcagactgctgagcccccccggcctgcccgccctgctgcccccctgcgccaccggcgccctgggcagcgccctgagaggccccagcctgcccgccctgggcgccggcgccgccgccggcagcgccgccgccgccgccgccgccgcccccggccccgccggcgccgccagcccccacccccccgccgtgggcggcgcccccggccccggccccgccggccccggcggcctgcacgccggcgcccccgccgccggccacagcctgttcagcctgcccgtgcccagcctgctgggcagcgtggccagcagactgagcagcgcccccctgaccatggccggcagcctggccggcaacctgcaggagctgagcgccagatacctgagcagcagcgccttcgagccctacagcagaaccaacaacaaggagggcgccgagaagaaggccctggactag

SEQ ID NO: 10031 - DNA, 711 bp, Artificial Sequence
  Description of Artificial Sequence: Synthetic coding sequence
atgaccgccgagttcctgagcctgctgtgcctgggcctgtgcctgggctacgaggacgagaagaagaacgagaagccccccaagcccagcctgcacgcctggcccagcagcgtggtggaggccgagagcaacgtgaccctgaagtgccaggcccacagccagaacgtgaccttcgtgctgagaaaggtgaacgacagcggctacaagcaggagcagagcagcgccgagaacgaggccgagttccccttcaccgacctgaagcccaaggacgccggcagatacttctgcgcctacaagaccaccgccagccacgagtggagcgagagcagcgagcacctgcagctggtggtgaccgacaagcacgacgagctggaggcccccagcatgaagaccgacaccagaaccatcttcgtggccatcttcagctgcatcagcatcctgctgctgttcctgagcgtgttcatcatctacagatgcagccagcacagcagcagcagcgaggagagcaccaagagaaccagccacagcaagctgcccgagcaggaggccgccgaggccgacctgagcaacatggagagagtgagcctgagcaccgccgacccccagggcgtgacctacgccgagctgagcaccagcgccctgagcgaggccgccagcgacaccacccaggagccccccggcagccacgagtacgccgccctgaaggtgtag

SEQ ID NO: 10032 - DNA, 447 bp, Artificial Sequence
  Description of Artificial Sequence: Synthetic coding sequence
atgagaaagagaatgggccccaccagactgcccagactggagtgcagcggcgccatcaccgcccactgcagcctggacctgcccggccccgacaagcacgacgagctggaggcccccagcatgaagaccgacaccagaaccatcttcgtggccatcttcagctgcatcagcatcctgctgctgttcctgagcgtgttcatcatctacagatgcagccagcacagcagcagcagcgaggagagcaccaagagaaccagccacagcaagctgcccgagcaggaggccgccgaggccgacctgagcaacatggagagagtgagcctgagcaccgccgacccccagggcgtgacctacgccgagctgagcaccagcgccctgagcgaggccgccagcgacaccacccaggagccccccggcagccacgagtacgccgccctgaaggtgtag

SEQ ID NO: 10033 - DNA, 618 bp, Artificial Sequence
  Description of Artificial Sequence: Synthetic coding sequence
atgaccgccgagttcctgagcctgctgtgcctgggcctgtgcctgggctacgaggacgagaagaagaacgagaagccccccaagcccagcctgcacgcctggcccagcagcgtggtggaggccgagagcaacgtgaccctgaagtgccaggcccacagccagaacgtgaccttcgtgctgagaaaggtgaacgacagcggctacaagcaggagcagagcagcgccgagaacgaggccgagttccccttcaccgacctgaagcccaaggacgccggcagatacttctgcgcctacaagaccaccgccagccacgagtggagcgagagcagcgagcacctgcagctggtggtgaccgacaagcacgacgagctggaggcccccagcatgaagaccggcagcagcagcgaggagagcaccaagagaaccagccacagcaagctgcccgagcaggaggccgccgaggccgacctgagcaacatggagagagtgagcctgagcaccgccgacccccagggcgtgacctacgccgagctgagcaccagcgccctgagcgaggccgccagcgacaccacccaggagccccccggcagccacgagtacgccgccctgaaggtgtag

SEQ ID NO: 10034 - DNA, 432 bp, Artificial Sequence
  Description of Artificial Sequence: Synthetic coding sequence
atgaccgccgagttcctgagcctgctgtgcctgggcctgtgcctgggctacgaggacgagaagaagaacgagaagccccccaagcccagcctgcacgcctggcccagcagcgtggtggaggccgagagcaacgtgaccctgaagtgccaggcccacagccagaacgtgaccttcgtgctgagaaaggtgaacgacagcggctacaagcaggagcagagcagcgccgagaacgaggccgagttccccttcaccgacctgaagcccaaggacgccggcagatacttctgcgcctacaagaccaccgccagccacgagtggagcgagagcagcgagcacctgcagctggtggtgaccgacaagcacgacgagctggaggcccccagcatgaagaccgtggcccacgtgtgcaacaccagaaccctgggcagatag

SEQ ID NO: 10035 - DNA, 1272 bp, Artificial Sequence
  Description of Artificial Sequence: Synthetic coding sequence
atggcccagctgcagaccagattctacaccgacaacaagaagtacgccgtggacgacgtgcccttcagcatccccgccgccagcgagatcgccgacctgagcaacatcatcaacaagctgctgaaggacaagaacgagttccacaagcacgtggagttcgacttcctgatcaagggccagttcctgagaatgcccctggacaagcacatggagatggagaacatcagcagcgaggaggtggtggagatcgagtacgtggagaagtacaccgccccccagcccgagcagtgcatgttccacgacgactggatcagcagcatcaagggcgccgaggagtggatcctgaccggcagctacgacaagaccagcagaatctggagcctggagggcaagagcatcatgaccatcgtgggccacaccgacgtggtgaaggacgtggcctgggtgaagaaggacagcctgagctgcctgctgctgagcgccagcatggaccagaccatcctgctgtgggagtggaacgtggagagaaacaaggtgaaggccctgcactgctgcagaggccacgccggcagcgtggacagcatcgccgtggacggcagcggcaccaagttctgcagcggcagctgggacaagatgctgaagatctggagcaccgtgcccaccgacgaggaggacgagatggaggagagcaccaacagacccagaaagaagcagaagaccgagcagctgggcctgaccagaacccccatcgtgaccctgagcggccacatggaggccgtgagcagcgtgctgtggagcgacgccgaggagatctgcagcgccagctgggaccacaccatcagagtgtgggacgtggagagcggcagcctgaagagcaccctgaccggcaacaaggtgttcaactgcatcagctacagccccctgtgcaagagactggccagcggcagcaccgacagacacatcagactgtgggaccccagaaccaaggacggcagcctggtgagcctgagcctgaccagccacaccggctgggtgaccagcgtgaagtggagccccacccacgagcagcagctgatcagcggcagcctggacaacatcgtgaagctgtgggacaccagaagctgcaaggcccccctgtacgacctggccgcccacgaggacaaggtgctgagcgtggactggaccgacaccggcctgctgctgagcggcggcgccgacaacaagctgtacagctacagatacagccccaccaccagccacgtgggcgcctag

SEQ ID NO: 10036 - DNA, 2034 bp, Artificial Sequence
  Description of Artificial Sequence: Synthetic coding sequence
atggccgccggcggcggcggcagctgcgaccccctggcccccgccggcgtgccctgcgccttcagcccccacagccaggcctacttcgccctggccagcaccgacggccacctgagagtgtgggagaccgccaacaacagactgcaccaggagtacgtgcccagcgcccacctgagcggcacctgcacctgcctggcctgggcccccgccagactgcaggccaaggagagcccccagagaaagaagagaaagagcgaggccgtgggcatgagcaaccagaccgacctgctggccctgggcaccgccgtgggcagcatcctgctgtacagcaccgtgaagggcgagctgcacagcaagctgatcagcggcggccacgacaacagagtgaactgcatccagtggcaccaggacagcggctgcctgtacagctgcagcgacgacaagcacatcgtggagtggaacgtgcagacctgcaaggtgaagtgcaagtggaagggcgacaacagcagcgtgagcagcctgtgcatcagccccgacggcaagatgctgctgagcgccggcagaaccatcaagctgtgggtgctggagaccaaggaggtgtacagacacttcaccggccacgccacccccgtgagcagcctgatgttcaccaccatcagaccccccaacgagagccagcccttcgacggcatcaccggcctgtacttcctgagcggcgccgtgcacgacagactgctgaacgtgtggcaggtgagaagcgagaacaaggagaagagcgccgtgatgagcttcaccgtgaccgacgagcccgtgtacatcgacctgaccctgagcgagaacaaggaggagcccgtgaagctggccgtggtgtgcagagacggccaggtgcacctgttcgagcacatcctgaacggctactgcaagaagcccctgaccagcaactgcaccatccagatcgccacccccggcaagggcaagaagagcacccccaagcccatccccatcctggccgccggcttctgcagcgacaagatgagcctgctgctggtgtacggcagctggttccagcccaccatcgagagagtggccctgaacagcagagagccccacatgtgcctggtgagagacatcagcaactgctgggcccccaaggtggagaccgccatcaccaaggtgagaacccccgtgatgaacagcgaggccaaggtgctggtgcccggcatccccggccaccacgccgccatcaagcccgcccccccccagaccgagcaggtggagagcaagagaaagagcggcggcaacgaggtgagcatcgaggagagactgggcgccatggacatcgacacccacaagaagggcaaggaggacctgcagaccaacagcttccccgtgctgctgacccagggcctggagagcaacgacttcgagatgctgaacaaggtgctgcagaccagaaacgtgaacctgatcaagaagaccgtgctgagaatgcccctgcacaccatcatccccctgctgcaggagctgaccaagagactgcagggccaccccaacagcgccgtgctgatggtgcagtggctgaagtgcgtgctgaccgtgcacgccagctacctgagcaccctgcccgacctggtgccccagctgggcaccctgtaccagctgatggagagcagagtgaagaccttccagaagctgagccacctgcacggcaagctgatcctgctgatcacccaggtgaccgccagcgagaagaccaagggcgccaccagccccggccagaaggccaagctggtgtacgaggaggagagcagcgaggaggagagcgacgacgagatcgccgacaaggacagcgaggacaactgggacgaggacgaggaggagagcgagagcgagaaggacgaggacgtggaggaggaggacgaggacgccgagggcaaggacgaggagaacggcgaggacagagacaccgccagcgagaaggagctgaacggcgacagcgacctggaccccgagaacgagagcgaggaggagtag

SEQ ID NO: 10037 - DNA, 1005 bp, Artificial Sequence
  Description of Artificial Sequence: Synthetic coding sequence
atggccaccgaggagaagaagcccgagaccgaggccgccagagcccagcccacccccagcagcagcgccacccagagcaagcccacccccgtgaagcccaactacgccctgaagttcaccctggccggccacaccaaggccgtgagcagcgtgaagttcagccccaacggcgagtggctggccagcagcagcgccgacaagctgatcaagatctggggcgcctacgacggcaagttcgagaagaccatcagcggccacaagctgggcatcagcgacgtggcctggagcagcgacagcaacctgctggtgagcgccagcgacgacaagaccctgaagatctgggacgtgagcagcggcaagtgcctgaagaccctgaagggccacagcaactacgtgttctgctgcaacttcaacccccagagcaacctgatcgtgagcggcagcttcgacgagagcgtgagaatctgggacgtgaagaccggcaagtgcctgaagaccctgcccgcccacagcgaccccgtgagcgccgtgcacttcaacagagacggcagcctgatcgtgagcagcagctacgacggcctgtgcagaatctgggacaccgccagcggccagtgcctgaagaccctgatcgacgacgacaacccccccgtgagcttcgtgaagttcagccccaacggcaagtacatcctggccgccaccctggacaacaccctgaagctgtgggactacagcaagggcaagtgcctgaagacctacaccggccacaagaacgagaagtactgcatcttcgccaacttcagcgtgaccggcggcaagtggatcgtgagcggcagcgaggacaacctggtgtacatctggaacctgcagaccaaggagatcgtgcagaagctgcagggccacaccgacgtggtgatcagcaccgcctgccaccccaccgagaacatcatcgccagcgccgccctggagaacgacaagaccatcaagctgtggaagagcgactgctag

SEQ ID NO: 10038 - DNA, 1005 bp, Artificial Sequence; identical to SEQ ID NO: 10037
  Description of Artificial Sequence: Synthetic coding sequence

SEQ ID NO: 10039 - DNA, 1158 bp, Artificial Sequence
  Description of Artificial Sequence: Synthetic coding sequence
atggccgccgccgccgccagatggaaccacgtgtgggtgggcaccgagaccggcatcctgaagggcgtgaacctgcagagaaagcaggccgccaacttcaccgccggcggccagcccagaagagaggaggccgtgagcgccctgtgctggggcaccggcggcgagacccagatgctggtgggctgcgccgacagaaccgtgaagcacttcagcaccgaggacggcatcttccagggccagagacactgccccggcggcgagggcatgttcagaggcctggcccaggccgacggcaccctgatcacctgcgtggacagcggcatcctgagagtgtggcacgacaaggacaaggacaccagcagcgaccccctgctggagctgagagtgggccccggcgtgtgcagaatgagacaggaccccgcccacccccacgtggtggccaccggcggcaaggagaacgccctgaagatctgggacctgcagggcagcgaggagcccgtgttcagagccaagaacgtgagaaacgactggctggacctgagagtgcccatctgggaccaggacatccagttcctgcccggcagccagaagctggtgacctgcaccggctaccaccaggtgagagtgtacgaccccgccagcccccagagaagacccgtgctggagaccacctacggcgagtaccccctgaccgccatgaccctgacccccggcggcaacagcgtgatcgtgggcaacacccacggccagctggccgagatcgacctgagacagggcagactgctgggctgcctgaagggcctggccggcagcgtgagaggcctgcagtgccaccccagcaagcccctgctggccagctgcggcctggacagagtgctgagaatccacagaatccagaaccccagaggcctggagcacaaggtgtacctgaagagccagctgaactgcctgctgctgagcggcagagacaactgggaggacgagccccaggagccccaggagcccaacaaggtgcccctggaggacaccgagaccgacgagctgtgggccagcctggaggccgccgccaagagaaagctgagcggcctggagcagccccagggcgccctgcagaccagaagaagaaagaagaagagacccggcagcaccagcccctag

SEQ ID NO: 10040 - DNA, 1101 bp, Artificial Sequence
  Description of Artificial Sequence: Synthetic coding sequence
atggccgccgccgccgccagatggaaccacgtgtgggtgggcaccgagaccggcatcctgaagggcgtgaacctgcagagaaagcaggccgccaacttcaccgccggcggccagcccagaagagaggaggccgtgagcgccctgtgctggggcaccggcggcgagacccagatgctggtgggctgcgccgacagaaccgtgaagcacttcagcaccgaggacggcatcttccagggccagagacactgccccggcggcgagggcatgttcagaggcctggcccaggccgacggcaccctgatcacctgcgtggacagcggcatcctgagagtgtggcacgacaaggacaaggacaccagcagcgaccccctgctggagctgagagtgggccccggcgtgtgcagaatgagacaggaccccgcccacccccacgtggtggccaccggcggcaaggagaacgccctgaagatctgggacctgcagggcagcgaggagcccgtgttcagagccaagaacgtgagaaacgactggctggacctgagagtgcccatctgggaccaggacatccagttcctgcccggcagccagaagctggtgacctgcaccggctaccaccaggtgagagtgtacgaccccgccagcccccagagaagacccgtgctggagaccacctacggcgagtaccccctgaccgccatgaccctgacccccggcggcaacagcgtgatcgtgggcaacacccacggccagctggccgagatcgacctgagacagggcagactgctgggctgcctgaagggcctggccggcagcgtgagaggcctgcagtgccaccccagcaagcccctgctggccagctgcggcctggacagagtgctgagaatccacagaatccagaaccccagaggcctggagcacaaggacgagccccaggagccccaggagcccaacaaggtgcccctggaggacaccgagaccgacgagctgtgggccagcctggaggccgccgccaagagaaagctgagcggcctggagcagccccagggcgccctgcagaccagaagaagaaagaagaagagacccggcagcaccagcccctag

SEQ ID NO: 10041 - DNA, 1158 bp, Artificial Sequence; identical to SEQ ID NO: 10039
  Description of Artificial Sequence: Synthetic coding sequence

SEQ ID NO: 10042 - DNA, 1158 bp, Artificial Sequence; identical to SEQ ID NO: 10039
  Description of Artificial Sequence: Synthetic coding sequence

SEQ ID NO: 10043 - DNA, 117 bp, Artificial Sequence
  Description of Artificial Sequence: Synthetic coding sequence
tgatgggccagcctggaggccgccgccaagagaaagctgagcggcctggagcagccccagggcgccctgcagaccagaagaagaaagaagaagagacccggcagcaccagcccctag

SEQ ID NO: 10044 - DNA, 174 bp, Artificial Sequence
  Description of Artificial Sequence: Synthetic coding sequence
atggccgccgccgccgccagatggaaccacgtgtgggtgggcaccgagaccggcatcctgaagggcgtgaacctgcagagaaagcaggccgccaacttcaccgccggcggccagcccagaagagaggaggccgtgagcgccctgtgctggggcaccggcggcgagacccagtag

SEQ ID NO: 10045 - DNA, 2493 bp, Artificial Sequence
  Description of Artificial Sequence: Synthetic coding sequence
atggtggaggaggagaacatcagagtggtgagatgcggcggcagcgagctgaacttcagaagagccgtgttcagcgccgacagcaagtacatcttctgcgtgagcggcgacttcgtgaaggtgtacagcaccgtgaccgaggagtgcgtgcacatcctgcacggccacagaaacctggtgaccggcatccagctgaaccccaacaaccacctgcagctgtacagctgcagcctggacggcaccatcaagctgtgggactacatcgacggcatcctgatcaagaccttcatcgtgggctgcaagctgcacgccctgttcaccctggcccaggccgaggacagcgtgttcgtgatcgtgaacaaggagaagcccgacatcttccagctggtgagcgtgaagctgcccaagagcagcagccaggaggtggaggccaaggagctgagcttcgtgctggactacatcaaccagagccccaagtgcatcgccttcggcaacgagggcgtgtacgtggccgccgtgagagagttctacctgagcgtgtacttcttcaagaagaagaccaccagcagattcaccctgagcagcagcagaaacaagaagcacgccaagaacaacttcacctgcgtggcctgccaccccaccgaggactgcatcgccagcggccacatggacggcaagatcagactgtggagaaacttctacgacgacaagaagtacacctacacctgcctgcactggcaccacgacatggtgatggacctggccttcagcgtgaccggcaccagcctgctgagcggcggcagagagagcgtgctggtggagtggagagacgccaccgagaagaacaaggagttcctgcccagactgggcgccaccatcgagcacatcagcgtgagccccgccggcgacctgttctgcaccagccacagcgacaacaagatcatcatcatccacagaaacctggaggccagcgccgtgatccagggcctggtgaaggacagaagcatcttcaccggcctgatgatcgaccccagaaccaaggccctggtgctgaacggcaagcccggccacctgcagttctacagcctgcagagcgacaagcagctgtacaacctggacatcatccagcaggagtacatcaacgactacggcctgatccagatcgagctgaccaaggccgccttcggctgcttcggcaactggctggccaccgtggagcagagacaggagaaggagaccgagctggagctgcagatgaagctgtggatgtacaacaagaagacccagggcttcatcctgaacaccaagatcaacatgccccacgaggactgcatcaccgccctgtgcttctgcaacgccgagaagagcgagcagcccaccctggtgaccgccagcaaggacggctacttcaaggtgtggatcctgaccgacgacagcgacatctacaagaaggccgtgggctggacctgcgacttcgtgggcagctaccacaagtaccaggccaccaactgctgcttcagcgaggacggcagcctgctggccgtgagcttcgaggagatcgtgaccatctgggacagcgtgacctgggagctgaagtgcaccttctgccagagagccggcaagatcagacacctgtgcttcggcagactgacctgcagcaagtacctgctgggcgccaccgagaacggcatcctgtgctgctggaacctgctgagctgcgccctggagtggaacgccaagctgaacgtgagagtgatggagcccgaccccaacagcgagaacatcgccgccatcagccagagcagcgtgggcagcgacctgttcgtgttcaagcccagcgagcccagacccctgtacatccagaagggcatcagcagagagaaggtgcagtggggcgtgttcgtgcccagagacgtgcccgagagcttcaccagcgaggcctaccagtggctgaacagaagccagttctacttcctgaccaagagccagagcctgctgaccttcagcaccaagagccccgaggagaagctgacccccaccagcaagcagctgctggccgaggagagcctgcccaccacccccttctacttcatcctgggcaagcacagacagcagcaggacgagaagctgaacgagaccctggagaacgagctggtgcagctgcccctgaccgagaacatccccgccatcagcgagctgctgcacacccccgcccacgtgctgcccagcgccgccttcctgtgcagcatgttcgtgaacagcctgctgctgagcaaggagaccaagagcgccaaggagatccccgaggacgtggacatggaggaggagaaggagagcgaggacagcgacgaggagaacgacttcaccgagaaggtgcaggacaccagcaacaccggcctgggcgaggacatcatccaccagctgagcaagagcgaggagaaggagctgagaaagttcagaaagatcgactacagctggatcgccgccctgtag

SEQ ID NO: 10046 - DNA, 1155 bp, Artificial Sequence
  Description of Artificial Sequence: Synthetic coding sequence
atggtgaagctgatccacaccctggccgaccacggcgacgacgtgaactgctgcgccttcagcttcagcctgctggccacctgcagcctggacaagaccatcagactgtacagcctgagagacttcaccgagctgccccacagccccctgaagttccacacctacgccgtgcactgctgctgcttcagccccagcggccacatcctggccagctgcagcaccgacggcaccaccgtgctgtggaacaccgagaacggccagatgctggccgtgatggagcagcccagcggcagccccgtgagagtgtgccagttcagccccgacagcacctgcctggccagcggcgccgccgacggcaccgtggtgctgtggaacgcccagagctacaagctgtacagatgcggcagcgtgaaggacggcagcctggccgcctgcgccttcagccccaacggcagcttcttcgtgaccggcagcagctgcggcgacctgaccgtgtgggacgacaagatgagatgcccccacagcgagaaggcccacgacctgggcatcacctgctgcgacttcagcagccagcccgtgagcgacggcgagcagggcctgcagttcttcagactggccagctgcggccaggactgccaggtgaagatctggatcgtgagcttcacccacatcctggccagaagaaccgagcaccagctgaagcagttcaccgaggactggagcgaggaggacgtgagcacctggctgtgcgcccaggacctgaaggacctggtgggcatcttcaagatgaacaacatcgacggcaaggagctgctgaacctgaccaaggagagcctggccgacgacctgaagatcgagagcctgggcctgagaagcaaggtgctgagaaagatcgaggagctgagaaccaaggtgaagagcctgagcagcggcatccccgacgagttcatctgccccatcaccagagagctgatgaaggaccccgtgatcgccagcgacggctacagctacgagaaggaggccatggagaactggatcagcaagaagaagagaaccagccccatgaccaacctggtgctgcccagcgccgtgctgacccccaacagaaccctgaagatggccatcaacagatggctggagacccaccagaagtag

SEQ ID NO: 10047 - DNA, 1431 bp, Artificial Sequence
  Description of Artificial Sequence: Synthetic coding sequence
atggtgaagctgatccacaccctggccgaccacggcgacgacgtgaactgctgcgccttcagcttcagcctgctggccacctgcagcctggacaagaccatcagactgtacagcctgagagacttcaccgagctgccccacagccccctgaagttccacacctacgccgtgcactgctgctgcttcagccccagcggccacatcctggccagctgcagcaccgacggcaccaccgtgctgtggaacaccgagaacggccagatgctggccgtgatggagcagcccagcggcagccccgtgagagtgtgccagttcagccccgacagcacctgcctggccagcggcgccgccgacggcaccgtggtgctgtggaacgcccagagctacaagctgtacagatgcggcagcgtgaaggacggcagcctggccgcctgcgccttcagccccaacggcagcttcttcgtgaccggcagcagctgcggcgacctgaccgtgtgggacgacaagatgagatgcccccacagcgagaaggcccacgacctgggcatcacctgctgcgacttcagcagccagcccgtgagcgacggcgagcagggcctgcagttcttcagactggccagctgcggccaggactgccaggtgaagatctggatcgtgagcttcacccacatcctgggcttcgagctgaagtacaagagcaccctgagcggccactgcgcccccgtgctggcctgcgccttcagccacgacggccagatgctggtgagcggcagcgtggacaagagcgtgatcgtgtacgacaccaacaccgagaacatcctgcacaccctgacccagcacaccagatacgtgaccacctgcgccttcgcccccaacaccctgctgctggccaccggcagcatggacaagaccgtgaacatctggcagttcgacctggagaccctgtgccaggccagaagaaccgagcaccagctgaagcagttcaccgaggactggagcgaggaggacgtgagcacctggctgtgcgcccaggacctgaaggacctggtgggcatcttcaagatgaacaacatcgacggcaaggagctgctgaacctgaccaaggagagcctggccgacgacctgaagatcgagagcctgggcctgagaagcaaggtgctgagaaagatcgaggagctgagaaccaaggtgaagagcctgagcagcggcatccccgacgagttcatctgccccatcaccagagagctgatgaaggaccccgtgatcgccagcgacggctacagctacgagaaggaggccatggagaactggatcagcaagaagaagagaaccagccccatgaccaacctggtgctgcccagcgccgtgctgacccccaacagaaccctgaagatggccatcaacagatggctggagacccaccagaagtag

SEQ ID NO: 10048 - DNA, 1431 bp, Artificial Sequence; identical to SEQ ID NO: 10047
  Description of Artificial Sequence: Synthetic coding sequence

SEQ ID NO: 10049 - DNA, 1431 bp, Artificial Sequence; identical to SEQ ID NO: 10047
  Description of Artificial Sequence: Synthetic coding sequence

SEQ ID NO: 10050 - DNA, 2385 bp, Artificial Sequence
  Description of Artificial Sequence: Synthetic coding sequence
atggagggcagcctggccggcagcctggccgcccccgacagaccccagggccccgagagactgcccggccccgcccccagagagaacatcgagggcggcgccgaggccgccgagggcgagggcggcatcttcagaagcaccagatacctgcccgtgaccaaggagggccccagagacatcctggacggcagaggcggcatcagcgtggccaacttcgaccccggcaccttcagcctgatgagatgcgacttctgcggcgccggcttcgacaccagagccggcctgagcagccacgccagagcccacctgagagacttcggcatcaccaactgggagctgaccgtgagccccatcaacatcctgcaggagctgctggccaccagcgccgccgagcagccccccagccccctgggcagagagcccggcggcccccccggcagcttcctgaccagcagaagacccagactgcccctgaccgtgcccttcccccccacctgggccgaggaccccggccccgcctacggcgacgccagcggccccgagcccgccagagacatcagatgcgagttctgcggcgagttcttcgagaacagaaagggcctgagcagccacgccagaagccacctgagacagatgggcgtgaccgagtggtacgtgaacggcagccccatcgacaccctgagagagatcctgaagagaagaacccagagcagacccggcggcccccccaacccccccggccccagccccaaggccctggccaagatgatgggcggcgccggccccggcagcagcctggaggccagaagccccagcgacctgcacatcagccccctggccaagaagctgccccccccccccggcagccccctgggccacagccccaccgccagccccccccccaccgccagaaagatgttccccggcctggccgcccccagcctgcccaagaagctgaagcccgagcagatcagagtggagatcaagagagagatgctgcccggcgccctgcacggcgagctgcaccccagcgagggcccctggggcgcccccagagaggacatgacccccctgaacctgagcagcagagccgagcccgtgagagacatcagatgcgagttctgcggcgagttcttcgagaacagaaagggcctgagcagccacgccagaagccacctgagacagatgggcgtgaccgagtggagcgtgaacggcagccccatcgacaccctgagagagatcctgaagaagaagagcaagccctgcctgatcaagaaggagccccccgccggcgacctggcccccgccctggccgaggacggcccccccaccgtggcccccggccccgtgcagagccccctgcccctgagccccctggccggcagacccggcaagcccggcgccggccccgcccaggtgcccagagagctgagcctgacccccatcaccggcgccaagcccagcgccaccggctacctgggcagcgtggccgccaagagacccctgcaggaggacagactgctgcccgccgaggtgaaggccaagacctacatccagaccgagctgcccttcaaggccaagaccctgcacgagaagaccagccacagcagcaccgaggcctgctgcgagctgtgcggcctgtacttcgagaacagaaaggccctggccagccacgccagagcccacctgagacagttcggcgtgaccgagtggtgcgtgaacggcagccccatcgagaccctgagcgagtggatcaagcacagaccccagaaggtgggcgcctacagaagctacatccagggcggcagacccttcaccaagaagttcagaagcgccggccacggcagagacagcgacaagagacccagcctgggcctggcccccggcggcctggccgtggtgggcagaagcgccggcggcgagcccggccccgaggccggcagagccgccgacggcggcgagagacccctggccgccagcccccccggcaccgtgaaggccgaggagcaccagagacagaacatcaacaagttcgagagaagacaggccagaccccccgacgccagcgccgccagaggcggcgaggacaccaacgacctgcagcagaagctggaggaggtgagacagcccccccccagagtgagacccgtgcccagcctggtgcccagacccccccagaccagcctggtgaagttcgtgggcaacatctacaccctgaagtgcagattctgcgaggtggagttccagggccccctgagcatccaggaggagtgggtgagacacctgcagagacacatcctggagatgaacttcagcaaggccgaccccccccccgaggagagccaggccccccaggcccagaccgccgccgccgaggccccctag

SEQ ID NO: 10051 - DNA, 4956 bp, Artificial Sequence
  Description of Artificial Sequence: Synthetic coding sequence
atggagggcagcctggccggcagcctggccgcccccgacagaccccagggccccgagagactgcccggccccgcccccagagagaacatcgagggcggcgccgaggccgccgagggcgagggcggcatcttcagaagcaccagatacctgcccgtgaccaaggagggccccagagacatcctggacggcagaggcggcatcagcggcacccccgacggcagaggcccctgggagcaccccctggtgcaggaggccggcgagggcatcctgagcgagagaagattcgaggacagcgtgatcgtgagaaccatgaagccccacgccgagctggagggcagcagaagattcctgcaccacagaggcgagcccagactgctggagaagcacgcccagggcagacccagattcgactggctgcaggacgaggacgagcagggcagcccccaggacgccggcctgcacctggacctgcccgcccagcccccccccctggcccccttcagaagagtgttcgtgcccgtggaggacacccccaagaccctggacatggccgtggtgggcggcagagaggacctggaggacctggagggcctggcccagcccagcgagtggggcctgcccaccagcgccagcgaggtggccacccagacctggaccgtgaacagcgaggccagcgtggagagactgcagcccctgctgccccccatcagaaccggcccctacctgtgcgagctgctggaggaggtggccgagggcgtggccagccccgacgaggacgaggacgaggagcccgccgtgttcccctgcatcgagtgcagcatctacttcaagcagaaggagcacctgctggagcacatgagccagcacagaagagcccccggccaggagccccccgccgacctggcccccctggcctgcggcgagtgcggctgggccttcgccgaccccaccgccctggagcagcacagacagctgcaccaggccagcagagagaagatcatcgaggagatccagaagctgaagcaggtgcccggcgacgagggcagagaggccagactgcagtgccccaagtgcgtgttcggcaccaacagcagcagagcctacgtgcagcacgccaagctgcacatgagagagccccccggccagaccaccaaggagcccttcggcggcagcagcggcgccggcagccccagccccgaggccagcgccctgctgtaccagccctacggcgccgccgtgggcctgagcgcctgcgtgttctgcggcttccccgcccccagcgagagcctgctgagagagcacgtgagactggtgcacgcccacccccactgggaggaggacggcgaggcctacgaggaggaccccgccagccagcccggcaccagccaggacgcccacgcctgcttccccgacaccgccgtggactacttcggcaaggccgagcccagcctggcccccatgtggagagagaaccccgccggctacgaccccagcctggccttcggccccggctgccagcagctgagcatcagagacttccccctgagcaagcccctgctgcacggcaccggccagagacccctgggcagactggccttccccagcaccctggccagcaccccctacagcctgcagctgggcagaaacaagagcaccgtgcacccccagggcctgggcgagagaagaagaccctggagcgaggaggaggaggaggaggaggaggaggaggacgtggtgctgaccagcgagatggacttcagccccgagaacggcgtgttcagccccctggccacccccagcctgatcccccaggccgccctggagctgaagcaggccttcagagaggccctgcaggccgtggaggccacccagggccagcagcagcagctgagaggcatggtgcccatcgtgctggtggccaagctgggcccccaggtgatggccgccgccagagtgccccccagactgcagcccgaggagctgggcctggccggcgcccaccccctggacttcctgctgctggacgcccccctgggcggccccctgggcctggacaccctgctggacggcgaccccgccatggccctgaagcacgaggagagaaagtgcccctactgccccgacagattccacaacggcatcggcctggccaaccacgtgagaggccacctgaacagagtgggcgtgagctacaacgtgagacacttcatcagcgccgaggaggtgaaggccatcgagagaagattcagcttccagaagaagaagaagaaggtggccaacttcgaccccggcaccttcagcctgatgagatgcgacttctgcggcgccggcttcgacaccagagccggcctgagcagccacgccagagcccacctgagagacttcggcatcaccaactgggagctgaccgtgagccccatcaacatcctgcaggagctgctggccaccagcgccgccgagcagccccccagccccctgggcagagagcccggcggcccccccggcagcttcctgaccagcagaagacccagactgcccctgaccgtgcccttcccccccacctgggccgaggaccccggccccgcctacggcgacgcccagagcctgaccacctgcgaggtgtgcggcgcctgcttcgagaccagaaagggcctgagcagccacgccagaagccacctgagacagctgggcgtggccgagagcgagagcagcggcgcccccatcgacctgctgtacgagctggtgaagcagaagggcctgcccgacgcccacctgggcctgccccccggcctggccaagaagagcagcagcctgaaggaggtggtggccggcgcccccagacccggcctgctgagcctggccaagcccctggacgcccccgccgtgaacaaggccatcaagagcccccccggcttcagcgccaagggcctgggccacccccccagcagccccctgctgaagaagacccccctggccctggccggcagccccacccccaagaaccccgaggacaagagcccccagctgagcctgagccccagacccgccagccccaaggcccagtggccccagagcgaggacgagggccccctgaacctgaccagcggccccgagcccgccagagacatcagatgcgagttctgcggcgagttcttcgagaacagaaagggcctgagcagccacgccagaagccacctgagacagatgggcgtgaccgagtggtacgtgaacggcagccccatcgacaccctgagagagatcctgaagagaagaacccagagcagacccggcggcccccccaacccccccggccccagccccaaggccctggccaagatgatgggcggcgccggccccggcagcagcctggaggccagaagccccagcgacctgcacatcagccccctggccaagaagctgccccccccccccggcagccccctgggccacagccccaccgccagccccccccccaccgccagaaagatgttccccggcctggccgcccccagcctgcccaagaagctgaagcccgagcagatcagagtggagatcaagagagagatgctgcccggcgccctgcacggcgagctgcaccccagcgagggcccctggggcgcccccagagaggacatgacccccctgaacctgagcagcagagccgagcccgtgagagacatcagatgcgagttctgcggcgagttcttcgagaacagaaagggcctgagcagccacgccagaagccacctgagacagatgggcgtgaccgagtggagcgtgaacggcagccccatcgacaccctgagagagatcctgaagaagaagagcaagccctgcctgatcaagaaggagccccccgccggcgacctggcccccgccctggccgaggacggcccccccaccgtggcccccggccccgtgcagagccccctgcccctgagccccctggccggcagacccggcaagcccggcgccggccccgcccaggtgcccagagagctgagcctgacccccatcaccggcgccaagcccagcgccaccggctacctgggcagcgtggccgccaagagacccctgcaggaggacagactgctgcccgccgaggtgaaggccaagacctacatccagaccgagctgcccttcaaggccaagaccctgcacgagaagaccagccacagcagcaccgaggcctgctgcgagctgtgcggcctgtacttcgagaacagaaaggccctggccagccacgccagagcccacctgagacagttcggcgtgaccgagtggtgcgtgaacggcagccccatcgagaccctgagcgagtggatcaagcacagaccccagaaggtgggcgcctacagaagctacatccagggcggcagacccttcaccaagaagttcagaagcgccggccacggcagagacagcgacaagagacccagcctgggcctggcccccggcggcctggccgtggtgggcagaagcgccggcggcgagcccggccccgaggccggcagagccgccgacggcggcgagagacccctggccgccagcccccccggcaccgtgaaggccgaggagcaccagagacagaacatcaacaagttcgagagaagacaggccagaccccccgacgccagcgccgccagaggcggcgaggacaccaacgacctgcagcagaagctggaggaggtgagacagcccccccccagagtgagacccgtgcccagcctggtgcccagacccccccagaccagcctggtgaagttcgtgggcaacatctacaccctgaagtgcagattctgcgaggtggagttccagggccccctgagcatccaggaggagtgggtgagacacctgcagagacacatcctggagatgaacttcagcaaggccgaccccccccccgaggagagccaggccccccaggcccagaccgccgccgccgaggccccctag

SEQ ID NO: 10052 - DNA, 2508 bp, Artificial Sequence
  Description of Artificial Sequence: Synthetic coding sequence
atggtggccatggacctgggcagccccagcctgcccaagaagagcctgcccgtgcccggcgccctggagcaggtggccagcagactgagcagcaaggtggccgccgaggtgccccacggcagcaagcaggagctgcaggacctgaaggcccagagcctgaccacctgcgaggtgtgcggcgcctgcttcgagaccagaaagggcctgagcagccacgccagaagccacctgagacagctgggcgtggccgagagcgagagcagcggcgcccccatcgacctgctgtacgagctggtgaagcagaagggcctgcccgacgcccacctgggcctgccccccggcctggccaagaagagcagcagcctgaaggaggtggtggccggcgcccccagacccggcctgctgagcctggccaagcccctggacgcccccgccgtgaacaaggccatcaagagcccccccggcttcagcgccaagggcctgggccacccccccagcagccccctgctgaagaagacccccctggccctggccggcagccccacccccaagaaccccgaggacaagagcccccagctgagcctgagccccagacccgccagccccaaggcccagtggccccagagcgaggacgagggccccctgaacctgaccagcggccccgagcccgccagagacatcagatgcgagttctgcggcgagttcttcgagaacagaaagggcctgagcagccacgccagaagccacctgagacagatgggcgtgaccgagtggtacgtgaacggcagccccatcgacaccctgagagagatcctgaagagaagaacccagagcagacccggcggcccccccaacccccccggccccagccccaaggccctggccaagatgatgggcggcgccggccccggcagcagcctggaggccagaagccccagcgacctgcacatcagccccctggccaagaagctgccccccccccccggcagccccctgggccacagccccaccgccagccccccccccaccgccagaaagatgttccccggcctggccgcccccagcctgcccaagaagctgaagcccgagcagatcagagtggagatcaagagagagatgctgcccggcgccctgcacggcgagctgcaccccagcgagggcccctggggcgcccccagagaggacatgacccccctgaacctgagcagcagagccgagcccgtgagagacatcagatgcgagttctgcggcgagttcttcgagaacagaaagggcctgagcagccacgccagaagccacctgagacagatgggcgtgaccgagtggagcgtgaacggcagccccatcgacaccctgagagagatcctgaagaagaagagcaagccctgcctgatcaagaaggagccccccgccggcgacctggcccccgccctggccgaggacggcccccccaccgtggcccccggccccgtgcagagccccctgcccctgagccccctggccggcagacccggcaagcccggcgccggccccgcccaggtgcccagagagctgagcctgacccccatcaccggcgccaagcccagcgccaccggctacctgggcagcgtggccgccaagagacccctgcaggaggacagactgctgcccgccgaggtgaaggccaagacctacatccagaccgagctgcccttcaaggccaagaccctgcacgagaagaccagccacagcagcaccgaggcctgctgcgagctgtgcggcctgtacttcgagaacagaaaggccctggccagccacgccagagcccacctgagacagttcggcgtgaccgagtggtgcgtgaacggcagccccatcgagaccctgagcgagtggatcaagcacagaccccagaaggtgggcgcctacagaagctacatccagggcggcagacccttcaccaagaagttcagaagcgccggccacggcagagacagcgacaagagacccagcctgggcctggcccccggcggcctggccgtggtgggcagaagcgccggcggcgagcccggccccgaggccggcagagccgccgacggcggcgagagacccctggccgccagcccccccggcaccgtgaaggccgaggagcaccagagacagaacatcaacaagttcgagagaagacaggccagaccccccgacgccagcgccgccagaggcggcgaggacaccaacgacctgcagcagaagctggaggaggtgagacagcccccccccagagtgagacccgtgcccagcctggtgcccagacccccccagaccagcctggtgaagttcgtgggcaacatctacaccctgaagtgcagattctgcgaggtggagttccagggccccctgagcatccaggaggagtgggtgagacacctgcagagacacatcctggagatgaacttcagcaaggccgaccccccccccgaggagagccaggccccccaggcccagaccgccgccgccgaggccccctag

SEQ ID NO: 10053 - DNA, 2898 bp, Artificial Sequence
  Description of Artificial Sequence: Synthetic coding sequence
atggacctgggcagccccagcctgcccaagaagagcctgcccgtgcccggcgccctggagcaggtggccagcagactgagcagcaaggtggccgccgaggtgccccacggcagcaagcaggagctgcaggacctgaaggcccagagcctgaccacctgcgaggtgtgcggcgcctgcttcgagaccagaaagggcctgagcagccacgccagaagccacctgagacagctgggcgtggccgagagcgagagcagcggcgcccccatcgacctgctgtacgagctggtgaagcagaagggcctgcccgacgcccacctgggcctgccccccggcctggccaagaagagcagcagcctgaaggaggtggtggccggcgcccccagacccggcctgctgagcctggccaagcccctggacgcccccgccgtgaacaaggccatcaagagcccccccggcttcagcgccaagggcctgggccacccccccagcagccccctgctgaagaagacccccctggccctggccggcagccccacccccaagaaccccgaggacaagagcccccagctgagcctgagccccagacccgccagccccaaggcccagtggccccagagcgaggacgagggccccctgaacctgaccctggacagcgacggcggcagagagctggactgccagctgtgcggcgcctggttcgagaccagaaagggcctgagcagccacgccagagcccacctgagacacctgggcgtgagcgaccccgacgccaagggcagccccatcgacgtgctgcacggcctgatcagaagagacggcgtgcagatcagactgccccccagaagaggcgccctggcccaccccggcagacccccccccaccagcgccgccctgagcctgctgcccccccccccccccgccaagaaggccaagctgaaggccgccggcatggccagcccctggggcaagcaggacctgagcgccgccgccgccgccggcatcttctgggccagcgacgtggagcccagccccctgaacctgagcagcggccccgagcccgccagagacatcagatgcgagttctgcggcgagttcttcgagaacagaaagggcctgagcagccacgccagaagccacctgagacagatgggcgtgaccgagtggtacgtgaacggcagccccatcgacaccctgagagagatcctgaagagaagaacccagagcagacccggcggcccccccaacccccccggccccagccccaaggccctggccaagatgatgggcggcgccggccccggcagcagcctggaggccagaagccccagcgacctgcacatcagccccctggccaagaagctgccccccccccccggcagccccctgggccacagccccaccgccagccccccccccaccgccagaaagatgttccccggcctggccgcccccagcctgcccaagaagctgaagcccgagcagatcagagtggagatcaagagagagatgctgcccggcgccctgcacggcgagctgcaccccagcgagggcccctggggcgcccccagagaggacatgacccccctgaacctgagcagcagagccgagcccgtgagagacatcagatgcgagttctgcggcgagttcttcgagaacagaaagggcctgagcagccacgccagaagccacctgagacagatgggcgtgaccgagtggagcgtgaacggcagccccatcgacaccctgagagagatcctgaagaagaagagcaagccctgcctgatcaagaaggagccccccgccggcgacctggcccccgccctggccgaggacggcccccccaccgtggcccccggccccgtgcagagccccctgcccctgagccccctggccggcagacccggcaagcccggcgccggccccgcccaggtgcccagagagctgagcctgacccccatcaccggcgccaagcccagcgccaccggctacctgggcagcgtggccgccaagagacccctgcaggaggacagactgctgcccgccgaggtgaaggccaagacctacatccagaccgagctgcccttcaaggccaagaccctgcacgagaagaccagccacagcagcaccgaggcctgctgcgagctgtgcggcctgtacttcgagaacagaaaggccctggccagccacgccagagcccacctgagacagttcggcgtgaccgagtggtgcgtgaacggcagccccatcgagaccctgagcgagtggatcaagcacagaccccagaaggtgggcgcctacagaagctacatccagggcggcagacccttcaccaagaagttcagaagcgccggccacggcagagacagcgacaagagacccagcctgggcctggcccccggcggcctggccgtggtgggcagaagcgccggcggcgagcccggccccgaggccggcagagccgccgacggcggcgagagacccctggccgccagcccccccggcaccgtgaaggccgaggagcaccagagacagaacatcaacaagttcgagagaagacaggccagaccccccgacgccagcgccgccagaggcggcgaggacaccaacgacctgcagcagaagctggaggaggtgagacagcccccccccagagtgagacccgtgcccagcctggtgcccagacccccccagaccagcctggtgaagttcgtgggcaacatctacaccctgaagtgcagattctgcgaggtggagttccagggccccctgagcatccaggaggagtgggtgagacacctgcagagacacatcctggagatgaacttcagcaaggccgaccccccccccgaggagagccaggccccccaggcccagaccgccgccgccgaggccccctag

SEQ ID NO: 10054 - DNA, 846 bp, Artificial Sequence
  Description of Artificial Sequence: Synthetic coding sequence
atggccagcagaggcagaagacccgagcacggcggcccccccgagctgttctacgacgagaccgaggccagaaagtacgtgagaaacagcagaatgatcgacatccagaccagaatggccggcagagccctggagctgctgtacctgcccgagaacaagccctgctacctgctggacatcggctgcggcaccggcctgagcggcagctacctgagcgacgagggccactactgggtgggcctggacatcagccccgccatgctggacgaggccgtggacagagagatcgagggcgacctgctgctgggcgacatgggccagggcatccccttcaagcccggcaccttcgacggctgcatcagcatcagcgccgtgcagtggctgtgcaacgccaacaagaagagcgagaaccccgccaagagactgtactgcttcttcgccagcctgttcagcgtgctggtgagaggcagcagagccgtgctgcagctgtaccccgagaacagcgagcagctggagctgatcaccacccaggccaccaaggccggcttcagcggcggcatggtggtggactaccccaacagcgccaaggccaagaagttctacctgtgcctgttcagcggccccagcaccttcatccccgagggcctgagcgagaaccaggacgaggtggagcccagagagagcgtgttcaccaacgagagattccccctgagaatgagcagaagaggcatggtgagaaagagcagagcctgggtgctggagaagaaggagagacacagaagacagggcagagaggtgagacccgacacccagtacaccggcagaaagagaaagcccagattctag

SEQ ID NO: 10055 - DNA, 372 bp, Artificial Sequence
  Description of Artificial Sequence: Synthetic coding sequence
atggccgacccccagagctgcttcatgaccagacagaagcccggcaacaccttcgccagcgagggcagcctgaacaccgccggcagacccggcgtgggcaagagacaggtggcccccgtggccggcgtggccagaaagggcagaagaatctggggcagcagaatgatcgacatccagaccagaatggccggcagagccctggagctgctgtacctgcccgagaacaagccctgctacctgctggacatcggctgcggcaccggcctgagcggcagctacctgagcgacgagggccactactgggtgggcctggacatcagccccgccatgctgggccccggcatccccagctgccccgccgccgtgccctag

SEQ ID NO: 10056 - DNA, 897 bp, Artificial Sequence
  Description of Artificial Sequence: Synthetic coding sequence
atggccagcagaggcagaagacccgagcacggcggcccccccgagctgttctacgacgagaccgaggccagaaagtacgtgagaaacagcagaatgatcgacatccagaccagaatggccggcagagccctggagctgctgtacctgcccgagaacaagccctgctacctgctggacatcggctgcggcaccggcctgagcggcagctacctgagcgacgagggccactactgggtgggcctggacatcagccccgccatgctggacgaggccgtggacagagagatcgagggcgacctgctgctgggcgacatgggccagggcatccccttcaagcccggcaccttcgacggctgcatcagcatcagcgccgtgcagtggctgtgcaacgccaacaagaagagcgagaaccccgccaagagactgtactgcttcttcgccagcctgttcagcgtgctggtgagaggcagcagagccgtgctgcagctgtaccccgagaacagcgagcagctggagctgatcaccacccaggccaccaaggccggcttcagcggcggcatggtggtggactaccccaacagcgccaaggccaagaagttctacctgtgcctgttcagcggccccagcaccttcatccccgagggcctgagcgagaaccaggacgaggtggagcccagagagagcgtgttcaccaacgagagagagggcggcgccttcgagagaagaggcatcagaggccaccagaccagaagattccccctgagaatgagcagaagaggcatggtgagaaagagcagagcctgggtgctggagaagaaggagagacacagaagacagggcagagaggtgagacccgacacccagtacaccggcagaaagagaaagcccagattctag

SEQ ID NO: 10057 - DNA, 1131 bp, Artificial Sequence
  Description of Artificial Sequence: Synthetic coding sequence
atggccgactactggaagagccagcccaagaagttctgcgactactgcaagtgctggatcgccgacaacagacccagcgtggagttccacgagagaggcaagaaccacaaggagaacgtggccaagagaatcagcgagatcaagcagaagagcctggacaaggccaaggaggaggagaaggccagcaaggagttcgccgccatggaggccgccgccctgaaggcctaccaggaggacctgaagagactgggcctggagagcgagatcctggagcccagcatcacccccgtgaccagcaccatcccccccaccagcaccagcaaccagcagaaggagaagaaggagaagaagaagagaaagaaggaccccagcaagggcagatgggtggagggcatcaccagcgagggctaccactactactacgacctgatcagcggcgccagccagtgggagaagcccgagggcttccagggcgacctgaagaagaccgccgtgaagaccgtgtgggtggagggcctgagcgaggacggcttcacctactactacaacaccgagaccggcgagagcagatgggagaagcccgacgacttcatcccccacaccagcgacctgcccagcagcaaggtgaacgagaacagcctgggcaccctggacgagagcaagagcagcgacagccacagcgacagcgacggcgagcaggaggccgaggagggcggcgtgagcaccgagaccgagaagcccaagatcaagttcaaggagaagaacaagaacagcgacggcggcagcgaccccgagacccagaaggagaagagcatccagaagcagaacagcctgggcagcaacgaggagaagagcaagaccctgaagaagagcaacccctacggcgagtggcaggagatcaagcaggaggtggagagccacgaggaggtggacctggagctgcccagcaccgagaacgagtacgtgagcaccagcgaggccgacggcggcggcgagcccaaggtggtgttcaaggagaagaccgtgaccagcctgggcgtgatggccgacggcgtggcccccgtgttcaagaagagaagaaccgagaacggcaagagcagaaacctgagacagagaggcgacgaccagtag

SEQ ID NO: 10058 - DNA, 1068 bp, Artificial Sequence
  Description of Artificial Sequence: Synthetic coding sequence
atggccgactactggaagagccagcccaagaagttctgcgactactgcaagtgctggatcgccgacaacagacccatcaagcagaagagcctggacaaggccaaggaggaggagaaggccagcaaggagttcgccgccatggaggccgccgccctgaaggcctaccaggaggacctgaagagactgggcctggagagcgagatcctggagcccagcatcacccccgtgaccagcaccatcccccccaccagcaccagcaaccagcagaaggagaagaaggagaagaagaagagaaagaaggaccccagcaagggcagatgggtggagggcatcaccagcgagggctaccactactactacgacctgatcagcggcgccagccagtgggagaagcccgagggcttccagggcgacctgaagaagaccgccgtgaagaccgtgtgggtggagggcctgagcgaggacggcttcacctactactacaacaccgagaccggcgagagcagatgggagaagcccgacgacttcatcccccacaccagcgacctgcccagcagcaaggtgaacgagaacagcctgggcaccctggacgagagcaagagcagcgacagccacagcgacagcgacggcgagcaggaggccgaggagggcggcgtgagcaccgagaccgagaagcccaagatcaagttcaaggagaagaacaagaacagcgacggcggcagcgaccccgagacccagaaggagaagagcatccagaagcagaacagcctgggcagcaacgaggagaagagcaagaccctgaagaagagcaacccctacggcgagtggcaggagatcaagcaggaggtggagagccacgaggaggtggacctggagctgcccagcaccgagaacgagtacgtgagcaccagcgaggccgacggcggcggcgagcccaaggtggtgttcaaggagaagaccgtgaccagcctgggcgtgatggccgacggcgtggcccccgtgttcaagaagagaagaaccgagaacggcaagagcagaaacctgagacagagaggcgacgaccagtag

SEQ ID NO: 10059 - DNA, 354 bp, Artificial Sequence
  Description of Artificial Sequence: Synthetic coding sequence
atgagcctgaccagcgacgccagcagccccagaagctacgtgagccccagaatcagcaccccccagaccaacaccgtgcccatcaagcccctgatcagcaccccccccgtgagcagccagcccaaggtgagcacccccgtggtgaagcagggccccgtgagccagagcgccacccagcagcccgtgaccgccgacaagagcaaggtgatgaacctgagcctgctggaggtgttcagcgcccaggtggccagagaggtgcaccacctggtgcccatcatcctgctgatcgtggtgatgcaccagatgcagcagctgtaccacagaatcctgctgcccgaccccagagtgcactag

SEQ ID NO: 10060 - DNA, 1635 bp, Artificial Sequence
  Description of Artificial Sequence: Synthetic coding sequence
atggtgatgtacgccagaaagcagcagagactgagcgacggctgccacgacagaagaggcgacagccagccctaccaggccctgaagtacagcagcaagagccaccccagcagcggcgaccacagacacgagaagatgagagacgccggcgaccccagcccccccaacaagatgctgagaagaagcgacagccccgagaacaagtacagcgacagcaccggccacagcaaggccaagaacgtgcacacccacagagtgagagagagagacggcggcaccagctacagcccccaggagaacagccacaaccacagcgccctgcacagcagcaacagccacagcagcaaccccagcaacaaccccagcaagaccagcgacgccccctacgacagcgccgacgactggagcgagcacatcagcagcagcggcaagaagtactactacaactgcagaaccgaggtgagccagtgggagaagcccaaggagtggctggagagagagcagagacagaaggaggccaacaagatggccgtgaacagcttccccaaggacagagactacagaagagaggtgatgcaggccaccgccaccagcggcttcgccagcggcaagagcaccagcggcgacaagcccgtgagccacagctgcaccacccccagcaccagcagcgccagcggcctgaaccccaccagcgccccccccaccagcgccagcgccgtgcccgtgagccccgtgccccagagccccatcccccccctgctgcaggaccccaacctgctgagacagctgctgcccgccctgcaggccaccctgcagctgaacaacagcaacgtggacatcagcaagatcaacgaggtgctgaccgccgccgtgacccaggccagcctgcagagcatcatccacaagttcctgaccgccggccccagcgccttcaacatcaccagcctgatcagccaggccgcccagctgagcacccaggcccagcccagcaaccagagccccatgagcctgaccagcgacgccagcagccccagaagctacgtgagccccagaatcagcaccccccagaccaacaccgtgcccatcaagcccctgatcagcaccccccccgtgagcagccagcccaaggtgagcacccccgtggtgaagcagggccccgtgagccagagcgccacccagcagcccgtgaccgccgacaagcagcagggccacgagcccgtgagccccagaagcctgcagagaagcagcagccagagaagccccagccccggccccaaccacaccagcaacagcagcaacgccagcaacgccaccgtggtgccccagaacagcagcgccagaagcacctgcagcctgacccccgccctggccgcccacttcagcgagaacctgatcaagcacgtgcagggctggcccgccgaccacgccgagaagcaggccagcagactgagagaggaggcccacaacatgggcaccatccacatgagcgagatctgcaccgagctgaagaacctgagaagcctggtgagagtgtgcgagatccaggccaccctgagagagcagagaatcctgttcctgagacagcagatcaaggagctggagaagctgaagaaccagaacagcttcatggtgtag

SEQ ID NO: 10061 - DNA, 1944 bp, Artificial Sequence
  Description of Artificial Sequence: Synthetic coding sequence
atggtgatgtacgccagaaagcagcagagactgagcgacggctgccacgacagaagaggcgacagccagccctaccaggccctgaagtacagcagcaagagccaccccagcagcggcgaccacagacacgagaagatgagagacgccggcgaccccagcccccccaacaagatgctgagaagaagcgacagccccgagaacaagtacagcgacagcaccggccacagcaaggccaagaacgtgcacacccacagagtgagagagagagacggcggcaccagctacagcccccaggagaacagccacaaccacagcgccctgcacagcagcaacagccacagcagcaaccccagcaacaaccccagcaagaccagcgacgccccctacgacagcgccgacgactggagcgagcacatcagcagcagcggcaagaagtactactacaactgcagaaccgaggtgagccagtgggagaagcccaaggagtggctggagagagagcagagacagaaggaggccaacaagatggccgtgaacagcttccccaaggacagagactacagaagagaggtgatgcaggccaccgccaccagcggcttcgccagcggcatggaggacaagcacagcagcgacgccagcagcctgctgccccagaacatcctgagccagaccagcagacacaacgacagagactacagactgcccagagccgagacccacagcagcagcacccccgtgcagcaccccatcaagcccgtggtgcaccccaccgccacccccagcaccgtgcccagcagccccttcaccctgcagagcgaccaccagcccaagaagagcttcgacgccaacggcgccagcaccctgagcaagctgcccacccccaccagcagcgtgcccgcccagaagaccgagagaaaggagagcaccagcggcgacaagcccgtgagccacagctgcaccacccccagcaccagcagcgccagcggcctgaaccccaccagcgccccccccaccagcgccagcgccgtgcccgtgagccccgtgccccagagccccatcccccccctgctgcaggaccccaacctgctgagacagctgctgcccgccctgcaggccaccctgcagctgaacaacagcaacgtggacatcagcaagatcaacgaggtgctgaccgccgccgtgacccaggccagcctgcagagcatcatccacaagttcctgaccgccggccccagcgccttcaacatcaccagcctgatcagccaggccgcccagctgagcacccaggcccagcccagcaaccagagccccatgagcctgaccagcgacgccagcagccccagaagctacgtgagccccagaatcagcaccccccagaccaacaccgtgcccatcaagcccctgatcagcaccccccccgtgagcagccagcccaaggtgagcacccccgtggtgaagcagggccccgtgagccagagcgccacccagcagcccgtgaccgccgacaagcagcagggccacgagcccgtgagccccagaagcctgcagagaagcagcagccagagaagccccagccccggccccaaccacaccagcaacagcagcaacgccagcaacgccaccgtggtgccccagaacagcagcgccagaagcacctgcagcctgacccccgccctggccgcccacttcagcgagaacctgatcaagcacgtgcagggctggcccgccgaccacgccgagaagcaggccagcagactgagagaggaggcccacaacatgggcaccatccacatgagcgagatctgcaccgagctgaagaacctgagaagcctggtgagagtgtgcgagatccaggccaccctgagagagcagagaatcctgttcctgagacagcagatcaaggagctggagaagctgaagaaccagaacagcttcatggtgtag

SEQ ID NO: 10062 - DNA, 1809 bp, Artificial Sequence
  Description of Artificial Sequence: Synthetic coding sequence
atgagagacgccggcgaccccagcccccccaacaagatgctgagaagaagcgacagccccgagaacaagtacagcgacagcaccggccacagcaaggccaagaacgtgcacacccacagagtgagagagagagacggcggcaccagctacagcccccaggagaacagccacaaccacagcgccctgcacagcagcaacagccacagcagcaaccccagcaacaaccccagcaagaccagcgacgccccctacgacagcgccgacgactggagcgagcacatcagcagcagcggcaagaagtactactacaactgcagaaccgaggtgagccagtgggagaagcccaaggagtggctggagagagagcagagacagaaggaggccaacaagatggccgtgaacagcttccccaaggacagagactacagaagagaggtgatgcaggccaccgccaccagcggcttcgccagcggcatggaggacaagcacagcagcgacgccagcagcctgctgccccagaacatcctgagccagaccagcagacacaacgacagagactacagactgcccagagccgagacccacagcagcagcacccccgtgcagcaccccatcaagcccgtggtgcaccccaccgccacccccagcaccgtgcccagcagccccttcaccctgcagagcgaccaccagcccaagaagagcttcgacgccaacggcgccagcaccctgagcaagctgcccacccccaccagcagcgtgcccgcccagaagaccgagagaaaggagagcaccagcggcgacaagcccgtgagccacagctgcaccacccccagcaccagcagcgccagcggcctgaaccccaccagcgccccccccaccagcgccagcgccgtgcccgtgagccccgtgccccagagccccatcccccccctgctgcaggaccccaacctgctgagacagctgctgcccgccctgcaggccaccctgcagctgaacaacagcaacgtggacatcagcaagatcaacgaggtgctgaccgccgccgtgacccaggccagcctgcagagcatcatccacaagttcctgaccgccggccccagcgccttcaacatcaccagcctgatcagccaggccgcccagctgagcacccaggcccagcccagcaaccagagccccatgagcctgaccagcgacgccagcagccccagaagctacgtgagccccagaatcagcaccccccagaccaacaccgtgcccatcaagcccctgatcagcaccccccccgtgagcagccagcccaaggtgagcacccccgtggtgaagcagggccccgtgagccagagcgccacccagcagcccgtgaccgccgacaagcagcagggccacgagcccgtgagccccagaagcctgcagagaagcagcagccagagaagccccagccccggccccaaccacaccagcaacagcagcaacgccagcaacgccaccgtggtgccccagaacagcagcgccagaagcacctgcagcctgacccccgccctggccgcccacttcagcgagaacctgatcaagcacgtgcagggctggcccgccgaccacgccgagaagcaggccagcagactgagagaggaggcccacaacatgggcaccatccacatgagcgagatctgcaccgagctgaagaacctgagaagcctggtgagagtgtgcgagatccaggccaccctgagagagcagagaatcctgttcctgagacagcagatcaaggagctggagaagctgaagaaccagaacagcttcatggtgtag

SEQ ID NO: 10063 - DNA, 702 bp, Artificial Sequence
  Description of Artificial Sequence: Synthetic coding sequence
atgagagacgccggcgaccccagcccccccaacaagatgctgagaagaagcgacagccccgagaacaagtacagcgacagcaccggccacagcaaggccaagaacgtgcacacccacagagtgagagagagagacggcggcaccagctacagcccccaggagaacagccacaaccacagcgccctgcacagcagcaacagccacagcagcaaccccagcaacaaccccagcaagaccagcgacgccccctacgacagcgccgacgactggagcgagcacatcagcagcagcggcaagaagtactactacaactgcagaaccgaggtgagccagtgggagaagcccaaggagtggctggagagagagcagagacagaaggaggccaacaagatggccgtgaacagcttccccaaggacagagactacagaagagaggtgatgcaggccaccgccaccagcggcttcgccagcggcatggaggacaagcacagcagcgacgccagcagcctgctgccccagaacatcctgagccagaccagcagacacaacgacagagactacagactgcccagagccgagacccacagcagcagcacccccgtgcagcaccccatcaagcccgtggtgcaccccaccgccacccccagcaccgtgcccagcagccccttcaccctgcagagcgaccaccagcccaagaagtag

SEQ ID NO: 10064 - DNA, 615 bp, Artificial Sequence
  Description of Artificial Sequence: Synthetic coding sequence
atgagagacgccggcgaccccagcccccccaacaagatgctgagaagaagcgacagccccgagaacaagtacagcgacagcaccggccacagcaaggccaagaacgtgcacacccacagagtgagagagagagacggcggcaccagctacagcccccaggagaacagccacaaccacagcgccctgcacagcagcaacagccacagcagcaaccccagcaacaaccccagcaagaccagcgacgccccctacgacagcgccgacgactggagcgagcacatcagcagcagcggcaagaagtactactacaactgcagaaccgaggtgagccagtgggagaagcccaaggagtggctggagagagagcagagacagaaggaggccaacaagatggccgtgaacagcttccccaaggacagagactacagaagagaggtgatgcaggccaccgccaccagcggcttcgccagcggcatggaggacaagcacagcagcgacgccagcagcctgctgccccagaacatcctgagccagaccagcagacacaacgacagagactacagactgcccagagccgagacccacagcagcagcacccccgtgcagcacccctag

SEQ ID NO: 10065 - DNA, 1044 bp, Artificial Sequence
  Description of Artificial Sequence: Synthetic coding sequence
atgagagacgccggcgaccccagcccccccaacaagatgctgagaagaagcgacagccccgagaacaagtacagcgacagcaccggccacagcaaggccaagaacgtgcacacccacagagtgagagagagagacggcggcaccagctacagcccccaggagaacagccacaaccacagcgccctgcacagcagcaacagccacagcagcaaccccagcaacaaccccagcaagaccagcgacgccccctacgacagcgccgacgactggagcgagcacatcagcagcagcggcaagaagtactactacaactgcagaaccgaggtgagccagtgggagaagcccaaggagtggctggagagagagcagagacagaaggaggccaacaagatggccgtgaacagcttccccaaggacagagactacagaagagaggtgatgcaggccaccgccaccagcggcttcgccagcggcatggaggacaagcacagcagcgacgccagcagcctgctgccccagaacatcctgagccagaccagcagacacaacgacagagactacagactgcccagagccgagacccacagcagcagcacccccgtgcagcaccccatcaagcccgtggtgcaccccaccgccacccccagcaccgtgcccagcagccccttcaccctgcagagcgaccaccagcccaagaagagcttcgacgccaacggcgccagcaccctgagcaagctgcccacccccaccagcagcgtgcccgcccagaagaccgagagaaaggagagcaccagcggcgacaagcccgtgagccacagctgcaccacccccagcaccagcagcgccagcggcctgaaccccaccagcgccccccccaccagcgccagcgccgtgcccgtgagccccgtgccccagagccccatcccccccctgctgcaggaccccaacctgctgagacagctgctgcccgccctgcaggccaccctgcagctgaacaacagcaacgtggacatcagcaagatcaacgaggtgctgaccgcctag

SEQ ID NO: 10066 - DNA, 1311 bp, Artificial Sequence
  Description of Artificial Sequence: Synthetic coding sequence
atgagagacgccggcgaccccagcccccccaacaagatgctgagaagaagcgacagccccgagaacaagtacagcgacagcaccggccacagcaaggccaagaacgtgcacacccacagagtgagagagagagacggcggcaccagctacagcccccaggagaacagccacaaccacagcgccctgcacagcagcaacagccacagcagcaaccccagcaacaaccccagcaagaccagcgacgccccctacgacagcgccgacgactggagcgagcacatcagcagcagcggcaagaagtactactacaactgcagaaccgaggtgagccagtgggagaagcccaaggagtggctggagagagagcagagacagaaggaggccaacaagatggccgtgaacagcttccccaaggacagagactacagaagagaggtgatgcaggccaccgccaccagcggcttcgccagcggcatggaggacaagcacagcagcgacgccagcagcctgctgccccagaacatcctgagccagaccagcagacacaacgacagagactacagactgcccagagccgagacccacagcagcagcacccccgtgcagcaccccatcaagcccgtggtgcaccccaccgccacccccagcaccgtgcccagcagccccttcaccctgcagagcgaccaccagcccaagaagagcttcgacgccaacggcgccagcaccctgagcaagctgcccacccccaccagcagcgtgcccgcccagaagaccgagagaaaggagagcaccagcggcgacaagcccgtgagccacagctgcaccacccccagcaccagcagcgccagcggcctgaaccccaccagcgccccccccaccagcgccagcgccgtgcccgtgagccccgtgccccagagccccatcccccccctgctgcaggaccccaacctgctgagacagctgctgcccgccctgcaggccaccctgcagctgaacaacagcaacgtggacatcagcaagatcaacgaggtgctgaccgccgccgtgacccaggccagcctgcagagcatcatccacaagttcctgaccgccggccccagcgccttcaacatcaccagcctgatcagccaggccgcccagctgagcacccaggacatccccctgcacgagggcatccagatggagagagacacccacagaagcaagtgggaggtgaagggcagcctgtgccagaaggccgacaagcagcaggagtgcctggtgtggaacggcagcatcatggtgcagagactgctgcagcccagcggctag

SEQ ID NO: 10067 - DNA, 522 bp, Artificial Sequence
  Description of Artificial Sequence: Synthetic coding sequence
atgagagacgccggcgaccccagcccccccaacaagatgctgagaagaagcgacagccccgagaacaagtacagcgacagcaccggccacagcaaggccaagaacgtgcacacccacagagtgagagagagagacggcggcaccagctacagcccccaggagaacagccacaaccacagcgccctgcacagcagcaacagccacagcagcaaccccagcaacaaccccagcaagaccagcgacgccccctacgacagcgccgacgactggagcgagcacatcagcagcagcggcaagaagtactactacaactgcagaaccgaggtgagccagtgggagaagcccaaggagtggctggagagagagcagagacagaaggaggccaacaagatggccgtgaacagcttccccaaggacagagactacagaagagaggtgatgcaggccaccgccaccagcggcttcgccagcggcatggaggacaagcacagcagcgacgccagcagcctgctgccccagtag

SEQ ID NO: 10068 - DNA, 180 bp, Artificial Sequence
  Description of Artificial Sequence: Synthetic coding sequence
atgagagacgccggcgaccccagcccccccaacaagatgctgagaagaagcgacagccccgagaacaagtacagcgacagcaccggccacagcaaggccaagaacgtgcacacccacagagtgagagagagagacggcggcaccagctacagcccccaggagaacagccacaaccactag

SEQ ID NO: 10069 - DNA, 111 bp, Artificial Sequence
  Description of Artificial Sequence: Synthetic coding sequence
atgagagacgccggcgaccccagcccccccaacaagatgctgagaagaagcgacagccccgagaacaagtacagcgacagcaccggccacagcaaggccaagaacgtgtag

SEQ ID NO: 10070 - DNA, 906 bp, Artificial Sequence
  Description of Artificial Sequence: Synthetic coding sequence
atgagagacgccggcgaccccagcccccccaacaagatgctgagaagaagcgacagccccgagaacaagtacagcgacagcaccggccacagcaaggccaagaacgtgcacacccacagagtgagagagagagacggcggcaccagctacagcccccaggagaacagccacaaccacagcgccctgcacagcagcaacagccacagcagcaaccccagcaacaaccccagcaagaccagcgacgccccctacgacagcgccgacgactggagcgagcacatcagcagcagcggcaagaagtactactacaactgcagaaccgaggtgagccagtgggagaagcccaaggagtggctggagagagagcagagacagaaggaggccaacaagatggccgtgaacagcttccccaaggacagagactacagaagagaggtgatgcaggccaccgccaccagcggcttcgccagcggcatggaggacaagcacagcagcgacgccagcagcctgctgccccagaacatcctgagccagaccagcagacacaacgacagagactacagactgcccagagccgagacccacagcagcagcacccccgtgcagcaccccatcaagcccgtggtgcaccccaccgccacccccagcaccgtgcccagcagccccttcaccctgcagagcgaccaccagcccaagaagagcttcgacgccaacggcgccagcaccctgagcaagctgcccacccccaccagcagcgtgcccgcccagaagaccgagagaaaggagagcaccagcggcgacaagcccgtgagccacagctgcaccacccccagcaccagcagcgccagcggcctgaaccccaccagcgccccccccaccagcgccagcggccccaagagcagctag

SEQ ID NO: 10071 - DNA, 5469 bp, Artificial Sequence
  Description of Artificial Sequence: Synthetic coding sequence
atgtaccccaactggggcagatacggcggcagcagccactacccccccccccccgtgcccccccccccccccgtggccctgcccgaggccagccccggccccggctacagcagcagcaccacccccgccgcccccagcagcagcggcttcatgagcttcagagagcagcacctggcccagctgcagcagctgcagcagatgcaccagaagcagatgcagtgcgtgctgcagccccaccacctgccccccccccccctgccccccccccccgtgatgcccggcggcggctacggcgactggcagcccccccccccccccatgccccccccccccggccccgccctgagctaccagaagcagcagcagtacaagcaccagatgctgcaccaccagagagacggcccccccggcctggtgcccatggagctggagagcccccccgagagcccccccgtgccccccggcagctacatgccccccagccagagctacatgccccccccccagcccccccccagctactacccccccaccagcagccagccctacctgccccccgcccagcccagccccagccagagcccccccagccagagctacctggcccccacccccagctacagcagcagcagcagcagcagccagagctacctgagccacagccagagctacctgcccagcagccaggccagccccagcagacccagccagggccacagcaagagccagctgctggccccccccccccccagcgccccccccggcaacaagaccaccgtgcagcaggagcccctggagagcggcgccaagaacaagagcaccgagcagcagcaggccgcccccgagcccgaccccagcaccatgaccccccaggagcagcagcagtactggtacagacagcacctgctgagcctgcagcagagaaccaaggtgcacctgcccggccacaagaagggccccgtggtggccaaggacacccccgagcccgtgaaggaggaggtgaccgtgcccgccaccagccaggtgcccgagagccccagcagcgaggagccccccctgcccccccccaacgaggaggtgcccccccccctgccccccgaggagccccagagcgaggaccccgaggaggacgccagactgaagcagctgcaggccgccgccgcccactggcagcagcaccagcagcacagagtgggcttccagtaccagggcatcatgcagaagcacacccagctgcagcagatcctgcagcagtaccagcagatcatccagccccccccccacatccaggccaccacccccccccccggcatccccccccccggcgtgccccagggcatccccccccagctgaccgccgcccccgtgccccccgccagcagcagccagagcagccaggtgcccgagaagcccagacccgccctgctgcccacccccgtgagcttcggcagcgccccccccaccacctaccacccccccctgcagagcgccggccccagcgagcaggtgaacagcaaggcccccctgagcaagagcgccctgccctacagcagcttcagcagcgaccagggcctgggcgagagcagcgccgcccccagccagcccatcaccgccgtgaaggacatgcccgtgagaagcggcggcctgctgcccgacccccccagaagcagctacctggagagccccagaggccccagattcgacggccccagaagattcgaggacctgggcagcagatgcgagggccccagacccaagggccccagattcgagggcaacagacccgacggccccagacccagatacgagggccaccccgccgagggcaccaagagcaagtggggcatgatccccagaggccccgccagccagttctacatcacccccagcaccagcctgagccccagacagagcggcccccagtggaagggccccaagcccgccttcggccagcagcaccagcagcagcccaagagccaggccgagcccctgagcggcaacaaggagcccctggccgacaccagcagcaaccagcagaagaacttcaagatgcagagcgccgccttcagcatcgccgccgacgtgaaggacgtgaaggccgcccagagcaacgagaacctgagcgacagccagcaggagccccccaagagcgaggtgagcgagggccccgtggagcccagcaactgggaccagaacgtgcagagcatggagacccagatcgacaaggcccaggccgtgacccagcccgtgcccctggccaacaagcccgtgcccgcccagagcaccttccccagcaagaccggcggcatggagggcggcaccgccgtggccaccagcagcctgaccgccgacaacgacttcaagcccgtgggcatcggcctgccccacagcgagaacaaccaggacaagggcctgcccagacccgacaacagagacaacagactggagggcaacagaggcaacagcagcagctacagaggccccggccagagcagaatggaggacaccagagacaagggcctggtgaacagaggcagaggccaggccatcagcagaggccccggcctggtgaagcaggaggacttcagagacaagatgatgggcagaagagaggacagcagagagaagatgaacagaggcgagggcagcagagacagaggcctggtgagacccggcagcagcagagagaaggtgcccggcggcctgcagggcagccaggacagaggcgccgccggcagcagagagagaggcccccccagaagagccggcagccaggagagaggccccctgagaagagccggcagcagagagagaatcccccccagaagagccggcagcagagagagaggcccccccagaggccccggcagcagagagagaggcctgggcagaagcgacttcggcagagacagaggccccttcagacccgagcccggcgacggcggcgagaagatgtacccctaccacagagacgagccccccagagccccctggaaccacggcgaggagagaggccacgaggagttccccctggacggcagaaacgcccccatggagagagagagactggacgactgggacagagagagatactggagagagtgcgagagagactaccaggacgacaccctggagctgtacaacagagaggacagattcagcgccccccccagcagaagccacgacggcgacagaagaggcccctggtgggacgactgggagagagaccaggacatggacgaggactacaacagagagatggagagagacatggacagagacgtggacagaatcagcagacccatggacatgtacgacagaagcctggacaacgagtgggacagagactacggcagacccctggacgagcaggagagccagttcagagagagagacatccccagcctgccccccctgccccccctgccccccctgccccccctggacagatacagagacgacagatggagagaggagagaaacagagagcacggctacgacagagacttcagagacagaggcgagctgagaatcagagagtaccccgagagaggcgacacctggagagagaagagagactacgtgcccgacagaatggactgggagagagagagactgagcgacagatggtaccccagcgacgtggacagacacagccccatggccgagcacatgcccagcagccaccacagcagcgagatgatgggcagcgacgccagcctggacagcgaccagggcctgggcggcgtgatggtgctgagccagagacagcacgagatcatcctgaaggccgcccaggagctgaagatgctgagagagcagaaggagcagctgcagaagatgaaggacttcggcagcgagccccagatggccgaccacctgcccccccaggagagcagactgcagaacaccagcagcagacccggcatgtaccccccccccggcagctacagaccccccccccccatgggcaagccccccggcagcatcgtgagacccagcgccccccccgccagaagcagcgtgcccgtgaccagaccccccgtgcccatcccccccccccccccccccccccccctgcccccccccccccccgtgatcaagccccagaccagcgccgtggagcaggagagatgggacgaggacagcttctacggcctgtgggacaccaacgacgagcagggcctgaacagcgagttcaagagcgagaccgccgccatccccagcgcccccgtgctgccccccccccccgtgcacagcagcatccccccccccggccccgtgcccatgggcatgccccccatgagcaagcccccccccgtgcagcagaccgtggactacggccacggcagagacatcagcaccaacaaggtggagcagatcccctacggcgagagaatcaccctgagacccgaccccctgcccgagagaagcaccttcgagaccgagcacgccggccagagagacagatacgacagagagagagacagagagccctacttcgacagacagagcaacgtgatcgccgaccacagagacttcaagagagacagagagacccacagagacagagacagagacagaggcgtgatcgactacgacagagacagattcgacagagagagaagacccagagacgacagagcccagagctacagagacaagaaggaccacagcagcagcagaagaggcggcttcgacagacccagctacgacagaaagagcgacagacccgtgtacgagggccccagcatgttcggcggcgagagaagaacctaccccgaggagagaatgcccctgcccgcccccagcctgagccaccagcccccccccgcccccagagtggagaagaagcccgagagcaagaacgtggacgacatcctgaagccccccggcagagagagcagacccgagagaatcgtggtgatcatgagaggcctgcccggcagcggcaagacccacgtggccaagctgatcagagtgatggagtacgagtacgaggccgagatggaggagacctacagaaccagcatgttcaagaccttcaagaagaccctggacgacggcttcttccccttcatcatcctggacgccatcaacgacagagtgagacacttcgaccagttctggagcgccgccaagaccaagggcttcgaggtgtacctggccgagatgagcgccgacaaccagacctgcggcaagagaaacatccacggcagaaagctgaaggagatcaacaagatggccgaccactgggagaccgcccccagacacatgatgagactggacatcagaagcctgctgcaggacgccgccatcgaggaggtggagatggaggacttcgacgccaacatcgaggagcagaaggaggagaagaaggacgccgaggaggaggagagcgagctggtgggcgacagacccaccaccctgaacagcgtgagcctgctgaagttcctgaagaaggtgtag

SEQ ID NO: 10072 - DNA, 6441 bp, Artificial Sequence
  Description of Artificial Sequence: Synthetic coding sequence
atgtaccccaactggggcagatacggcggcagcagccactacccccccccccccgtgcccccccccccccccgtggccctgcccgaggccagccccggccccggctacagcagcagcaccacccccgccgcccccagcagcagcggcttcatgagcttcagagagcagcacctggcccagctgcagcagctgcagcagatgcaccagaagcagatgcagtgcgtgctgcagccccaccacctgccccccccccccctgccccccccccccgtgatgcccggcggcggctacggcgactggcagcccccccccccccccatgccccccccccccggccccgccctgagctaccagaagcagcagcagtacaagcaccagatgctgcaccaccagagagacggcccccccggcctggtgcccatggagctggagagcccccccgagagcccccccgtgccccccggcagctacatgccccccagccagagctacatgccccccccccagcccccccccagctactacccccccaccagcagccagccctacctgccccccgcccagcccagccccagccagagcccccccagccagagctacctggcccccacccccagctacagcagcagcagcagcagcagccagagctacctgagccacagccagagctacctgcccagcagccaggccagccccagcagacccagccagggccacagcaagagccagctgctggccccccccccccccagcgccccccccggcaacaagaccaccgtgcagcaggagcccctggagagcggcgccaagaacaagagcaccgagcagcagcaggccgcccccgagcccgaccccagcaccatgaccccccaggagcagcagcagtactggtacagacagcacctgctgagcctgcagcagagaaccaaggtgcacctgcccggccacaagaagggccccgtggtggccaaggacacccccgagcccgtgaaggaggaggtgaccgtgcccgccaccagccaggtgcccgagagccccagcagcgaggagccccccctgcccccccccaacgaggaggtgcccccccccctgccccccgaggagccccagagcgaggaccccgaggaggacgccagactgaagcagctgcaggccgccgccgcccactggcagcagcaccagcagcacagagtgggcttccagtaccagggcatcatgcagaagcacacccagctgcagcagatcctgcagcagtaccagcagatcatccagccccccccccacatccagaccatgagcgtggacatgcagctgagacactacgagatgcagcagcagcagttccagcacctgtaccaggagtgggagagagagttccagctgtgggaggagcagctgcacagctacccccacaaggaccagctgcaggagtacgagaagcagtggaagacctggcagggccacatgaaggccacccagagctacctgcaggagaaggtgaacagcttccagaacatgaagaaccagtacatgggcaacatgagcatgcccccccccttcgtgccctacagccagatgcccccccccctgcccaccatgcccccccccgtgctgccccccagcctgcccccccccgtgatgccccccgccctgcccgccaccgtgcccccccccggcatgcccccccccgtgatgccccccagcctgcccaccagcgtgcccccccccggcatgccccccagcctgagcagcgccggccccccccccgtgctgcccccccccagcctgagcagcgccggccccccccccgtgctgcccccccccagcctgagcagcaccgcccccccccccgtgatgcccctgccccccctgagcagcgccacccccccccccggcatccccccccccggcgtgccccagggcatccccccccagctgaccgccgcccccgtgccccccgccagcagcagccagagcagccaggtgcccgagaagcccagacccgccctgctgcccacccccgtgagcttcggcagcgccccccccaccacctaccacccccccctgcagagcgccggccccagcgagcaggtgaacagcaaggcccccctgagcaagagcgccctgccctacagcagcttcagcagcgaccagggcctgggcgagagcagcgccgcccccagccagcccatcaccgccgtgaaggacatgcccgtgagaagcggcggcctgctgcccgacccccccagaagcagctacctggagagccccagaggccccagattcgacggccccagaagattcgaggacctgggcagcagatgcgagggccccagacccaagggccccagattcgagggcaacagacccgacggccccagacccagatacgagggccaccccgccgagggcaccaagagcaagtggggcatgatccccagaggccccgccagccagttctacatcacccccagcaccagcctgagccccagacagagcggcccccagtggaagggccccaagcccgccttcggccagcagcaccagcagcagcccaagagccaggccgagcccctgagcggcaacaaggagcccctggccgacaccagcagcaaccagcagaagaacttcaagatgcagagcgccgccttcagcatcgccgccgacgtgaaggacgtgaaggccgcccagagcaacgagaacctgagcgacagccagcaggagccccccaagagcgaggtgagcgagggccccgtggagcccagcaactgggaccagaacgtgcagagcatggagacccagatcgacaaggcccaggccgtgacccagcccgtgcccctggccaacaagcccgtgcccgcccagagcaccttccccagcaagaccggcggcatggagggcggcaccgccgtggccaccagcagcctgaccgccgacaacgacttcaagcccgtgggcatcggcctgccccacagcgagaacaaccaggacaagggcctgcccagacccgacaacagagacaacagactggagggcaacagaggcaacagcagcagctacagaggccccggccagagcagaatggaggacaccagagacaagggcctggtgaacagaggcagaggccaggccatcagcagaggccccggcctggtgaagcaggaggacttcagagacaagatgatgggcagaagagaggacagcagagagaagatgaacagaggcgagggcagcagagacagaggcctggtgagacccggcagcagcagagagaaggtgcccggcggcctgcagggcagccaggacagaggcgccgccggcagcagagagagaggcccccccagaagagccggcagccaggagagaggccccctgagaagagccggcagcagagagagaatcccccccagaagagccggcagcagagagagaggcccccccagaggccccggcagcagagagagaggcctgggcagaagcgacttcggcagagacagaggccccttcagacccgagcccggcgacggcggcgagaagatgtacccctaccacagagacgagccccccagagccccctggaaccacggcgaggagagaggccacgaggagttccccctggacggcagaaacgcccccatggagagagagagactggacgactgggacagagagagatactggagagagtgcgagagagactaccaggacgacaccctggagctgtacaacagagaggacagattcagcgccccccccagcagaagccacgacggcgacagaagaggcccctggtgggacgactgggagagagaccaggacatggacgaggactacaacagagagatggagagagacatggacagagacgtggacagaatcagcagacccatggacatgtacgacagaagcctggacaacgagtgggacagagactacggcagacccctggacgagcaggagagccagttcagagagagagacatccccagcctgccccccctgccccccctgccccccctgccccccctggacagatacagagacgacagatggagagaggagagaaacagagagcacggctacgacagagacttcagagacagaggcgagctgagaatcagagagtaccccgagagaggcgacacctggagagagaagagagactacgtgcccgacagaatggactgggagagagagagactgagcgacagatggtaccccagcgacgtggacagacacagccccatggccgagcacatgcccagcagccaccacagcagcgagatgatgggcagcgacgccagcctggacagcgaccagggcctgggcggcgtgatggtgctgagccagagacagcacgagatcatcctgaaggccgcccaggagctgaagatgctgagagagcagaaggagcagctgcagaagatgaaggacttcggcagcgagccccagatggccgaccacctgcccccccaggagagcagactgcagaacaccagcagcagacccggcatgtaccccccccccggcagctacagaccccccccccccatgggcaagccccccggcagcatcgtgagacccagcgccccccccgccagaagcagcgtgcccgtgaccagaccccccgtgcccatcccccccccccccccccccccccccctgcccccccccccccccgtgatcaagccccagaccagcgccgtggagcaggagagatgggacgaggacagcttctacggcctgtgggacaccaacgacgagcagggcctgaacagcgagttcaagagcgagaccgccgccatccccagcgcccccgtgctgccccccccccccgtgcacagcagcatccccccccccggccccgtgcccatgggcatgccccccatgagcaagcccccccccgtgcagcagaccgtggactacggccacggcagagacatcagcaccaacaaggtggagcagatcccctacggcgagagaatcaccctgagacccgaccccctgcccgagagaagcaccttcgagaccgagcacgccggccagagagacagatacgacagagagagagacagagagccctacttcgacagacagagcaacgtgatcgccgaccacagagacttcaagagagacagagagacccacagagacagagacagagacagaggcgtgatcgactacgacagagacagattcgacagagagagaagacccagagacgacagagcccagagctacagagacaagaaggaccacagcagcagcagaagaggcggcttcgacagacccagctacgacagaaagagcgacagacccgtgtacgagggccccagcatgttcggcggcgagagaagaacctaccccgaggagagaatgcccctgcccgcccccagcctgagccaccagcccccccccgcccccagagtggagaagaagcccgagagcaagaacgtggacgacatcctgaagccccccggcagagagagcagacccgagagaatcgtggtgatcatgagaggcctgcccggcagcggcaagacccacgtggccaagctgatcagagacaaggaggtggagttcggcggccccgcccccagagtgctgagcctggacgactacttcatcaccgaggtggagaaggaggagaaggaccccgacagcggcaagaaggtgaagaagaaggtgatggagtacgagtacgaggccgagatggaggagacctacagaaccagcatgttcaagaccttcaagaagaccctggacgacggcttcttccccttcatcatcctggacgccatcaacgacagagtgagacacttcgaccagttctggagcgccgccaagaccaagggcttcgaggtgtacctggccgagatgagcgccgacaaccagacctgcggcaagagaaacatccacggcagaaagctgaaggagatcaacaagatggccgaccactgggagaccgcccccagacacatgatgagactggacatcagaagcctgctgcaggacgccgccatcgaggaggtggagatggaggacttcgacgccaacatcgaggagcagaaggaggagaagaaggacgccgaggaggaggagagcgagctgggctacatccccaagagcaagtgggagatggacaccagcgaggccaagctggacaagctggacggcctgagaaccggcaccaagagaaagagagactgggaggccatcgccagcagaatggaggactacctgcagctgcccgacgactacgacaccagagccagcgagcccggcaagaagagagtgagatgggccgacctggaggagaagaaggacgccgacagaaagagagccatcggcttcgtggtgggccagaccgactgggagaagatcaccgacgagagcggccacctggccgagaaggccctgaacagaaccaagtacatctag

SEQ ID NO: 10073 - DNA, 5565 bp, Artificial Sequence
  Description of Artificial Sequence: Synthetic coding sequence
atgaccccccaggagcagcagcagtactggtacagacagcacctgctgagcctgcagcagagaaccaaggtgcacctgcccggccacaagaagggccccgtggtggccaaggacacccccgagcccgtgaaggaggaggtgaccgtgcccgccaccagccaggtgcccgagagccccagcagcgaggagccccccctgcccccccccaacgaggaggtgcccccccccctgccccccgaggagccccagagcgaggaccccgaggaggacgccagactgaagcagctgcaggccgccgccgcccactggcagcagcaccagcagcacagagtgggcttccagtaccagggcatcatgcagaagcacacccagctgcagcagatcctgcagcagtaccagcagatcatccagccccccccccacatccagaccatgagcgtggacatgcagctgagacactacgagatgcagcagcagcagttccagcacctgtaccaggagtgggagagagagttccagctgtgggaggagcagctgcacagctacccccacaaggaccagctgcaggagtacgagaagcagtggaagacctggcagggccacatgaaggccacccagagctacctgcaggagaaggtgaacagcttccagaacatgaagaaccagtacatgggcaacatgagcatgcccccccccttcgtgccctacagccagatgcccccccccctgcccaccatgcccccccccgtgctgccccccagcctgcccccccccgtgatgccccccgccctgcccgccaccgtgcccccccccggcatgcccccccccgtgatgccccccagcctgcccaccagcgtgcccccccccggcatgccccccagcctgagcagcgccggccccccccccgtgctgcccccccccagcctgagcagcgccggccccccccccgtgctgcccccccccagcctgagcagcaccgcccccccccccgtgatgcccctgccccccctgagcagcgccacccccccccccggcatccccccccccggcgtgccccagggcatccccccccagctgaccgccgcccccgtgccccccgccagcagcagccagagcagccaggtgcccgagaagcccagacccgccctgctgcccacccccgtgagcttcggcagcgccccccccaccacctaccacccccccctgcagagcgccggccccagcgagcaggtgaacagcaaggcccccctgagcaagagcgccctgccctacagcagcttcagcagcgaccagggcctgggcgagagcagcgccgcccccagccagcccatcaccgccgtgaaggacatgcccgtgagaagcggcggcctgctgcccgacccccccagaagcagctacctggagagccccagaggccccagattcgacggccccagaagattcgaggacctgggcagcagatgcgagggccccagacccaagggccccagattcgagggcaacagacccgacggccccagacccagatacgagggccaccccgccgagggcaccaagagcaagtggggcatgatccccagaggccccgccagccagttctacatcacccccagcaccagcctgagccccagacagagcggcccccagtggaagggccccaagcccgccttcggccagcagcaccagcagcagcccaagagccaggccgagcccctgagcggcaacaaggagcccctggccgacaccagcagcaaccagcagaagaacttcaagatgcagagcgccgccttcagcatcgccgccgacgtgaaggacgtgaaggccgcccagagcaacgagaacctgagcgacagccagcaggagccccccaagagcgaggtgagcgagggccccgtggagcccagcaactgggaccagaacgtgcagagcatggagacccagatcgacaaggcccaggccgtgacccagcccgtgcccctggccaacaagcccgtgcccgcccagagcaccttccccagcaagaccggcggcatggagggcggcaccgccgtggccaccagcagcctgaccgccgacaacgacttcaagcccgtgggcatcggcctgccccacagcgagaacaaccaggacaagggcctgcccagacccgacaacagagacaacagactggagggcaacagaggcaacagcagcagctacagaggccccggccagagcagaatggaggacaccagagacaagggcctggtgaacagaggcagaggccaggccatcagcagaggccccggcctggtgaagcaggaggacttcagagacaagatgatgggcagaagagaggacagcagagagaagatgaacagaggcgagggcagcagagacagaggcctggtgagacccggcagcagcagagagaaggtgcccggcggcctgcagggcagccaggacagaggcgccgccggcagcagagagagaggcccccccagaagagccggcagccaggagagaggccccctgagaagagccggcagcagagagagaatcccccccagaagagccggcagcagagagagaggcccccccagaggccccggcagcagagagagaggcctgggcagaagcgacttcggcagagacagaggccccttcagacccgagcccggcgacggcggcgagaagatgtacccctaccacagagacgagccccccagagccccctggaaccacggcgaggagagaggccacgaggagttccccctggacggcagaaacgcccccatggagagagagagactggacgactgggacagagagagatactggagagagtgcgagagagactaccaggacgacaccctggagctgtacaacagagaggacagattcagcgccccccccagcagaagccacgacggcgacagaagaggcccctggtgggacgactgggagagagaccaggacatggacgaggactacaacagagagatggagagagacatggacagagacgtggacagaatcagcagacccatggacatgtacgacagaagcctggacaacgagtgggacagagactacggcagacccctggacgagcaggagagccagttcagagagagagacatccccagcctgccccccctgccccccctgccccccctgccccccctggacagatacagagacgacagatggagagaggagagaaacagagagcacggctacgacagagacttcagagacagaggcgagctgagaatcagagagtaccccgagagaggcgacacctggagagagaagagagactacgtgcccgacagaatggactgggagagagagagactgagcgacagatggtaccccagcgacgtggacagacacagccccatggccgagcacatgcccagcagccaccacagcagcgagatgatgggcagcgacgccagcctggacagcgaccagggcctgggcggcgtgatggtgctgagccagagacagcacgagatcatcctgaaggccgcccaggagctgaagatgctgagagagcagaaggagcagctgcagaagatgaaggacttcggcagcgagccccagatggccgaccacctgcccccccaggagagcagactgcagaacaccagcagcagacccggcatgtaccccccccccggcagctacagaccccccccccccatgggcaagccccccggcagcatcgtgagacccagcgccccccccgccagaagcagcgtgcccgtgaccagaccccccgtgcccatcccccccccccccccccccccccccctgcccccccccccccccgtgatcaagccccagaccagcgccgtggagcaggagagatgggacgaggacagcttctacggcctgtgggacaccaacgacgagcagggcctgaacagcgagttcaagagcgagaccgccgccatccccagcgcccccgtgctgccccccccccccgtgcacagcagcatccccccccccggccccgtgcccatgggcatgccccccatgagcaagcccccccccgtgcagcagaccgtggactacggccacggcagagacatcagcaccaacaaggtggagcagatcccctacggcgagagaatcaccctgagacccgaccccctgcccgagagaagcaccttcgagaccgagcacgccggccagagagacagatacgacagagagagagacagagagccctacttcgacagacagagcaacgtgatcgccgaccacagagacttcaagagagacagagagacccacagagacagagacagagacagaggcgtgatcgactacgacagagacagattcgacagagagagaagacccagagacgacagagcccagagctacagagacaagaaggaccacagcagcagcagaagaggcggcttcgacagacccagctacgacagaaagagcgacagacccgtgtacgagggccccagcatgttcggcggcgagagaagaacctaccccgaggagagaatgcccctgcccgcccccagcctgagccaccagcccccccccgcccccagagtggagaagaagcccgagagcaagaacgtggacgacatcctgaagccccccggcagagagagcagacccgagagaatcgtggtgatcatgagaggcctgcccggcagcggcaagacccacgtggccaagctgatcagagacaaggaggtggagttcggcggccccgcccccagagtgctgagcctggacgactacttcatcaccgaggtggagaaggaggagaaggaccccgacagcggcaagaaggtgaagaagaaggtgatggagtacgagtacgaggccgagatggaggagacctacagaaccagcatgttcaagaccttcaagaagaccctggacgacggcttcttccccttcatcatcctggacgccatcaacgacagagtgagacacttcgaccagttctggagcgccgccaagaccaagggcttcgaggtgtacctggccgagatgagcgccgacaaccagacctgcggcaagagaaacatccacggcagaaagctgaaggagatcaacaagatggccgaccactgggagaccgcccccagacacatgatgagactggacatcagaagcctgctgcaggacgccgccatcgaggaggtggagatggaggacttcgacgccaacatcgaggagcagaaggaggagaagaaggacgccgaggaggaggagagcgagctgggctacatccccaagagcaagtgggagatggacaccagcgaggccaagctggacaagctggacggcctgagaaccggcaccaagagaaagagagactgggaggccatcgccagcagaatggaggactacctgcagctgcccgacgactacgacaccagagccagcgagccccccagacccagaggcgccagcctgtgcgtgaccctgctgcccagattcagcagctgcttcgtgagcaccgccctggtgttcttcaaggtgctgcagtgcccccaggaggtgctggagagctgctgcacccaggccagaagatag

SEQ ID NO: 10074 - DNA, 2184 bp, Artificial Sequence
  Description of Artificial Sequence: Synthetic coding sequence
atggccgccgacagcagagaggagaaggacggcgagctgaacgtgctggacgacatcctgaccgaggtgcccgagcaggacgacgagctgtacaaccccgagagcgagcaggacaagaacgagaagaagggcagcaagagaaagagcgacagaatggagagcaccgacaccaagagacagaagcccagcgtgcacagcagacagctggtgagcaagcccctgagcagcagcgtgagcaacaacaagagaatcgtgagcaccaagggcaagagcgccaccgagtacaagaacgaggagtaccagagaagcgagagaaacaagagactggacgccgacagaaagatcagactgagcagcagcgccagcagagagccctacaagaaccagcccgagaagacctgcgtgagaaagagagaccccgagagaagagccaagagccccacccccgacggcagcgagagaatcggcctggaggtggacagaagagccagcagaagcagccagagcagcaaggaggaggtgaacagcgaggagtacggcagcgaccacgagaccggcagcagcggcagcagcgacgagcagggcaacaacaccgagaacgaggaggagggcgtggaggaggacgtggaggaggacgaggaggtggaggaggacgccgaggaggacgaggaggtggacgaggacggcgaggaggaggaggaggaggaggaggaggaggaggaggaggaggaggaggaggaggaggagtacgagcaggacgagagagaccagaaggaggagggcaacgactacgacaccagaagcgaggccagcgacagcggcagcgagagcgtgagcttcaccgacggcagcgtgagaagcggcagcggcaccgacggcagcgacgagaagaagaaggagagaaagagagccagaggcatcagccccatcgtgttcgacagaagcggcagcagcgccagcgagagctacgccggcagcgagaagaagcacgagaagctgagcagcagcgtgagagccgtgagaaaggaccagaccagcaagctgaagtacgtgctgcaggacgccagattcttcctgatcaagagcaacaaccacgagaacgtgagcctggccaaggccaagggcgtgtggagcaccctgcccgtgaacgagaagaagctgaacctggccttcagaagcgccagaagcgtgatcctgatcttcagcgtgagagagagcggcaagttccagggcttcgccagactgagcagcgagagccaccacggcggcagccccatccactgggtgctgcccgccggcatgagcgccaagatgctgggcggcgtgttcaagatcgactggatctgcagaagagagctgcccttcaccaagagcgcccacctgaccaacccctggaacgagcacaagcccgtgaagatcggcagagacggccaggagatcgagctggagtgcggcacccagctgtgcctgctgttcccccccgacgagagcatcgacctgtaccaggtgatccacaagatgagacacaagagaagaatgcacagccagcccagaagcagaggcagacccagcagaagagagcccgtgagagacgtgggcagaagaagacccgaggactacgacatccacaacagcagaaagaagcccagaatcgactacccccccgagttccaccagagacccggctacctgaaggaccccagataccaggaggtggacagaagattcagcggcgtgagaagagacgtgttcctgaacggcagctacaacgactacgtgagagagttccacaacatgggccccccccccccctggcagggcatgcccccctaccccggcatggagcagcccccccaccacccctactaccagcaccacgccccccccccccaggcccaccccccctacagcggccaccaccccgtgccccacgaggccagatacagagacaagagagtgcacgactacgacatgagagtggacgacttcctgagaagaacccaggccgtggtgagcggcagaagaagcagacccagagagagagacagagagagagagagagacagacccagagacaacagaagagacagagagagagacagaggcagagacagagagagagagagagagagactgtgcgacagagacagagacagaggcgagagaggcagatacagaagatag

SEQ ID NO: 10075 - DNA, 2130 bp, Artificial Sequence
  Description of Artificial Sequence: Synthetic coding sequence
atggccgccgacagcagagaggagaaggacggcgagctgaacgtgctggacgacatcctgaccgaggtgcccgagcaggacgacgagctgtacaaccccgagagcgagcaggacaagaacgagaagaagggcagcaagagaaagagcgacagaatggagagcaccgacaccaagagacagaagcccagcgtgcacagcagacagctggtgagcaagcccctgagcagcagcgtgagcaacaacaagagaatcgtgagcaccaagggcaagagcgccaccgagtacaagaacgaggagtaccagagaagcgagagaaacaagagactggacgccgacagaaagatcagactgagcagcagcgccagcagagagccctacaagaaccagcccgagaagacctgcgtgagaaagagagaccccgagagaagagccaagagccccacccccgacggcagcgagagaatcggcctggaggtggacagaagagccagcagaagcagccagagcagcaaggaggaggtgaacagcgaggagtacggcagcgaccacgagaccggcagcagcggcagcagcgacgagcagggcaacaacaccgagaacgaggaggagggcgtggaggaggacgtggaggaggacgaggaggtggaggaggacgccgaggaggacgaggaggtggacgaggacggcgaggaggaggaggaggaggaggaggaggaggaggaggaggaggaggaggaggaggaggagtacgagcaggacgagagagaccagaaggaggagggcaacgactacgacaccagaagcgaggccagcgacagcggcagcgagagcgtgagcttcaccgacggcagcgtgagaagcggcagcggcaccgacggcagcgacgagaagaagaaggagagaaagagagccagaggcatcagccccatcgtgttcgacagaagcggcagcagcgccagcgagagctacgccgaccagaccagcaagctgaagtacgtgctgcaggacgccagattcttcctgatcaagagcaacaaccacgagaacgtgagcctggccaaggccaagggcgtgtggagcaccctgcccgtgaacgagaagaagctgaacctggccttcagaagcgccagaagcgtgatcctgatcttcagcgtgagagagagcggcaagttccagggcttcgccagactgagcagcgagagccaccacggcggcagccccatccactgggtgctgcccgccggcatgagcgccaagatgctgggcggcgtgttcaagatcgactggatctgcagaagagagctgcccttcaccaagagcgcccacctgaccaacccctggaacgagcacaagcccgtgaagatcggcagagacggccaggagatcgagctggagtgcggcacccagctgtgcctgctgttcccccccgacgagagcatcgacctgtaccaggtgatccacaagatgagacacaagagaagaatgcacagccagcccagaagcagaggcagacccagcagaagagagcccgtgagagacgtgggcagaagaagacccgaggactacgacatccacaacagcagaaagaagcccagaatcgactacccccccgagttccaccagagacccggctacctgaaggaccccagataccaggaggtggacagaagattcagcggcgtgagaagagacgtgttcctgaacggcagctacaacgactacgtgagagagttccacaacatgggccccccccccccctggcagggcatgcccccctaccccggcatggagcagcccccccaccacccctactaccagcaccacgccccccccccccaggcccaccccccctacagcggccaccaccccgtgccccacgaggccagatacagagacaagagagtgcacgactacgacatgagagtggacgacttcctgagaagaacccaggccgtggtgagcggcagaagaagcagacccagagagagagacagagagagagagagagacagacccagagacaacagaagagacagagagagagacagaggcagagacagagagagagagagagagagactgtgcgacagagacagagacagaggcgagagaggcagatacagaagatag

SEQ ID NO: 10076 - DNA, 2130 bp, Artificial Sequence; identical to SEQ ID NO: 10075
  Description of Artificial Sequence: Synthetic coding sequence

SEQ ID NO: 10077 - DNA, 2184 bp, Artificial Sequence; identical to SEQ ID NO: 10074
  Description of Artificial Sequence: Synthetic coding sequence

SEQ ID NO: 10078 - DNA, 1992 bp, Artificial Sequence
  Description of Artificial Sequence: Synthetic coding sequence
atgttcctgaaggccggcagaggcaacaaggtgccccccgtgagagtgtacggccccgactgcgtggtgctgatggagccccccctgagcaagagaaacccccccgccctgagactggccgacctggccaccgcccaggtgcagcccctgcagaacatgaccggcttccccgccctggccggcccccccgcccacagccagctgagagccgccgtggcccacctgagactgagagacctgggcgccgaccccggcgtggccaccacccccctgggccccgagcacatggcccaggccagcaccctgggcctgagcccccccagccaggccttccccgcccaccccgaggcccccgccgccgccgccagagccgccgccctggtggcccaccccggcgccggcagctacccctgcggcggcggcagcagcggcgcccagcccagcgccccccccccccccgccccccccctgccccccacccccagccccccccccccccccccccccccccccccccccgccctgagcggctacaccaccaccaacagcggcggcggcggcagcagcggcaagggccacagcagagacttcgtgctgagaagagacctgagcgccaccgcccccgccgccgccatgcacggcgcccccctgggcggcgagcagagaagcggcaccggcagcccccagcaccccgccccccccccccacagcgccggcatgttcatcagcgccagcggcacctacgccggccccgacggcagcggcggccccgccctgttccccgccctgcacgacacccccggcgcccccggcggccacccccaccccctgaacggccagatgagactgggcctggccgccgccgccgccgccgccgccgccgagctgtacggcagagccgagccccccttcgcccccagaagcggcgacgcccactacggcgccgtggccgccgccgccgccgccgccctgcacggctacggcgccgtgaacctgaacctgaacctggccgccgccgccgccgccgccgccgccggccccggcccccacctgcagcaccacgcccccccccccgcccccccccccccccccgcccccgcccagcacccccaccagcaccacccccacctgcccggcgccgccggcgccttcctgagatacatgagacagcccatcaagcaggagctgatctgcaagtggatcgaccccgacgagctggccggcctgcccccccccccccccccccccccccccccccccccccccccccccgccggcggcgccaagccctgcagcaagaccttcggcaccatgcacgagctggtgaaccacgtgaccgtggagcacgtgggcggccccgagcagagcagccacgtgtgcttctgggaggactgccccagagagggcaagcccttcaaggccaagtacaagctgatcaaccacatcagagtgcacaccggcgagaagcccttcccctgccccttccccggctgcggcaaggtgttcgccagaagcgagaacctgaagatccacaagagaacccacaccggcgagaagcccttcaagtgcgagttcgacggctgcgacagaaagttcgccaacagcagcgacagaaagaagcacagccacgtgcacaccagcgacaagccctactactgcaagatcagaggctgcgacaagagctacacccaccccagcagcctgagaaagcacatgaagatccactgcaagagccccccccccagccccggccccctgggctacagcagcgtgggcacccccgtgggcgcccccctgagccccgtgctggaccccgccagaagccacagcagcaccctgagcccccaggtgaccaacctgaacgagtggtacgtgtgccaggccagcggcgcccccagccacctgcacacccccagcagcaacggcaccaccagcgagaccgaggacgaggagatctacggcaaccccgaggtggtgagaaccatccactag

SEQ ID NO: 10079 - DNA, 654 bp, Artificial Sequence
  Description of Artificial Sequence: Synthetic coding sequence
gccgccgccgccctgcacggctacggcgccgtgaacctgaacctgaacctggccgccgccgccgccgccgcccacccccaccagcaccacccccacctgcccggcgccgccggcgccttcctgagatacatgagacagcccatcaagcaggagctgatctgcaagtggatcgaccccgacgagctggccggcagagccaagccctgcagcaagaccttcggcaccatgcacgagctggtgaaccacgtgaccgtggagcacgtgggcggccccgagcagagcagccacgtgtgcttctgggaggactgccccagagagggcaagcccttcaaggccaagtacaagctgatcaaccacatcagagtgcacaccggcgagaagcccttcccctgccccttccccggctgcggcaaggtgttcgccagaagcgagaacctgaagatccacaagagaacccacaccggcgagaagcccttcaagtgcgagttcgacggctgcgacagaaagttcgccaacagcagcgacagaaagaagcacagccacgtgcacaccagcgacaagccctactactgcaagatcagaggctgcgacaagagctacacccaccccagcagcctgagaaagcacatgaagatccactgcaagagcccctag

SEQ ID NO: 10080 - DNA, 3696 bp, Artificial Sequence
  Description of Artificial Sequence: Synthetic coding sequence
atgtgcaagtgctgcaacctgttcagccccaaccagagcgagctgctgagccacgtgagcgagaagcacatggaggagggcgtgaacgtggacgagatcatcatccccctgagacccctgagcacccccgagccccccaacagcagcaagaccggcgacgagttcctggtgatgaagagaaagagaggcagacccaagggcagcaccaagaagagcagcaccgaggaggagctggccgagaacatcgtgagccccaccgaggacagccccctggcccccgaggagggcaacagcctgccccccagcagcctggagtgcagcaagtgctgcagaaagttcagcaacaccagacagctgagaaagcacatctgcatcatcgtgctgaacctgggcgaggaggagggcgaggccggcaacgagagcgacctggagctggagaagaagtgcaaggaggacgacagagagaaggccagcaagagacccagaagccagaagaccgagaaggtgcagaagatcagcggcaaggaggccagacagctgagcggcgccaagaagcccatcatcagcgtggtgctgaccgcccacgaggccatccccggcgccaccaagatcgtgcccgtggaggccggcccccccgagaccggcgccaccaacagcgagaccaccagcgccgacctggtgcccagaagaggctaccaggagtacgccatccagcagaccccctacgagcagcccatgaagagcagcagactgggccccacccagctgaagatcttcacctgcgagtactgcaacaaggtgttcaagttcaagcacagcctgcaggcccacctgagaatccacaccaacgagaagccctacaagtgcccccagtgcagctacgccagcgccatcaaggccaacctgaacgtgcacctgagaaagcacaccggcgagaagttcgcctgcgactactgcagcttcacctgcctgagcaagggccacctgaaggtgcacatcgagagagtgcacaagaagatcaagcagcactgcagattctgcaagaagaagtacagcgacgtgaagaacctgatcaagcacatcagagacgcccacgacccccaggacaagaaggtgaaggaggccctggacgagctgtgcctgatgaccagagagggcaagagacagctgctgtacgactgccacatctgcgagagaaagttcaagaacgagctggacagagacagacacatgctggtgcacggcgacaagtggcccttcgcctgcgagctgtgcggccacggcgccaccaagtaccaggccctggagctgcacgtgagaaagcaccccttcgtgtacgtgtgcgccgtgtgcagaaagaagttcgtgagcagcatcagactgagaacccacatcaaggaggtgcacggcgccgcccaggaggccctggtgttcaccagcagcatcaaccagagcttctgcctgctggagcccggcggcgacatccagcaggaggccctgggcgaccagctgcagctggtggaggaggagttcgccctgcagggcgtgaacgccctgaaggaggaggcctgccccggcgacacccagctggaggagggcagaaaggagcccgaggcccccggcgagatgcccgcccccgccgtgcacctggccagcccccaggccgagagcaccgccctgcccccctgcgagctggagaccaccgtggtgagcagcagcgacctgcacagccaggaggtggtgagcgacgacttcctgctgaagaacgacaccagcagcgccgaggcccacgccgcccccgagaagccccccgacatgcagcacagaagcagcgtgcagacccagggcgaggtgatcaccctgctgctgagcaaggcccagagcgccggcagcgaccaggagagccacggcgcccagagccccctgggcgagggccagaacatggccgtgctgagcgccggcgaccccgaccccagcagatgcctgagaagcaaccccgccgaggccagcgacctgctgccccccgtggccggcggcggcgacaccatcacccaccagcccgacagctgcaaggccgcccccgagcacagaagcggcatcaccgccttcatgaaggtgctgaacagcctgcagaagaagcagatgaacaccagcctgtgcgagagaatcagaaaggtgtacggcgacctggagtgcgagtactgcggcaagctgttctggtaccaggtgcacttcgacatgcacgtgagaacccacaccagagagcacctgtactactgcagccagtgccactacagcagcatcaccaagaactgcctgaagagacacgtgatccagaagcacagcaacatcctgctgaagtgccccaccgacggctgcgactacagcacccccgacaagtacaagctgcaggcccacctgaaggtgcacaccgccctggacaagagaagctacagctgccccgtgtgcgagaagagcttcagcgaggacagactgatcaagagccacatcaagaccaaccaccccgaggtgagcatgagcaccatcagcgaggtgctgggcagaagagtgcagctgaagggcctgatcggcaagagagccatgaagtgcccctactgcgacttctacttcatgaagaacggcagcgacctgcagagacacatctgggcccacgagggcgtgaagcccttcaagtgcagcctgtgcgagtacgccaccagaagcaagagcaacctgaaggcccacatgaacagacacagcaccgagaagacccacctgtgcgacatgtgcggcaagaagttcaagagcaagggcaccctgaagagccacaagctgctgcacaccgccgacggcaagcagttcaagtgcaccgtgtgcgactacaccgccgcccagaagccccagctgctgagacacatggagcagcacgtgagcttcaagcccttcagatgcgcccactgccactacagctgcaacatcagcggcagcctgaagagacactacaacagaaagcaccccaacgaggagtacgccaacgtgggcaccggcgagctggccgccgaggtgctgatccagcagggcggcctgaagtgccccgtgtgcagcttcgtgtacggcaccaagtgggagttcaacagacacctgaagaacaagcacggcctgaaggtggtggagatcgacggcgaccccaagtgggagaccgccaccgaggcccccgaggagcccagcacccagtacctgcacatcaccgaggccgaggaggacgtgcagggcacccaggccgccgtggccgccctgcaggacctgagatacaccagcgagagcggcgacagactggaccccaccgccgtgaacatcctgcagcagatcatcgagctgggcgccgagacccacgacgccaccgccctggccagcgtggtggccatggcccccggcaccgtgaccgtggtgaagcaggtgaccgaggaggagcccagcagcaaccacaccgtgatgatccaggagaccgtgcagcaggccagcgtggagctggccgagcagcaccacctggtggtgagcagcgacgacgtggagggcatcgagaccgtgaccgtgtacacccagggcggcgaggccagcgagttcatcgtgtacgtgcaggaggccatgcagcccgtggaggagcaggccgtggagcagcccgcccaggagctgtag

SEQ ID NO: 10081 - DNA, 1935 bp, Artificial Sequence
  Description of Artificial Sequence: Synthetic coding sequence
atggccaagcccagccacagcagctacgtgctgcagcagctgaacaaccagagagagtggggcttcctgtgcgactgctgcatcgccatcgacgacatctacttccaggcccacaaggccgtgctggccgcctgcagcagctacttcagaatgttcttcatgaaccaccagcacagcaccgcccagctgaacctgagcaacatgaagatcagcgccgagtgcttcgacctgatcctgcagttcatgtacctgggcaagatcatgaccgcccccagcagcttcgagcagttcaaggtggccatgaactacctgcagctgtacaacgtgcccgactgcctggaggacatccaggacgccgactgcagcagcagcaagtgcagcagcagcgccagcagcaagcagaacagcaagatgatcttcggcgtgagaatgtacgaggacaccgtggccagaaacggcaacgaggccaacagatggtgcgccgagcccagcagcaccgtgaacaccccccacaacagagaggccgacgaggagagcctgcagctgggcaacttccccgagcccctgttcgacgtgtgcaagaagagcagcgtgagcaagctgagcacccccaaggagagagtgagcagaagattcggcagaagcttcacctgcgacagctgcggcttcggcttcagctgcgagaagctgctggacgagcacgtgctgacctgcaccaacagacacctgtaccagaacaccagaagctaccacagaatcgtggacatcagagacggcaaggacagcaacatcaaggccgagttcggcgagaaggacagcagcaagaccttcagcgcccagaccgacaagtacagaggcgacaccagccaggccgccgacgacagcgccagcaccaccggcagcagaaagagcagcaccgtggagagcgagatcgccagcgaggagaagagcagagccgccgagagaaagagaatcatcatcaagatggagcccgaggacatccccaccgacgagctgaaggacttcaacatcatcaaggtgaccgacaaggactgcaacgagagcaccgacaacgacgagctggaggacgagcccgaggagcccttctacagatactacgtggaggaggacgtgagcatcaagaagagcggcagaaagaccctgaagcccagaatgagcgtgagcgccgacgagagaggcggcctggagaacatgagaccccccaacaacagcagccccgtgcaggaggacgccgagaacgccagctgcgagctgtgcggcctgaccatcaccgaggaggacctgagcagccactacctggccaagcacatcgagaacatctgcgcctgcggcaagtgcggccagatcctggtgaagggcagacagctgcaggagcacgcccagagatgcggcgagccccaggacctgaccatgaacggcctgggcaacaccgaggagaagatggacctggaggagaaccccgacgagcagagcgagatcagagacatgttcgtggagatgctggacgacttcagagacaaccactaccagatcaacagcatccagaagaagcagctgttcaagcacagcgcctgccccttcagatgccccaactgcggccagagattcgagaccgagaacctggtggtggagcacatgagcagctgcctggaccaggacatgttcaagagcgccatcatggaggagaacgagagagaccacagaagaaagcacttctgcaacctgtgcggcaagggcttctaccagagatgccacctgagagagcactacaccgtgcacaccaaggagaagcagttcgtgtgccagacctgcggcaagcagttcctgagagagagacagctgagactgcacaacgacatgcacaagggcatggccagcggcgagatcggccccagcaagcccgtggagaagtag

SEQ ID NO: 10082 - DNA, 2142 bp, Artificial Sequence
  Description of Artificial Sequence: Synthetic coding sequence
atggccaagcccagccacagcagctacgtgctgcagcagctgaacaaccagagagagtggggcttcctgtgcgactgctgcatcgccatcgacgacatctacttccaggcccacaaggccgtgctggccgcctgcagcagctacttcagaatgttcttcatgaaccaccagcacagcaccgcccagctgaacctgagcaacatgaagatcagcgccgagtgcttcgacctgatcctgcagttcatgtacctgggcaagatcatgaccgcccccagcagcttcgagcagttcaaggtggccatgaactacctgcagctgtacaacgtgcccgactgcctggaggacatccaggacgccgactgcagcagcagcaagtgcagcagcagcgccagcagcaagcagaacagcaagatgatcttcggcgtgagaatgtacgaggacaccgtggccagaaacggcaacgaggccaacagatggtgcgccgagcccagcagcaccgtgaacaccccccacaacagagaggccgacgaggagagcctgcagctgggcaacttccccgagcccctgttcgacgtgtgcaagaagagcagcgtgagcaagctgagcacccccaaggagagagtgagcagaagattcggcagaagcttcacctgcgacagctgcggcttcggcttcagctgcgagaagctgctggacgagcacgtgctgacctgcaccaacagacacctgtaccagaacaccagaagctaccacagaatcgtggacatcagagacggcaaggacagcaacatcaaggccgagttcggcgagaaggacagcagcaagaccttcagcgcccagaccgacaagtacagaggcgacaccagccaggccgccgacgacagcgccagcaccaccggcagcagaaagagcagcaccgtggagagcgagatcgccagcgaggagaagagcagagccgccgagagaaagagaatcatcatcaagatggagcccgaggacatccccaccgacgagctgaaggacttcaacatcatcaaggtgaccgacaaggactgcaacgagagcaccgacaacgacgagctggaggacgagcccgaggagcccttctacagatactacgtggaggaggacgtgagcatcaagaagagcggcagaaagaccctgaagcccagaatgagcgtgagcgccgacgagagaggcggcctggagaacatgagaccccccaacaacagcagccccgtgcaggaggacgccgagaacgccagctgcgagctgtgcggcctgaccatcaccgaggaggacctgagcagccactacctggccaagcacatcgagaacatctgcgcctgcggcaagtgcggccagatcctggtgaagggcagacagctgcaggagcacgcccagagatgcggcgagccccaggacctgaccatgaacggcctgggcaacaccgaggagaagatggacctggaggagaaccccgacgagcagagcgagatcagagacatgttcgtggagatgctggacgacttcagagacaaccactaccagatcaacagcatccagaagaagcagctgttcaagcacagcgcctgccccttcagatgccccaactgcggccagagattcgagaccgagaacctggtggtggagcacatgagcagctgcctggaccaggacatgttcaagagcgccatcatggaggagaacgagagagaccacagaagaaagcacttctgcaacctgtgcggcaagggcttctaccagagatgccacctgagagagcactacaccgtgcacaccaaggagaagcagttcgtgtgccagacctgcggcaagcagttcctgagagagagacagctgagactgcacaacgacatgcacaagggcatggccagatacgtgtgcagcatctgcgaccagggcaacttcagaaagcacgaccacgtgagacacatgatcagccacctgagcgccggcgagaccatctgccaggtgtgcttccagatcttccccaacaacgagcagctggagcagcacatggacgtgcacctgtacacctgcggcatctgcggcgccaagttcaacctgagaaaggacatgagaagccactacaacgccaagcacctgaagagaacctag

SEQ ID NO: 10083 - DNA, 468 bp, Artificial Sequence
  Description of Artificial Sequence: Synthetic coding sequence
atggccaagcccagccacagcagctacgtgctgcagcagctgaacaaccagagagagtggggcttcctgtgcgactgctgcatcgccatcgacgacatctacttccaggcccacaaggccgtgctggccgcctgcagcagctacttcagaatgttcttcatgaaccaccagcacagcaccgcccagctgaacctgagcaacatgaagatcagcgccgagtgcttcgacctgatcctgcagttcatgtacctgggcaagatcatgaccgcccccagcagcttcgagcagttcaaggtggccatgaactacctgcagctgtacaacgtgcccgactgcctggaggacatccaggacgccgactgcagcagcagcaagtgcagcagcagcgccagcagcaagcagaacagcaagatgatcttcggcgtgagaatgtacgaggacaccgtggccagaaacggcaacgagtag

SEQ ID NO: 10084 - DNA, 2142 bp, Artificial Sequence; identical to SEQ ID NO: 10082
  Description of Artificial Sequence: Synthetic coding sequence

SEQ ID NO: 10085 - DNA, 105 bp, Artificial Sequence
  Description of Artificial Sequence: Synthetic coding sequence
atggccaagcccagccacagcagctacgtgctgcagcagctgaacaaccagagagagtggggcttcctgtgcgactgctgcatcgccatcgacgacatctactag

SEQ ID NO: 10086 - DNA, 393 bp, Artificial Sequence
  Description of Artificial Sequence: Synthetic coding sequence
atggccaagcccagccacagcagctacgtgctgcagcagctgaacaaccagagagagtggggcttcctgtgcgactgctgcatcgccatcgacgacatctacttccaggcccacaaggccgtgctggccgcctgcagcagctacttcagaatgttcttcatgaaccaccagcacagcaccgcccagctgaacctgagcaacatgaagatcagcgccgagtgcttcgacctgatcctgcagttcatgtacctgggcaagatcatgaccgcccccagcagcttcgagcagttcaaggtggccatgaactacctgcagctgtacaacgtgcccgactgcctggaggacatccaggacgccgactgcagcagcagcaagtgcagcagcagcgcctag

SEQ ID NO: 10087 - DNA, 1740 bp, Artificial Sequence
  Description of Artificial Sequence: Synthetic coding sequence
atgaccagactggagagaagcagccacagaaccgtgatctgcaaggtgcccggcgagctggtggccagagagggcaagtgcgccagcagagccagagagagcgagatccccagcgaggagggctactgcgacttcaacagcagacccaacgagaacagctactgctaccagctgctgagacagctgaacgagcagagaaagaagggcatcctgtgcgacgtgagcatcgtggtgagcggcaagatcttcaaggcccacaagaacatcctggtggccggcagcagattcttcaagaccctgtactgcttcagcaacaaggagagccccaaccagaacaacaccacccacctggacatcgccgccgtgcagggcttcagcgtgatcctggacttcctgtacagcggcaacctggtgctgaccagccagaacgccatcgaggtgatgaccgtggccagctacctgcagatgagcgaggtggtgcagacctgcagaaacttcatcaaggacgccctgaacatcagcatcaagagcgaggcccccgagagcgtggtggtggactacaacaacagaaagcccgtgaacagagacggcctgagcagcagcagagaccagaagatcgccagcttctgggccaccagaaacctgaccaacctggccagcaacgtgaagatcgagaacgacggctgcaacgtggacgagggccagatcgagaactaccagatgaacgacagcagctgggtgcaggacggcagccccgagatggccgagaacgagagcgagggccagaccaaggtgttcatctggaacaacatgggcagccagggcatccaggagaccggcaagaccagaagaaagaaccagaccaccaagagattcatctacaacatcccccccaacaacgagaccaacctggaggactgcagcgtgatgcagccccccgtggcctaccccgaggagaacaccctgctgatcaaggaggagcccgacctggacggcgccctgctgagcggccccgacggcgacagaaacgtgaacgccaacctgctggccgaggccggcaccagccaggacggcggcgacgccggcaccagccacgacttcaagtacggcctgatgcccggccccagcaacgacttcaagtacggcctgatccccggcaccagcaacgacttcaagtacggcctgatccccggcgccagcaacgacttcaagtacggcctgctgcccgagagctggcccaagcaggagacctgggagaacggcgagagcagcctgatcatgaacaagctgaagtgcccccactgcagctacgtggccaagtacagaagaaccctgaagagacacctgctgatccacaccggcgtgagaagcttcagctgcgacatctgcggcaagctgttcaccagaagagagcacgtgaagagacacagcctggtgcacaagaaggacaagaagtacaagtgcatggtgtgcaagaagatcttcatgctggccgccagcgtgggcatcagacacggcagcagaagatacggcgtgtgcgtggactgcgccgacaagagccagcccggcggccaggagggcgtggaccagggccaggacaccgagttccccagagacgaggagtacgaggagaacgaggtgggcgaggccgacgaggagctggtggacgacggcgaggaccagaacgaccccagcagatgggacgagagcggcgaggtgtgcatgagcctggacgactag

SEQ ID NO: 10088 - DNA, 2616 bp, Artificial Sequence
  Description of Artificial Sequence: Synthetic coding sequence
atgagcttcagcgagatgaacagaagaaccctggccttcagaggcggcggcctggtgaccgccagcggcggcggcagcaccaacaacaacgccggcggcgaggccagcgcctggcccccccagccccagcccagacagccccccccccccgccccccccgccctgcagccccccaacggcagaggcgccgacgaggaggtggagctggagggcctggagccccaggacctggaggccagcgccggccccgccgccggcgccgccgaggaggccaaggagctgctgctgccccaggacgccggcggccccaccagcctgggcggcggcgccggcggccccctgctggccgagagaaacagaagaaccctggccttcagaggcggcggcggcggcggcctgggcaacaacggcagcagcagaggcagacccgagaccagcgtgtggcccctgagacacttcaacggcagaggccccgccaccgtggacctggagctggacgccctggagggcaaggagctgatgcaggacggcgccagcctgagcgacagcaccgaggacgaggaggagggcgccagcctgggcgacggcagcggcgccgagggcggcagctgcagcagcagcagaagaagcggcggcgacggcggcgacgaggtggagggcagcggcgtgggcgccggcgagggcgagaccgtgcagcacttccccctggccagacccaagagcctgatgcagaagctgcagtgcagcttccagaccagctggctgaaggacttcccctggctgagatacagcaaggacaccggcctgatgagctgcggctggtgccagaagacccccgccgacggcggcagcgtggacctgccccccgtgggccacgacgagctgagcagaggcaccagaaactacaagaagaccctgctgctgagacaccacgtgagcaccgagcacaagctgcacgaggccaacgcccaggagagcgagatccccagcgaggagggctactgcgacttcaacagcagacccaacgagaacagctactgctaccagctgctgagacagctgaacgagcagagaaagaagggcatcctgtgcgacgtgagcatcgtggtgagcggcaagatcttcaaggcccacaagaacatcctggtggccggcagcagattcttcaagaccctgtactgcttcagcaacaaggagagccccaaccagaacaacaccacccacctggacatcgccgccgtgcagggcttcagcgtgatcctggacttcctgtacagcggcaacctggtgctgaccagccagaacgccatcgaggtgatgaccgtggccagctacctgcagatgagcgaggtggtgcagacctgcagaaacttcatcaaggacgccctgaacatcagcatcaagagcgaggcccccgagagcgtggtggtggactacaacaacagaaagcccgtgaacagagacggcctgagcagcagcagagaccagaagatcgccagcttctgggccaccagaaacctgaccaacctggccagcaacgtgaagatcgagaacgacggctgcaacgtggacgagggccagatcgagaactaccagatgaacgacagcagctgggtgcaggacggcagccccgagatggccgagaacgagagcgagggccagaccaaggtgttcatctggaacaacatgggcagccagggcatccaggagaccggcaagaccagaagaaagaaccagaccaccaagagattcatctacaacatcccccccaacaacgagaccaacctggaggactgcagcgtgatgcagccccccgtggcctaccccgaggagaacaccctgctgatcaaggaggagcccgacctggacggcgccctgctgagcggccccgacggcgacagaaacgtgaacgccaacctgctggccgaggccggcaccagccaggacggcggcgacgccggcaccagccacgacttcaagtacggcctgatgcccggccccagcaacgacttcaagtacggcctgatccccggcaccagcaacgacttcaagtacggcctgatccccggcgccagcaacgacttcaagtacggcctgctgcccgagagctggcccaagcaggagacctgggagaacggcgagagcagcctgatcatgaacaagctgaagtgcccccactgcagctacgtggccaagtacagaagaaccctgaagagacacctgctgatccacaccggcgtgagaagcttcagctgcgacatctgcggcaagctgttcaccagaagagagcacgtgaagagacacagcctggtgcacaagaaggacaagaagtacaagtgcatggtgtgcaagaagatcttcatgctggccgccagcgtgggcatcagacacggcagcagaagatacggcgtgtgcgtggactgcgccgacaagagccagcccggcggccaggagggcgtggaccagggccaggacaccgagttccccagagacgaggagtacgaggagaacgaggtgggcgaggccgacgaggagctggtggacgacggcgaggaccagaacgaccccagcagatgggacgagagcggcgaggtgtgcatgagcctggacgactag

SEQ ID NO: 10089 - DNA, 2616 bp, Artificial Sequence; identical to SEQ ID NO: 10088
  Description of Artificial Sequence: Synthetic coding sequence

SEQ ID NO: 10090 - DNA, 2544 bp, Artificial Sequence
  Description of Artificial Sequence: Synthetic coding sequence
atgagcttcagcgagatgaacagaagaaccctggccttcagaggcggcggcctggtgaccgccagcggcggcggcagcaccaacaacaacgccggcggcgaggccagcgcctggcccccccagccccagcccagacagccccccccccccgccccccccgccctgcagccccccaacggcagaggcgccgacgaggaggtggagctggagggcctggagccccaggacctggaggccagcgccggccccgccgccggcgccgccgaggaggccaaggagctgctgctgccccaggacgccggcggccccaccagcctgggcggcggcgccggcggccccctgctggccgagagaaacagaagaaccctggccttcagaggcggcggcggcggcggcctgggcaacaacggcagcagcagaggcagacccgagaccagcgtgtggcccctgagacacttcaacggcagaggccccgccaccgtggacctggagctggacgccctggagggcaaggagctgatgcaggacggcgccagcctgagcgacagcaccgaggacgaggaggagggcgccagcctgggcgacggcagcggcgccgagggcggcagctgcagcagcagcagaagaagcggcggcgacggcggcgacgaggtggagggcagcggcgtgggcgccggcgagggcgagaccgtgcagcacttccccctggccagacccaagagcctgatgcagaagctgcagtgcagcttccagaccagctggctgaaggacttcccctggctgagatacagcaaggacaccggcctgatgagctgcggctggtgccagaagacccccgccgacggcggcagcgtggacctgccccccgtgggccacgacgagctgagcagaggcaccagaaactacaagaagaccctgctgctgagacaccacgtgagcaccgagcacaagctgcacgaggccaacgcccaggagagcgagatccccagcgaggagggctactgcgacttcaacagcagacccaacgagaacagctactgctaccagctgctgagacagctgaacgagcagagaaagaagggcatcctgtgcgacgtgagcatcgtggtgagcggcaagatcttcaaggcccacaagaacatcctggtggccggcagcagattcttcaagaccctgtactgcttcagcaacaaggagagccccaaccagaacaacaccacccacctggacatcgccgccgtgcagggcttcagcgtgatcctggacttcctgtacagcggcaacctggtgctgaccagccagaacgccatcgaggtgatgaccgtggccagctacctgcagatgagcgaggtggtgcagacctgcagaaacttcatcaaggacgccctgaacatcagcatcaagagcgaggcccccgagagcgtggtggtggactacaacaacagaaagcccgtgaacagagacggcctgagcagcagcagagaccagaagatcgccagcttctgggccaccagaaacctgaccaacctggccagcaacgtgaagatcgagaacgacggctgcaacgtggacgagggccagatcgagaactaccagatgaacgacagcagctgggtgcaggacggcagccccgagatggccgagaacgagagcgagggccagaccaaggtgttcatctggaacaacatgggcagccagggcatccaggagaccggcaagaccagaagaaagaaccagaccaccaagagattcatctacaacatcccccccaacaacgagaccaacctggaggactgcagcgtgatgcagccccccgtggcctaccccgaggagaacaccctgctgatcaaggaggagcccgacctggacggcgccctgctgagcggccccgacggcgacagaaacgtgaacgccaacctgctggccgaggccggcaccagccaggacggcggcgacgccggcaccagccacgacttcaagtacggcctgatgcccggcgccagcaacgacttcaagtacggcctgctgcccgagagctggcccaagcaggagacctgggagaacggcgagagcagcctgatcatgaacaagctgaagtgcccccactgcagctacgtggccaagtacagaagaaccctgaagagacacctgctgatccacaccggcgtgagaagcttcagctgcgacatctgcggcaagctgttcaccagaagagagcacgtgaagagacacagcctggtgcacaagaaggacaagaagtacaagtgcatggtgtgcaagaagatcttcatgctggccgccagcgtgggcatcagacacggcagcagaagatacggcgtgtgcgtggactgcgccgacaagagccagcccggcggccaggagggcgtggaccagggccaggacaccgagttccccagagacgaggagtacgaggagaacgaggtgggcgaggccgacgaggagctggtggacgacggcgaggaccagaacgaccccagcagatgggacgagagcggcgaggtgtgcatgagcctggacgactag

SEQ ID NO: 10091 - DNA, 3162 bp, Artificial Sequence
  Description of Artificial Sequence: Synthetic coding sequence
atgagcagcgaggagagctacagagccatcctgagatacctgaccaacgagagagagccctacgcccccggcaccgagggcaacgtgaagagaaagatcagaaaggccgccgcctgctacgtggtgagaggcggcaccctgtactaccagagaagacagagacacagaaagaccttcgccgagctggaggtggtgctgcagcccgagagaagaagagacctgatcgaggccgcccacctgggccccggcggcacccaccacaccagacaccagacctggcactacctgagcaagacctactggtggagaggcatcctgaagcaggtgaaggactacatcaagcagtgcagcaagtgccaggagaagctggacagaagcagacccatcagcgacgtgagcgagatgctggaggagctgggcctggacctggagagcggcgaggagagcaacgagagcgaggacgacctgagcaacttcaccagcagccccaccaccgccagcaagcccgccaagaagaagcccgtgagcaagcacgagctggtgttcgtggacaccaagggcgtggtgaagagaagcagccccaagcactgccaggccgtgctgaagcagctgaacgagcagagactgagcaaccagttctgcgacgtgaccctgctgatcgagggcgaggagtacaaggcccacaagagcgtgctgagcgccaacagcgagtacttcagagacctgttcatcgagaagggcgccgtgagcagccacgaggccgtggtggacctgagcggcttctgcaaggccagcttcctgcccctgctggagttcgcctacaccagcgtgctgagcttcgacttctgcagcatggccgacgtggccatcctggccagacacctgttcatgagcgaggtgctggagatctgcgagagcgtgcacaagctgatggaggagaagcagctgaccgtgtacaagaagggcgaggtgcagaccgtggccagcacccaggacctgagagtgcagaacggcggcaccgccccccccgtggccagcagcgagggcaccaccaccagcctgcccaccgagctgggcgactgcgagatcgtgctgctggtgaacggcgagctgcccgaggccgagcagaacggcgaggtgggcagacagcccgagccccaggtgagcagcgaggccgagagcgccctgagcagcgtgggctgcatcgccgacagccaccccgagatggagagcgtggacctgatcaccaagaacaaccagaccgagctggagaccagcaacaacagagagaacaacaccgtgagcaacatccaccccaagctgagcaaggagaacgtgatcagcagcagccccgaggacagcggcatgggcaacgacatcagcgccgaggacatctgcgccgaggacatccccaagcacagacagaaggtggaccagcccctgaaggaccaggagaacctggtggccagcaccgccaagaccgacttcggccccgacgacgacacctacagaagcagactgagacagagaagcgtgaacgagggcgcctacatcagactgcacaagggcatggagaagaagctgcagaagagaaaggccgtgcccaagagcgccgtgcagcaggtggcccagaagctggtgcagagaggcaagaagatgaagcagcccaagagagacgccaaggagaacaccgaggaggccagccacaagtgcggcgagtgcggcatggtgttccagagaagatacgccctgatcatgcacaagctgaagcacgagagagccagagactacaagtgccccctgtgcaagaagcagttccagtacagcgccagcctgagagcccacctgatcagacacaccagaaaggacgcccccagcagcagcagcagcaacagcaccagcaacgaggccagcggcaccagcagcgagaagggcagaaccaagagagagttcatctgcagcatctgcggcagaaccctgcccaagctgtacagcctgagaatccacatgctgaagcacaccggcgtgaagccccacgcctgccaggtgtgcggcaagaccttcatctacaagcacggcctgaagctgcaccagagcctgcaccagagccagaagcagttccagtgcgagctgtgcgtgaagagcttcgtgaccaagagaagcctgcaggagcacatgagcatccacaccggcgagagcaagtacctgtgcagcgtgtgcggcaagagcttccacagaggcagcggcctgagcaagcacttcaagaagcaccagcccaagcccgaggtgagaggctaccactgcacccagtgcgagaagagcttcttcgaggccagagacctgagacagcacatgaacaagcacctgggcgtgaagcccttccagtgccagttctgcgacaagtgctacagctggaagaaggactggtacagccacgtgaagagccacagcgtgaccgagccctacagatgcaacatctgcggcaaggagttctacgagaaggccctgttcagaagacacgtgaagaaggccacccacggcaagaagggcagagccaagcagaacctggagagagtgtgcgagaagtgcggcagaaagttcacccagctgagagagtacagaagacacatgaacaaccacgagggcgtgaagcccttcgagtgcctgacctgcggcgtggcctgggccgacgccagaagcctgaagagacacgtgagaacccacaccggcgagagaccctacgtgtgccccgtgtgcagcgaggcctacatcgacgccagaaccctgagaaagcacatgaccaagttccacagagactacgtgccctgcaagatcatgctggagaaggacaccctgcagttccacaaccagggcacccaggtggcccacgccgtgagcatcctgaccgccggcatgcaggagcaggagagcagcggcccccaggagctggagaccgtggtggtgaccggcgagaccatggaggccctggaggccgtggccgccaccgaggagtaccccagcgtgagcaccctgagcgaccagagcatcatgcaggtggtgaactacgtgctggcccagcagcagggccagaagctgagcgaggtggccgaggccatccagaccgtgaaggtggaggtggcccacatcagcggcggcgagtag

SEQ ID NO: 10092 - DNA, 1380 bp, Artificial Sequence
  Description of Artificial Sequence: Synthetic coding sequence
atggccagcggcgtggaggtgctgagattccagctgcccggccacgaggccgccaccctgagaaacatgaaccagctgagagccgaggagagattctgcgacgtgaccatcgtggccgacagcctgaagttcagaggccacaaggtgatcctggccgcctgcagccccttcctgagagaccagttcctgctgaaccccagcagcgagctgcaggtgagcctgatgcacagcgccagaatcgtggccgacctgctgctgagctgctacaccggcgccctggagttcgccgtgagagacatcgtgaactacctgaccgccgccagctacctgcagatggagcacgtggtggagaagtgcagaaacgccctgagccagttcatcgagcccaagatcggcctgaaggaggacggcgtgagcgaggccagcctggtgagcagcatcagcgccaccaagagcctgctgccccccgccagaacccccaagcccgcccccaagccccccccccccccccccctgcccccccccctgctgagacccgtgaagctggagttccccctggacgaggacctggagctgaaggccgaggaggaggacgaggacgaggacgaggacgtgagcgacatctgcatcgtgaaggtggagagcgccctggaggtggcccacagactgaagccccccggcggcctgggcggcggcctgggcatcggcggcagcgtgggcggccacctgggcgagctggcccagagcagcgtgccccccagcaccgtggcccccccccagggcgtggtgaaggcctgctacagcctgagcgaggacgccgagggcgagggcctgctgctgatccccggcggcagagccagcgtgggcgccaccagcggcctggtggaggccgccgccgtggccatggccgccagaggcgccggcggcagcctgggcgccggcggcagcagaggccccctgcccggcggcttcagcggcggcaaccccctgaagaacatcaagtgcaccaagtgccccgaggtgttccagggcgtggagaagctggtgttccacatgagagcccagcacttcatcttcatgtgccccagatgcggcaagcagttcaaccacagcagcaacctgaacagacacatgaacgtgcacagaggcgtgaagagccacagctgcggcatctgcggcaagtgcttcacccagaagagcaccctgcacgaccacctgaacctgcacagcggcgccagaccctacagatgcagctactgcgacgtgagattcgcccacaagcccgccatcagaagacacctgaaggagcagcacggcaagaccaccgccgagaacgtgctggaggccagcgtggccgagatcaacgtgctgatcagatag

SEQ ID NO: 10093 - DNA, 1380 bp, Artificial Sequence; identical to SEQ ID NO: 10092
  Description of Artificial Sequence: Synthetic coding sequence

SEQ ID NO: 10094 - DNA, 1380 bp, Artificial Sequence; identical to SEQ ID NO: 10092
  Description of Artificial Sequence: Synthetic coding sequence

SEQ ID NO: 10095 - DNA, 1380 bp, Artificial Sequence; identical to SEQ ID NO: 10092
  Description of Artificial Sequence: Synthetic coding sequence

SEQ ID NO: 10096 - DNA, 1380 bp, Artificial Sequence; identical to SEQ ID NO: 10092
  Description of Artificial Sequence: Synthetic coding sequence

SEQ ID NO: 10097 - DNA, 1545 bp, Artificial Sequence
  Description of Artificial Sequence: Synthetic coding sequence
atggacctggccaaccacggcctgatcctgctgcagcagctgaacgcccagagagagttcggcttcctgtgcgactgcaccgtggccatcggcgacgtgtacttcaaggcccacaagagcgtgctggccagcttcagcaactacttcaagatgctgttcgtgcaccagaccagcgagtgcgtgagactgaagcccaccgacatccagcccgacatcttcagctacctgctgcacctgatgtacaccggcaagatggccccccagctgatcgaccccgtgagactggagcagggcatcaagttcctgcacgcctaccccctgatccaggaggccagcctggccagccagggcgccttcagccaccccgaccaggtgttccccctggccagcagcctgtacggcatccagatcgccgaccaccagctgagacaggccaccaagatcgccagcgcccccgagaagctgggcagagaccccagaccccagaccagcagaatcagccaggagcaggtgcccgaggccagccagctgagccagctgaccagcaacctggcccaggtgaacagaaccaacatgacccccagcgaccccctgcagaccagcctgagccccgagctggtgagcacccccgtgcccccccccccccccggcgaggagaccaacctggaggccagcagcagcgacgagcagcccgccagcctgaccatcgcccacgtgaagcccagcatcatgaagagaaacggcagcttccccaagtactacgcctgccacctgtgcggcagaagattcaccctgagaagcagcctgagagagcacctgcagatccacaccggcgtgcccttcaccagcagccagcagggcgagagcagagtgcccctgaccctgtgcagcaacgccgccgacctgggcaaggacgccatggaggtgcccgaggccggcatgatcagcgacagcgagctgcagcacatcagcgacagccccatcatcgacggccagcagcagagcgagacccccccccccagcgacatcgccgacatcgacaacctggagcaggccgaccaggagagagaggtgaagagaagaaagtacgagtgcaccatctgcggcagaaagttcatccagaagagccactggagagagcacatgtacatccacaccggcaagcccttcaagtgcagcacctgcgacaagagcttctgcagagccaaccaggccgccagacacgtgtgcctgaaccagagcatcgacacctacaccatggtggacaagcagaccctggagctgtgcaccttcgaggagggcagccagatggacaacatgctggtgcagaccaacaagccctacaagtgcaacctgtgcgacaagaccttcagcacccccaacgaggtggtgaagcacagctgccagaaccagaacagcgacgtgttcgccctggacgagggcagaagcatcctgctgggcagcggcgacagcgaggtgaccgagcccgaccaccccgtgctggccagcatcaagaaggagcaggagaccgtgctgctggactag

SEQ ID NO: 10098 - DNA, 1905 bp, Artificial Sequence
  Description of Artificial Sequence: Synthetic coding sequence
atggagcccagccccctgagccccagcggcgccgccctgcccctgcccctgagcctggcccccccccccctgcccctgcccgccgccgccgtggtgcacgtgagcttccccgaggtgaccagcgccctgctggagagcctgaaccagcagagactgcagggccagctgtgcgacgtgagcatcagagtgcagggcagagagttcagagcccacagagccgtgctggccgccagcagcccctacttccacgaccaggtgctgctgaagggcatgaccagcatcagcctgcccagcgtgatggaccccggcgccttcgagaccgtgctggccagcgcctacaccggcagactgagcatggccgccgccgacatcgtgaacttcctgaccgtgggcagcgtgctgcagatgtggcacatcgtggacaagtgcaccgagctgctgagagagggcagagccagcgccaccaccaccatcaccaccgccgccgccaccagcgtgaccgtgcccggcgccggcgtgcccagcggcagcggcggcaccgtggcccccgccaccatgggcagcgccagaagccacgccagcagcagagccagcgagaaccagagccccagcagcagcaactacttcagccccagagagagcaccgacttcagcagcagcagccaggaggccttcgccgccagcgccgtgggcagcggcgagagaagaggcggcggccccgtgttccccgcccccgtggtgggcagcggcggcgccaccagcggcaagctgctgctggaggccgacgagctgtgcgacgacggcggcgacggcagaggcgccgtggtgcccggcgccggcctgagaagacccacctacaccccccccagcatcatgccccagaagcactgggtgtacgtgaagagaggcggcaactgccccgcccccacccccctggtgccccaggaccccgacctggaggaggaggaggaggaggaggacctggtgctgacctgcgaggacgacgaggacgaggagctgggcggcagcagcagagtgcccgtgggcggcggccccgaggccaccctgagcatcagcgacgtgagaaccctgagcgagccccccgacaagggcgaggagcaggtgaacttctgcgagagcagcaacgacttcggcccctacgagggcggcggccccgtggccggcctggacgacagcggcggccccacccccagcagctacgcccccagccacccccccagacccctgctgcccctggacatgcagggcaaccagatcctggtgttccccagcagcagcagcagcagcagcagccaggcccccggccagccccccggcaaccaggccgagcacggcgccgtgaccgtgggcggcaccagcgtgggcagcctgggcgtgcccggcagcgtgggcggcgtgcccggcggcaccggcagcggcgacggcaacaagatcttcctgtgccactgcggcaaggccttcagccacaagagcatgagagacagacacgtgaacatgcacctgaacctgagacccttcgactgccccgtgtgcaacaagaagttcaagatgaagcaccacctgaccgagcacatgaagacccacaccggcctgaagccctacgagtgcggcgtgtgcgccaagaagttcatgtggagagacagcttcatgagacacagaggccactgcgagagaagacacagactgggcggcgtgggcgccgtgcccggccccggcacccccaccggccccagcctgcccagcaagagagagagccccggcgtgggcggcggcagcggcgacgaggccagcgccgccaccccccccagcagcagaagagtgtggagcccccccagagtgcacaaggtggagatgggcttcggcggcggcggcggcgccaactag

SEQ ID NO: 10099 - DNA, 1905 bp, Artificial Sequence; identical to SEQ ID NO: 10098
  Description of Artificial Sequence: Synthetic coding sequence

SEQ ID NO: 10100 - DNA, 450 bp, Artificial Sequence
  Description of Artificial Sequence: Synthetic coding sequence
atggagcccagccccctgagccccagcggcgccgccctgcccctgcccctgagcctggcccccccccccctgcccctgcccgccgccgccgtggtgcacgtgagcttccccgaggtgaccagcgccctgctggagagcctgaaccagcagagactgcagggccagctgtgcgacgtgagcatcagagtgcagggcagagagttcagagcccacagagccgtgctggccgccagcagcccctacttccacgaccaggtgctgctgaagggcatgaccagcatcagcctgcccagcgtgatggaccccggcgccttcgagaccgtgctggccagcgcctacaccggcagactgagcatggccgccgccgacatcgtgaacttcctgaccgtgggcagcgtgctgcagatgtggcacatcgtggacaagtgcaccgagctgctgagagagtag

SEQ ID NO: 10101 - DNA, 450 bp, Artificial Sequence; identical to SEQ ID NO: 10100
  Description of Artificial Sequence: Synthetic coding sequence

SEQ ID NO: 10102 - DNA, 1905 bp, Artificial Sequence; identical to SEQ ID NO: 10098
  Description of Artificial Sequence: Synthetic coding sequence

SEQ ID NO: 10103 - DNA, 1905 bp, Artificial Sequence; identical to SEQ ID NO: 10098
  Description of Artificial Sequence: Synthetic coding sequence

SEQ ID NO: 10104 - DNA, 1326 bp, Artificial Sequence
  Description of Artificial Sequence: Synthetic coding sequence
atgagcgagagaagcgacctgctgcacttcaagttcgagaactacggcgacagcatgctgcagaagatgaacaagctgagagaggagaacaagttctgcgacgtgaccgtgctgatcgacgacatcgaggtgcagggccacaagatcgtgttcgccgccggcagccccttcctgagagaccagttcctgctgaacgacagcagagaggtgaagatcagcatcctgcagagcagcgaggtgggcagacagctgctgctgagctgctacagcggcgtgctggagttccccgagatggagctggtgaactacctgaccgccgccagcttcctgcagatgagccacatcgtggagagatgcacccaggccctgtggaagttcatcaagcccaagcagcccatggacagcaaggagggctgcgagccccagagcgccagcccccagagcaaggagcagcagggcgacgccagaggcagccccaagcaggacagcccctgcatccaccccagcgaggacagcatggacatggaggacagcgacatccagatcgtgaaggtggagagcatcggcgacgtgagcgaggtgagaagcaagaaggaccagaaccagttcatcagcagcgagcccaccgccctgcacagcagcgagccccagcacagcctgatcaacagcaccgtggagaacagagtgagcgagatcgagcagaaccacctgcacaactacgccctgagctacaccggcagcgacaacatcatcatggccagcaaggacgtgttcggccccaacatcagaggcgtggacaagggcctgcagtggcaccaccagtgccccaagtgcaccagagtgttcagacacctggagaactacgccaaccacctgaagatgcacaagctgttcatgtgcctgctgtgcggcaagaccttcacccagaagggcaacctgcacagacacatgagagtgcacgccggcatcaagcccttccagtgcaagatctgcggcaagaccttcagccagaagtgcagcctgcaggaccacctgaacctgcacagcggcgacaagccccacaagtgcaactactgcgacatggtgttcgcccacaagcccgtgctgagaaagcacctgaagcagctgcacggcaagaacagcttcgacaacgccaacgagagaaacgtgcaggacctgaccgtggacttcgacagcttcgcctgcaccaccgtgaccgacagcaagggctgccagccccagcccgacgccacccaggtgctggacgccggcaagctggcccaggccgtgctgaacctgagaaacgacagcacctgcgtgaactag

SEQ ID NO: 10105 - DNA, 1326 bp, Artificial Sequence; identical to SEQ ID NO: 10104
  Description of Artificial Sequence: Synthetic coding sequence

SEQ ID NO: 10106 - DNA, 1725 bp, Artificial Sequence
  Description of Artificial Sequence: Synthetic coding sequence
atgctgagagagttcagcaagtggggcgtggaggccagccccggcaaggcctgggagagaaagagaagcctgctgagaggcgccgtgggcagatacagaggcgccaccggcggcgacctgttctgggcccccttccccagctggggcaccatggagttccccgagcacagccagcagctgctgcagagcctgagagagcagagaagccagggcttcctgtgcgactgcaccgtgatggtgggcagcacccagttcctggcccacagagccgtgctggccagctgcagccccttcttccagctgttctacaaggagagagagctggacaagagagacctggtgtgcatccacaacgagatcgtgaccgcccccgccttcggcctgctgctggacttcatgtacgccggccagctgaccctgagaggcgacacccccgtggaggacgtgctggccgccgccagctacctgcacatgaacgacatcgtgaaggtgtgcaagagaagactgcaggccagagccctggccgaggccgacagcaccaagaaggaggaggagaccaacagccagctgcccagcctggagttcctgagcagcaccagcagaggcacccagcccagcctggccagcgccgagaccagcggccactggggcaagggcgagtggaagggcagcgccgcccccagccccaccgtgagaccccccgacgagccccccatgagcagcggcgccgacaccacccagcccggcatggaggtggacgccccccacctgagagccccccacccccccgtggccgacgtgagcctggccagccccagcagcagcaccgagaccatccccaccaactacttcagcagcggcatcagcgccgtgagcctggagcccctgcccagcctggacgtgggccccgagagcctgagagtggtggagcccaaggaccccggcggccccctgcagggcttctacccccccgccagcgcccccaccagcgcccccgcccccgtgagcgcccccgtgcccagccaggcccccgcccccgccgaggccgagctggtgcaggtgaaggtggaggccatcgtgatcagcgacgaggagaccgacgtgagcgacgagcagccccagggccccgagagagccttccccagcggcggcgccgtgtacggcgcccagcccagccagcccgaggccttcgaggaccccggcgccgccggcctggaggaggtgggccccagcgaccacttcctgcccaccgacccccacctgccctaccacctgctgcccggcgccggccagtaccacagaggcctggtgaccagccccctgcccgcccccgccagcctgcacgagcccctgtacctgagcagcgagtacgaggccgcccccggcagcttcggcgtgttcaccgaggacgtgcccacctgcaagacctgcggcaagaccttcagctgcagctacaccctgagaagacacgccaccgtgcacaccagagagagaccctacgagtgcagatactgcctgagaagctacacccagagcggcgacctgtacagacacatcagaaaggcccacaacgaggacctggccaagagaagcaagcccgaccccgaggtgggccccctgctgggcgtgcagcccctgcccggcagccccaccgccgacagacagagcagcagcggcggcggcccccccaaggacttcgtgctggcccccaagaccaacatctag

SEQ ID NO: 10107 - DNA, 1512 bp, Artificial Sequence
  Description of Artificial Sequence: Synthetic coding sequence
atggagaagggcggcaacatccagctggagatccccgacttcagcaacagcgtgctgagccacctgaaccagctgagaatgcagggcagactgtgcgacatcgtggtgaacgtgcagggccaggccttcagagcccacaaggtggtgctggccgccagcagcccctacttcagagaccacatgagcctgaacgagatgagcaccgtgagcatcagcgtgatcaagaaccccaccgtgttcgagcagctgctgagcttctgctacaccggcagaatctgcctgcagctggccgacatcatcagctacctgaccgccgccagcttcctgcagatgcagcacatcatcgacaagtgcacccagatcctggagggcatccacttcaagatcaacgtggccgaggtggaggccgagctgagccagaccagaaccaagcaccaggagagaccccccgagagccacagagtgacccccaacctgaacagaagcctgagccccagacacaacacccccaagggcaacagaagaggccaggtgagcgccgtgctggacatcagagagctgagcccccccgaggagagcaccagcccccagatcatcgagcccagcagcgacgtggagagcagagagcccatcctgagaatcaacagagccggccagtggtacgtggagaccggcgtggccgacagaggcggcagaagcgacgacgaggtgagagtgctgggcgccgtgcacatcaagaccgagaacctggaggagtggctgggccccgagaaccagcccagcggcgaggacggcagcagcgccgaggaggtgaccgccatggtgatcgacaccaccggccacggcagcgtgggccaggagaactacaccctgggcagcagcggcgccaaggtggccagacccaccagcagcgaggtggacagattcagccccagcggcagcgtggtgcccctgaccgagagacacagagccagaagcgagagccccggcagaatggacgagcccaagcagcccagcagccaggtggaggagagcgccatgatgggcgtgagcggctacgtggagtacctgagagagcaggaggtgagcgagagatggttcagatacaaccccagactgacctgcatctactgcgccaagagcttcaaccagaagggcagcctggacagacacatgagactgcacatgggcatcacccccttcgtgtgcagaatgtgcggcaagaagtacaccagaaaggaccagctggagtaccacatcagaaagcacaccggcaacaagcccttccactgccacgtgtgcggcaagagcttccccttccaggccatcctgaaccagcacttcagaaagaaccaccccggctgcatccccctggagggcccccacagcatcagccccgagaccaccgtgaccagcagaggccaggccgaggaggagagccccagccaggaggagaccgtggcccccggcgaggccgtgcagggcagcgtgagcaccaccggccccgactag

SEQ ID NO: 10108 - DNA, 1236 bp, Artificial Sequence
  Description of Artificial Sequence: Synthetic coding sequence
atgcccgccaccggcagataccaccagctgcccaacagctgccagttcagcgccaacgccgcctactacagacagatgtacaccgaccccggcggccacagcttcaagatcaacgtggccgaggtggaggccgagctgagccagaccagaaccaagcaccaggagagaccccccgagagccacagagtgacccccaacctgaacagaagcctgagccccagacacaacacccccaagggcaacagaagaggccaggtgagcgccgtgctggacatcagagagctgagcccccccgaggagagcaccagcccccagatcatcgagcccagcagcgacgtggagagcagagagcccatcctgagaatcaacagagccggccagtggtacgtggagaccggcgtggccgacagaggcggcagaagcgacgacgaggtgagagtgctgggcgccgtgcacatcaagaccgagaacctggaggagtggctgggccccgagaaccagcccagcggcgaggacggcagcagcgccgaggaggtgaccgccatggtgatcgacaccaccggccacggcagcgtgggccaggagaactacaccctgggcagcagcggcgccaaggtggccagacccaccagcagcgaggtggacagattcagccccagcggcagcgtggtgcccctgaccgagagacacagagccagaagcgagagccccggcagaatggacgagcccaagcagcccagcagccaggtggaggagagcgccatgatgggcgtgagcggctacgtggagtacctgagagagcaggaggtgagcgagagatggttcagatacaaccccagactgacctgcatctactgcgccaagagcttcaaccagaagggcagcctggacagacacatgagactgcacatgggcatcacccccttcgtgtgcagaatgtgcggcaagaagtacaccagaaaggaccagctggagtaccacatcagaaagcacaccggcaacaagcccttccactgccacgtgtgcggcaagagcttccccttccaggccatcctgaaccagcacttcagaaagaaccaccccggctgcatccccctggagggcccccacagcatcagccccgagaccaccgtgaccagcagaggccaggccgaggaggagagccccagccaggaggagaccgtggcccccggcgaggccgtgcagggcagcgtgagcaccaccggccccgactag

SEQ ID NO: 10109 - DNA, 927 bp, Artificial Sequence
  Description of Artificial Sequence: Synthetic coding sequence
atggagaagggcggcaacatccagctggagatccccgacttcagcaacagcgtgctgagccacctgaaccagctgagaatgcagggcagactgtgcgacatcgtggtgaacgtgcagggccaggccttcagagcccacaaggtggtgctggccgccagcagcccctacttcagagaccacatgagcctgaacgagatgagcaccgtgagcatcagcgtgatcaagaaccccaccgtgttcgagcagctgctgagcttctgctacaccggcagaatctgcctgcagctggccgacatcatcagctacctgaccgccgccagcttcctgcagatgcagcacatcatcgacaagtgcacccagatcctggagggcatccacttcaagatcaacgtggccgaggtggaggccgagctgagccagaccagaaccaagcaccaggagagaccccccgagagccacagagtgacccccaacctgaacagaagcctgagccccagacacaacacccccaagggcaacagaagaggccaggtgagcgccgtgctggacatcagagagctgagcccccccgaggagagcaccagcccccagatcatcgagcccagcagcgacgtggagagcagagagcccatcctgagaatcaacagagccggccagtggtacgtggagaccggcgtggccgacagaggcggcagaagcgacgacgaggtgagagtgctgggcgccgtgcacatcaagaccgagaacctggaggagtggctgggccccgagaaccagcccagcggcgaggacggcagcagcgccgaggaggtgaccgccatggtgatcgacaccaccggccacggcagcgtgggccaggagaactacaccctgggcagcagcggcgccaaggtggccagacccaccagcagcgaggtggacagatag

SEQ ID NO: 10110 - DNA, 1512 bp, Artificial Sequence; identical to SEQ ID NO: 10107
  Description of Artificial Sequence: Synthetic coding sequence

SEQ ID NO: 10111 - DNA, 1086 bp, Artificial Sequence
  Description of Artificial Sequence: Synthetic coding sequence
atggagaagggcggcaacatccagctggagatccccgacttcagcaacagcgtgctgagccacctgaaccagctgagaatgcagggcagactgtgcgacatcgtggtgaacgtgcagggccaggccttcagagcccacaaggtggtgctggccgccagcagcccctacttcagagaccacatgagcctgaacgagatgagcaccgtgagcatcagcgtgatcaagaaccccaccgtgttcgagcagctgctgagcttctgctacaccggcagaatctgcctgcagctggccgacatcatcagctacctgaccgccgccagcttcctgcagatgcagcacatcatcgacaagtgcacccagatcctggagggcatccacttcaagatcaacgtggccgaggtggaggccgagctgagccagaccagaaccaagcaccaggagagaccccccgagagccacagagtgacccccaacctgaacagaagcctgagccccagacacaacacccccaagggcaacagaagaggccaggtgagcgccgtgctggacatcagagagctgagcccccccgaggagagcaccagcccccagatcatcgagcccagcagcgacgtggagagcagagagcccatcctgagaatcaacagagccggccagtggtacgtggagaccggcgtggccgacagaggcggcagaagcgacgacgaggtgagagtgctgggcgccgtgcacatcaagaccgagaacctggaggagtggctgggccccgagaaccagcccagcggcgaggacggcagcagcgccgaggaggtgaccgccatggtgatcgacaccaccggccacggcagcgtgggccaggagaactacaccctgggcagcagcggcgccaaggtggccagacccaccagcagcgaggtggacagattcagccccagcggcagcgtggtgcccctgaccgagagacacagagccagaagcgagagccccggcagaatggacgagcccaagcagcccagcagccaggtgtggagctgcggcttcagaaccgccctggtggtgggcggcatcgccaccgtgtacgagtag

SEQ ID NO: 10112 - DNA, 1512 bp, Artificial Sequence; identical to SEQ ID NO: 10107
  Description of Artificial Sequence: Synthetic coding sequence

SEQ ID NO: 10113 - DNA, 2139 bp, Artificial Sequence
  Description of Artificial Sequence: Synthetic coding sequence
atgggcatgagaatcaagctgcagagcaccaaccaccccaacaacctgctgaaggagctgaacaagtgcagactgagcgagaccatgtgcgacgtgaccatcgtggtgggcagcagaagcttccccgcccacaaggccgtgctggcctgcgccgccggctacttccagaacctgttcctgaacaccggcctggacgccgccagaacctacgtggtggacttcatcacccccgccaacttcgagaaggtgctgagcttcgtgtacaccagcgagctgttcaccgacctgatcaacgtgggcgtgatctacgaggtggccgagagactgggcatggaggacctgctgcaggcctgccacagcaccttccccgacctggagagcaccgccagagccaagcccctgaccagcaccagcgagagccacagcggcaccctgagctgccccagcgccgagcccgcccaccccctgggcgagctgagaggcggcggcgactacctgggcgccgacagaaactacgtgctgcccagcgacgccggcggcagctacaaggaggaggagaagaacgtggccagcgacgccaaccacagcctgcacctgccccagccccccccccccccccccaagaccgaggaccacgacacccccgcccccttcaccagcatccccagcatgatgacccagcccctgctgggcaccgtgagcaccggcatccagaccagcaccagcagctgccagccctacaaggtgcagagcaacggcgacttcagcaagaacagcttcctgacccccgacaacgccgtggacatcaccaccggcaccaacagctgcctgagcaacagcgagcacagcaaggaccccggcttcggccagatggacgagctgcagctggaggacctgggcgacgacgacctgcagttcgaggaccccgccgaggacatcggcaccaccgaggaggtgatcgagctgagcgacgacagcgaggacgagctggccttcggcgagaacgacaacagagagaacaaggccatgccctgccaggtgtgcaagaaggtgctggagcccaacatccagctgatcagacagcacgccagagaccacgtggacctgctgaccggcaactgcaaggtgtgcgagacccacttccaggacagaaacagcagagtgacccacgtgctgagccacatcggcatcttcctgttcagctgcgacatgtgcgagaccaagttcttcacccagtggcagctgaccctgcacagaagagacggcatcttcgagaacaacatcatcgtgcaccccaacgaccccctgcccggcaagctgggcctgttcagcggcgccgccagccccgagctgaagtgcgccgcctgcggcaaggtgctggccaaggacttccacgtggtgagaggccacatcctggaccacctgaacctgaagggccaggcctgcagcgtgtgcgaccagagacacctgaacctgtgcagcctgatgtggcacaccctgagccacctgggcatcagcgtgttcagctgcagcgtgtgcgccaacagcttcgtggactggcacctgctggagaagcacatggccgtgcaccagagcctggaggacgccctgttccactgcagactgtgcagccagagcttcaagagcgaggccgcctacagataccacgtgagccagcacaagtgcaacagcggcctggacgccagacccggcttcggcctgcagcaccccgccctgcagaagagaaagctgcccgccgaggagttcctgggcgaggagctggccctgcagggccagcccggcaacagcaagtacagctgcaaggtgtgcggcaagagattcgcccacaccagcgagttcaactaccacagaagaatccacaccggcgagaagccctaccagtgcaaggtgtgccacaagttcttcagaggcagaagcaccatcaagtgccacctgaagacccacagcggcgccctgatgtacagatgcaccgtgtgcggccactacagcagcaccctgaacctgatgagcaagcacgtgggcgtgcacaagggcagcctgccccccgacttcaccatcgagcagaccttcatgtacatcatccacagcaaggaggccgacaagaaccccgacagctag

SEQ ID NO: 10114 - DNA, 2730 bp, Artificial Sequence
  Description of Artificial Sequence: Synthetic coding sequence
atgaagaagagaagaaaggtgaccagcaacctggagaagatccacctgggctaccacaaggacagcagcgagggcaacgtggccgtggagtgcgaccaggtgacctacacccacagcgccggcagacccacccccgaggccctgcactgctaccaggagctgccccccagccccgaccagagaaagctgctgagcagcctgcagtacaacaagaacctgctgaagtacctgaacgacgacagacagaagcagcccagcttctgcgacctgctgatcatcgtggagggcaaggagttcagcgcccacaaggtggtggtggccgtgggcagcagctacttccacgcctgcctgagcaagaaccccagcaccgacgtggtgaccctggaccacgtgacccacagcgtgttccagcacctgctggagttcctgtacaccagcgagttcttcgtgtacaagtacgagatccccctggtgctggaggccgccaagttcctggacatcatcgacgccgtgaagctgctgaacaacgagaacgtggcccccttccacagcgagctgaccgagaagagcagccccgaggagaccctgaacgagctgaccggcagactgagcaacaaccaccagtgcaagttctgcagcagacacttctgctacaagaagagcctggagaaccacctggccaagacccacagaagcctgctgctgggcaagaagcacggcctgaagatgctggagagaagcttcagcgccagaagaagcaagagaaacagaaagtgccccgtgaagttcgacgacaccagcgacgacgagcaggagagcggcgacggcagcgacaacctgaaccaggagaacttcgacaaggagaagagcgacagaaacgacagcgaggaccccggcagcgagtacaacgccgaggaggacgagctggaggaggagatgagcgacgagtacagcgacatcgaggagcagagcgagaaggaccacaacgacgccgaggaggagcccgaggccggcgacagcgtgggcaacgtgcacgagggcctgacccccgtggtgatccagaacagcaacaagaagatcctgcagtgccccaagtgcgacaagaccttcgacagaatcggcaagtacgagagccacaccagagtgcacaccggcgagaagcccttcgagtgcgacatctgccaccagagatacagcaccaagagcaacctgaccgtgcacagaaagaagcacagcaacgagaccgagttccacaagaaggagcacaagtgcccctactgcaacaagctgcacgccagcaagaagaccctggccaagcacgtgaagagattccaccccgagaacgcccaggagttcatcagcatcaagaagaccaagagcgagagctggaagtgcgacatctgcaagaagagcttcaccagaagaccccacctggaggagcacatgatcctgcacagccaggacaagcccttcaagtgcacctactgcgaggagcacttcaagagcagattcgccagactgaagcaccaggagaagttccacctgggccccttcccctgcgacatctgcggcagacagttcaacgacaccggcaacctgaagagacacatcgagtgcacccacggcggcaagagaaagtggacctgcttcatctgcggcaagagcgtgagagagagaaccaccctgaaggagcacctgagaatccacagcggcgagaagccccacctgtgcagcatctgcggccagagcttcagacacggcagcagctacagactgcacctgagagtgcaccacgacgacaagagatacgagtgcgacgagtgcggcaagaccttcatcagacacgaccacctgaccaagcacaagaagatccacagcggcgagaaggcccaccagtgcgaggagtgcggcaagtgcttcggcagaagagaccacctgaccgtgcactacaagagcgtgcacctgggcgagaaggtgtggcagaagtacaaggccaccttccaccagtgcgacgtgtgcaagaagatcttcaagggcaagagcagcctggagatgcacttcagaacccacagcggcgagaagccctacaagtgccagatctgcaaccagagcttcagaatcaagaagaccctgaccaagcacctggtgatccacagcgacgccagacccttcaactgccagcactgcaacgccaccttcaagagaaaggacaagctgaagtaccacatcgaccacgtgcacgagatcaagagccccgacgaccccctgagcaccagcgaggagaagctggtgagcctgcccgtggagtacagcagcgacgacaagatcttccagaccgagaccaagcagtacatggaccagcccaaggtgtaccagagcgaggccaagaccatgctgcagaacgtgagcgccgaggtgtgcgtgcccgtgaccctggtgcccgtgcagatgcccgacacccccagcgacctggtgagacacaccaccaccctgccccccagcagccacgagatcctgagcccccagccccagagcaccgactaccccagagccgccgacctggccttcctggagaagtacaccctgaccccccagcccgccaacatcgtgcaccccgtgagacccgagcagatgctggaccccagagagcagagctacctgggcaccctgctgggcctggacagcaccaccggcgtgcagaacatcagcaccaacgagcaccacagctag

SEQ ID NO: 10115 - DNA, 1404 bp, Artificial Sequence
  Description of Artificial Sequence: Synthetic coding sequence
atggagcccggcaccaacagcttcagagtggagttccccgacttcagcagcaccatcctgcagaagctgaaccagcagagacagcagggccagctgtgcgacgtgagcatcgtggtgcagggccacatcttcagagcccacaaggccgtgctggccgccagcagcccctacttctgcgaccaggtgctgctgaagaacagcagaagaatcgtgctgcccgacgtgatgaaccccagagtgttcgagaacatcctgctgagcagctacaccggcagactggtgatgcccgcccccgagatcgtgagctacctgaccgccgccagcttcctgcagatgtggcacgtggtggacaagtgcaccgaggtgctggagggcaaccccaccgtgctgtgccagaagctgaaccacggcagcgaccaccagagccccagcagcagcagctacaacggcctggtggagagcttcgagctgggcagcggcggccacaccgacttccccaaggcccaggagctgagagacggcgagaacgaggaggagagcaccaaggacgagctgagcagccagctgaccgagcacgagtacctgcccagcaacagcagcaccgagcacgacagactgagcaccgagatggccagccaggacggcgaggagggcgccagcgacagcgccgagttccactacaccagacccatgtacagcaagcccagcatcatggcccacaagagatggatccacgtgaagcccgagagactggagcaggcctgcgagggcatggacgtgcacgccacctacgacgagcaccaggtgaccgagagcatcaacaccgtgcagaccgagcacaccgtgcagcccagcggcgtggaggaggacttccacatcggcgagaagaaggtggaggccgagttcgacgagcaggccgacgagagcaactacgacgagcaggtggacttctacggcagcagcatggaggagttcagcggcgagagaagcgacggcaacctgatcggccacagacaggaggccgccctggccgccggctacagcgagaacatcgagatggtgaccggcatcaaggaggaggccagccacctgggcttcagcgccaccgacaagctgtacccctgccagtgcggcaagagcttcacccacaagagccagagagacagacacatgagcatgcacctgggcctgagaccctacggctgcggcgtgtgcggcaagaagttcaagatgaagcaccacctggtgggccacatgaagatccacaccggcatcaagccctacgagtgcaacatctgcgccaagagattcatgtggagagacagcttccacagacacgtgaccagctgcaccaagagctacgaggccgccaaggccgagcagaacaccaccgaggccaactag

SEQ ID NO: 10116 - DNA, 1404 bp, Artificial Sequence; identical to SEQ ID NO: 10115
  Description of Artificial Sequence: Synthetic coding sequence

SEQ ID NO: 10117 - DNA, 1404 bp, Artificial Sequence; identical to SEQ ID NO: 10115
  Description of Artificial Sequence: Synthetic coding sequence

SEQ ID NO: 10118 - DNA, 591 bp, Artificial Sequence
  Description of Artificial Sequence: Synthetic coding sequence
atggagcccggcaccaacagcttcagagtggagttccccgacttcagcagcaccatcctgcagaagctgaaccagcagagacagcagggccagctgtgcgacgtgagcatcgtggtgcagggccacatcttcagagcccacaaggccgtgctggccgccagcagcccctacttctgcgaccaggtgctgctgaagaacagcagaagaatcgtgctgcccgacgtgatgaaccccagagtgttcgagaacatcctgctgagcagctacaccggcagactggtgatgcccgcccccgagatcgtgagctacctgaccgccgccagcttcctgcagatgtggcacgtggtggacaagtgcaccgaggtgctggagggcaaccccaccgtgctgtgccagaagctgaaccacggcagcgaccaccagagccccagcagcagcagctacaacggcctggtggagagcttcgagctgggcagcggcggccacaccgacttccccaaggcccaggagctgagagacggcgagaacgaggaggagagcaccaaggacgagctgagcagccagctgaccgagcacgagtacctgccctag

SEQ ID NO: 10119 - DNA, 1536 bp, Artificial Sequence
  Description of Artificial Sequence: Synthetic coding sequence
atggccgccgccgaggccgtgcaccacatccacctgcagaacttcagcagaagcctgctggagaccctgaacggccagagactgggcggccacttctgcgacgtgaccgtgagaatcagagaggccagcctgagagcccacagatgcgtgctggccgccggcagccccttcttccaggacaagctgctgctgggccacagcgagatcagagtgccccccgtggtgcccgcccagaccgtgagacagctggtggagttcctgtacagcggcagcctggtggtggcccagggcgaggccctgcaggtgctgaccgccgccagcgtgctgagaatccagaccgtgatcgacgagtgcacccagatcatcgccagagccagagcccccggcaccagcgcccccacccccctgcccacccccgtgcccccccccctggcccccgcccagctgagacacagactgagacacctgctggccgccagaccccccggccaccccggcgccgcccacagcagaaagcagagacagcccgccagactgcagctgcccgccccccccacccccgccaaggccgagggccccgacgccgaccccagcctgagcgccgcccccgacgacagaggcgacgaggacgacgaggagagcgacgacgagaccgacggcgaggacggcgagggcggcggccccggcgagggccaggccccccccagcttccccgactgcgccgccggcttcctgaccgccgccgccgacagcgcctgcgaggagccccccgcccccaccggcctggccgactacagcggcgccggcagagacttcctgagaggcgccggcagcgccgaggacgtgttccccgacagctacgtgagcacctggcacgacgaggacggcgccgtgcccgagggctgccccaccgagacccccgtgcagcccgactgcatcctgagcggcagcagaccccccggcgtgaagacccccggcccccccgtggccctgttccccttccacctgggcgcccccggcccccccgcccccccccccagcgcccccagcggccccgcccccgcccccccccccgccttctaccccaccctgcagcccgaggccgcccccagcacccagctgggcgaggtgcccgcccccagcgccgcccccaccaccgcccccagcggcacccccgccagaacccccggcgccgagccccccacctacgagtgcagccactgcagaaagaccttcagcagcagaaagaactacaccaagcacatgttcatccacagcggcgagaagccccaccagtgcgccgtgtgctggagaagcttcagcctgagagactacctgctgaagcacatggtgacccacaccggcgtgagagccttccagtgcgccgtgtgcgccaagagattcacccagaagagcagcctgaacgtgcacatgagaacccacagacccgagagagccccctgccccgcctgcggcaaggtgttcagccacagagccctgctggagagacacctggccgcccaccccgccccctag

SEQ ID NO: 10120 - DNA, 1770 bp, Artificial Sequence
  Description of Artificial Sequence: Synthetic coding sequence
atgaacaacagaaaggaggacatggagatcaccagccactacagacacctgctgagagagctgaacgagcagagacagcacggcgtgctgtgcgacgtgtgcgtggtggtggagggcaaggtgttcaaggcccacaagaacgtgctgctgggcagcagcagatacttcaagaccctgtactgccaggtgcagaagaccagcgagcaggccaccgtgacccacctggacatcgtgaccgcccagggcttcaaggccatcatcgacttcatgtacagcgcccacctggccctgaccagcagaaacgtgatcgaggtgatgagcgccgccagcttcctgcagatgaccgacatcgtgcaggcctgccacgacttcatcaaggccgccctggacatcagcatcaagagcgacgccagcgacgagctggccgagttcgagatcggcgccagcagcagcagcagcaccgaggccctgatcagcgccgtgatggccggcagaagcatcagcccctggctggccagaagaaccagccccgccaacagcagcggcgacagcgccatcgccagctgccacgacggcggcagcagctacggcaaggaggaccaggagcccaaggccgacggccccgacgacgtgagcagccagcccctgtggcccggcgacgtgggctacggccccctgagaatcaaggaggagcaggtgagccccagccagtacggcggcagcgagctgcccagcgccaaggacggcgccgtgcagaacagcttcagcgagcagagcgccggcgacgcctggcagcccaccggcagaagaaagaacagaaagaacaaggagaccgtgagacacatcacccagcaggtggaggacgacagcagagccagcagccccgtgcccagcttcctgcccaccagcggctggcccttcagcagcagagacagcaacgccgacctgagcgtgaccgaggccagcagcagcgacagcagaggcgagagagccgagctgtacgcccaggtggaggagggcctgctgggcggcgaggccagctacctgggcccccccctgacccccgagaaggacgacgccctgcaccaggccaccgccgtggccaacctgagagccgccctgatgagcaagaacagcctgctgagcctgaaggccgacgtgctgggcgacgacggcagcctgctgttcgagtacctgcccagaggcgcccacagcctgagcctgaacgagttcaccgtgatcagaaagaagttcaagtgcccctactgcagcttcagcgccatgcaccagtgcatcctgaagagacacatgagaagccacaccggcgagagaccctacccctgcgagatctgcggcaagaagttcaccagaagagagcacatgaagagacacaccctggtgcacagcaaggacaagaagtacgtgtgcaaggtgtgcagcagagtgttcatgagcgccgccagcgtgggcatcagacacggcagcagaagacacggcgtgtgcaccgactgcgccggcagaggcatggccggccccctggaccacggcggcggcggcggcgagggcagccccgaggccctgttccccggcgacggcccctacctggaggaccccgaggaccccagaggcgaggccgaggagctgggcgaggacgacgagggcctggcccccgaggacgccctgctggccgacgacaaggacgaggaggacagccccagacccagaagcccccccggcggccccgacaaggacttcgcctggctgagctag

SEQ ID NO: 10121 - DNA, 1770 bp, Artificial Sequence; identical to SEQ ID NO: 10120
  Description of Artificial Sequence: Synthetic coding sequence

SEQ ID NO: 10122 - DNA, 1770 bp, Artificial Sequence; identical to SEQ ID NO: 10120
  Description of Artificial Sequence: Synthetic coding sequence

SEQ ID NO: 10123 - DNA, 342 bp, Artificial Sequence
  Description of Artificial Sequence: Synthetic coding sequence
atgagcaccatccagaacctgcagagcttcgaccccttcgccgacgccaccaagggcgacgacctgctgcccgccggcaccgaggactacatccacatcagaatccagcagagaaacggcagaaagaccctgaccaccgtgcagggcatcgccgacgactacgacaagaagaagctggtgaaggccttcaagaagaagttcgcctgcaacggcaccgtgatcgagcaccccgagtacggcgaggtgatccagctgcagggcgaccagagaaagaacatctgccagttcctgctggaggtgggcatcgtgaaggaggagcagctgaaggtgcacggcttctag

SEQ ID NO: 10124 - DNA, 1116 bp, Artificial Sequence
  Description of Artificial Sequence: Synthetic coding sequence
atggccaccagaagcagagagaacgccagaagaagaggcacccccgagcccgaggaggccggcagaagaggcggcaagagacccaagcccccccccggcgtggccagcgccagcgccagaggcccccccgccaccgacggcctgggcgccaaggtgaagctggaggagaagcagcaccacccctgccagaagtgccccagagtgttcaacaacagatggtacctggagaagcacatgaacgtgacccacagcagaatgcagatctgcgaccagtgcggcaagagattcctgctggagagcgagctgctgctgcacagacagaccgactgcgagagaaacatccagtgcgtgacctgcggcaaggccttcaagaagctgtggagcctgcacgagcacaacaagatcgtgcacggctacgccgagaagaagttcagctgcgagatctgcgagaagaagttctacaccatggcccacgtgagaaagcacatggtggcccacaccaaggacatgcccttcacctgcgagacctgcggcaagagcttcaagagaagcatgagcctgaaggtgcacagcctgcagcacagcggcgagaagcccttcagatgcgagaactgcaacgagagattccagtacaagtaccagctgagaagccacatgagcatccacatcggccacaagcagttcatgtgccagtggtgcggcaaggacttcaacatgaagcagtacttcgacgagcacatgaagacccacaccggcgagaagccctacatctgcgagatctgcggcaagagcttcaccagcagacccaacatgaagagacacagaagaacccacaccggcgagaagccctacccctgcgacgtgtgcggccagagattcagattcagcaacatgctgaaggcccacaaggagaagtgcttcagagtgagccacaccctggccggcgacggcgtgcccgccgcccccggcctgccccccacccagccccaggcccacgccctgcccctgctgcccggcctgccccagaccctgcccccccccccccacctgcccccccccccccccctgttccccaccaccgccagccccggcggcagaatgaacgccaacaactag

SEQ ID NO: 10125 - DNA, 1941 bp, Artificial Sequence
  Description of Artificial Sequence: Synthetic coding sequence
atgggcagactgaacgagcagagactgttccagcccgacctgtgcgacgtggacctggtgctggtgccccagagaagcgtgttccccgcccacaagggcgtgctggccgcctacagccagttcttccacagcctgttcacccagaacaagcagctgcagagagtggagctgagcctggaggccctggcccccggcggcctgcagcagatcctgaacttcatctacaccagcaagctgctggtgaacgccgccaacgtgcacgaggtgctgagcgccgccagcctgctgcagatggccgacatcgccgccagctgccaggagctgctggacgccagaagcctgggcccccccggccccggcaccgtggccctggcccagcccgccgccagctgcacccccgccgcccccccctactactgcgacatcaagcaggaggccgacacccccggcctgcccaagatctacgccagagagggccccgacccctacagcgtgagagtggaggacggcgccggcaccgccggcggcaccgtgcccgccaccatcggccccgcccagcccttcttcaaggaggagaaggagggcggcgtggaggaggccggcggcccccccgccagcctgtgcaagctggagggcggcgaggagctggaggaggagctgggcggcagcggcacctacagcagaagagagcagagccagatcatcgtggaggtgaacctgaacaaccagaccctgcacgtgagcaccggccccgagggcaagcccggcgccggccccagccccgccaccgtggtgctgggcagagaggacggcctgcagagacacagcgacgaggaggaggaggacgacgaggaggaggaggaggaggaggaggaggaggagggcggcggcagcggcagagaggaggaggaggaggaggagggcggcagccagggcgaggaggaggaggaggaggaggacggccacagcgagcaggaggaggaggaggaggagaagcagcaccacccctgccagaagtgccccagagtgttcaacaacagatggtacctggagaagcacatgaacgtgacccacagcagaatgcagatctgcgaccagtgcggcaagagattcctgctggagagcgagctgctgctgcacagacagaccgactgcgagagaaacatccagtgcgtgacctgcggcaaggccttcaagaagctgtggagcctgcacgagcacaacaagatcgtgcacggctacgccgagaagaagttcagctgcgagatctgcgagaagaagttctacaccatggcccacgtgagaaagcacatggtggcccacaccaaggacatgcccttcacctgcgagacctgcggcaagagcttcaagagaagcatgagcctgaaggtgcacagcctgcagcacagcggcgagaagcccttcagatgcgagaactgcaacgagagattccagtacaagtaccagctgagaagccacatgagcatccacatcggccacaagcagttcatgtgccagtggtgcggcaaggacttcaacatgaagcagtacttcgacgagcacatgaagacccacaccggcgagaagccctacatctgcgagatctgcggcaagagcttcaccagcagacccaacatgaagagacacagaagaacccacaccggcgagaagccctacccctgcgacgtgtgcggccagagattcagattcagcaacatgctgaaggcccacaaggagaagtgcttcagagtgagccacaccctggccggcgacggcgtgcccgccgcccccggcctgccccccacccagccccaggcccacgccctgcccctgctgcccggcctgccccagaccctgcccccccccccccacctgcccccccccccccccctgttccccaccaccgccagccccggcggcagaatgaacgccaacaactag

SEQ ID NO: 10126 - DNA, 2298 bp, Artificial Sequence
  Description of Artificial Sequence: Synthetic coding sequence
atggaccccgtggccacccacagctgccacctgctgcagcagctgcacgagcagagaatccagggcctgctgtgcgactgcatgctggtggtgaagggcgtgtgcttcaaggcccacaagaacgtgctggccgccttcagccagtacttcagaagcctgttccagaacagcagcagccagaagaacgacgtgttccacctggacgtgaagaacgtgagcggcatcggccagatcctggacttcatgtacaccagccacctggacctgaaccaggacaacatccaggtgatgctggacaccgcccagtgcctgcaggtgcagaacgtgctgagcctgtgccacaccttcctgaagagcgccaccgtggtgcagccccccggcatgccctgcaacagcaccctgagcctgcagagcaccctgacccccgacgccacctgcgtgatcagcgagaactaccccccccacctgctgcaggagtgcagcgccgacgcccagcagaacaagaccctggacgagagccacccccacgccagccccagcgtgaacagacaccacagcgccggcgagatcagcaagcaggcccccgacaccagcgacggcagctgcaccgagctgcccttcaagcagcccaactactactacaagctgagaaacttctacagcaagcagtaccacaagcacgccgccggccccagccaggagagagtggtggagcagcccttcgccttcagcaccagcaccgacctgaccaccgtggagagccagccctgcgccgtgagccacagcgagtgcatcctggagagccccgagcacctgcccagcaacttcctggcccagcccgtgaacgacagcgccccccaccccgagagcgacgccacctgccagcagcccgtgaagcagatgagactgaagaaggccatccacctgaagaagctgaacttcctgaagagccagaagtacgccgagcaggtgagcgagcccaagagcgacgacggcctgaccaagagactggagagcgccagcaagaacaccctggagaaggccagcagccagagcgccgaggagaaggagagcgaggaggtggtgagctgcgagaacttcaactgcatcagcgagaccgagagacccgaggaccccgccgccctggaggaccagagccagaccctgcagagccagagacagtacgcctgcgagctgtgcggcaagcccttcaagcaccccagcaacctggagctgcacaagagaagccacaccggcgagaagcccttcgagtgcaacatctgcggcaagcacttcagccaggccggcaacctgcagacccacctgagaagacacagcggcgagaagccctacatctgcgagatctgcggcaagagattcgccgccagcggcgacgtgcagagacacatcatcatccacagcggcgagaagccccacctgtgcgacatctgcggcagaggcttcagcaacttcagcaacctgaaggagcacaagaagacccacaccgccgacaaggtgttcacctgcgacgagtgcggcaagagcttcaacatgcagagaaagctggtgaagcacagaatcagacacaccggcgagagaccctacagctgcagcgcctgcggcaagtgcttcggcggcagcggcgacctgagaagacacgtgagaacccacaccggcgagaagccctacacctgcgagatctgcaacaagtgcttcaccagaagcgccgtgctgagaagacacaagaagatgcactgcaaggccggcgacgagagccccgacgtgctggaggagctgagccaggccatcgagaccagcgacctggagaagagccagagcagcgacagcttcagccaggacaccagcgtgaccctgatgcccgtgagcgtgaagctgcccgtgcaccccgtggagaacagcgtggccgagttcgacagccacagcggcggcagctactgcaagctgagaagcatgatccagccccacggcgtgagcgaccaggagaagctgagcctggaccccggcaagctggccaagccccagatgcagcagacccagccccaggcctacgcctacagcgacgtggacacccccgccggcggcgagcccctgcaggccgacggcatggccatgatcagaagcagcctggccgccctggacaaccacggcggcgaccccctgggcagcagagccagcagcaccacctacagaaacagcgagggccagttcttcagcagcatgaccctgtggggcctggccatgaagaccctgcagaacgagaacgagctggaccagtag

SEQ ID NO: 10127 - DNA, 1932 bp, Artificial Sequence
  Description of Artificial Sequence: Synthetic coding sequence
atggaccccgtggccacccacagctgccacctgctgcagcagctgcacgagcagagaatccagggcctgctgtgcgactgcatgctggtggtgaagggcgtgtgcttcaaggcccacaagaacgtgctggccgccttcagccagtacttcagaagcctgttccagaacagcagcagccagaagaacgacgtgttccacctggacgtgaagaacgtgagcggcatcggccagatcctggacttcatgtacaccagccacctggacctgaaccaggacaacatccaggtgatgctggacaccgcccagtgcctgcaggtgcagaacgtgctgagcctgtgccacaccttcctgaagagcgccaccgtggtgcagccccccggcatgccctgcaacagcaccctgagcctgcagagcaccctgacccccgacgccacctgcgtgatcagcgagaactaccccccccacctgctgcaggagtgcagcgccgacgcccagcagaacaagaccctggacgagagccacccccacgccagccccagcgtgaacagacaccacagcgccggcgagatcagcaagcaggcccccgacaccagcgacggcagctgcaccgagctgcccttcaagcagcccaactactactacaagctgagaaacttctacagcaagcagtaccacaagcacgccgccggccccagccaggagagagtggtggagcagcccttcgccttcagcaccagcaccgacctgaccaccgtggagagccagccctgcgccgtgagccacagcgagtgcatcctggagagccccgagcacctgcccagcaacttcctggcccagcccgtgaacgacagcgccccccaccccgagagcgacgccacctgccagcagcccgtgaagcagatgagactgaagaaggccatccacctgaagaagctgaacttcctgaagagccagaagtacgccgagcaggtgagcgagcccaagagcgacgacggcctgaccaagagactggagagcgccagcaagaacaccctggagaaggccagcagccagagcgccgaggagaaggagagcgaggaggtggtgagctgcgagaacttcaactgcatcagcgagaccgagagacccgaggaccccgccgccctggaggaccagagccagaccctgcagagccagagacagtacgcctgcgagctgtgcggcaagcccttcaagcaccccagcaacctggagctgcacaagagaagccacaccggcaagtgcttcggcggcagcggcgacctgagaagacacgtgagaacccacaccggcgagaagccctacacctgcgagatctgcaacaagtgcttcaccagaagcgccgtgctgagaagacacaagaagatgcactgcaaggccggcgacgagagccccgacgtgctggaggagctgagccaggccatcgagaccagcgacctggagaagagccagagcagcgacagcttcagccaggacaccagcgtgaccctgatgcccgtgagcgtgaagctgcccgtgcaccccgtggagaacagcgtggccgagttcgacagccacagcggcggcagctactgcaagctgagaagcatgatccagccccacggcgtgagcgaccaggagaagctgagcctggaccccggcaagctggccaagccccagatgcagcagacccagccccaggcctacgcctacagcgacgtggacacccccgccggcggcgagcccctgcaggccgacggcatggccatgatcagaagcagcctggccgccctggacaaccacggcggcgaccccctgggcagcagagccagcagcaccacctacagaaacagcgagggccagttcttcagcagcatgaccctgtggggcctggccatgaagaccctgcagaacgagaacgagctggaccagtag

SEQ ID NO: 10128 - DNA, 441 bp, Artificial Sequence
  Description of Artificial Sequence: Synthetic coding sequence
atggaccccgtggccacccacagctgccacctgctgcagcagctgcacgagcagagaatccagggcctgctgtgcgactgcatgctggtggtgaagggcgtgtgcttcaaggcccacaagaacgtgctggccgccttcagccagtacttcagaagcctgttccagaacagcagcagccagaagaacgacgtgttccacctggacgtgaagaacgtgagcggcatcggccagatcctggacttcatgtacaccagccacctggacctgaaccaggacaacatccaggtgatgctggacaccgcccagtgcctgcaggtgcagaacgtgctgagcctgtgccacaccttcctgaagagcgccaccgtggtgcagccccccggcatgccctgcaacagcaccctgagcctgcagagcaccctgacccccgacgccacctgctag

SEQ ID NO: 10129 - DNA, 747 bp, Artificial Sequence
  Description of Artificial Sequence: Synthetic coding sequence
atgcagagaaagctggtgaagcacagaatcagacacaccggcgagagaccctacagctgcagcgcctgcggcaagtgcttcggcggcagcggcgacctgagaagacacgtgagaacccacaccggcgagaagccctacacctgcgagatctgcaacaagtgcttcaccagaagcgccgtgctgagaagacacaagaagatgcactgcaaggccggcgacgagagccccgacgtgctggaggagctgagccaggccatcgagaccagcgacctggagaagagccagagcagcgacagcttcagccaggacaccagcgtgaccctgatgcccgtgagcgtgaagctgcccgtgcaccccgtggagaacagcgtggccgagttcgacagccacagcggcggcagctactgcaagctgagaagcatgatccagccccacggcgtgagcgaccaggagaagctgagcctggaccccggcaagctggccaagccccagatgcagcagacccagccccaggcctacgcctacagcgacgtggacacccccgccggcggcgagcccctgcaggccgacggcatggccatgatcagaagcagcctggccgccctggacaaccacggcggcgaccccctgggcagcagagccagcagcaccacctacagaaacagcgagggccagttcttcagcagcatgaccctgtggggcctggccatgaagaccctgcagaacgagaacgagctggaccagtag

SEQ ID NO: 10130 - DNA, 2034 bp, Artificial Sequence
  Description of Artificial Sequence: Synthetic coding sequence
atggacttccccggccacttcgagcagatcttccagcagctgaactaccagagactgcacggccagctgtgcgactgcgtgatcgtggtgggcaacagacacttcaaggcccacagaagcgtgctggccgcctgcagcacccacttcagagccctgttcagcgtggccgagggcgaccagaccatgaacatgatccagctggacagcgaggtggtgaccgccgaggccttcgccgccctgatcgacatgatgtacaccagcaccctgatgctgggcgagagcaacgtgatggacgtgctgctggccgccagccacctgcacctgaacagcgtggtgaaggcctgcaagcactacctgaccaccagaaccctgcccatgagcccccccagcgagagagtgcaggagcagagcgccagaatgcagagaagcttcatgctgcagcagctgggcctgagcatcgtgagcagcgccctgaacagcagccagaacggcgaggagcagcccgcccccatgagcagcagcatgagaagcaacctggaccagagaacccccttccccatgagaagactgcacaagagaaagcagagcgccgaggagagagccagacagagactgagacccagcatcgacgagagcgccatcagcgacgtgacccccgagaacggccccagcggcgtgcacagcagagaggagttcttcagccccgacagcctgaagatcgtggacaaccccaaggccgacggcatgaccgacaaccaggaggacagcgccatcatgttcgaccagagcttcggcacccaggaggacgcccaggtgcccagccagagcgacaacagcgccggcaacatggcccagctgagcatggccagcagagccacccaggtggagaccagcttcgaccaggaggccgcccccgagaagagcagcttccagtgcgagaaccccgaggtgggcctgggcgagaaggagcacatgagagtggtggtgaagagcgagcccctgagcagccccgagccccaggacgaggtgagcgacgtgaccagccaggccgagggcagcgagagcgtggaggtggagggcgtggtggtgagcgccgagaagatcgacctgagccccgagagcagcgacagaagcttcagcgacccccagagcagcaccgacagagtgggcgacatccacatcctggaggtgaccaacaacctggagcacaagagcaccttcagcatcagcaacttcctgaacaagagcagaggcaacaacttcaccgccaaccagaacaacgacgacaacatccccaacaccaccagcgactgcagactggagagcgaggccccctacctgctgagccccgaggccggccccgccggcggccccagcagcgcccccggcagccacgtggagaaccccttcagcgagcccgccgacagccacttcgtgagacccatgcaggaggtgatgggcctgccctgcgtgcagaccagcggctaccagggcggcgagcagttcggcatggacttcagcagaagcggcctgggcctgcacagcagcttcagcagagtgatgatcggcagccccagaggcggcgccagcaacttcccctactacagaagaatcgcccccaagatgcccgtggtgaccagcgtgagaagcagccagatccccgagaacagcaccagcagccagctgatgatgaacggcgccaccagcagcttcgagaacggccaccccagccagcccggccccccccagctgaccagagccagcgccgacgtgctgagcaagtgcaagaaggccctgagcgagcacaacgtgctggtggtggagggcgccagaaagtacgcctgcaagatctgctgcaagaccttcctgaccctgaccgactgcaagaagcacatcagagtgcacaccggcgagaagccctacgcctgcctgaagtgcggcaagagattcagccagagcagccacctgtacaagcacagcaagaccacctgcctgagatggcagagcagcaacctgcccagcaccctgctgtag

SEQ ID NO: 10131 - DNA, 1275 bp, Artificial Sequence
  Description of Artificial Sequence: Synthetic coding sequence
atggccgccgagagcgacgtgctgcacttccagttcgagcagcagggcgacgtggtgctgcagaagatgaacctgctgagacagcagaacctgttctgcgacgtgagcatctacatcaacgacaccgagttccagggccacaaggtgatcctggccgcctgcagcaccttcatgagagaccagttcctgctgacccagagcaagcacgtgagaatcaccatcctgcagagcgccgaggtgggcagaaagctgctgctgagctgctacaccggcgccctggaggtgaagagaaaggagctgctgaagtacctgaccgccgccagctacctgcagatggtgcacatcgtggagaagtgcaccgaggccctgagcaagtacctggagatcgacctgagcatgaagaacaacaaccagcacaccgacctgtgccagagcagcgaccccgacgtgaagaacgaggacgagaacagcgacaaggactgcgagatcatcgagatcagcgaggacagccccgtgaacatcgacttccacgtgaaggaggaggagagcaacgccctgcagagcaccgtggagagcctgaccagcgagagaaaggagatgaagagccccgagctgagcaccgtggacatcggcttcaaggacaacgagatctgcatcctgcacgtggagagcatcagcaccgccggcgtggagaacggccagttcagccagccctgcaccagcagcaaggccagcatgtacttcagcgagacccagcacagcctgatcaacagcaccgtggagagcagagtggccgaggtgcccggcaaccaggaccagggcctgttctgcgagaacaccgagggcagctacggcaccgtgagcgagatccagaacctggaggagggctacagcctgagacaccagtgccccagatgccccagaggcttcctgcacgtggagaactacctgagacacctgaagatgcacaagctgttcctgtgcctgcagtgcggcaagaccttcacccagaagaagaacctgaacagacacatcagaggccacatgggcatcagacccttccagtgcaccgtgtgcctgaagaccttcaccgccaagagcaccctgcaggaccacctgaacatccacagcggcgacagaccctacaagtgccactgctgcgacatggacttcaagcacaagagcgccctgaagaagcacctgaccagcgtgcacggcagaagcagcggcgagaagctgagcagacccgacctgaagagacagagcctgctgtag

SEQ ID NO: 10132 - DNA, 1755 bp, Artificial Sequence
  Description of Artificial Sequence: Synthetic coding sequence
atggccggcggcgtggacggccccatcggcatccccttccccgaccacagcagcgacatcctgagcggcctgaacgagcagagaacccagggcctgctgtgcgacgtggtgatcctggtggagggcagagagttccccacccacagaagcgtgctggccgcctgcagccagtacttcaagaagctgttcaccagcggcgccgtggtggaccagcagaacgtgtacgagatcgacttcgtgagcgccgaggccctgaccgccctgatggacttcgcctacaccgccaccctgaccgtgagcaccgccaacgtgggcgacatcctgagcgccgccagactgctggagatccccgccgtgagccacgtgtgcgccgacctgctggacagacagatcctggccgccgacgccggcgccgacgccggccagctggacctggtggaccagatcgaccagagaaacctgctgagagccaaggagtacctggagttcttccagagcaaccccatgaacagcctgccccccgccgccgccgccgccgccgccagcttcccctggagcgccttcggcgccagcgacgacgacctggacgccaccaaggaggccgtggccgccgccgtggccgccgtggccgccggcgactgcaacggcctggacttctacggccccggcccccccgccgagagaccccccaccggcgacggcgacgagggcgacagcaaccccggcctgtggcccgagagagacgaggacgcccccaccggcggcctgttccccccccccgtggccccccccgccgccacccagaacggccactacggcagaggcggcgaggaggaggccgccagcctgagcgaggccgcccccgagcccggcgacagccccggcttcctgagcggcgccgccgagggcgaggacggcgacggccccgacgtggacggcctggccgccagcaccctgctgcagcagatgatgagcagcgtgggcagagccggcgccgccgccggcgacagcgacgaggagagcagagccgacgacaagggcgtgatggactactacctgaagtacttcagcggcgcccacgacggcgacgtgtaccccgcctggagccagaaggtggagaagaagatcagagccaaggccttccagaagtgccccatctgcgagaaggtgatccagggcgccggcaagctgcccagacacatcagaacccacaccggcgagaagccctacgagtgcaacatctgcaaggtgagattcaccagacaggacaagctgaaggtgcacatgagaaagcacaccggcgagaagccctacctgtgccagcagtgcggcgccgccttcgcccacaactacgacctgaagaaccacatgagagtgcacaccggcctgagaccctaccagtgcgacagctgctgcaagaccttcgtgagaagcgaccacctgcacagacacctgaagaaggacggctgcaacggcgtgcccagcagaagaggcagaaagcccagagtgagaggcggcgcccccgaccccagccccggcgccaccgccacccccggcgcccccgcccagcccagcagccccgacgccagaagaaacggccaggagaagcacttcaaggacgaggacgaggacgaggacgtggccagccccgacggcctgggcagactgaacgtggccggcgccggcggcggcggcgacagcggcggcggccccggcgccgccaccgacggcaacttcaccgccggcctggcctag

SEQ ID NO: 10133 - DNA, 1620 bp, Artificial Sequence
  Description of Artificial Sequence: Synthetic coding sequence
atgggcagccccgaggacgacctgatcggcatccccttccccgaccacagcagcgagctgctgagctgcctgaacgagcagagacagctgggccacctgtgcgacctgaccatcagaacccagggcctggagtacagaacccacagagccgtgctggccgcctgcagccactacttcaagaagctgttcaccgagggcggcggcggcgccgtgatgggcgccggcggcagcggcaccgccaccggcggcgccggcgccggcgtgtgcgagctggacttcgtgggccccgaggccctgggcgccctgctggagttcgcctacaccgccaccctgaccaccagcagcgccaacatgcccgccgtgctgcaggccgccagactgctggagatcccctgcgtgatcgccgcctgcatggagatcctgcagggcagcggcctggaggcccccagccccgacgaggacgactgcgagagagccagacagtacctggaggccttcgccaccgccaccgccagcggcgtgcccaacggcgaggacagccccccccaggtgcccctgccccccccccccccccccccccccagacccgtggccagaagaagcagaaagcccagaaaggccttcctgcagaccaagggcgccagagccaaccacctggtgcccgaggtgcccaccgtgcccgcccaccccctgacctacgaggaggaggaggtggccggcagagtgggcagcagcggcggcagcggccccggcgacagctacagcccccccaccggcaccgccagcccccccgagggcccccagagctacgagccctacgagggcgaggaggaggaggaggagctggtgtacccccccgcctacggcctggcccagggcggcggcccccccctgagccccgaggagctgggcagcgacgaggacgccatcgaccccgacctgatggcctacctgagcagcctgcaccaggacaacctggcccccggcctggacagccaggacaagctggtgagaaagagaagaagccagatgccccaggagtgccccgtgtgccacaagatcatccacggcgccggcaagctgcccagacacatgagaacccacaccggcgagaagcccttcgcctgcgaggtgtgcggcgtgagattcaccagaaacgacaagctgaagatccacatgagaaagcacaccggcgagagaccctacagctgcccccactgccccgccagattcctgcacagctacgacctgaagaaccacatgcacctgcacaccggcgacagaccctacgagtgccacctgtgccacaaggccttcgccaaggaggaccacctgcagagacacctgaagggccagaactgcctggaggtgagaaccagaagaagaagaaaggacgacgcccccccccactaccccccccccagcaccgccgccgccagccccgccggcctggacctgagcaacggccacctggacaccttcagactgagcctggccagattctgggagcagagcgcccccaccggcccccccgtgagcacccccggcccccccgacgacgacgaggaggagggcgcccccaccaccccccaggccgagggcgccatggagagcagctag

SEQ ID NO: 10134 - DNA, 1620 bp, Artificial Sequence; identical to SEQ ID NO: 10133
  Description of Artificial Sequence: Synthetic coding sequence

SEQ ID NO: 10135 - DNA, 1722 bp, Artificial Sequence
  Description of Artificial Sequence: Synthetic coding sequence
atgctgcagcccggcccccacccccccagcccccaggccgccgcccccggcgaggcctggcccggccccagccaggccccctggcagagcctggaggagaagatgggcagccccgaggacgacctgatcggcatccccttccccgaccacagcagcgagctgctgagctgcctgaacgagcagagacagctgggccacctgtgcgacctgaccatcagaacccagggcctggagtacagaacccacagagccgtgctggccgcctgcagccactacttcaagaagctgttcaccgagggcggcggcggcgccgtgatgggcgccggcggcagcggcaccgccaccggcggcgccggcgccggcgtgtgcgagctggacttcgtgggccccgaggccctgggcgccctgctggagttcgcctacaccgccaccctgaccaccagcagcgccaacatgcccgccgtgctgcaggccgccagactgctggagatcccctgcgtgatcgccgcctgcatggagatcctgcagggcagcggcctggaggcccccagccccgacgaggacgactgcgagagagccagacagtacctggaggccttcgccaccgccaccgccagcggcgtgcccaacggcgaggacagccccccccaggtgcccctgccccccccccccccccccccccccagacccgtggccagaagaagcagaaagcccagaaaggccttcctgcagaccaagggcgccagagccaaccacctggtgcccgaggtgcccaccgtgcccgcccaccccctgacctacgaggaggaggaggtggccggcagagtgggcagcagcggcggcagcggccccggcgacagctacagcccccccaccggcaccgccagcccccccgagggcccccagagctacgagccctacgagggcgaggaggaggaggaggagctggtgtacccccccgcctacggcctggcccagggcggcggcccccccctgagccccgaggagctgggcagcgacgaggacgccatcgaccccgacctgatggcctacctgagcagcctgcaccaggacaacctggcccccggcctggacagccaggacaagctggtgagaaagagaagaagccagatgccccaggagtgccccgtgtgccacaagatcatccacggcgccggcaagctgcccagacacatgagaacccacaccggcgagaagcccttcgcctgcgaggtgtgcggcgtgagattcaccagaaacgacaagctgaagatccacatgagaaagcacaccggcgagagaccctacagctgcccccactgccccgccagattcctgcacagctacgacctgaagaaccacatgcacctgcacaccggcgacagaccctacgagtgccacctgtgccacaaggccttcgccaaggaggaccacctgcagagacacctgaagggccagaactgcctggaggtgagaaccagaagaagaagaaaggacgacgcccccccccactaccccccccccagcaccgccgccgccagccccgccggcctggacctgagcaacggccacctggacaccttcagactgagcctggccagattctgggagcagagcgcccccaccggcccccccgtgagcacccccggcccccccgacgacgacgaggaggagggcgcccccaccaccccccaggccgagggcgccatggagagcagctag

SEQ ID NO: 10136 - DNA, 1620 bp, Artificial Sequence; identical to SEQ ID NO: 10133
  Description of Artificial Sequence: Synthetic coding sequence

SEQ ID NO: 10137 - DNA, 1023 bp, Artificial Sequence
  Description of Artificial Sequence: Synthetic coding sequence
atggagatcagcagccaccagagccacctgctgcagcagctgaacgagcagagaagacaggacgtgttctgcgactgcagcatcctggtggagggcaaggtgttcaaggcccacagaaacgtgctgttcgccagcagcggctacttcaagatgctgctgagccagaacagcaaggagaccagccagcccaccaccgccaccttccaggccttcagccccgacaccttcaccgtgatcctggacttcgtgtacagcggcaagctgagcctgaccggccagaacgtgatcgaggtgatgagcgccgccagcttcctgcagatgaccgacgtgatcagcgtgtgcaagaccttcatcaagagcagcctggacatcagcgagaaggagaaggacagatacttcagcctgagcgacaaggacgccaacagcaacggcgtggagagaagcagcttctacagcggcggctggcaggagggcagcagcagccccagaagccacctgagccccgagcagggcaccggcatcatcagcggcaagagctggaacaagtacaactaccaccccgccagccagaagaacacccagcagcccctggccaagcacgagcccagaaaggagagcatcaagaagaccaagcacctgagactgagccagcccagcgaggtgacccactacaagagcagcaagagagaggtgagaaccagcgacagcagcagccacgtgagccagagcgaggagcaggcccagatcgacgccgagatggacagcacccccgtgggctaccagtacggccagggcagcgacgtgaccagcaagagcttccccgacgacctgcccagaatgagattcaagtgcccctactgcacccacgtggtgaagagaaaggccgacctgaagagacacctgagatgccacaccggcgagagaccctacccctgccaggcctgcggcaagagattcagcagactggaccacctgagcagccacttcagaaccatggagatcagaatccccgacggcacctag

SEQ ID NO: 10138 - DNA, 1326 bp, Artificial Sequence
  Description of Artificial Sequence: Synthetic coding sequence
atggagatcagcagccaccagagccacctgctgcagcagctgaacgagcagagaagacaggacgtgttctgcgactgcagcatcctggtggagggcaaggtgttcaaggcccacagaaacgtgctgttcgccagcagcggctacttcaagatgctgctgagccagaacagcaaggagaccagccagcccaccaccgccaccttccaggccttcagccccgacaccttcaccgtgatcctggacttcgtgtacagcggcaagctgagcctgaccggccagaacgtgatcgaggtgatgagcgccgccagcttcctgcagatgaccgacgtgatcagcgtgtgcaagaccttcatcaagagcagcctggacatcagcgagaaggagaaggacagatacttcagcctgagcgacaaggacgccaacagcaacggcgtggagagaagcagcttctacagcggcggctggcaggagggcagcagcagccccagaagccacctgagccccgagcagggcaccggcatcatcagcggcaagagctggaacaagtacaactaccaccccgccagccagaagaacacccagcagcccctggccaagcacgagcccagaaaggagagcatcaagaagaccaagcacctgagactgagccagcccagcgaggtgacccactacaagagcagcaagagagaggtgagaaccagcgacagcagcagccacgtgagccagagcgaggagcaggcccagatcgacgccgagatggacagcacccccgtgggctaccagtacggccagggcagcgacgtgaccagcaagagcttccccgacgacctgcccagaatgagattcaagtgcccctactgcacccacgtggtgaagagaaaggccgacctgaagagacacctgagatgccacaccggcgagagaccctacccctgccaggcctgcggcaagagattcagcagactggaccacctgagcagccacttcagaaccatccaccaggcctgcaagctgatctgcagaaagtgcaagagacacgtgaccgacctgaccggccaggtggtgcaggagggcaccagaagatacagactgtgcaacgagtgcctggccgagttcggcatcgacagcctgcccatcgacctggaggccgagcagcacctgatgagccccagcgacggcgacaaggacagcagatggcacctgagcgaggacgagaacagaagctacgtggagatcgtggaggacggcagcggcgacctggtgatccagcaggtggacgacagcgaggaggaggaggagaaggagatcaagcccaacatcagatag

SEQ ID NO: 10139 - DNA, 1488 bp, Artificial Sequence
  Description of Artificial Sequence: Synthetic coding sequence
atggagatgcagagctactacgccaagctgctgggcgagctgaacgagcagagaaagagagacttcttctgcgactgcagcatcatcgtggagggcagaatcttcaaggcccacagaaacatcctgttcgccaacagcggctacttcagagccctgctgatccactacatccaggacagcggcagacacagcaccgccagcctggacatcgtgaccagcgacgccttcagcatcatcctggacttcctgtacagcggcaagctggacctgtgcggcgagaacgtgatcgaggtgatgagcgccgccagctacctgcagatgaacgacgtggtgaacttctgcaagacctacatcagaagcagcctggacatctgcagaaagatggagaaggaggccgccgtggccgccgccgtggccgccgccgccgccgccgccgccgccgccgccgccgccgccgcccaccaggtggacagcgagagccccagcagcggcagagagggcaccagctgcggcaccaagagcctggtgagcagccccgccgagggcgagaagagcgtggagtgcctgagagagagcccctgcggcgactgcggcgactgccaccccctggagctggtggtgagagacagcctgggcggcggcagcgccgacagcaacctgagcaccccccccaagagaatcgagcccaaggtggagttcgacgccgacgaggtggaggtggacgtgggcgagcagctgcagcagtacgccgcccccctgaacctggcccacgtggaggaggccctgcccagcggccaggccgtggacctggcctacagcaactaccacgtgaagcagttcctggaggccctgctgagaaacagcgccgcccccagcaaggacgacgccgaccaccacttcagcagaagcctggagggcagacccgagggcgccggcgtggccatgagcagcatgatggacgtgcaggccgactggtacggcgaggacagcggcgacgtgctggtggtgcccatcaagctgcacaagtgccccttctgcccctacaccgccaagcagaagggcatcctgaagagacacatcagaagccacaccggcgagagaccctacccctgcgagacctgcggcaagagattcaccagacaggagcacctgagaagccacgccctgagcgtgcacagaagcaacagacccatcatctgcaagggctgcagaagaaccttcaccagccacctgagccagggcctgagaagattcggcctgtgcgacagctgcacctgcgtgaccgacacccccgacgacgacgacgacctgatgcccatcaacctgagcctggtggaggccagcagcgagagccaggagaagagcgacaccgacaacgactggcccatctacgtggagagcggcgaggagaacgaccccgccggcgacgacagcgacgacaagccccagatccagcccaacctgagcgacagagagaccctgacctag

SEQ ID NO: 10140 - DNA, 1422 bp, Artificial Sequence
  Description of Artificial Sequence: Synthetic coding sequence
atggagacccccacccccctgccccccgtgcccgccagccccacctgcaaccccgcccccagaaccatccagatcgagttcccccagcacagcagcagcctgctggagagcctgaacagacacagactggagggcaagttctgcgacgtgagcctgctggtgcagggcagagagctgagagcccacaaggccgtgctggccgccgccagcccctacttccacgacaagctgctgctgggcgacgcccccagactgaccctgcccagcgtgatcgaggccgacgccttcgagggcctgctgcagctgatctacagcggcagactgagactgcccctggacgccctgcccgcccacctgctggtggccagcggcctgcagatgtggcaggtggtggaccagtgcagcgagatcctgagagagctggagaccagcggcggcggcatcagcgccagaggcggcaacagctaccacgccctgctgagcaccaccagcagcaccggcggctggtgcatcagaagcagccccttccagacccccgtgcagagcagcgccagcaccgagagccccgccagcaccgagagccccgtgggcggcgagggcagcgagctgggcgaggtgctgcagatccaggtggaggaggaggaggaggaggaggaggacgacgacgacgaggaccagggcagcgccaccctgagccagaccccccagccccagagagtgagcggcgtgttccccagaccccacggcccccaccccctgcccatgaccgccacccccagaaagctgcccgagggcgagagcgcccccctggagctgcccgccccccccgccctgccccccaagatcttctacatcaagcaggagcccttcgagcccaaggaggagatcagcggcagcggcacccagcccggcggcgccaaggaggagaccaaggtgttcagcggcggcgacaccgagggcaacggcgagctgggcttcctgctgcccagcggccccggccccaccagcggcggcggcggccccagctggaagcccgtggacctgcacggcaacgagatcctgagcggcggcggcggccccggcggcgccggccaggccgtgcacggccccgtgaagctgggcggcaccccccccgccgacggcaagagattcggctgcctgtgcggcaagagattcgccgtgaagcccaagagagacagacacatcatgctgaccttcagcctgagacccttcggctgcggcatctgcaacaagagattcaagctgaagcaccacctgaccgagcacatgaagacccacgccggcgccctgcacgcctgcccccactgcggcagaagattcagagtgcacgcctgcttcctgagacacagagacctgtgcaagggccagggctgggccaccgcccactggacctacaagtag

SEQ ID NO: 10141 - DNA, 1422 bp, Artificial Sequence; identical to SEQ ID NO: 10140
  Description of Artificial Sequence: Synthetic coding sequence

SEQ ID NO: 10142 - DNA, 1227 bp, Artificial Sequence
  Description of Artificial Sequence: Synthetic coding sequence
atgctgcccagacccaaggcccccgccagccccagaagaccccagacccccacccccagcgagcaggacgccgaccccggccccgccagccccagagacaccgaggcccagagactgagattcagacagttccagtaccacgtggccagcggcccccacctggccctgggccagctgtggaccctgtgcagacagtggctgagacccgaggccagaagcaaggagcagatgctggagctgctggtgctggagcagttcctgggcgccctgcccagcaagatgagaacctgggtgcagagccagggccccagaagctgcagagaggccgccagcctggtggaggacctgacccagatgtgccagcaggaggtgctggtgagcctggacagcgtggagccccaggactggagcttcggcgaggaggaggacggcaagagccccagaagccagaaggagcccagccaggccagcgagctgatcctggacgccgtggccgccgcccccgccctgcccgaggagagcgagtggctggagaccacccagctgcagcagagcctgcacaccagagccgaggccgaggcccccagagcccccggcctgctgggcagcagagccagactgcccctgaagcccagcatctgggacgagcccgaggacctgctggccggccccagcagcgacctgagagccgagggcaccgtgatcagcagccccaagggccccagcgcccagagaatcagccccagaagaagaaacagaaacaccgaccagagcggcagacaccagcccagcctgaagcacaccaagggcggcacccaggaggccgtggccggcatcagcgtggtgcccagaggccccagaggcggcagacccttccagtgcgccgactgcggcatggtgttcacctgggtgacccacttcatcgagcaccagaagacccacagagaggagggccccttcccctgccccgagtgcggcaaggtgttcctgcacaacagcgtgctgaccgagcacggcaagatccacctgctggagccccccagaaagaaggcccccagaagcaagggccccagagagagcgtgccccccagagacggcgcccagggccccgtggcccccagaagccccaagagacccttccagtgcagcgtgtgcggcaaggccttcccctggatggtgcacctgatcgaccaccagaagctgcacaccgcccacggccacatgtag

SEQ ID NO: 10143 - DNA, 537 bp, Artificial Sequence
  Description of Artificial Sequence: Synthetic coding sequence
atgctgcccagacccaaggcccccgccagccccagaagaccccagacccccacccccagcgagcaggacgccgaccccggccccgccagccccagagacaccgaggcccagagactgagattcagacagttccagtaccacgtggccagcggcccccacctggccctgggccagctgtggaccctgtgcagacagtggctgagacccgaggccagaagcaaggagcagatgctggagctgctggtgctggagcagttcctgggcgccctgcccagcaagatgagaacctgggtgcagagccagggccccagaagctgcagagaggccgccagcctggtggaggacctgacccagatgtgccagcaggagggcgagagaagaagactgcccgcccccggcagagccagaggccccgacgtgagcgaggacagaaccgccctgctgcccgcccacatcgcccccacccccgccagacccctgcccaccagcaagcccctgctgcccagaggctgcgtgttcaactacttctacatctag

SEQ ID NO: 10144 - DNA, 2178 bp, Artificial Sequence
  Description of Artificial Sequence: Synthetic coding sequence
atgggccccagagccagcctgagcagactgagagagctgtgcggccactggctgagacccgccctgcacaccaagaagcagatcctggagctgctggtgctggagcagttcctgagcgtgctgcccccccacctgctgggcagactgcagggccagcccctgagagacggcgaggaggtggtgctgctgctggagggcatccacagagagcccagccacgccggccccctggacttcagctgcaacgccggcaagagctgccccagagccgacgtgaccctggaggagaagggctgcgccagccaggtgcccagccacagccccaagaaggagctgcccgccgaggagcccagcgtgctgggccccagcgacgagccccccagaccccagcccagagccgcccagcccgccgagcccggccagtggagactgccccccagcagcaagcagcccctgagccccggcccccagaagaccttccaggccctgcaggagagcagcccccagggccccagcccctggcccgaggagagcagcagagaccaggagctggccgccgtgctggagtgcctgaccttcgaggacgtgcccgagaacaaggcctggcccgcccaccccctgggcttcggcagcagaacccccgacaaggaggagttcaagcaggaggagcccaagggcgccgcctggcccacccccatcctggccgagagccaggccgacagccccggcgtgcccggcgagccctgcgcccagagcctgggcagaggcgccgccgccagcggccccggcgaggacggcagcctgctgggcagcagcgagatcctggaggtgaaggtggccgagggcgtgcccgagcccaaccccgagctgcagttcatctgcgccgactgcggcgtgagcttcccccagctgagcagactgaaggcccaccagctgagaagccaccccgccggcagaagcttcctgtgcctgtgctgcggcaagagcttcggcagaagcagcatcctgaagctgcacatgagaacccacaccgacgagagaccccacgcctgccacctgtgcggccacagattcagacagagcagccacctgagcaagcacctgctgacccacagcagcgagcccgccttcctgtgcgccgagtgcggcagaggcttccagagaagagccagcctggtgcagcacctgctggcccacgcccaggaccagaagcccccctgcgcccccgagagcaaggccgaggccccccccctgaccgacgtgctgtgcagccactgcggccagagcttccagagaagaagcagcctgaagagacacctgagaatccacgccagagacaaggacagaagaagcagcgagggcagcggcagcagaagaagagacagcgacagaagacccttcgtgtgcagcgactgcggcaaggccttcagaagaagcgagcacctggtggcccacagaagagtgcacaccggcgagagacccttcagctgccaggcctgcggcagaagcttcacccagagcagccagctggtgagccaccagagagtgcacaccggcgagaagccctacgcctgcccccagtgcggcaagagattcgtgagaagagccagcctggccagacacctgctgacccacggcggccccagaccccaccactgcacccagtgcggcaagagcttcggccagacccaggacctggccagacaccagagaagccacaccggcgagaagccctgcagatgcagcgagtgcggcgagggcttcagccagagcgcccacctggccagacaccagagaatccacaccggcgagaagccccacgcctgcgacacctgcggccacagattcagaaacagcagcaacctggccagacacagaagaagccacaccggcgagagaccctacagctgccagacctgcggcagaagcttcagaagaaacgcccacctgagaagacacctggccacccacgccgagcccggccaggagcaggccgagcccccccaggagtgcgtggagtgcggcaagagcttcagcagaagctgcaacctgctgagacacctgctggtgcacaccggcgccagaccctacagctgcacccagtgcggcagaagcttcagcagaaacagccacctgctgagacacctgagaacccacgccagagagaccctgtactag

SEQ ID NO: 10145 - DNA, 1977 bp, Artificial Sequence
  Description of Artificial Sequence: Synthetic coding sequence
accagagtgcaggccgaggccagaggcggcagccccgccgtgcagatgctgcccgtgagcggcggccacggcgccaccggcgtgcccgagcccgcccccggcgccctgagacccctggccgccgccggcagcgcccaccaggagaccgaccccggcgccgccggcgccggcgccgtgcccgagtgcgccgccagcgccccccccggcccccccgccggcgccgccgcccagggctggggcggcggcggcgccgccgccagaggccacccccccggcgcccagcccagaggcgccgccggcccccagggccccagcccctggcccgaggagagcagcagagaccaggagctggccgccgtgctggagtgcctgaccttcgaggacgtgcccgagaacaaggcctggcccgcccaccccctgggcttcggcagcagaacccccgacaaggaggagttcaagcaggaggagcccaagggcgccgcctggcccacccccatcctggccgagagccaggccgacagccccggcgtgcccggcgagccctgcgcccagagcctgggcagaggcgccgccgccagcggccccggcgaggacggcagcctgctgggcagcagcgagatcctggaggtgaaggtggccgagggcgtgcccgagcccaaccccgagctgcagttcatctgcgccgactgcggcgtgagcttcccccagctgagcagactgaaggcccaccagctgagaagccaccccgccggcagaagcttcctgtgcctgtgctgcggcaagagcttcggcagaagcagcatcctgaagctgcacatgagaacccacaccgacgagagaccccacgcctgccacctgtgcggccacagattcagacagagcagccacctgagcaagcacctgctgacccacagcagcgagcccgccttcctgtgcgccgagtgcggcagaggcttccagagaagagccagcctggtgcagcacctgctggcccacgcccaggaccagaagcccccctgcgcccccgagagcaaggccgaggccccccccctgaccgacgtgctgtgcagccactgcggccagagcttccagagaagaagcagcctgaagagacacctgagaatccacgccagagacaaggacagaagaagcagcgagggcagcggcagcagaagaagagacagcgacagaagacccttcgtgtgcagcgactgcggcaaggccttcagaagaagcgagcacctggtggcccacagaagagtgcacaccggcgagagacccttcagctgccaggcctgcggcagaagcttcacccagagcagccagctggtgagccaccagagagtgcacaccggcgagaagccctacgcctgcccccagtgcggcaagagattcgtgagaagagccagcctggccagacacctgctgacccacggcggccccagaccccaccactgcacccagtgcggcaagagcttcggccagacccaggacctggccagacaccagagaagccacaccggcgagaagccctgcagatgcagcgagtgcggcgagggcttcagccagagcgcccacctggccagacaccagagaatccacaccggcgagaagccccacgcctgcgacacctgcggccacagattcagaaacagcagcaacctggccagacacagaagaagccacaccggcgagagaccctacagctgccagacctgcggcagaagcttcagaagaaacgcccacctgagaagacacctggccacccacgccgagcccggccaggagcaggccgagcccccccaggagtgcgtggagtgcggcaagagcttcagcagaagctgcaacctgctgagacacctgctggtgcacaccggcgccagaccctacagctgcacccagtgcggcagaagcttcagcagaaacagccacctgctgagacacctgagaacccacgccagagagaccctgtactag

SEQ ID NO: 10146 - DNA, 1047 bp, Artificial Sequence
  Description of Artificial Sequence: Synthetic coding sequence
atgaccaccgccctggagcccgaggaccagaagggcctgctgatcatcaaggccgaggaccactactggggccaggacagcagcagccagaagtgcagcccccacagaagagagctgtacagacagcacttcagaaagctgtgctaccaggacgcccccggccccagagaggccctgacccagctgtgggagctgtgcagacagtggctgagacccgagtgccacaccaaggagcagatcctggacctgctggtgctggagcagttcctgagcatcctgcccaaggacctgcaggcctgggtgagagcccaccaccccgagaccggcgaggaggccgtgaccgtgctggaggacctggagagagagctggacgagcccggcaagcaggtgcccggcaacagcgagagaagagacatcctgatggacaagctggcccccctgggcagaccctacgagagcctgaccgtgcagctgcaccccaagaagacccagctggagcaggaggccggcaagccccagagaaacggcgacaagaccagaaccaagaacgaggagctgttccagaaggaggacatgcccaaggacaaggagttcctgggcgagatcaacgacagactgaacaaggacaccccccagcaccccaagagcaaggacatcatcgagaacgagggcagaagcgagtggcagcagagagagagaagaagatacaagtgcgacgagtgcggcaagagcttcagccacagcagcgacctgagcaagcacagaagaacccacaccggcgagaagccctacaagtgcgacgagtgcggcaaggccttcatccagagaagccacctgatcggccaccacagagtgcacaccggcgtgaagccctacaagtgcaaggagtgcggcaaggacttcagcggcagaaccggcctgatccagcaccagagaatccacaccggcgagaagccctacgagtgcgacgagtgcggcagacccttcagagtgagcagcgccctgatcagacaccagagaatccacaccgccaacaagctgtactag

SEQ ID NO: 10147 - DNA, 1533 bp, Artificial Sequence
  Description of Artificial Sequence: Synthetic coding sequence
atgctgcccctggagaaggccttcgccagccccagaagcagccccgccccccccgacctgcccacccccggcagcgccgccggcgtgcagcaggaggagcccgagaccatccccgagagaacccccgccgacctggagttcagcagactgagattcagagagttcgtgtaccaggaggccgccggcccccaccagaccctggccagactgcacgagctgtgcagacagtggctgatgcccgaggccagaagcaaggagcagatgctggagctgctggtgctggagcagttcctgggcatcctgcccgacaaggtgagaccctgggtggtggcccagtaccccgagagctgcaagaaggccgccagcctggtggagggcctggccgacgtgctggaggagcccggcatgctgctgggcagccccgccggcagcagcagcatcctgagcgacggcgtgtacgagagacacatggaccccctgctgctgcccggcgagctggccagccccagccaggccctgggcgccggcgagatccccgcccccagcgagaccccctggctgagccccgaccccctgttcctggagcagagaagagtgagagaggccaagaccgaggaggacggccccgccaacaccgagcagaagctgaagagcttccccgaggacccccagcacctgggcgagtggggccacctggaccccgccgaggagaacctgaagagctacagaaagctgctgctgtggggctaccagctgagccagcccgacgccgccagcagactggacaccgaggagctgagactggtggagagagacccccagggcagcagcctgcccgagggcggcagaagacaggagagcgccggctgcgcctgcgaggaggccgcccccgccggcgtgctgcccgagctgcccaccgaggccccccccggcgacgccctggccgacccccccagcggcaccaccgaggaggaggaggagcagcccggcaaggcccccgacccccaggacccccaggacgccgagagcgacagcgccaccggcagccagagacagagcgtgatccagcagcccgcccccgacagaggcaccgccaagctgggcaccaagagaccccaccccgaggacggcgacggccagagcctggagggcgtgagcagcagcggcgacagcgccggcctggaggccggccagggccccggcgccgacgagcccggcctgagcagaggcaagccctacgcctgcggcgagtgcggcgaggccttcgcctggctgagccacctgatggagcaccacagcagccacggcggcagaaagagatacgcctgccagggctgctggaagaccttccacttcagcctggccctggccgagcaccagaagacccacgagaaggagaagagctacgccctgggcggcgccagaggcccccagcccagcaccagagaggcccaggccggcgccagagccggcggcccccccgagagcgtggagggcgaggccccccccgccccccccgaggcccagagatag

SEQ ID NO: 10148 - DNA, 1125 bp, Artificial Sequence
  Description of Artificial Sequence: Synthetic coding sequence
atgctgctgggcagccccgccggcagcagcagcatcctgagcgacggcgtgtacgagagacacatggaccccctgctgctgcccggcgagctggccagccccagccaggccctgggcgccggcgagatccccgcccccagcgagaccccctggctgagccccgaccccctgttcctggagcagagaagagtgagagaggccaagaccgaggaggacggccccgccaacaccgagcagaagctgaagagcttccccgaggacccccagcacctgggcgagtggggccacctggaccccgccgaggagaacctgaagagctacagaaagctgctgctgtggggctaccagctgagccagcccgacgccgccagcagactggacaccgaggagctgagactggtggagagagacccccagggcagcagcctgcccggcggcagaagacaggagagcgccggctgcgcctgcgaggaggccgcccccgccggcgtgctgcccgagctgcccaccgaggccccccccggcgacgccctggccgacccccccagcggcaccaccgaggaggaggaggagcagcccggcaaggcccccgacccccaggacccccaggacgccgagagcgacagcgccaccggcagccagagacagagcgtgatccagcagcccgcccccgacagaggcaccgccaagctgggcaccaagagaccccaccccgaggacggcgacggccagagcctggagggcgtgagcagcagcggcgacagcgccggcctggaggccggccagggccccggcgccgacgagcccggcctgagcagaggcaagccctacgcctgcggcgagtgcggcgaggccttcgcctggctgagccacctgatggagcaccacagcagccacggcggcagaaagagatacgcctgccagggctgctggaagaccttccacttcagcctggccctggccgagcaccagaagacccacgagaaggagaagagctacgccctgggcggcgccagaggcccccagcccagcaccagagaggcccaggccggcgccagagccggcggcccccccgagagcgtggagggcgaggccccccccgccccccccgaggcccagagatag

SEQ ID NO: 10149 - DNA, 1701 bp, Artificial Sequence
  Description of Artificial Sequence: Synthetic coding sequence
atgagaagagtgggcggcagagccgacgaggacgccaccgccgccggcagcctgtgggtgctggccccccccgagcccaccggccacctggtgatccccggcaccagccccctggagcccccctgcccctggctggacagccacatcttccagtgcagattcggcaagatgctgcccctggagaaggccttcgccagccccagaagcagccccgccccccccgacctgcccacccccggcagcgccgccggcgtgcagcaggaggagcccgagaccatccccgagagaacccccgccgacctggagttcagcagactgagattcagagagttcgtgtaccaggaggccgccggcccccaccagaccctggccagactgcacgagctgtgcagacagtggctgatgcccgaggccagaagcaaggagcagatgctggagctgctggtgctggagcagttcctgggcatcctgcccgacaaggtgagaccctgggtggtggcccagtaccccgagagctgcaagaaggccgccagcctggtggagggcctggccgacgtgctggaggagcccggcatgctgctgggcagccccgccggcagcagcagcatcctgagcgacggcgtgtacgagagacacatggaccccctgctgctgcccggcgagctggccagccccagccaggccctgggcgccggcgagatccccgcccccagcgagaccccctggctgagccccgaccccctgttcctggagcagagaagagtgagagaggccaagaccgaggaggacggccccgccaacaccgagcagaagctgaagagcttccccgaggacccccagcacctgggcgagtggggccacctggaccccgccgaggagaacctgaagagctacagaaagctgctgctgtggggctaccagctgagccagcccgacgccgccagcagactggacaccgaggagctgagactggtggagagagacccccagggcagcagcctgcccgagggcggcagaagacaggagagcgccggctgcgcctgcgaggaggccgcccccgccggcgtgctgcccgagctgcccaccgaggccccccccggcgacgccctggccgacccccccagcggcaccaccgaggaggaggaggagcagcccggcaaggcccccgacccccaggacccccaggacgccgagagcgacagcgccaccggcagccagagacagagcgtgatccagcagcccgcccccgacagaggcaccgccaagctgggcaccaagagaccccaccccgaggacggcgacggccagagcctggagggcgtgagcagcagcggcgacagcgccggcctggaggccggccagggccccggcgccgacgagcccggcctgagcagaggcaagccctacgcctgcggcgagtgcggcgaggccttcgcctggctgagccacctgatggagcaccacagcagccacggcggcagaaagagatacgcctgccagggctgctggaagaccttccacttcagcctggccctggccgagcaccagaagacccacgagaaggagaagagctacgccctgggcggcgccagaggcccccagcccagcaccagagaggcccaggccggcgccagagccggcggcccccccgagagcgtggagggcgaggccccccccgccccccccgaggcccagagatag

SEQ ID NO: 10150 - DNA, 1701 bp, Artificial Sequence; identical to SEQ ID NO: 10149
  Description of Artificial Sequence: Synthetic coding sequence

SEQ ID NO: 10151 - DNA, 453 bp, Artificial Sequence
  Description of Artificial Sequence: Synthetic coding sequence
atgatggccgccgacatccccagagtgaccacccccctgagcagcctggtgcaggtgccccaggaggaggacagacaggaggaggaggtgaccaccatgatcctggaggacgacagctgggtgcaggaggccgtgctgcaggaggacggccccgagagcgagcccttcccccagagcgccggcaagggcggcccccaggaggaggtgaccagaggcccccagggcgccctgggcagactgagagagctgtgcagaagatggctgagacccgaggtgcacaccaaggagcagatgctgaccatgctgcccaaggagatccaggcctggctgcaggagcacagacccgagagcagcgaggaggccgccgccctggtggaggacctgacccagaccctgcaggacagcgccgtggccgtggtggccagcctgcccgtggaggtgaccagcctgtag

SEQ ID NO: 10152 - DNA, 1788 bp, Artificial Sequence
  Description of Artificial Sequence: Synthetic coding sequence
atgatggccgccgacatccccagagtgaccacccccctgagcagcctggtgcaggtgccccaggaggaggacagacaggaggaggaggtgaccaccatgatcctggaggacgacagctgggtgcaggaggccgtgctgcaggaggaggtgaccagaggcccccagggcgccctgggcagactgagagagctgtgcagaagatggctgagacccgaggtgcacaccaaggagcagatgctgaccatgctgcccaaggagatccaggcctggctgcaggagcacagacccgagagcagcgaggaggccgccgccctggtggaggacctgacccagaccctgcaggacagcgacttcgagatccagagcgagaacggcgagaactgcaaccaggacatgttcgagaacgagagcagaaagatcttcagcgagatgcccgagggcgagagcgcccagcacagcgacggcgagagcgacttcgagagagacgccggcatccagagactgcagggccacagccccggcgaggaccacggcgaggtggtgagccaggacagagaggtgggccagctgatcggcctgcagggcacctacctgggcgagaagccctacgagtgcccccagtgcggcaagaccttcagcagaaagagccacctgatcacccacgagagaacccacaccggcgagaagtactacaagtgcgacgagtgcggcaagagcttcagcgacggcagcaacttcagcagacaccagaccacccacaccggcgagaagccctacaagtgcagagactgcggcaagagcttcagcagaagcgccaacctgatcacccaccagagaatccacaccggcgagaagcccttccagtgcgccgagtgcggcaagagcttcagcagaagccccaacctgatcgcccaccagagaacccacaccggcgagaagccctacagctgccccgagtgcggcaagagcttcggcaacagaagcagcctgaacacccaccagggcatccacaccggcgagaagccctacgagtgcaaggagtgcggcgagagcttcagctacaacagcaacctgatcagacaccagagaatccacaccggcgagaagccctacaagtgcaccgactgcggccagagattcagccagagcagcgccctgatcacccacagaagaacccacaccggcgagaagccctaccagtgcagcgagtgcggcaagagcttcagcagaagcagcaacctggccacccacagaagaacccacatggtggagaagccctacaagtgcggcgtgtgcggcaagagcttcagccagagcagcagcctgatcgcccaccagggcatgcacaccggcgagaagccctacgagtgcctgacctgcggcgagagcttcagctggagcagcaacctgctgaagcaccagagaatccacaccggcgagaagccctacaagtgcagcgagtgcggcaagtgcttcagccagagaagccagctggtggtgcaccagagaacccacaccggcgagaagccctacaagtgcctgatgtgcggcaagagcttcagcagaggcagcatcctggtgatgcaccagagagcccacctgggcgacaagccctacagatgccccgagtgcggcaagggcttcagctggaacagcgtgctgatcatccaccagagaatccacaccggcgagaagccctacaagtgccccgagtgcggcaagggcttcagcaacagcagcaacttcatcacccaccagagaacccacatgaaggagaagctgtactag

SEQ ID NO: 10153 - DNA, 441 bp, Artificial Sequence
  Description of Artificial Sequence: Synthetic coding sequence
atgatggccgccgacatccccagagtgaccacccccctgagcagcctggtgcaggtgccccaggaggaggacagacaggaggaggaggtgaccaccatgatcctggaggacgacagctgggtgcaggaggccgtgctgcaggaggacggccccgagagcgagcccttcccccagagcgccggcaagggcggcccccaggaggaggtgaccagaggcccccagggcgccctgggcagactgagagagctgtgcagaagatggctgagacccgaggtgcacaccaaggagcagatgctgaccatgctgcccaaggagatccaggcctggctgcaggagcacagacccgagagcagcgaggaggccgccgccctggtggaggacctgacccagaccctgcaggacagcgagaccgccagctgcgtgcacggctgccccgtgtag

SEQ ID NO: 10154 - DNA, 99 bp, Artificial Sequence
  Description of Artificial Sequence: Synthetic coding sequence
atgatggccgccgacatccccagagtgaccacccccctgagcagcctggtgcaggtgccccaggaggaggacagacaggaggaggaggtgaccacctag

SEQ ID NO: 10155 - DNA, 1845 bp, Artificial Sequence
  Description of Artificial Sequence: Synthetic coding sequence
atgatggccgccgacatccccagagtgaccacccccctgagcagcctggtgcaggtgccccaggaggaggacagacaggaggaggaggtgaccaccatgatcctggaggacgacagctgggtgcaggaggccgtgctgcaggaggacggccccgagagcgagcccttcccccagagcgccggcaagggcggcccccaggaggaggtgaccagaggcccccagggcgccctgggcagactgagagagctgtgcagaagatggctgagacccgaggtgcacaccaaggagcagatgctgaccatgctgcccaaggagatccaggcctggctgcaggagcacagacccgagagcagcgaggaggccgccgccctggtggaggacctgacccagaccctgcaggacagcgacttcgagatccagagcgagaacggcgagaactgcaaccaggacatgttcgagaacgagagcagaaagatcttcagcgagatgcccgagggcgagagcgcccagcacagcgacggcgagagcgacttcgagagagacgccggcatccagagactgcagggccacagccccggcgaggaccacggcgaggtggtgagccaggacagagaggtgggccagctgatcggcctgcagggcacctacctgggcgagaagccctacgagtgcccccagtgcggcaagaccttcagcagaaagagccacctgatcacccacgagagaacccacaccggcgagaagtactacaagtgcgacgagtgcggcaagagcttcagcgacggcagcaacttcagcagacaccagaccacccacaccggcgagaagccctacaagtgcagagactgcggcaagagcttcagcagaagcgccaacctgatcacccaccagagaatccacaccggcgagaagcccttccagtgcgccgagtgcggcaagagcttcagcagaagccccaacctgatcgcccaccagagaacccacaccggcgagaagccctacagctgccccgagtgcggcaagagcttcggcaacagaagcagcctgaacacccaccagggcatccacaccggcgagaagccctacgagtgcaaggagtgcggcgagagcttcagctacaacagcaacctgatcagacaccagagaatccacaccggcgagaagccctacaagtgcaccgactgcggccagagattcagccagagcagcgccctgatcacccacagaagaacccacaccggcgagaagccctaccagtgcagcgagtgcggcaagagcttcagcagaagcagcaacctggccacccacagaagaacccacatggtggagaagccctacaagtgcggcgtgtgcggcaagagcttcagccagagcagcagcctgatcgcccaccagggcatgcacaccggcgagaagccctacgagtgcctgacctgcggcgagagcttcagctggagcagcaacctgctgaagcaccagagaatccacaccggcgagaagccctacaagtgcagcgagtgcggcaagtgcttcagccagagaagccagctggtggtgcaccagagaacccacaccggcgagaagccctacaagtgcctgatgtgcggcaagagcttcagcagaggcagcatcctggtgatgcaccagagagcccacctgggcgacaagccctacagatgccccgagtgcggcaagggcttcagctggaacagcgtgctgatcatccaccagagaatccacaccggcgagaagccctacaagtgccccgagtgcggcaagggcttcagcaacagcagcaacttcatcacccaccagagaacccacatgaaggagaagctgtactag

SEQ ID NO: 10156 - DNA, 84 bp, Artificial Sequence
  Description of Artificial Sequence: Synthetic coding sequence
atgatggccgccgacatccccagagtgaccacccccctgagcagcctggtgcaggtgccccaggaggaggacagacaggagtag

SEQ ID NO: 10157 - DNA, 1845 bp, Artificial Sequence; identical to SEQ ID NO: 10155
  Description of Artificial Sequence: Synthetic coding sequence

SEQ ID NO: 10158 - DNA, 1845 bp, Artificial Sequence; identical to SEQ ID NO: 10155
  Description of Artificial Sequence: Synthetic coding sequence

SEQ ID NO: 10159 - DNA, 162 bp, Artificial Sequence
  Description of Artificial Sequence: Synthetic coding sequence
atgatggccgccgacatccccagagtgaccacccccctgagcagcctggtgcaggtgccccaggaggaggacagacaggaggaggaggtgaccaccatgatcctggaggacgacagctgggtgcaggaggccgtgctgcaggaggacggccccgagagctag

SEQ ID NO: 10160 - DNA, 1422 bp, Artificial Sequence
  Description of Artificial Sequence: Synthetic coding sequence
atgatgaccaaggtgctgggcatggcccccgtgctgggccccagacccccccaggagcaggtgggccccctgatggtgaaggtggaggagaaggaggagaagggcaagtacctgcccagcctggagatgttcagacagagattcagacagttcggctaccacgacacccccggccccagagaggccctgagccagctgagagtgctgtgctgcgagtggctgagacccgagatccacaccaaggagcagatcctggagctgctggtgctggagcagttcctgaccatcctgccccaggagctgcaggcctgggtgcaggagcactgccccgagagcgccgaggaggccgtgaccctgctggaggacctggagagagagctggacgagcccggccaccaggtgagcaccccccccaacgagcagaagcccgtgtgggagaagatcagcagcagcggcaccgccaaggagagccccagcagcatgcagccccagcccctggagaccagccacaagtacgagagctggggccccctgtacatccaggagagcggcgaggagcaggagttcgcccaggaccccagaaaggtgagagactgcagactgagcacccagcacgaggagagcgccgacgagcagaagggcagcgaggccgagggcctgaagggcgacatcatcagcgtgatcatcgccaacaagcccgaggccagcctggagagacagtgcgtgaacctggagaacgagaagggcaccaagccccccctgcaggaggccggcagcaagaagggcagagagagcgtgcccaccaagcccacccccggcgagagaagatacatctgcgccgagtgcggcaaggccttcagcaacagcagcaacctgaccaagcacagaagaacccacaccggcgagaagccctacgtgtgcaccaagtgcggcaaggccttcagccacagcagcaacctgaccctgcactacagaacccacctggtggacagaccctacgactgcaagtgcggcaaggccttcggccagagcagcgacctgctgaagcaccagagaatgcacaccgaggaggccccctaccagtgcaaggactgcggcaaggccttcagcggcaagggcagcctgatcagacactacagaatccacaccggcgagaagccctaccagtgcaacgagtgcggcaagagcttcagccagcacgccggcctgagcagccaccagagactgcacaccggcgagaagccctacaagtgcaaggagtgcggcaaggccttcaaccacagcagcaacttcaacaagcaccacagaatccacaccggcgagaagccctactggtgccaccactgcggcaagaccttctgcagcaagagcaacctgagcaagcaccagagagtgcacaccggcgagggcgaggccccctag

SEQ ID NO: 10161 - DNA, 1347 bp, Artificial Sequence
  Description of Artificial Sequence: Synthetic coding sequence
atgatgaccaaggtgctgggcatggcccccgtgctgggccccagacccccccaggagcaggtgggccccctgatggtgaaggtggaggagaaggaggagaagggcaagtacctgcccagcctggagatgttcagacagagattcagacagttcggctaccacgacacccccggccccagagaggccctgagccagctgagagtgctgtgctgcgagtggctgagacccgagatccacaccaaggagcactgccccgagagcgccgaggaggccgtgaccctgctggaggacctggagagagagctggacgagcccggccaccaggtgagcaccccccccaacgagcagaagcccgtgtgggagaagatcagcagcagcggcaccgccaaggagagccccagcagcatgcagccccagcccctggagaccagccacaagtacgagagctggggccccctgtacatccaggagagcggcgaggagcaggagttcgcccaggaccccagaaaggtgagagactgcagactgagcacccagcacgaggagagcgccgacgagcagaagggcagcgaggccgagggcctgaagggcgacatcatcagcgtgatcatcgccaacaagcccgaggccagcctggagagacagtgcgtgaacctggagaacgagaagggcaccaagccccccctgcaggaggccggcagcaagaagggcagagagagcgtgcccaccaagcccacccccggcgagagaagatacatctgcgccgagtgcggcaaggccttcagcaacagcagcaacctgaccaagcacagaagaacccacaccggcgagaagccctacgtgtgcaccaagtgcggcaaggccttcagccacagcagcaacctgaccctgcactacagaacccacctggtggacagaccctacgactgcaagtgcggcaaggccttcggccagagcagcgacctgctgaagcaccagagaatgcacaccgaggaggccccctaccagtgcaaggactgcggcaaggccttcagcggcaagggcagcctgatcagacactacagaatccacaccggcgagaagccctaccagtgcaacgagtgcggcaagagcttcagccagcacgccggcctgagcagccaccagagactgcacaccggcgagaagccctacaagtgcaaggagtgcggcaaggccttcaaccacagcagcaacttcaacaagcaccacagaatccacaccggcgagaagccctactggtgccaccactgcggcaagaccttctgcagcaagagcaacctgagcaagcaccagagagtgcacaccggcgagggcgaggccccctag

SEQ ID NO: 10162 - DNA, 546 bp, Artificial Sequence
  Description of Artificial Sequence: Synthetic coding sequence
atgatgaccaaggtgctgggcatggcccccgtgctgggccccagacccccccaggagcaggtgggccccctgatggtgaaggtggaggagaaggaggagaagggcaagtacctgcccagcctggagatgttcagacagagattcagacagttcggctaccacgacacccccggccccagagaggccctgagccagctgagagtgctgtgctgcgagtggctgagacccgagatccacaccaaggagcagatcctggagctgctggtgctggagcagttcctgaccatcctgccccaggagctgcaggcctgggtgcaggagcactgccccgagagcgccgaggaggccgtgaccctgctggaggacctggagagagagctggacgagcccggccaccaggtgagcaccccccccaacgagcagaagcccgtgtgggagaagatcagcagcagcggcaccgccaaggagagccccagcagcatgcagccccagcccctggagaccagccacaagtacgagagctggggccccctgtacatccagtag

SEQ ID NO: 10163 - DNA, 1353 bp, Artificial Sequence
  Description of Artificial Sequence: Synthetic coding sequence
atgatgaccaaggtgctgggcatggcccccgtgctgggccccagacccccccaggagcaggtgggccccctgatggtgaaggtggaggagaaggaggagaagggcaagtacctgcccagcctggagatgttcagacagagattcagacagttcggctaccacgacacccccggccccagagaggccctgagccagctgagagtgctgtgctgcgagtggctgagacccgagatccacaccaaggagcagatcctggagctgctggtgctggagcagttcctgaccatcctgccccaggagctgcaggcctgggtgcaggagcactgccccgagagcgccgaggaggccgtgaccctgctggaggacctggagagagagctggacgagcccggccaccaggtgagcaccccccccaacgagcagaagcccgtgtgggagaagatcagcagcagcggcaccgccaaggagagccccagcagcatgcagccccagcccctggagaccagccacaagtacgagagctggggccccctgtacatccaggagagcggcgaggagcaggagttcgcccaggaccccagaaaggtgagagactgcagactgagcacccagcacgaggagagcgccgacgagcagaagggcagcgaggccgagggcctgaagggcgacatcatcagcgtgatcatcgccaacaagcccgaggccagcctggagagacagtgcgtgaacctggagaacgagaagggcaccaagccccccctgcaggaggccggcagcaagaagggcgagcacaccctgggcagaaacctgacctgcgcccccagcgtgggcaagctgagcgccaccgcccagaccagccccagcaccaccgagcacacctggtggaccggccccatgaccgtgagcgtggagaagctgctgggcagagcccagaccttcctgaacatcagagagtgcacccagaagagaagacacatcagcgccaagatcgtggccagactgagcgccggcaaggccgccagcttcgtgaccatcggcagcaccctgggcagaagcctgatcagcgtgaccaacgtgggcagagccagcgtgagcatgagagccagcgcccccaccagagacagcacccccgagagaagccacatcagcgtgagaagcgtgggcaagcccagcaccaccgcccccaccagcatcaacaccaccgagagcacccccggcaagagccccaccggcgtgatcaccgtggagagacccagcgtggccagccccatcttccccaacatcagcgagagcaccctggagagagagaagcacagaaacttccaggccctgctgctgctgagcctgttctag

SEQ ID NO: 10164 - DNA, 1170 bp, Artificial Sequence
  Description of Artificial Sequence: Synthetic coding sequence
atggccatcaccctgaccctgcagaccgccgagatgcaggagggcctgctggccgtgaaggtgaaggaggaggaggaggagcacagctgcggccccgagagcggcctgagcagaaacaacccccacaccagagagatcttcagaagaagattcagacagttctgctaccaggagagccccggccccagagaggccctgcagagactgcaggagctgtgccaccagtggctgagacccgagatgcacaccaaggagcagatcctggagctgctggtgctggagcagttcctgaccatcctgcccgaggagctgcaggcctgggtgagacagcacagacccgtgagcggcgaggaggccgtgaccgtgctggaggacctggagagagagctggacgaccccggcgagcaggtgctgagccacgcccacgagcaggaggagttcgtgaaggagaaggccacccccggcgccgcccaggagagcagcaacgaccagttccagaccctggaggagcagctgggctacaacctgagagaggtgtgccccgtgcaggagatcgacggcaaggccggcacctggaacgtggagctggcccccaagagagagatcagccaggaggtgaagagcctgatccaggtgctgggcaagcagaacggcaacatcacccagatccccgagtacggcgacacctgcgacagagagggcagactggagaagcagagagtgagcagcagcgtggagagaccctacatctgcagcgagtgcggcaagagcttcacccagaacagcatcctgatcgagcaccagagaacccacaccggcgagaagccctacgagtgcgacgagtgcggcagagccttcagccagagaagcggcctgttccagcaccagagactgcacaccggcgagaagagataccagtgcagcgtgtgcggcaaggccttcagccagaacgccggcctgttccaccacctgagaatccacaccggcgagaagccctaccagtgcaaccagtgcaacaagagcttcagcagaagaagcgtgctgatcaagcaccagagaatccacaccggcgagagaccctacgagtgcgaggagtgcggcaagaacttcatctaccactgcaacctgatccagcacagaaaggtgcaccccgtggccgagagcagctag

SEQ ID NO: 10165 - DNA, 1392 bp, Artificial Sequence
  Description of Artificial Sequence: Synthetic coding sequence
atgatggccaagagcgccctgagagagaacggcaccaacagcgagaccttcagacagagattcagaagattccactaccaggaggtggccggccccagagaggccttcagccagctgtgggagctgtgctgcagatggctgagacccgaggtgagaaccaaggagcagatcgtggagctgctggtgctggagcagttcctgaccgtgctgcccggcgagatccagaactgggtgcaggagcagtgccccgagaacggcgaggaggccgtgaccctggtggaggacctggagagagagcccggcagacccagaagcagcgtgaccgtgagcgtgaagggccaggaggtgagactggagaagatgaccccccccaagagcagccaggagctgctgagcgtgagacaggagagcgtggagccccagcccagaggcgtgcccaagaaggagagagccagaagccccgacctgggcccccaggagcagatgaaccccaaggagaagctgaagcccttccagagaagcggcttcgaggccggcttcgagaacgaggacaacagcaagagagacatcagcgaggaggtgcagctgcacagaaccctgctggccagaagcgagagaaagatccccagatacctgcaccagggcaagggcaacgagagcgactgcagaagcggcagacagtgggccaagaccagcggcgagaagagaggcaagctgaccctgcccgagaagagcctgagcgaggtgctgagccagcagagaccctgcctgggcgagagaccctacaagtacctgaagtacagcaagagcttcggccccaacagcctgctgatgcaccaggtgagccaccaggtggagaacccctacaagtgcgccgactgcggcaagagcttcagcagaagcgccagactgatcagacacagaagaatccacaccggcgagaagccctacaagtgcctggactgcggcaagagcttcagagacagcagcaacttcatcacccacagaagaatccacaccggcgagaagccctaccagtgcggcgagtgcggcaagtgcttcaaccagagcagcagcctgatcatccaccagagaacccacaccggcgagaagccctaccagtgcgaggagtgcggcaagagcttcaacaacagcagccacttcagcgcccacagaagaatccacaccggcgagagaccccacgtgtgccccgactgcggcaagagcttcagcaagagcagcgacctgagagcccaccacagaacccacaccggcgagaagccctacggctgccacgactgcggcaagtgcttcagcaagagcagcgccctgaacaagcacggcgagatccacgccagagagaagctgctgacccagagcgcccccaagtag

SEQ ID NO: 10166 - DNA, 2559 bp, Artificial Sequence
  Description of Artificial Sequence: Synthetic coding sequence
atgatggccaagagcgccctgagagagaacggcaccaacagcgagaccttcagacagagattcagaagattccactaccaggaggtggccggccccagagaggccttcagccagctgtgggagctgtgctgcagatggctgagacccgaggtgagaaccaaggagcagatcgtggagctgctggtgctggagcagttcctgaccgtgctgcccggcgagatccagaactgggtgcaggagcagtgccccgagaacggcgaggaggccgtgaccctggtggaggacctggagagagagcccggcagacccagaagcagcgtgaccgtgagcgtgaagggccaggaggtgagactggagaagatgaccccccccaagagcagccaggagctgctgagcgtgagacaggagagcgtggagccccagcccagaggcgtgcccaagaaggagagagccagaagccccgacctgggcccccaggagcagatgaaccccaaggagaagctgaagcccttccagagaagcggcctgcccttccccaagagcggcgtggtgagcagactggagcagggcgagccctggatccccgacctgctgggcagcaaggagaaggagctgcccagcggcagccacatcggcgacagaagagtgcacgccgacctgctgcccagcaagaaggacagaagaagctgggtggagcaggaccactggagcttcgaggacgagaaggtggccggcgtgcactggggctacgaggagaccagaaccctgctggccatcctgagccagaccgagttctacgaggccctgagaaactgccacagaaacagccaggtgtacggcgccgtggccgagagactgagagagtacggcttcctgagaaccctggagcagtgcagaaccaagttcaagggcctgcagaagagctacagaaaggtgaagagcggccacccccccgagacctgccccttcttcgaggagatggaggccctgatgagcgcccaggtgatcgccctgcccagcaacggcctggaggccgccgccagccacagcggcctggtgggcagcgacgccgagaccgaggagcccggccagagaggctggcagcacgaggagggcgccgaggaggccgtggcccaggagagcgacagcgacgacatggacctggaggccaccccccaggaccccaacagcgccgcccccgtggtgttcagaagccccggcggcgtgcactggggctacgaggagaccaagacctacctggccatcctgagcgagacccagttctacgaggccctgagaaactgccacagaaacagccagctgtacggcgccgtggccgagagactgtgggagtacggcttcctgagaacccccgagcagtgcagaaccaagttcaagagcctgcagaccagctacagaaaggtgaagaacggccaggcccccgagacctgccccttcttcgaggagatggacgccctggtgagcgtgagagtggccgccccccccaacgacggccaggaggagaccgccagctgccccgtgcagggcaccagcgaggccgaggcccagaagcaggccgaggaggccgacgaggccaccgaggaggacagcgacgacgacgaggaggacaccgagatcccccccggcgccgtgatcaccagagcccccgtgctgttccagagccccagaggcttcgaggccggcttcgagaacgaggacaacagcaagagagacatcagcgaggaggtgcagctgcacagaaccctgctggccagaagcgagagaaagatccccagatacctgcaccagggcaagggcaacgagagcgactgcagaagcggcagacagtgggccaagaccagcggcgagaagagaggcaagctgaccctgcccgagaagagcctgagcgaggtgctgagccagcagagaccctgcctgggcgagagaccctacaagtacctgaagtacagcaagagcttcggccccaacagcctgctgatgcaccaggtgagccaccaggtggagaacccctacaagtgcgccgactgcggcaagagcttcagcagaagcgccagactgatcagacacagaagaatccacaccggcgagaagccctacaagtgcctggactgcggcaagagcttcagagacagcagcaacttcatcacccacagaagaatccacaccggcgagaagccctaccagtgcggcgagtgcggcaagtgcttcaaccagagcagcagcctgatcatccaccagagaacccacaccggcgagaagccctaccagtgcgaggagtgcggcaagagcttcaacaacagcagccacttcagcgcccacagaagaatccacaccggcgagagaccccacgtgtgccccgactgcggcaagagcttcagcaagagcagcgacctgagagcccaccacagaacccacaccggcgagaagccctacggctgccacgactgcggcaagtgcttcagcaagagcagcgccctgaacaagcacggcgagatccacgccagagagaagctgctgacccagagcgcccccaagtag

SEQ ID NO: 10167 - DNA, 1485 bp, Artificial Sequence
  Description of Artificial Sequence: Synthetic coding sequence
atgagcggcgaggccaccgtgctggcctaccacgcccccgaggagcaggagggcctgctggtggtgaaggtggaggaggagaactacgtgctggaccaggacttcggcctgcaggagaacccctggagccaggaggtgttcagacagaagttcagacagttcagctacagcgacagcaccggccccagagaggccctgagcagactgagagagctgtgctgccagtggctgagacccgaggtgcacagcaaggagcagatcctggagctgctgatgctggagcagttcctggccatcctgcccgaggagctgcaggcctggctgagagagcacagacccgagaacggcgaggaggccgtgaccatgctggaggagctggagaaggagctggaggagcccagacagcaggacaccacccacggccaggagatgttctggcaggagatgaccagcaccggcgccctgaagagcctgagcctgaacagccccgtgcagcccctggagaaccagtgcaagaccgagacccaggagagccaggccttccaggagagagacggcagaatggtggccggcaaggtgctgatggccaagcaggagatcgtggagtgcgtggccagcgccgccatgatcagccccggcaagctgcccggcgagacccacagccagagaatcgccgaggaggccctgggcggcctggacaacagcaagaagcagaagggcaacgccgccggcaacaagatcagccagctgcccagccaggacagacacttcagcctggccaccttcaacagaagaatccccaccgagcacagcgtgctggagagccacgagagcgagggcagcttcagcatgaacagcaacgacatcacccagcagagcgtggacaccagagagaagctgtacgagtgcttcgactgcggcaaggccttctgccagagcagcaagctgatcagacaccagagaatccacaccggcgagagaccctacgcctgcaaggagtgcggcaaggccttcagcctgagcagcgacctggtgagacaccagagaatccacagcggcgagaagccctacgagtgctgcgagtgcggcaaggccttcagaggcagcagcgagctgatcagacacagaagaatccacaccggcgagaagccctacgagtgcggcgagtgcggcaaggccttcagcagaagcagcgccctgatccagcacaagaagatccacaccggcgacaagagctacgagtgcatcgcctgcggcaaggccttcggcagaagcagcatcctgatcgagcaccagagaatccacaccggcgagaagccctacgagtgcaacgagtgcggcaagagcttcaaccagagcagcgccctgacccagcaccagagaatccacaccggcgagaagccctacgagtgcagcgagtgcagaaagaccttcagacacagaagcggcctgatgcagcaccagagaacccacaccagagtgtag

SEQ ID NO: 10168 - DNA, 1284 bp, Artificial Sequence
  Description of Artificial Sequence: Synthetic coding sequence
caggaggtgttcagacagaagttcagacagttcagctacagcgacagcaccggccccagagaggccctgagcagactgagagagctgtgctgccagtggctgagacccgaggtgcacagcaaggagcagatcctggagctgctgatgctggagcagttcctggccatcctgcccgaggagctgcaggcctggctgagagagcacagacccgagaacggcgaggaggccgtgaccatgctggaggagctggagaaggagctggaggagcccagacagcaggtgagaagcaagcacttcttctgcgtgcccgccaccaccgtgagcagcgtgatgggcagcaagatcctgaccctgagcatccacatcttcagatggcaggacggcggctggcagagcgtggacggcaaggccagaaacagcagcgccgccatgatcagccccggcaagctgcccggcgagacccacagccagagaatcgccgaggaggccctgggcggcctggacaacagcaagaagcagaagggcaacgccgccggcaacaagatcagccagctgcccagccaggacagacacttcagcctggccaccttcaacagaagaatccccaccgagcacagcgtgctggagagccacgagagcgagggcagcttcagcatgaacagcaacgacatcacccagcagagcgtggacaccagagagaagctgtacgagtgcttcgactgcggcaaggccttctgccagagcagcaagctgatcagacaccagagaatccacaccggcgagagaccctacgcctgcaaggagtgcggcaaggccttcagcctgagcagcgacctggtgagacaccagagaatccacagcggcgagaagccctacgagtgctgcgagtgcggcaaggccttcagaggcagcagcgagctgatcagacacagaagaatccacaccggcgagaagccctacgagtgcggcgagtgcggcaaggccttcagcagaagcagcgccctgatccagcacaagaagatccacaccggcgacaagagctacgagtgcatcgcctgcggcaaggccttcggcagaagcagcatcctgatcgagcaccagagaatccacaccggcgagaagccctacgagtgcaacgagtgcggcaagagcttcaaccagagcagcgccctgacccagcaccagagaatccacaccggcgagaagccctacgagtgcagcgagtgcagaaagaccttcagacacagaagcggcctgatgcagcaccagagaacccacacctag

SEQ ID NO: 10169 - DNA, 666 bp, Artificial Sequence
  Description of Artificial Sequence: Synthetic coding sequence
atgagcggcgaggccaccgtgctggcctaccacgcccccgaggagcaggagggcctgctggtggtgaaggtggaggaggagaactacgtgctggaccaggacttcggcctgcaggagaacccctggagccaggaggtgttcagacagaagttcagacagttcagctacagcgacagcaccggccccagagaggccctgagcagactgagagagctgtgctgccagtggctgagacccgaggtgcacagcaaggagcagatcctggagctgctgatgctggagcagttcctggccatcctgcccgaggagctgcaggcctggctgagagagcacagacccgagaacggcgaggaggccgtgaccatgctggaggagctggagaaggagctggaggagcccagacagcaggacaccacccacggccaggagatgttctggcaggagatgaccagcaccggcgccctgaagagcctgagcctgaacagccccgtgcagcccctggagaaccagtgcaagaccgagacccaggagagccaggccttccaggagagagacggcgtgagcctgtaccaccccggctggagcgccgtggtgcagccccagctgaccgccgccgccctgaacccctgggtgaaggtgatcctgctgccccagccccccgagtag

SEQ ID NO: 10170 - DNA, 1485 bp, Artificial Sequence; identical to SEQ ID NO: 10167
  Description of Artificial Sequence: Synthetic coding sequence

SEQ ID NO: 10171 - DNA, 1140 bp, Artificial Sequence
  Description of Artificial Sequence: Synthetic coding sequence
atgatcgtgagacccccccagcccagagagaccagcgtggtgaccttccacggcaaggagtacatcgtgcaggacagcgacatcgagatggccgaggcccccagcagcgtgagagacgacctgaaggacgtgagcagccagagagccagcagcgtgaaccagatgagacccggcgagggccaggcccacagagagctgcagatcctgcccagagtgcccgccctgagcagaagacagggcgaggacttcctgctgcacaagagcatcgacgtgaccggcgaccccaagagcctgagacccaagcagaccctggagaaggacctgaaggagaacagagaggagaaccccggcctgaccagccccgagccccagctgcccaagagccccaccgacctggtgagagccaaggagggcaaggacccccccaagatcgccagcgtggagaacgtggacgccgacacccccagcgcctgcgtggtggagagagaggccagcacccacagcggcaacagaggcgacgccctgaacctgagcagccccaagagaagcaagcccgacgccagcagcatcagccaggaggagccccagggcgaggccacccccgtgggcaacagagagagccccggccaggccggcatgaacagcatccacagccccggccccgccagccccgtgagccaccccgacggccaggaggccaaggccctgccccccttcgcctgcgacgtgtgcgagaagagattcacctgcaacagcaagctggtgatccacaagagaagccacaccggcgagagactgttccagtgcaacctgtgcggcaagagattcatgcagctgatcagcctgcagttccaccagagaacccacaccggcgagagaccctacacctgcgacgtgtgccagaagcagttcacccagaagagctacctgaagtgccacaagagaagccacaccggcgagaagcccttcgagtgcaaggactgcaagaaggtgttcacctacagaggcagcctgaaggagcaccagagaatccacagcggcgagaagccctacaagtgcagcaagtgccccagagccttcagcagactgaagctgctgagaagacaccagaagacccaccccgaggccaccagccagtag

SEQ ID NO: 10172 - DNA, 1491 bp, Artificial Sequence
  Description of Artificial Sequence: Synthetic coding sequence
atggccgccaactgcaccagcagctggagcctgggcgagagctgcaacagacccggcctggagctgcccagaagcatggccagcagcgagacccagctgggcaaccacgacgtggaccccgagatcagccacgtgaacttcagaatgttcagctgccccaaggagagcgaccccatccaggccctgagaaagctgaccgagctgtgccacctgtggctgagacccgacctgcacaccaaggagcagatcctggacatgctggtgatggagcagttcatgatcagcatgccccaggagctgcaggtgctggtgatgatgaacggcgtgcagagctgcaaggacctggaggacctgctgagaaacaacagaagacccaagaagtggagcgtggtgaccttccacggcaaggagtacatcgtgcaggacagcgacatcgagatggccgaggcccccagcagcgtgagagacgacctgaaggacgtgagcagccagagagccagcagcgtgaaccagatgagacccggcgagggccaggcccacagagagctgcagatcctgcccagagtgcccgccctgagcagaagacagggcgaggacttcctgctgcacaagagcatcgacgtgaccggcgaccccaagagcctgagacccaagcagaccctggagaaggacctgaaggagaacagagaggagaaccccggcctgaccagccccgagccccagctgcccaagagccccaccgacctggtgagagccaaggagggcaaggacccccccaagatcgccagcgtggagaacgtggacgccgacacccccagcgcctgcgtggtggagagagaggccagcacccacagcggcaacagaggcgacgccctgaacctgagcagccccaagagaagcaagcccgacgccagcagcatcagccaggaggagccccagggcgaggccacccccgtgggcaacagagagagccccggccaggccggcatgaacagcatccacagccccggccccgccagccccgtgagccaccccgacggccaggaggccaaggccctgccccccttcgcctgcgacgtgtgcgagaagagattcacctgcaacagcaagctggtgatccacaagagaagccacaccggcgagagactgttccagtgcaacctgtgcggcaagagattcatgcagctgatcagcctgcagttccaccagagaacccacaccggcgagagaccctacacctgcgacgtgtgccagaagcagttcacccagaagagctacctgaagtgccacaagagaagccacaccggcgagaagcccttcgagtgcaaggactgcaagaaggtgttcacctacagaggcagcctgaaggagcaccagagaatccacagcggcgagaagccctacaagtgcagcaagtgccccagagccttcagcagactgaagctgctgagaagacaccagaagacccaccccgaggccaccagccagtag

SEQ ID NO: 10173 - DNA, 2274 bp, Artificial Sequence
  Description of Artificial Sequence: Synthetic coding sequence
atggacgtggccgagagccccgagagagacccccacagccccgaggacgaggagcagccccagggcctgagcgacgacgacatcctgagagacagcggcagcgaccaggacctggacggcgccggcgtgagagccagcgacctggaggacgaggagagcgccgccagaggccccagccaggaggaggaggacaaccacagcgacgaggaggacagagccagcgagcccaagagccaggaccaggacagcgaggtgaacgagctgagcagaggccccaccagcagcccctgcgaggaggagggcgacgagggcgaggaggacagaaccagcgacctgagagacgaggccagcagcgtgaccagagagctggacgagcacgagctggactacgacgaggaggtgcccgaggagcccgcccccgccgtgcaggaggacgaggccgagaaggccggcgccgaggacgacgaggagaagggcgagggcacccccagagaggagggcaaggccggcgtgcagagcgtgggcgagaaggagagcctggaggccgccaaggagaagaagaaggaggacgacgacggcgagatcgacgacggcgagatcgacgacgacgacctggaggagggcgaggtgaaggaccccagcgacagaaaggtgagacccagacccacctgcagattcttcatgaaggacgtggtgacccccctgagcaccctgctgccccccatcagcaacagcatccccttcagaggccaggtgaagggcaactgcacctggggcatgaactgcagattcatccaccccggcgtgaacgacaagggcaactacagcctgatcaccaaggccgaccccttcccccccaacggcgccccccccctgggcccccaccccctgatgcccgccaacccctggggcggccccgtggtggacgagatcctgcccccccccccccccgagccccccaccgagagcgcctgggagagaggcctgagacacgccaaggaggtgctgaagaaggccaccatcagaaaggagcaggagcccgacttcgaggagaagagattcaccgtgaccatcggcgaggacgagagagagttcgacaaggagaacgaggtgttcagagactggaacagcagaatccccagagacgtgagagacaccgtgctggagccctacgccgacccctactacgactacgagatcgagagattctggagaggcggccagtacgagaacttcagagtgcagtacaccgagaccgagccctaccacaactacagagagagagagagagagagagagagagagagagacagagacagagagaaggagagagagaaggagaagggcaagcccaagcccagaagcccccagccccccagcagacaggccgagccccccaagaaggaggccgccaccaccggcccccaggtgaagagagccgacgagtggaaggacccctggagaagaagcaagagccccaagaagaagctgggcgtgagcgtgagccccagcagagccagaagaagaagaaagaccagcgccagcagcgccagcgccagcaacagcagcagaagcagcagcagaagcagcagctacagcggcagcggcagcagcagaagcagaagcagaagcagcagctacagcagctacagcagcagaagcagcagacacagcagcttcagcggcagcagaagcagaagcagaagcttcagcagcagccccagccccagccccacccccagcccccacagacccagcatcagaaccaagggcgagcccgcccccccccccggcaaggccggcgagaagagcgtgaagaagcccgcccccccccccgcccccccccaggccaccaagaccaccgcccccgtgcccgagcccaccaagcccggcgaccccagagaggccagaagaaaggagagacccgccagaaccccccccagaagaagactgatcaaggaggccggcagcgccatgaaccaccagaccagaaccggcagagccctgctgcagcccagcggccccacccacccccagaccgaggtgctgggcaccggcagccaggtgggcgactgggcccccagaagccagagcggcagagaggccagaacccccaagcccctgcagcccagactgaccggcagcgccagctgccaccccagccccagagcccccgccagaagcagagcctgccccgccaagcccagaatccccgccccccccgcccccaaccagggcagacccgccagatgcctgggcggcagaagctgctag

SEQ ID NO: 10174 - DNA, 2862 bp, Artificial Sequence
  Description of Artificial Sequence: Synthetic coding sequence
atggacgtggccgagagccccgagagagacccccacagccccgaggacgaggagcagccccagggcctgagcgacgacgacatcctgagagacagcggcagcgaccaggacctggacggcgccggcgtgagagccagcgacctggaggacgaggagagcgccgccagaggccccagccaggaggaggaggacaaccacagcgacgaggaggacagagccagcgagcccaagagccaggaccaggacagcgaggtgaacgagctgagcagaggccccaccagcagcccctgcgaggaggagggcgacgagggcgaggaggacagaaccagcgacctgagagacgaggccagcagcgtgaccagagagctggacgagcacgagctggactacgacgaggaggtgcccgaggagcccgcccccgccgtgcaggaggacgaggccgagaaggccggcgccgaggacgacgaggagaagggcgagggcacccccagagaggagggcaaggccggcgtgcagagcgtgggcgagaaggagagcctggaggccgccaaggagaagaagaaggaggacgacgacggcgagatcgacgacggcgagatcgacgacgacgacctggaggagggcgaggtgaaggaccccagcgacagaaaggtgagacccagacccacctgcagattcttcatgaagggcaactgcacctggggcatgaactgcagattcatccaccccggcgtgaacgacaagggcaactacagcctgatcaccaaggccgaccccttcccccccaacggcgccccccccctgggcccccaccccctgatgcccgccaacccctggggcggccccgtggtggacgagatcctgcccccccccccccccgagccccccaccgagagcgcctgggagagaggcctgagacacgccaaggaggtgctgaagaaggccaccatcagaaaggagcaggagcccgacttcgaggagaagagattcaccgtgaccatcggcgaggacgagagagagttcgacaaggagaacgaggtgttcagagactggaacagcagaatccccagagacgtgagagacaccgtgctggagccctacgccgacccctactacgactacgagatcgagagattctggagaggcggccagtacgagaacttcagagtgcagtacaccgagaccgagccctaccacaactacagagagagagagagagagagagagagagagaacagacagagagagagagagagagagagagagagagacagagagagagagagaagacagagagagagagagagagagagagagagagagagagacaaggagagacagagaagaaaggaggagtgggagagagagagagccaagagagacgagaaggacagacagcacagagacagagacagagagaaggagagagagaaggagaagggcaagcccaagcccagaagcccccagccccccagcagacaggccgagccccccaagaaggaggccgccaccaccggcccccaggtgaagagagccgacgagtggaaggacccctggagaagaagcaagagccccaagaagaagctgggcgtgagcgtgagccccagcagagccagaagaagaagaaagaccagcgccagcagcgccagcgccagcaacagcagcagaagcagcagcagaagcagcagctacagcggcagcggcagcagcagaagcagaagcagaagcagcagctacagcagctacagcagcagaagcagcagacacagcagcttcagcggcagcagaagcagaagcagaagcttcagcagcagccccagccccagccccacccccagcccccacagacccagcatcagaaccaagggcgagcccgcccccccccccggcaaggccggcgagaagagcgtgaagaagcccgcccccccccccgcccccccccaggccaccaagaccaccgcccccgtgcccgagcccaccaagcccggcgaccccagagaggccagaagaaaggagagacccgccagaaccccccccagaagaagaaccctgagcggcagcggcagcggcagcggcagcagctacagcggcagcagcagcagaagcagaagcctgagcgtgagcagcgtgagcagcgtgagcagcgccaccagcagcagcagcagcgcccacagcgtggacagcgaggacatgtacgccgacctggccagccccgtgagcagcgccagcagcagaagccccgcccccgcccagaccagaaaggagaagggcaagagcaagaaggaggacggcgtgaaggaggagaagagaaagagagacagcagcacccagccccccaagagcgccaagccccccgccggcggcaagagcagccagcagcccagcaccccccagcaggccccccccggccagccccagcagggcaccttcgtggcccacaaggagatcaagctgaccctgctgaacaaggccgccgacaagggcagcagaaagagatacgagcccagcgacaaggacagacagagccccccccccgccaagagacccaacaccagccccgacagaggcagcagagacagaaagagcggcggcagactgggcagccccaagcccgagagacagagaggccagaacagcaaggcccccgccgcccccgccgacagaaagagacagctgagcccccagagcaagagcagcagcaaggtgaccagcgtgcccggcaaggccagcgaccccggcgccgccagcaccaagagcggcaaggccagcaccctgagcagaagagaggagctgctgaagcagctgaaggccgtggaggacgccatcgccagaaagagagccaagatccccggcaaggcctag

SEQ ID NO: 10175 - DNA, 2934 bp, Artificial Sequence
  Description of Artificial Sequence: Synthetic coding sequence
atggacgtggccgagagccccgagagagacccccacagccccgaggacgaggagcagccccagggcctgagcgacgacgacatcctgagagacagcggcagcgaccaggacctggacggcgccggcgtgagagccagcgacctggaggacgaggagagcgccgccagaggccccagccaggaggaggaggacaaccacagcgacgaggaggacagagccagcgagcccaagagccaggaccaggacagcgaggtgaacgagctgagcagaggccccaccagcagcccctgcgaggaggagggcgacgagggcgaggaggacagaaccagcgacctgagagacgaggccagcagcgtgaccagagagctggacgagcacgagctggactacgacgaggaggtgcccgaggagcccgcccccgccgtgcaggaggacgaggccgagaaggccggcgccgaggacgacgaggagaagggcgagggcacccccagagaggagggcaaggccggcgtgcagagcgtgggcgagaaggagagcctggaggccgccaaggagaagaagaaggaggacgacgacggcgagatcgacgacggcgagatcgacgacgacgacctggaggagggcgaggtgaaggaccccagcgacagaaaggtgagacccagacccacctgcagattcttcatgaaggacgtggtgacccccctgagcaccctgctgccccccatcagcaacagcatccccttcagaggccaggtgaagggcaactgcacctggggcatgaactgcagattcatccaccccggcgtgaacgacaagggcaactacagcctgatcaccaaggccgaccccttcccccccaacggcgccccccccctgggcccccaccccctgatgcccgccaacccctggggcggccccgtggtggacgagatcctgcccccccccccccccgagccccccaccgagagcgcctgggagagaggcctgagacacgccaaggaggtgctgaagaaggccaccatcagaaaggagcaggagcccgacttcgaggagaagagattcaccgtgaccatcggcgaggacgagagagagttcgacaaggagaacgaggtgttcagagactggaacagcagaatccccagagacgtgagagacaccgtgctggagccctacgccgacccctactacgactacgagatcgagagattctggagaggcggccagtacgagaacttcagagtgcagtacaccgagaccgagccctaccacaactacagagagagagagagagagagagagagagagaacagacagagagagagagagagagagagagagagagacagagagagagagagaagacagagagagagagagagagagagagagagagagagagacaaggagagacagagaagaaaggaggagtgggagagagagagagccaagagagacgagaaggacagacagcacagagacagagacagagagaaggagagagagaaggagaagggcaagcccaagcccagaagcccccagccccccagcagacaggccgagccccccaagaaggaggccgccaccaccggcccccaggtgaagagagccgacgagtggaaggacccctggagaagaagcaagagccccaagaagaagctgggcgtgagcgtgagccccagcagagccagaagaagaagaaagaccagcgccagcagcgccagcgccagcaacagcagcagaagcagcagcagaagcagcagctacagcggcagcggcagcagcagaagcagaagcagaagcagcagctacagcagctacagcagcagaagcagcagacacagcagcttcagcggcagcagaagcagaagcagaagcttcagcagcagccccagccccagccccacccccagcccccacagacccagcatcagaaccaagggcgagcccgcccccccccccggcaaggccggcgagaagagcgtgaagaagcccgcccccccccccgcccccccccaggccaccaagaccaccgcccccgtgcccgagcccaccaagcccggcgaccccagagaggccagaagaaaggagagacccgccagaaccccccccagaagaagaaccctgagcggcagcggcagcggcagcggcagcagctacagcggcagcagcagcagaagcagaagcctgagcgtgagcagcgtgagcagcgtgagcagcgccaccagcagcagcagcagcgcccacagcgtggacagcgaggacatgtacgccgacctggccagccccgtgagcagcgccagcagcagaagccccgcccccgcccagaccagaaaggagaagggcaagagcaagaaggaggacggcgtgaaggaggagaagagaaagagagacagcagcacccagccccccaagagcgccaagccccccgccggcggcaagagcagccagcagcccagcaccccccagcaggccccccccggccagccccagcagggcaccttcgtggcccacaaggagatcaagctgaccctgctgaacaaggccgccgacaagggcagcagaaagagatacgagcccagcgacaaggacagacagagccccccccccgccaagagacccaacaccagccccgacagaggcagcagagacagaaagagcggcggcagactgggcagccccaagcccgagagacagagaggccagaacagcaaggcccccgccgcccccgccgacagaaagagacagctgagcccccagagcaagagcagcagcaaggtgaccagcgtgcccggcaaggccagcgaccccggcgccgccagcaccaagagcggcaaggccagcaccctgagcagaagagaggagctgctgaagcagctgaaggccgtggaggacgccatcgccagaaagagagccaagatccccggcaaggcctag

SEQ ID NO: 10176 - DNA, 999 bp, Artificial Sequence
  Description of Artificial Sequence: Synthetic coding sequence
atggacgtggccgagagccccgagagagacccccacagccccgaggacgaggagcagccccagggcctgagcgacgacgacatcctgagagacagcggcagcgaccaggacctggacggcgccggcgtgagagccagcgacctggaggacgaggagagcgccgccagaggccccagccaggaggaggaggacaaccacagcgacgaggaggacagagccagcgagcccaagagccaggaccaggacagcgaggacgacgacctggaggagggcgaggtgaaggaccccagcgacagaaaggtgagacccagacccacctgcagattcttcatgaagggcaactgcacctggggcatgaactgcagattcatccaccccggcgtgaacgacaagggcaactacagcctgatcaccaaggccgaccccttcccccccaacggcgccccccccctgggcccccaccccctgatgcccgccaacccctggggcggccccgtggtggacgagatcctgcccccccccccccccgagccccccaccgagagcgcctgggagagaggcctgagacacgccaaggaggtgctgaagaaggccaccatcagaaaggagcaggagcccgacttcgaggagaagagattcaccgtgaccatcggcgaggacgagagagagttcgacaaggagaacgaggtgttcagagactggaacagcagaatccccagagacgtgagagacaccgtgctggagccctacgccgacccctactacgactacgagatcgagagattctggagaggcggccagtacgagaacttcagagtgcagtacaccgagaccgagccctaccacaactacagagagagagagagagagagagagagagagaacagacagagagagagagacaaggagagacagagaagaaaggaggagtgggagagagagagagccgccaagctgagccaccagagaagaagactgccccccagaggcagaagatag

SEQ ID NO: 10177 - DNA, 2847 bp, Artificial Sequence
  Description of Artificial Sequence: Synthetic coding sequence
atggaggagaaggagatcctgagaagacagatcagactgctgcagggcctgatcgacgactacaagaccctgcacggcaacgcccccgcccccggcacccccgccgccagcggctggcagccccccacctaccacagcggcagagccttcagcgccagataccccagacccagcagaagaggctacagcagccaccacggccccagctggagaaagaagtacagcctggtgaacagaccccccggccccagcgacccccccgccgaccacgccgtgagacccctgcacggcgccagaggcggccagccccccgtgccccagcagcacgtgctggagagacaggtgcagctgagccagggccagaacgtggtgatcaaggtgaagccccccagcaagagcggcagcgccagcgccagcggcgcccagagaggcagcctggaggagttcgaggagaccccctggagcgaccagagacccagagagggcgagggcgagccccccagaggccagctgcagcccagcagacccaccagagccagaggcacctgcagcgtggaggaccccctgctggtgtgccagaaggagcccggcaagcccagaatggtgaagagcgtgggcagcgtgggcgacagccccagagagcccagaagaaccgtgagcgagagcgtgatcgccgtgaaggccagcttccccagcagcgccctgccccccagaaccggcgtggccctgggcagaaagctgggcagccacagcgtggccagctgcgccccccagctgctgggcgacagaagagtggacgccggccacaccgaccagcccgtgcccagcggcagcgtgggcggccccgccagacccgccagcggccccagacaggccagagaggccagcctggtggtgacctgcagaaccaacaagttcagaaagaacaactacaagtgggtggccgccagcagcaagagccccagagtggccagaagagccctgagccccagagtggccgccgagaacgtgtgcaaggccagcgccggcatggccaacaaggtggagaagccccagctgatcgccgaccccgagcccaagcccagaaagcccgccaccagcagcaagcccggcagcgcccccagcaagtacaagtggaaggccagcagccccagcgccagcagcagcagcagcttcagatggcagagcgaggccagcagcaaggaccacgccagccagctgagccccgtgctgagcagaagccccagcggcgacagacccgccgtgggccacagcggcctgaagcccctgagcggcgagacccccctgagcgcctacaaggtgaagagcagaaccaagatcatcagaagaagaagcagcaccagcctgcccggcgacaagaagagcggcaccagccccgccgccaccgccaagagccacctgagcctgagaagaagacaggccctgagaggcaagagcagccccgtgctgaagaagacccccaacaagggcctggtgcaggtgaccacccacagactgtgcagactgccccccagcagagcccacctgcccaccaaggaggccagcagcctgcacgccgtgagaaccgcccccaccagcaaggtgatcaagaccagatacagaatcgtgaagaagacccccgccagccccctgagcgccccccccttccccctgagcctgcccagctggagagccagaagactgagcctgagcagaagcctggtgctgaacagactgagacccgtggccagcggcggcggcaaggcccagcccggcagcccctggtggagaagcaagggctacagatgcatcggcggcgtgctgtacaaggtgagcgccaacaagctgagcaagaccagcggccagcccagcgacgccggcagcagacccctgctgagaaccggcagactggaccccgccggcagctgcagcagaagcctggccagcagagccgtgcagagaagcctggccatcatcagacaggccagacagagaagagagaagagaaaggagtactgcatgtactacaacagattcggcagatgcaacagaggcgagagatgcccctacatccacgaccccgagaaggtggccgtgtgcaccagattcgtgagaggcacctgcaagaagaccgacggcacctgccccttcagccaccacgtgagcaaggagaagatgcccgtgtgcagctacttcctgaagggcatctgcagcaacagcaactgcccctacagccacgtgtacgtgagcagaaaggccgaggtgtgcagcgacttcctgaagggctactgccccctgggcgccaagtgcaagaagaagcacaccctgctgtgccccgacttcgccagaagaggcgcctgccccagaggcgcccagtgccagctgctgcacagaacccagaagagacacagcagaagagccgccaccagccccgcccccggccccagcgacgccaccgccagaagcagagtgagcgccagccacggccccagaaagcccagcgccagccagagacccaccagacagacccccagcagcgccgccctgaccgccgccgccgtggccgcccccccccactgccccggcggcagcgccagccccagcagcagcaaggccagcagcagcagcagcagcagcagcagcccccccgccagcctggaccacgaggcccccagcctgcaggaggccgccctggccgccgcctgcagcaacagactgtgcaagctgcccagcttcatcagcctgcagagcagccccagccccggcgcccagcccagagtgagagcccccagagcccccctgaccaaggacagcggcaagcccctgcacatcaagcccagactgtag

SEQ ID NO: 10178 - DNA, 2916 bp, Artificial Sequence
  Description of Artificial Sequence: Synthetic coding sequence
atgagcaacgtgagcgaggagagaagaaagagacagcagaacatcaaggagggcctgcagttcatccagagccccctgagctaccccggcacccaggagcagtacgccgtgtacctgagagccctggtgagaaacctgttcaacgagggcaacgacgtgtacagagagcacgactggaacaacagcatcagccagtacaccgaggccctgaacatcgccgactacgccaagagcgaggagatcctgatccccaaggagatcatcgagaagctgtacatcaacagaatcgcctgctacagcaacatgggcttccacgacaaggtgctggaggactgcaacatcgtgctgagcctgaacgccagcaactgcaaggccctgtacagaaagagcaaggccctgagcgacctgggcagatacaagaaggcctacgacgccgtggccaagtgcagcctggccgtgccccaggacgagcacgtgatcaagctgacccaggagctggcccagaagctgggcttcaagatcagaaaggcctacgtgagagccgagctgagcctgaagagcgtgcccggcgacggcgccaccaaggccctgaaccacagcgtggaggacatcgagcccgacctgctgacccccagacaggaggccgtgcccgtggtgagcctgcccgcccccagcttcagccacgaggtgggcagcgagctggccagcgtgcccgtgatgcccctgaccagcatcctgcccctgcaggtggaggagagcgccctgcccagcgccgtgctggccaacggcggcaagatgcccttcaccatgcccgaggccttcctggacgacggcgacatggtgctgggcgacgagctggacgacctgctggacagcgcccccgagaccaacgagaccgtgatgcccagcgccctggtgagaggccccctgcagaccgccagcgtgagccccagcatgcccttcagcgccagcctgctgggcaccctgcccatcggcgccagatacgcccccccccccagcttcagcgagttctacccccccctgaccagcagcctggaggacttctgcagcagcctgaacagcttcagcatgagcgagagcaagagagacctgagcaccagcaccagcagagagggcacccccctgaacaacagcaacagcagcctgctgctgatgaacggccccggcagcctgttcgccagcgagaacttcctgggcatcagcagccagcccagaaacgacttcggcaacttcttcggcagcgccgtgaccaagcccagcagcagcgtgacccccagacaccccctggagggcacccacgagctgagacaggcctgccagatctgcttcgtgaagagcggccccaagctgatggacttcacctaccacgccaacatcgaccacaagtgcaagaaggacatcctgatcggcagaatcaagaacgtggaggacaagagctggaagaagatcagacccagacccaccaagaccaactacgagggcccctactacatctgcaaggacgtggccgccgaggaggagtgcagatacagcggccactgcaccttcgcctactgccaggaggagatcgacgtgtggaccctggagagaaagggcgccttcagcagagaggccttcttcggcggcaacggcaagatcaacctgaccgtgttcaagctgctgcaggagcacctgggcgagttcatcttcctgtgcgagaagtgcttcgaccacaagcccagaatgatcagcaagagaaacaaggacaacagcaccgcctgcagccaccccgtgaccaagcacgagttcgaggacaacaagtgcctggtgcacatcctgagagagaccaccgtgaagtacagcaagatcagaagcttccacggccagtgccagctggacctgtgcagacacgaggtgagatacggctgcctgagagaggacgagtgcttctacgcccacagcctggtggagctgaaggtgtggatcatgcagaacgagaccggcatcagccacgacgccatcgcccaggagagcaagagatactggcagaacctggaggccaacgtgcccggcgcccaggtgctgggcaaccagatcatgcccggcttcctgaacatgaagatcaagttcgtgtgcgcccagtgcctgagaaacggccaggtgatcgagcccgacaagaacagaaagtactgcagcgccaaggccagacacagctggaccaaggacagaagagccatgagagtgatgagcatcgagagaaagaagtggatgaacatcagacccctgcccaccaagaagcagatgcccctgcagttcgacctgtgcaaccacatcgccagcggcaagaagtgccagtacgtgggcaactgcagcttcgcccacagccccgaggagagagaggtgtggacctacatgaaggagaacggcatccaggacatggagcagttctacgagctgtggctgaagagccagaagaacgagaagagcgaggacatcgccagccagagcaacaaggagaacggcaagcagatccacatgcccaccgactacgccgaggtgaccgtggacttccactgctggatgtgcggcaagaactgcaacagcgagaagcagtggcagggccacatcagcagcgagaagcacaaggagaaggtgttccacaccgaggacgaccagtactgctggcagcacagattccccaccggctacttcagcatctgcgacagatacatgaacggcacctgccccgagggcaacagctgcaagttcgcccacggcaacgccgagctgcacgagtgggaggagagaagagacgccctgaagatgaagctgaacaaggccagaaaggaccacctgatcggccccaacgacaacgacttcggcaagtacagcttcctgttcaaggacctgaactag

SEQ ID NO: 10179 - DNA, 2916 bp, Artificial Sequence; identical to SEQ ID NO: 10178
  Description of Artificial Sequence: Synthetic coding sequence

SEQ ID NO: 10180 - DNA, 2934 bp, Artificial Sequence
  Description of Artificial Sequence: Synthetic coding sequence
atggagagacagaagagaaaggccgacatcgagaagggcctgcagttcatccagagcaccctgcccctgaagcaggaggagtacgaggccttcctgctgaagctggtgcagaacctgttcgccgagggcaacgacctgttcagagagaaggactacaagcaggccctggtgcagtacatggagggcctgaacgtggccgactacgccgccagcgaccaggtggccctgcccagagagctgctgtgcaagctgcacgtgaacagagccgcctgctacttcaccatgggcctgtacgagaaggccctggaggacagcgagaaggccctgggcctggacagcgagagcatcagagccctgttcagaaaggccagagccctgaacgagctgggcagacacaaggaggcctacgagtgcagcagcagatgcagcctggccctgccccacgacgagagcgtgacccagctgggccaggagctggcccagaagctgggcctgagagtgagaaaggcctacaagagaccccaggagctggagaccttcagcctgctgagcaacggcaccgccgccggcgtggccgaccagggcaccagcaacggcctgggcagcatcgacgacatcgagaccgactgctacgtggaccccagaggcagccccgccctgctgcccagcacccccaccatgcccctgttcccccacgtgctggacctgctggcccccctggacagcagcagaaccctgcccagcaccgacagcctggacgacttcagcgacggcgacgtgttcggccccgagctggacaccctgctggacagcctgagcctggtgcagggcggcctgagcggcagcggcgtgcccagcgagctgccccagctgatccccgtgttccccggcggcacccccctgctgccccccgtggtgggcggcagcatccccgtgagcagccccctgccccccgccagcttcggcctggtgatggaccccagcaagaagctggccgccagcgtgctggacgccctggacccccccggccccaccctggaccccctggacctgctgccctacagcgagaccagactggacgccctggacagcttcggcagcaccagaggcagcctggacaagcccgacagcttcatggaggagaccaacagccaggaccacagaccccccagcggcgcccagaagcccgcccccagccccgagccctgcatgcccaacaccgccctgctgatcaagaaccccctggccgccacccacgagttcaagcaggcctgccagctgtgctaccccaagaccggccccagagccggcgactacacctacagagagggcctggagcacaagtgcaagagagacatcctgctgggcagactgagaagcagcgaggaccagacctggaagagaatcagacccagacccaccaagaccagcttcgtgggcagctactacctgtgcaaggacatgatcaacaagcaggactgcaagtacggcgacaactgcaccttcgcctaccaccaggaggagatcgacgtgtggaccgaggagagaaagggcaccctgaacagagacctgctgttcgaccccctgggcggcgtgaagagaggcagcctgaccatcgccaagctgctgaaggagcaccagggcatcttcaccttcctgtgcgagatctgcttcgacagcaagcccagaatcatcagcaagggcaccaaggacagccccagcgtgtgcagcaacctggccgccaagcacagcttctacaacaacaagtgcctggtgcacatcgtgagaagcaccagcctgaagtacagcaagatcagacagttccaggagcacttccagttcgacgtgtgcagacacgaggtgagatacggctgcctgagagaggacagctgccacttcgcccacagcttcatcgagctgaaggtgtggctgctgcagcagtacagcggcatgacccacgaggacatcgtgcaggagagcaagaagtactggcagcagatggaggcccacgccggcaaggccagcagcagcatgggcgcccccagaacccacggccccagcaccttcgacctgcagatgaagttcgtgtgcggccagtgctggagaaacggccaggtggtggagcccgacaaggacctgaagtactgcagcgccaaggccagacactgctggaccaaggagagaagagtgctgctggtgatgagcaaggccaagagaaagtgggtgagcgtgagacccctgcccagcatcagaaacttcccccagcagtacgacctgtgcatccacgcccagaacggcagaaagtgccagtacgtgggcaactgcagcttcgcccacagccccgaggagagagacatgtggaccttcatgaaggagaacaagatcctggacatgcagcagacctacgacatgtggctgaagaagcacaaccccggcaagcccggcgagggcacccccatcagcagcagagagggcgagaagcagatccagatgcccaccgactacgccgacatcatgatgggctaccactgctggctgtgcggcaagaacagcaacagcaagaagcagtggcagcagcacatccagagcgagaagcacaaggagaaggtgttcaccagcgacagcgacgccagcggctgggccttcagattccccatgggcgagttcagactgtgcgacagactgcagaagggcaaggcctgccccgacggcgacaagtgcagatgcgcccacggccaggaggagctgaacgagtggctggacagaagagaggtgctgaagcagaagctggccaaggccagaaaggacatgctgctgtgccccagagacgacgacttcggcaagtacaacttcctgctgcaggaggacggcgacctggccggcgccacccccgaggcccccgccgccgccgccaccgccaccaccggcgagtag

SEQ ID NO: 10181 - DNA, 2934 bp, Artificial Sequence; identical to SEQ ID NO: 10180
  Description of Artificial Sequence: Synthetic coding sequence

SEQ ID NO: 10182 - DNA, 876 bp, Artificial Sequence
  Description of Artificial Sequence: Synthetic coding sequence
atggacttcgagaacctgttcagcaagccccccaaccccgccctgggcaagaccgccaccgacagcgacgagagaatcgacgacgagatcgacaccgaggtggaggagacccaggaggagaagatcaagctggagtgcgagcagatccccaagaagttcagacacagcgccatcagccccaagagcagcctgcacagaaagagcagaagcaaggactacgacgtgtacagcgacaacgacatctgcagccaggagagcgaggacaacttcgccaaggagctgcagcagtacatccaggccagagagatggccaacgccgcccagcccgaggagagcaccaagaaggagggcgtgaaggacaccccccaggccgccaagcagaagaacaagaacctgaaggccggccacaagaacggcaagcagaagaagatgaagagaaagtggcccggccccggcaacaagggcagcaacgccctgctgagaaacagcggcagccaggaggaggacggcaagcccaaggagaagcagcagcacctgagccaggccttcatcaaccagcacaccgtggagagaaagggcaagcagatctgcaagtacttcctggagagaaagtgcatcaagggcgaccagtgcaagttcgaccacgacgccgagatcgagaagaagaaggagatgtgcaagttctacgtgcagggctactgcaccagaggcgagaactgcctgtacctgcacaacgagtacccctgcaagttctaccacaccggcaccaagtgctaccagggcgagtactgcaagttcagccacgcccccctgacccccgagacccaggagctgctggccaaggtgctggacaccgagaagaagagctgcaagtag

SEQ ID NO: 10183 - DNA, 876 bp, Artificial Sequence; identical to SEQ ID NO: 10182
  Description of Artificial Sequence: Synthetic coding sequence

SEQ ID NO: 10184 - DNA, 846 bp, Artificial Sequence
  Description of Artificial Sequence: Synthetic coding sequence
atggccgaggccgcccccgccagagaccccgagaccgacaagcacaccgaggaccagagccccagcacccccctgccccagcccgccgccgagaagaacagctacctgtacagcaccgagatcaccctgtggaccgtggtggccgccatccaggccctggagaagaaggtggacagctgcctgaccagactgctgaccctggagggcagaaccggcaccgccgagaagaagctggccgactgcgagaagaccgccgtggagttcggcaaccagctggagggcaagtgggccgtgctgggcaccctgctgcaggagtacggcctgctgcagagaagactggagaacgtggagaacctgctgagaaacagaaacttctggatcctgagactgccccccggcagcaagggcgaggcccccaaggtgcccgtgaccttcgacgacgtggccgtgtacttcagcgagctggagtggggcaagctggaggactggcagaaggagctgtacaagcacgtgatgagaggcaactacgagaccctggtgagcctggactacgccatcagcaagcccgacatcctgaccagaatcgagagaggcgaggagccctgcctggacagatggggccaggagaagggcaacgaggtggaggtgggcagacccagaatgatgggcaccggcctgcccccctaccccgagcacctgaccagccccctgagccccgcccaggaggagctgaaggagggccaggcccccaagcagcagcaggacagcgaggccagagtggcccccgccggccccgaggccggcctggccctgagaaccgacctgcagggcgaggcccagatctag

SEQ ID NO: 10185 - DNA, 540 bp, Artificial Sequence
  Description of Artificial Sequence: Synthetic coding sequence
atggccgaggccgccgccccccccgactggcactgcggcctgaccagcagagagagacccagaagcgacctgcagagaagccccttcagactgagctggctgctgttcagatggtggagaagaagatggaaccccagactgcccggctacagagcctggagagacgcctgcggccagcccagaagaagctggctgaccgccagaagatggctgtggagcagcggcaccagctggagagccctggtgaacggcggcgccagcctggtgtgcggcagccaggtgggcctggtgagcagcgagtggctgtgccagaagggcctggtgtacgacagaaacgccggccagctggagagaccccaggccttctgccccggcagcagcaagagaaagggccaggtgggcggcgccagcagagcccacagaagacccctgtggcacacctgcgcccaggtgagacacgccggcccctgcctgctgagacccgtgagcctgggcctgagaagacacggcgtgccctggggcgccagccagagactgtag

SEQ ID NO: 10186 - DNA, 1641 bp, Artificial Sequence
  Description of Artificial Sequence: Synthetic coding sequence
atggccgaggccgcccccgccagagaccccgagaccgacaagcacaccgaggaccagagccccagcacccccctgccccagcccgccgccgagaagaacagctacctgtacagcaccgagatcaccctgtggaccgtggtggccgccatccaggccctggagaagaaggtggacagctgcctgaccagactgctgaccctggagggcagaaccggcaccgccgagaagaagctggccgactgcgagaagaccgccgtggagttcggcaaccagctggagggcaagtgggccgtgctgggcaccctgctgcaggagtacggcctgctgcagagaagactggagaacgtggagaacctgctgagaaacagaaacttctggatcctgagactgccccccggcagcaagggcgaggcccccaaggtgcccgtgaccttcgacgacgtggccgtgtacttcagcgagctggagtggggcaagctggaggactggcagaaggagctgtacaagcacgtgatgagaggcaactacgagaccctggtgagcctggactacgccatcagcaagcccgacatcctgaccagaatcgagagaggcgaggagccctgcctggacagatggggccaggagaagggcaacgaggtggaggtgggcagacccagaatgatgggcaccggcctgcccccctaccccgagcacctgaccagccccctgagccccgcccaggaggagctgaaggagggccaggcccccaagcagcagcaggacagcgaggccagagtggcccccgccggccccgaggccggcggcggcgtggccatcaagaccgaggcccagagcgaggacgagatgacccccgagagactgttcctgggcgtgagcagaggccagaccgagtgcagaatccccagaggccccagaaacagacccggcggccccagcagacaccaggcccagggcatgcccagagtgagagccggcgagcccagaccccccggcgccagcggcgagacccccagagtgctgagcagaagaagacagagagccttcccctgccccgactgcggccagagcttcagactgaagatcaacctgaccatccaccagagaacccacgtggaggagggcagacaggaggcccccggcagaagccccaccagctgcggcgacagccaggccatgctggagcccggcgaggtggtggtgcccggccccgtgatcagatggctgcccgaggagcccgagggcagaagaagcgtggccggcggcagagccctggtgggcagaagacccgccgccagcaagatgtaccactgcagcgagtgcctgagattcttccagcagagaaagagcctgctgctgcaccagagactgcacaccggcaacggccagggctggcccgcctgcccctactgcggcaaggccttcagaagacccagcgacctgttcagacaccagagaatccacaccggcgagagaccctaccagtgcccccagtgcggcagaaccttcaacagaaaccaccacctggccgtgcacatgcagacccacgccagaggccaggtgggcccccacttccccgccgcccccgccagacacggcagcctgcccctgccctggcccagcagaaaggaggagggctag

SEQ ID NO: 10187 - DNA, 846 bp, Artificial Sequence; identical to SEQ ID NO: 10184
  Description of Artificial Sequence: Synthetic coding sequence

SEQ ID NO: 10188 - DNA, 2589 bp, Artificial Sequence
  Description of Artificial Sequence: Synthetic coding sequence
atggccaccctgaacagcgccagcaccaccggcaccacccccagccccggccacaacgcccccagcctgcccagcgacaccttcagcagcagcacccccagcgaccccgtgaccaaggacccccccgccgccagcagcaccagcgagaacatgagaagcagcgagcccggcggccagctgctggagagcggctgcggcctggtgccccccaaggagatcggcgagccccaggagggccccgactgcggccacttcccccccaacgaccccggcgtggagaaggacaaggagcaggaggaggaggaggagggcctgccccccatggacctgagcaaccacctgttcttcaccgccggcggcgaggcctacctggtggccaagctgagcctgcccggcggcagcgagctgctgctgcccaagggcttcccctggggcgaggccggcatcaaggaggagcccagcctgcccttcctggcctaccccccccccagccacctgaccgccctgcacatccagcacggcttcgaccccatccagggcttcagcagcagcgaccagatcctgagccacgacaccagcgcccccagccccgccgcctgcgaggagagacacggcgccttctggagctaccagctggcccccaacccccccggcgaccccaaggacggccccatgggcaacagcggcggcaaccacgtggccgtgttctggctgtgcctgctgtgcagactgggcttcagcaagccccaggccttcatggaccacacccagagccacggcgtgaagctgacccccgcccagtaccagggcctgagcggcagccccgccgtgctgcaggagggcgacgagggctgcaaggccctgatcagcttcctggagcccaagctgcccgccagacccagcagcgacatccccctggacaacagcagcaccgtgaacatggaggccaacgtggcccagaccgaggacggcccccccgaggccgaggtgcaggccctgatcctgctggacgaggaggtgatggccctgagcccccccagcccccccaccgccacctgggaccccagccccacccaggccaaggagagccccgtggccgccggcgaggccggccccgactggttccccgagggccaggaggaggacggcggcctgtgcccccccctgaaccagagcagccccaccagcaaggagggcggcaccctgcccgcccccgtgggcagccccgaggaccccagcgaccccccccagccctacagactggccgacgactacacccccgcccccgccgccttccagggcctgagcctgagcagccacatgagcctgctgcacagcagaaacagctgcaagaccctgaagtgccccaagtgcaactggcactacaagtaccagcagaccctggacgtgcacatgagagagaagcaccccgagagcaacagccactgcagctactgcagcgccggcggcgcccaccccagactggccagaggcgagagctacaactgcggctacaagccctacagatgcgacgtgtgcaactacagcaccaccaccaagggcaacctgagcatccacatgcagagcgacaagcacctggccaacctgcagggcttccaggccggccccggcggccagggcagcccccccgaggccagcctgccccccagcgccggcgacaaggagcccaagaccaagagcagctggcagtgcaaggtgtgcagctacgagaccaacatcagcagaaacctgagaatccacatgaccagcgagaagcacatgcagaacgtgctgatgctgcaccagggcctgcccctgggcctgccccccggcctgatgggccccggccccccccccccccccggcgccacccccaccagcccccccgagctgttccagtacttcggcccccaggccctgggccagccccagacccccctggccggccccggcctgagacccgacaagcccctggaggcccagctgctgctgaacggcttccaccacgtgggcgcccccgccagaaagttccccaccagcgcccccggcagcctgagccccgacgcccacctgccccccagccagctgctgggcagcagcagcgacagcctgcccaccagccccccccccgacgacagcctgagcctgaaggtgttcagatgcctggtgtgccaggccttcagcaccgacagcctggagctgctgctgtaccactgcagcatcggcagaagcctgcccgaggccgagtggaaggaggtggccggcgacacccacagatgcaagctgtgctgctacggcacccagctgaaggccaacttccagctgcacctgaagaccgacaagcacgcccagaagtaccagctggccgcccacctgagagagggcggcggcgccatgggcacccccagccccgccagcctgggcgacggcgccccctacggcagcgtgagccccctgcacctgagatgcaacatctgcgacttcgagagcaacagcaaggagaagatgcagctgcacgccagaggcgccgcccacgaggagaacagccagatctacaagagaaccggcaccggcctgctgatcaagtag

SEQ ID NO: 10189 - DNA, 303 bp, Artificial Sequence
  Description of Artificial Sequence: Synthetic coding sequence
atggccaccctgaacagcgccagcaccaccggcaccacccccagccccggccacaacgcccccagcctgcccagcgacaccttcagcagcagcacccccagcgaccccgtgaccaaggacccccccgccgccagcagcaccagcgagaacatgagaagcagcgagcccggcggccagctgctggagagcggctgcggcctggtgccccccaaggagatcggcgagccccaggagggccccgactgcggccacttcccccccaacgaccccggcgtggagaaggacaaggagcaggaggagtag

SEQ ID NO: 10190 - DNA, 7719 bp, Artificial Sequence
  Description of Artificial Sequence: Synthetic coding sequence
atggccaccctgaacagcgccagcaccaccggcaccacccccagccccggccacaacgcccccagcctgcccagcgacaccttcagcagcagcacccccagcgaccccgtgaccaaggacccccccgccgccagcagcaccagcgagaacatgagaagcagcgagcccggcggccagctgctggagagcggctgcggcctggtgccccccaaggagatcggcgagccccaggagggccccgactgcggccacttcccccccaacgaccccggcgtggagaaggacaaggagcaggaggaggaggaggagggcctgccccccatggacctgagcaaccacctgttcttcaccgccggcggcgaggcctacctggtggccaagctgagcctgcccggcggcagcgagctgctgctgcccaagggcttcccctggggcgaggccggcatcaaggaggagcccagcctgcccttcctggcctaccccccccccagccacctgaccgccctgcacatccagcacggcttcgaccccatccagggcttcagcagcagcgaccagatcctgagccacgacaccagcgcccccagccccgccgcctgcgaggagagacacggcgccttctggagctaccagctggcccccaacccccccggcgaccccaaggacggccccatgggcaacagcggcggcaaccacgtggccgtgttctggctgtgcctgctgtgcagactgggcttcagcaagccccaggccttcatggaccacacccagagccacggcgtgaagctgacccccgcccagtaccagggcctgagcggcagccccgccgtgctgcaggagggcgacgagggctgcaaggccctgatcagcttcctggagcccaagctgcccgccagacccagcagcgacatccccctggacaacagcagcaccgtgaacatggaggccaacgtggcccagaccgaggacggcccccccgaggccgaggtgcaggccctgatcctgctggacgaggaggtgatggccctgagcccccccagcccccccaccgccacctgggaccccagccccacccaggccaaggagagccccgtggccgccggcgaggccggccccgactggttccccgagggccaggaggaggacggcggcctgtgcccccccctgaaccagagcagccccaccagcaaggagggcggcaccctgcccgcccccgtgggcagccccgaggaccccagcgaccccccccagccctacagactggccgacgactacacccccgcccccgccgccttccagggcctgagcctgagcagccacatgagcctgctgcacagcagaaacagctgcaagaccctgaagtgccccaagtgcaactggcactacaagtaccagcagaccctggacgtgcacatgagagagaagcaccccgagagcaacagccactgcagctactgcagcgccggcggcgcccaccccagactggccagaggcgagagctacaactgcggctacaagccctacagatgcgacgtgtgcaactacagcaccaccaccaagggcaacctgagcatccacatgcagagcgacaagcacctggccaacctgcagggcttccaggccggccccggcggccagggcagcccccccgaggccagcctgccccccagcgccggcgacaaggagcccaagaccaagagcagctggcagtgcaaggtgtgcagctacgagaccaacatcagcagaaacctgagaatccacatgaccagcgagaagcacatgcagaacgtgctgatgctgcaccagggcctgcccctgggcctgccccccggcctgatgggccccggccccccccccccccccggcgccacccccaccagcccccccgagctgttccagtacttcggcccccaggccctgggccagccccagacccccctggccggccccggcctgagacccgacaagcccctggaggcccagctgctgctgaacggcttccaccacgtgggcgcccccgccagaaagttccccaccagcgcccccggcagcctgagccccgacgcccacctgccccccagccagctgctgggcagcagcagcgacagcctgcccaccagccccccccccgacgacagcctgagcctgaaggtgttcagatgcctggtgtgccaggccttcagcaccgacagcctggagctgctgctgtaccactgcagcatcggcagaagcctgcccgaggccgagtggaaggaggtggccggcgacacccacagatgcaagctgtgctgctacggcacccagctgaaggccaacttccagctgcacctgaagaccgacaagcacgcccagaagtaccagctggccgcccacctgagagagggcggcggcgccatgggcacccccagccccgccagcctgggcgacggcgccccctacggcagcgtgagccccctgcacctgagatgcaacatctgcgacttcgagagcaacagcaaggagaagatgcagctgcacgccagaggcgccgcccacgaggagaacagccagatctacaagttcctgctggacatggagggcgccgaggccggcgccgagctgggcctgtaccactgcctgctgtgcgcctgggagacccccagcagactggccgtgctgcagcacctgagaacccccgcccacagagacgcccaggcccagagaagactgcagctgctgcagaacggccccaccaccgaggagggcctggccgccctgcagagcatcctgagcttcagccacggccagctgagaacccccggcaaggcccccgtgacccccctggccgagccccccacccccgagaaggacgcccagaacaagaccgagcagctggccagcgaggagaccgagaacaagaccggccccagcagagacagcgccaaccagaccaccgtgtactgctgcccctactgcagcttcctgagccccgagagcagccaggtgagagcccacaccctgagccagcacgccgtgcagcccaagtacagatgccccctgtgccaggagcagctggtgggcagacccgccctgcacttccacctgagccacctgcacaacgtggtgcccgagtgcgtggagaagctgctgctggtggccaccaccgtggagatgaccttcaccaccaaggtgctgagcgcccccaccctgagccccctggacaacggccaggagccccccacccacggccccgagcccacccccagcagagaccaggccgccgagggccccaacctgacccccgaggccagccccgaccccctgcccgagccccccctggccagcgtggaggtgcccgacaagcccagcggcagccccggccagccccccagccccgcccccagccccgtgcccgagcccgacgcccaggccgaggacgtggcccccccccccaccatggccgaggaggaggagggcaccaccggcgagctgagaagcgccgagcccgcccccgccgacagcagacaccccctgacctacagaaagaccaccaacttcgccctggacaagttcctggaccccgccagaccctacaagtgcaccgtgtgcaaggagagcttcacccagaagaacatcctgctggtgcactacaacagcgtgagccacctgcacaagatgaagaaggccgccatcgaccccagcgcccccgccagaggcgaggccggcgccccccccaccaccaccgccgccaccgacaagcccttcaagtgcaccgtgtgcagagtgagctacaaccagagcagcaccctggagatccacatgagaagcgtgctgcaccagaccagaagcagaggcaccaagaccgacagcaagatcgagggccccgagagaagccaggaggagcccaaggagggcgagaccgagggcgaggtgggcaccgagaagaagggccccgacaccagcggcttcatcagcggcctgcccttcctgagccccccccccccccccctggacctgcacagattccccgcccccctgttcaccccccccgtgctgccccccttccccctggtgcccgagagcctgctgaagctgcagcagcagcagctgctgctgcccttctacctgcacgacctgaaggtgggccccaagctgaccctggccggccccgcccccgtgctgagcctgcccgccgccaccccccccccccccccccagccccccaaggccgagctggccgagagagagtgggagagaccccccatggccaaggagggcaacgaggccggccccagcagcccccccgaccccctgcccaacgaggccgccagaaccgccgccaaggccctgctggagaacttcggcttcgagctggtgatccagtacaacgagggcaagcaggccgtgccccccccccccaccccccccccccccgaggccctgggcggcggcgacaagctggcctgcggcgcctgcggcaagctgttcagcaacatgctgatcctgaagacccacgaggagcacgtgcacagaagattcctgcccttcgaggccctgagcagatacgccgcccagttcagaaagagctacgacagcctgtacccccccctggccgagccccccaagccccccgacggcagcctggacagccccgtgccccacctgggcccccccttcctggtgcccgagcccgaggccggcggcaccagagcccccgaggagagaagcagagccggcggccactggcccatcgaggaggaggagagcagcagaggcaacctgccccccctggtgcccgccggcagaagattcagcagaaccaagttcaccgagttccagacccaggccctgcagagcttcttcgagaccagcgcctaccccaaggacggcgaggtggagagactggccagcctgctgggcctggccagcagagtggtggtggtgtggttccagaacgccagacagaaggccagaaagaacgcctgcgagggcggcagcatgcccaccggcggcggcaccggcggcgccagcggctgcagaagatgccacgccaccttcagctgcgtgttcgagctggtgagacacctgaagaagtgctacgacgaccagaccctggaggaggaggaggaggaggccgagagaggcgaggaggaggaggaggtggaggaggaggaggtggaggaggagcagggcctggagccccccgccggccccgagggccccctgcccgagccccccgacggcgaggagctgagccaggccgaggccaccaaggccggcggcaaggagcccgaggagaaggccacccccagccccagccccgcccacacctgcgaccagtgcgccatcagcttcagcagccaggacctgctgaccagccacagaagactgcacttcctgcccagcctgcagcccagcgcccccccccagctgctggacctgcccctgctggtgttcggcgagagaaaccccctggtggccgccaccagccccatgcccggcccccccctgaagagaaagcacgaggacggcagcctgagccccaccggcagcgaggccggcggcggcggcgagggcgagccccccagagacaagagactgagaaccaccatcctgcccgagcagctggagatcctgtacagatggtacatgcaggacagcaaccccaccagaaagatgctggactgcatcagcgaggaggtgggcctgaagaagagagtggtgcaggtgtggttccagaacaccagagccagagagagaaagggccagttcagaagcacccccggcggcgtgcccagccccgccgtgaagccccccgccaccgccacccccgccagcctgcccaagttcaacctgctgctgggcaaggtggacgacggcaccggcagagaggcccccaagagagaggcccccgccttcccctaccccaccgccaccctggccagcggcccccagcccttcctgccccccggcaaggaggccaccacccccacccccgagccccccctgcccctgctgcccccccccccccccagcgaggaggagggccccgaggagccccccaaggccagccccgagagcgaggcctgcagcctgagcgccggcgacctgagcgacagcagcgccagcagcctggccgagcccgagagccccggcgccggcggcaccagcggcggccccggcggcggcaccggcgtgcccgacggcatgggccagagaagatacagaacccagatgagcagcctgcagctgaagatcatgaaggcctgctacgaggcctacagaacccccaccatgcaggagtgcgaggtgctgggcgaggagatcggcctgcccaagagagtgatccaggtgtggttccagaacgccagagccaaggagaagaaggccaagctgcagggcaccgccgccggcagcaccggcggcagcagcgagggcctgctggccgcccagagaaccgactgcccctactgcgacgtgaagtacgacttctacgtgagctgcagaggccacctgttcagcagacagcacctggccaagctgaaggaggccgtgagagcccagctgaagagcgagagcaagtgctacgacctggcccccgcccccgaggccccccccgccctgaaggccccccccgccaccacccccgccagcatgcccctgggcgccgcccccaccctgcccagactggcccccgtgctgctgagcggccccgccctggcccagccccccctgggcaacctggcccccttcaacagcggccccgccgccagcagcggcctgctgggcctggccaccagcgtgctgcccaccaccaccgtggtgcagaccgccggccccggcagacccctgccccagagacccatgcccgaccagaccaacaccagcaccgccggcaccaccgaccccgtgcccggcccccccaccgagcccctgggcgacaaggtgagcagcgagagaaagcccgtggccggccccaccagcagcagcaacgacgccctgaagaacctgaaggccctgaagaccaccgtgcccgccctgctgggcggccagttcctgcccttccccctgccccccgccggcggcaccgccccccccgccgtgttcggcccccagctgcagggcgcctacttccagcagctgtacggcatgaagaagggcctgttccccatgaaccccatgatcccccagaccctgatcggcctgctgcccaacgccctgctgcagccccccccccagccccccgagcccaccgccaccgccccccccaagccccccgagctgcccgcccccggcgagggcgaggccggcgaggtggacgagctgctgaccggcagcaccggcatcagcaccgtggacgtgacccacagatacctgtgcagacagtgcaagatggccttcgacggcgaggcccccgccaccgcccaccagagaagcttctgcttcttcggcagaggcagcggcggcagcatgcccccccccctgagagtgcccatctgcacctaccactgcctggcctgcgaggtgctgctgagcggcagagaggccctggccagccacctgagaagcagcgcccacagaagaaaggccgcccccccccagggcggcccccccatcagcatcaccaacgccgccaccgccgccagcgccgccgtggccttcgccaaggaggaggccagactgccccacaccgacagcaaccccaagaccaccaccaccagcaccctgctggccctgtag

SEQ ID NO: 10191 - DNA, 1227 bp, Artificial Sequence
  Description of Artificial Sequence: Synthetic coding sequence
atggccaccctgaacagcgccagcaccaccggcaccacccccagccccggccacaacgcccccagcctgcccagcgacaccttcagcagcagcacccccagcgaccccgtgaccaaggacccccccgccgccagcagcaccagcgagaacatgagaagcagcgagcccggcggccagctgctggagagcggctgcggcctggtgccccccaaggagatcggcgagccccaggagggccccgactgcggccacttcccccccaacgaccccggcgtggagaaggacaaggagcaggaggaggaggaggagggcctgccccccatggacctgagcaaccacctgttcttcaccgccggcggcgaggcctacctggtggccaagctgagcctgcccggcggcagcgagctgctgctgcccaagggcttcccctggggcgaggccggcatcaaggaggagcccagcctgcccttcctggcctaccccccccccagccacctgaccgccctgcacatccagcacggcttcgaccccatccagggcttcagcagcagcgaccagatcctgagccacgacaccagcgcccccagccccgccgcctgcgaggagagacacggcgccttctggagctaccagctggcccccaacccccccggcgaccccaaggacggccccatgggcaacagcggcggcaaccacgtggccgtgttctggctgtgcctgctgtgcagactgggcttcagcaagccccaggccttcatggaccacacccagagccacggcgtgaagctgacccccgcccagtaccagggcctgagcggcagccccgccgtgctgcaggagggcgacgagggctgcaaggccctgatcagcttcctggagcccaagctgcccgccagacccagcagcgacatccccctggacaacagcagcaccgtgaacatggaggccaacgtggcccagaccgaggacggcccccccgaggccgaggtgcaggccctgatcctgctggacgaggaggtgatggccctgagcccccccagcccccccaccgccacctggggctacaccaccgcctgctgcgtgagaggcagacacccccccgcctggctgtgctgcaacacctgcgcccacctgcccaccgccatgcccagacccagaggcgtgtgcagctgctacagaatggcccagcccctgagaaaggacagccagctgttcagagccagctag

SEQ ID NO: 10192 - DNA, 741 bp, Artificial Sequence
  Description of Artificial Sequence: Synthetic coding sequence
atggccaccctgaacagcgccagcaccaccggcaccacccccagccccggccacaacgcccccagcctgcccagcgacaccttcagcagcagcacccccagcgaccccgtgaccaaggacccccccgccgccagcagcaccagcgagaacatgagaagcagcgagcccggcggccagctgctggagagcggctgcggcctggtgccccccaaggagatcggcgagccccaggagggccccgactgcggccacttcccccccaacgaccccggcgtggagaaggacaaggagcaggaggaggaggaggagggcctgccccccatggacctgagcaaccacctgttcttcaccgccggcggcgaggcctacctggtggccaagctgagcctgcccggcggcagcgagctgctgctgcccaagggcttcccctggggcgaggccggcatcaaggaggagcccagcctgcccttcctggcctaccccccccccagccacctgaccgccctgcacatccagcacggcttcgaccccatccagggcttcagcagcagcgaccagatcctgagccacgacaccagcgcccccagccccgccgcctgcgaggagagacacggcgccttctggagctaccagctggcccccaacccccccggcgaccccaaggacggccccatgggcaacagcggcggcaaccacgtggccgtgttctggctgtgcctgctgtgcagactgggcttctag

SEQ ID NO: 10193 - DNA, 1563 bp, Artificial Sequence
  Description of Artificial Sequence: Synthetic coding sequence
atgagccagctgagcctgagctggctgggcctgtggcccgtggccgccagcccctggctgctgctgctgctggtgggcgccagctggctgctggcccacgtgctggcctggacctacgccttctacgacaactgcagaagactgagatgcttcccccagccccccagaagaaactggttctggggccaccagggcatggtgaaccccaccgaggagggcatgagagtgctgacccagctggtggccacctacccccagggcttcaaggtgtggatgggccccatcagccccctgctgagcctgtgccaccccgacatcatcagaagcgtgatcaacgccagcgccgccatcgcccccaaggacaagttcttctacagcttcctggagccctggctgggcgacggcctgctgctgagcgccggcgacaagtggagcagacacagaagaatgctgacccccgccttccacttcaacatcctgaagccctacatgaagatcttcaacgagagcgtgaacatcatgcacgccaagtggcagctgctggccagcgagggcagcgcctgcctggacatgttcgagcacatcagcctgatgaccctggacagcctgcagaagtgcgtgttcagcttcgacagccactgccaggagaagcccagcgagtacatcgccgccatcctggagctgagcgccctggtgagcaagagacaccacgagatcctgctgcacatcgacttcctgtactacctgacccccgacggccagagattcagaagagcctgcagactggtgcacgacttcaccgacgccgtgatccaggagagaagaagaaccctgcccagccagggcgtggacgacttcctgcaggccaaggccaagagcaagaccctggacttcatcgacgtgctgctgctgagcaaggacgaggacggcaagaagctgagcgacgaggacatcagagccgaggccgacaccttcatgttcgagggccacgacaccaccgccagcggcctgagctgggtgctgtaccacctggccaagcaccccgagtaccaggagagatgcagacaggaggtgcaggagctgctgaaggacagagagcccaaggagatcgagtgggacgacctggcccacctgcccttcctgaccatgtgcatgaaggagagcctgagactgcacccccccgtgcccgtgatcagcagacacgtgacccaggacatcgtgctgcccgacggcagagtgatccccaagggcatcatctgcctgatcagcgtgttcggcacccaccacaaccccgccgtgtggcccgaccccgaggtgtacgaccccttcagattcgaccccgagaacatcaaggagagaagccccctggccttcatccccttcagcgccggccccagaaactgcatcggccagaccttcgccatggccgagatgaaggtggtgctggccctgaccctgctgagattcagagtgctgcccgaccacaccgagcccagaagaaagcccgagctggtgctgagagccgagggcggcctgtggctgagagtggagcccctgagctag

SEQ ID NO: 10194 - DNA, 1584 bp, Artificial Sequence
  Description of Artificial Sequence: Synthetic coding sequence
atgtaccagcccgaggacgacaacaacagcgacgtgaccagcgacgacgacatgaccagaaacagaagagagagcagccccccccacagcgtgcacagcttcagcggcgacagagactgggacagaagaggcagaagcagagacatggagcccagagacagatggagccacaccagaaaccccagaagcagaatgccccccagagacctgagcctgcccgtggtggccaagaccagcttcgagatggacagagaggacgacagagacagcagagcctacgagagcagaagccaggacgccgagagctaccagaacgtggtggacctggccgaggacagaaagccccacaacaccatccaggacaacatggagaactacagaaagctgctgagcctgggcttcctggcccaggacagcgtgcccgccgagaagagaaacaccgagatgctggacaacctgcccagcgccggcagccagttccccgacttcaagcacctgggcaccttcctggtgttcgaggagctggtgaccttcgaggacgtgctggtggacttcagccccgaggagctgagcagcctgagcgccgcccagagaaacctgtacagagaggtgatgctggagaactacagaaacctggtgagcctgggccaccagttcagcaagcccgacatcatcagcagactggaggaggaggagagctacgccatggagaccgacagcagacacaccgtgatctgccagggcgagagccacgacgaccccctggagccccaccagggcaaccaggagaagctgctgacccccatcaccatgaacgaccccaagaccctgacccccgagagaagctacggcagcgacgagttcgagagaagcagcaacctgagcaagcagagcaaggaccccctgggcaaggacccccaggagggcaccgcccccggcatctgcaccagcccccagagcgccagccaggagaacaagcacaacagatgcgagttctgcaagagaaccttcagcacccaggtggccctgagaagacacgagagaatccacaccggcaagaagccctacgagtgcaagcagtgcgccgaggccttctacctgatgccccacctgaacagacaccagaagacccacagcggcagaaagaccagcggctgcaacgagggcagaaagcccagcgtgcagtgcgccaacctgtgcgagagagtgagaatccacagccaggaggactacttcgagtgcttccagtgcggcaaggccttcctgcagaacgtgcacctgctgcagcacctgaaggcccacgaggccgccagagtgctgccccccggcctgagccacagcaagacctacctgatcagataccagagaaagcacgactacgtgggcgagagagcctgccagtgctgcgactgcggcagagtgttcagcagaaacagctacctgatccagcactacagaacccacacccaggagagaccctaccagtgccagctgtgcggcaagtgcttcggcagacccagctacctgacccagcactaccagctgcacagccaggagaagaccgtggagtgcgaccactgctag

SEQ ID NO: 10195 - DNA, 1584 bp, Artificial Sequence; identical to SEQ ID NO: 10194
  Description of Artificial Sequence: Synthetic coding sequence

SEQ ID NO: 10196 - DNA, 1584 bp, Artificial Sequence; identical to SEQ ID NO: 10194
  Description of Artificial Sequence: Synthetic coding sequence

SEQ ID NO: 10197 - DNA, 1584 bp, Artificial Sequence; identical to SEQ ID NO: 10194
  Description of Artificial Sequence: Synthetic coding sequence

SEQ ID NO: 10198 - DNA, 1707 bp, Artificial Sequence
  Description of Artificial Sequence: Synthetic coding sequence
atggccagactgaccaagagaagacaggccgacaccaaggccatccagcacctgtgggccgccatcgagatcatcagaaaccagaagcagatcgccaacatcgacagaatcaccaagtacatgagcagagtgcacggcatgcaccccaaggagaccaccagacagctgagcctggccgtgaaggacggcctgatcgtggagaccctgaccgtgggctgcaagggcagcaaggccggcatcgagcaggagggctactggctgcccggcgacgagatcgactgggagaccgagaaccacgactggtactgcttcgagtgccacctgcccggcgaggtgctgatctgcgacctgtgcttcagagtgtaccacagcaagtgcctgagcgacgagttcagactgagagacagcagcagcccctggcagtgccccgtgtgcagaagcatcaagaagaagaacaccaacaagcaggagatgggcacctacctgagattcatcgtgagcagaatgaaggagagagccatcgacctgaacaagaagggcaaggacaacaagcaccccatgtacagaagactggtgcacagcgccgtggacgtgcccaccatccaggagaaggtgaacgagggcaagtacagaagctacgaggagttcaaggccgacgcccagctgctgctgcacaacaccgtgatcttctacggcgccgacagcgagcaggccgacatcgccagaatgctgtacaaggacacctgccacgagctggacgagctgcagctgtgcaagaactgcttctacctgagcaacgccagacccgacaactggttctgctacccctgcatccccaaccacgagctggtgtgggccaagatgaagggcttcggcttctggcccgccaaggtgatgcagaaggaggacaaccaggtggacgtgagattcttcggccaccaccaccagagagcctggatccccagcgagaacatccaggacatcaccgtgaacatccacagactgcacgtgaagagaagcatgggctggaagaaggcctgcgacgagctggagctgcaccagagattcctgagagagggcagattctggaagagcaagaacgaggacagaggcgaggaggaggccgagagcagcatcagcagcaccagcaacgagcagctgaaggtgacccaggagcccagagccaagaagggcagaagaaaccagagcgtggagcccaagaaggaggagcccgagcccgagaccgaggccgtgagcagcagccaggagatccccaccatgccccagcccatcgagaaggtgagcgtgagcacccagaccaagaagctgagcgccagcagccccagaatgctgcacagaagcacccagaccaccaacgacggcgtgtgccagagcatgtgccacgacaagtacaccaagatcttcaacgacttcaaggacagaatgaagagcgaccacaagagagagaccgagagagtggtgagagaggccctggagaagctgagaagcgagatggaggaggagaagagacaggccgtgaacaaggccgtggccaacatgcagggcgagatggacagaaagtgcaagcaggtgaaggagaagtgcaaggaggagttcgtggaggagatcaagaagctggccacccagcacaagcagctgatcagccagaccaagaagaagcagtgggtgaacaccagcctgttctag

SEQ ID NO: 10199 - DNA, 1224 bp, Artificial Sequence
  Description of Artificial Sequence: Synthetic coding sequence
atgaacaagagccagggcagcgtgagcttcaccgacgtgaccgtggacttcacccaggaggagtgggagcagctggaccccagccagagaatcctgtacatggacgtgatgctggagaactacagcaacctgctgagcgtggaggtgtggaaggccgacgaccagatggagagagaccacagaaaccccgacgagcaggccagacagttcctgatcctgaagaaccagacccccatcgaggagagaggcgacctgttcggcaaggccctgaacctgaacaccgacttcgtgagcctgagacaggtgccctacaagtacgacctgtacgagaagaccctgaagtacaacagcgacctgctgaacagcaacagaagctacgccggcaagcagaccgacgagtgcaacgagttcggcaaggccctgctgtacctgaagcaggagaagacccacagcggcgtggagtacagcgagtacaacaagagcggcaaggccctgagccacaaggccgccatcttcaagcaccagaagatcaagaacctggtgcagcccttcatctgcacctactgcgacaaggccttcagcttcaagagcctgctgatcagccacaagagaatccacaccggcgagaagccctacgagtgcaacgtgtgcaagaagaccttcagccacaaggccaacctgatcaagcaccagagaatccacaccggcgagaagcccttcgagtgccccgagtgcggcaaggccttcacccaccagagcaacctgatcgtgcaccagagagcccacatggagaagaagccctacgagtgcagcgagtgcggcaagaccttcgcccagaagttcgagctgaccacccaccagagaatccacaccggcgagagaccctacgagtgcaacgagtgcgccaagaccttcttcaagaagagcaacctgatcatccaccagaagatccacaccggcgagaagagatacgagtgcagcgagtgcggcaagagcttcatccagaacagccagctgatcatccacatgagaacccacaccggcgagaagccctacgagtgcaccgagtgcggcaagaccttcagccagagaagcaccctgagactgcacctgagaatccacaccggcgagaagccctacgagtgcagcgagtgcggcaaggccttcagcagaaagagcagactgagcgtgcaccagagagtgcacatcggcgagaagccctag

SEQ ID NO: 10200 - DNA, 1224 bp, Artificial Sequence; identical to SEQ ID NO: 10199
  Description of Artificial Sequence: Synthetic coding sequence

SEQ ID NO: 10201 - DNA, 1602 bp, Artificial Sequence
  Description of Artificial Sequence: Synthetic coding sequence
atggcccacggcagcgtgaccttcagagacgtggccatcgacttcagccaggaggagtgggagttcctggaccccgcccagagagacctgtacagagacgtgatgtgggagaactacagcaacttcatcagcctgggccccagcatcagcaagcccgacgtgatcaccctgctggacgaggagagaaaggagcccggcatggtggtgagagagggcaccagaagatactgccccgacctggagagcagatacagaaccaacaccctgagccccgagaaggacatctacgagatctacagcttccagtgggacatcatggagagaatcaagagctacagcctgcagggcagcatcttcagaaacgactgggagtgcaagagcaagatcgagggcgagaaggagcagcaggagggctacttcggccaggtgaagatcaccagcgagaagatgaccacctacaagagacacaacttcctgaccgagtaccagatcgtgcacaacggcgagaaggtgtacgagtgcaaggagtgcagaaagaccttcatcagaagaagcaccctgagccagcacctgagaatccacaccggcgagaagccctacaagtgcaaggagtgcggccaggccttcagacagagagcccacctgatcagacaccacaagctgcacaccggcgagaagccctacgagtgcaaggagtgcggcaaggccttcaccgtgctgcaggagctgacccagcaccagagactgcacaccggcgagaagccctacgagtgcaaggagtgcggcaaggccttcagagtgcaccagcagctggccagacaccagagaatccacaccggcgagaagccctacgagtgcaaggactgcggcaagaccttcagacagtgcacccacctgaccagacaccagagactgcacaccgccgagaagctgtacgagtgcaaggagtgcggcaaggccttcgtgtgcggccccgacctgagagtgcaccagaagatccacttcggcgagaagccctacgagtgcaaggagtgcggcaaggccttcagaatctgccagcagctgaccgtgcaccagagcatccacaccggcgagaagccctacgagtgcaaggagtgcggcaagaccttcagactgagacagcagctggtgagacaccagagaatccacaccagagagaagccctacgagtgcatggagtgctggaagaccttcagcagctacagccagctgatcagccaccagagcatccacatcggcgagagaccctacgagtgcgaggagtgcggcaaggccttcagactgctgagccagctgacccagcaccagagcatccacaccggcgagaagccctacgagtgcaaggagtgcagaaagcccttcagactgctgagccagctgacccagcaccagagcatccacaccggcgagaagccctacgagtgcaaggagtgcggcaaggccttcagactgtacagcttcctgacccagcaccagagaatccacaccggcgagaagccctacaagtgcaaggagtgcaagaaggccttcagacagcacagccacctgacccagcaccagaagatccacaacggcatctag

SEQ ID NO: 10202 - DNA, 1602 bp, Artificial Sequence
  Description of Artificial Sequence: Synthetic coding sequence
gtggcccacggcagcgtgaccttcagagacgtggccatcgacttcagccaggaggagtgggagttcctggaccccgcccagagagacctgtacagagacgtgatgtgggagaactacagcaacttcatcagcctgggccccagcatcagcaagcccgacgtgatcaccctgctggacgaggagagaaaggagcccggcatggtggtgagagagggcaccagaagatactgccccgacctggagagcagatacagaaccaacaccctgagccccgagaaggacatctacgagatctacagcttccagtgggacatcatggagagaatcaagagctacagcctgcagggcagcatcttcagaaacgactgggagtgcaagagcaagatcgagggcgagaaggagcagcaggagggctacttcggccaggtgaagatcaccagcgagaagatgaccacctacaagagacacaacttcctgaccgagtaccagatcgtgcacaacggcgagaaggtgtacgagtgcaaggagtgcagaaagaccttcatcagaagaagcaccctgagccagcacctgagaatccacaccggcgagaagccctacaagtgcaaggagtgcggccaggccttcagacagagagcccacctgatcagacaccacaagctgcacaccggcgagaagccctacgagtgcaaggagtgcggcaaggccttcaccgtgctgcaggagctgacccagcaccagagactgcacaccggcgagaagccctacgagtgcaaggagtgcggcaaggccttcagagtgcaccagcagctggccagacaccagagaatccacaccggcgagaagccctacgagtgcaaggactgcggcaagaccttcagacagtgcacccacctgaccagacaccagagactgcacaccgccgagaagctgtacgagtgcaaggagtgcggcaaggccttcgtgtgcggccccgacctgagagtgcaccagaagatccacttcggcgagaagccctacgagtgcaaggagtgcggcaaggccttcagaatctgccagcagctgaccgtgcaccagagcatccacaccggcgagaagccctacgagtgcaaggagtgcggcaagaccttcagactgagacagcagctggtgagacaccagagaatccacaccagagagaagccctacgagtgcatggagtgctggaagaccttcagcagctacagccagctgatcagccaccagagcatccacatcggcgagagaccctacgagtgcgaggagtgcggcaaggccttcagactgctgagccagctgacccagcaccagagcatccacaccggcgagaagccctacgagtgcaaggagtgcagaaagcccttcagactgctgagccagctgacccagcaccagagcatccacaccggcgagaagccctacgagtgcaaggagtgcggcaaggccttcagactgtacagcttcctgacccagcaccagagaatccacaccggcgagaagccctacaagtgcaaggagtgcaagaaggccttcagacagcacagccacctgacccagcaccagaagatccacaacggcatctag

SEQ ID NO: 10203 - DNA, 2265 bp, Artificial Sequence
  Description of Artificial Sequence: Synthetic coding sequence
atgaccaccgccggcagaggcaacctgggcctgatccccagaagcaccgccttccagaagcaggagggcagactgaccgtgaagcaggagcccgccaaccagacctggggccagggcagcagcctgcagaagaactacccccccgtgtgcgagatcttcagactgcacttcagacagctgtgctaccacgagatgagcggcccccaggaggccctgagcagactgagagagctgtgcagatggtggctgatgcccgaggtgcacaccaaggagcagatcctggagctgctggtgctggagcagttcctgagcatcctgcccggcgagctgagaacctgggtgcagctgcaccaccccgagagcggcgaggaggccgtggccgtggtggaggacttccagagacacctgagcggcagcgaggaggtgagcgcccccgcccagaagcaggagatgcacttcgaggagaccaccgccctgggcaccaccaaggagagcccccccaccagccccctgagcggcggcagcgcccccggcgcccacctggagcccccctacgaccccggcacccaccacctgcccagcggcgacttcgcccagtgcaccagccccgtgcccaccctgccccaggtgggcaacagcggcgaccaggccggcgccaccgtgctgagaatggtgagaccccaggacaccgtggcctacgaggacctgagcgtggactacacccagaagaagtggaagagcctgaccctgagccagagagccctgcagtggaacatgatgcccgagaaccaccacagcatggccagcctggccggcgagaacatgatgaagggcagcgagctgacccccaagcaggagttcttcaagggcagcgagagcagcaacagaaccagcggcggcctgttcggcgtggtgcccggcgccgccgagaccggcgacgtgtgcgaggacaccttcaaggagctggagggccagaccagcgacgaggagggcagcagactggagaacgacttcctggagatcaccgacgaggacaagaagaagagcaccaaggacagatacgacaagtacaaggaggtgggcgagcacccccccctgagcagcagccccgtggagcacgagggcgtgctgaagggccagaagagctacagatgcgacgagtgcggcaaggccttcaacagaagcagccacctgatcggccaccagagaatccacaccggcgagaagccctacgagtgcaacgagtgcggcaagaccttcagacagaccagccagctgatcgtgcacctgagaacccacaccggcgagaagccctacgagtgcagcgagtgcggcaaggcctacagacacagcagccacctgatccagcaccagagactgcacaacggcgagaagccctacaagtgcaacgagtgcgccaaggccttcacccagagcagcagactgaccgaccaccagagaacccacaccggcgagaagccctacgagtgcaacgagtgcggcgaggccttcatcagaagcaagagcctggccagacaccaggtgctgcacaccggcaagaagccctacaagtgcaacgagtgcggcagagccttctgcagcaacagaaacctgatcgaccaccagagaatccacaccggcgagaagccctacgagtgcagcgagtgcggcaaggccttcagcagaagcaagtgcctgatcagacaccagagcctgcacaccggcgagaagccctacaagtgcagcgagtgcggcaaggccttcaaccagaacagccagctgatcgagcacgagagaatccacaccggcgagaagcccttcgagtgcagcgagtgcggcaaggccttcggcctgagcaagtgcctgatcagacaccagagactgcacaccggcgagaagccctacaagtgcaacgagtgcggcaagagcttcaaccagaacagccacctgatcatccaccagagaatccacaccggcgagaagccctacgagtgcaacgagtgcggcaaggtgttcagctacagcagcagcctgatggtgcaccagagaacccacaccggcgagaagccctacaagtgcaacgactgcggcaaggccttcagcgacagcagccagctgatcgtgcaccagagagtgcacaccggcgagaagccctacgagtgcagcgagtgcggcaaggccttcagccagagaagcaccttcaaccaccaccagagaacccacaccggcgagaagagcagcggcctggcctggagcgtgagctag

SEQ ID NO: 10204 - DNA, 612 bp, Artificial Sequence
  Description of Artificial Sequence: Synthetic coding sequence
agcaagtgcctgatcagacaccagagcctgcacaccggcgagaagccctacaagtgcagcgagtgcggcaaggccttcaaccagaacagccagctgatcgagcacgagagaatccacaccggcgagaagcccttcgagtgcagcgagtgcggcaaggccttcggcctgagcaagtgcctgatcagacaccagagactgcacaccggcgagaagccctacaagtgcaacgagtgcggcaagagcttcaaccagaacagccacctgatcatccaccagagaatccacaccggcgagaagccctacgagtgcaacgagtgcggcaaggtgttcagctacagcagcagcctgatggtgcaccagagaacccacaccggcgagaagccctacaagtgcaacgactgcggcaaggccttcagcgacagcagccagctgatcgtgcaccagagagtgcacaccggcgagaagccctacgagtgcagcgagtgcggcaaggccttcagccagagaagcaccttcaaccaccaccagagaacccacaccggcgaggtgctgagaagcggcctggtgagcttcctgagatacggcagcgagaccgagagcaacgacctgtag

SEQ ID NO: 10205 - DNA, 831 bp, Artificial Sequence
  Description of Artificial Sequence: Synthetic coding sequence
atgaccaccgccggcagaggcaacctgggcctgatccccagaagcaccgccttccagaagcaggagggcagactgaccgtgaagcaggagcccgccaaccagacctggggccagggcagcagcctgcagaagaactacccccccgtgtgcgagatcttcagactgcacttcagacagctgtgctaccacgagatgagcggcccccaggaggccctgagcagactgagagagctgtgcagatggtggctgatgcccgaggtgcacaccaaggagcagatcctggagctgctggtgctggagcagttcctgagcatcctgcccggcgagctgagaacctgggtgcagctgcaccaccccgagagcggcgaggaggccgtggccgtggtggaggacttccagagacacctgagcggcagcgaggaggtgagcgcccccgcccagaagcaggagatgcacttcgaggagaccaccgccctgggcaccaccaaggagagcccccccaccagccccctgagcggcggcagcgcccccggcgcccacctggagcccccctacgaccccggcacccaccacctgcccagcggcgacttcgcccagtgcaccagccccgtgcccaccctgccccaggtgggcaacagcggcgaccaggccggcgccaccgtgctgagaatggtgagaccccaggacaccgtggcctacgaggacctgagcgtggactacacccagaagaagtggaagagcctgaccctgagccagagagccctgcagtggaacatgatgcccgagaaccaccacagcatggccagcctgggctggagcaccatggcctag

SEQ ID NO: 10206 - DNA, 2265 bp, Artificial Sequence; identical to SEQ ID NO: 10203
  Description of Artificial Sequence: Synthetic coding sequence

SEQ ID NO: 10207 - DNA, 831 bp, Artificial Sequence; identical to SEQ ID NO: 10205
  Description of Artificial Sequence: Synthetic coding sequence

SEQ ID NO: 10208 - DNA, 1989 bp, Artificial Sequence
  Description of Artificial Sequence: Synthetic coding sequence
atgaacctgaccgaggactacatggtgttcgaggacgtggccatccacttcagccaggaggagtggggcatcctgaacgacgtgcagagacacctgcacagcgacgtgatgctggagaacttcgccctgctgagcagcgtgggctgctggcacggcgccaaggacgaggaggcccccagcaagcagtgcgtgagcgtgggcgtgagccaggtgaccaccctgaagcccgccctgagcacccagaaggcccagccctgcgagacctgcagcagcctgctgaaggacatcctgcacctggccgagcacgacggcacccaccccaagagaaccgccaagctgtacctgcaccagaaggagcacctgagagagaagctgaccagaagcgacgagggcagacccagcttcgtgaacgacagcgtgcacctggccaagagaaacctgacctgcatgcagggcggcaaggacttcaccggcgacagcgacctgcagcagcaggccctgcacagcggctggaagccccacagagacacccacggcgtggaggccttccagagcggccagaacaactacagctgcacccagtgcggcaaggacttctgccaccagcacaccctgttcgagcaccagaagatccacaccgaggagagaccctacgagtgcagcgagtgcggcaagctgttcagatacaacagcgacctgatcaagcaccagagaaaccacaccggcgagagaccctacaagtgcagcgagtgcggcaaggccttcagcctgaagtacaacgtggtgcagcaccagaagatccacaccggcgagagaccctacgagtgcagcgagtgcggcaaggccttcctgagaaagagccacctgctgcagcaccagagaatccacaccagacccagaccctacgtgtgcagcgagtgcggcaaggccttcctgacccaggcccacctggtgggccaccagaagatccacaccggcgagagaccctacggctgcaacgagtgcggcaagtacttcatgtacagcagcgccctgatcagacaccagaaggtgcacaccggcgagagacccttctactgctgcgagtgcggcaagttcttcatggacagctgcaccctgatcatccaccagagagtgcacaccggcgagaagccctacgagtgcaacgagtgcggcaagttcttcagatacagaagcaccctgatcagacaccagaaggtgcacaccggcgagaagccctacgagtgcagcgagtgcggcaagttcttcatggacaccagcaccctgatcatccaccagagagtgcacaccggcgagaagccctacgagtgcaacaagtgcggcaagttcttcagatactgcttcaccctgaacagacaccagagagtgcacagcggcgagagaccctacgagtgcagcgagtgcggcaagttcttcgtggacagctgcaccctgaagagccaccagagagtgcacaccggcgagagacccttcgagtgcagcatctgcggcaagagcttcagatgcagaagcaccctggacacccaccagagaatccacaccggcgagagaccctacgagtgcagcgagtgcggcaagttcttcagacacaacagcaaccacatcagacacagaagaaaccacttcggcgagagaagcttcgagtgcaccgagtgcggcagagtgttcagccagaacagccacctgatcagacaccagaaggtgcacaccagagagagaacctacaagtgcagcaagtgcggcaagttcttcatggacagcagcaccctgatcagccacgagagagtgcacaccggcgagaagccctacgagtgcagcgagtgcggcaaggtgttcagatacaacagcagcctgatcaagcacagaagaatccacaccggcgagagaccctaccagtgcagcgagtgcggcagagtgttcaaccagaacagccacctgatccagcaccagaaggtgcacaccagatag

SEQ ID NO: 10209 - DNA, 1989 bp, Artificial Sequence; identical to SEQ ID NO: 10208
  Description of Artificial Sequence: Synthetic coding sequence

SEQ ID NO: 10210 - DNA, 3090 bp, Artificial Sequence
  Description of Artificial Sequence: Synthetic coding sequence
atgaccagagagaacgtggcccacaacgccctgagacaggagggcctggtgaagggcaaggacgacacctggaagtggggcaccagcttccagggcagcagcagcagcgtgtgggagaccagccacctgcacttcagacagctgagataccacgagaccagcggcccccaggaggccctgagcagactgagagagctgtgcagaagatggctgagacccgaggccagaaccaaggcccagatcctggagctgctggtgctggagcagttcctgagcatcctgcccggcgagatcagaacctgggtgcagctgcaccaccccggcagcggcgaggaggccgtggccctggtggaggagctgcagaaggacctggacggccccgccatccaggtgcccgtgctggtgaaggaccaggacaccctgcagaaggtggtgagcgcccccggcaccaccctgccccccgtgctgcccggcagccacatcgccgccgagatctgcccccacccccccaccgacctggtggccttcaacctgcaggacccccagcacgacagccccgcccccgaggccagcgccctgagccaggaggagaaccccagaaaccagctgatggccctgatgctgctgaccgcccagccccaggagctggtgatgttcgaggaggtgagcgtgtgcttcaccagcgaggagtgggcctgcctgggccccatccagagagccctgtactgggacgtgatgctggagaactacggcaacgtgaccagcctggagtgggagaccatgaccgagaacgaggaggtgaccagcaagcccagcagcagccagagagccgacagccacaagggcaccagcaagagactgcagggcagcgtgccccaggtgctggacttcgaggaggagtgcgagtggcaggtgctggccagccagtggggcaacgagaccgacgagagagccgacaccgtgaagaaggtgagcctgtgcgagagagacaagaagaagagaaccccccccgagaagcagggccagaagtggaaggagctgggcgacagcctgaccttcggcagcgccatcagcgagagcctgatcggcaccgagggcaagaagttctacaagtgcgacatgtgctgcaagcacttcaacaagatcagccacctgatcaaccacagaagaatccacaccggcgagaagccccacaagtgcaaggagtgcggcaagggcttcatccagagaagcagcctgctgatgcacctgagaaaccacagcggcgagaagccctacaagtgcaacgagtgcggcaaggccttcagccagagcgcctacctgctgaaccaccagagaatccacaccggcgagaagccctacaagtgcaaggagtgcggcaagggcttctacagacacagcggcctgatcatccacctgagaagacacagcggcgagagaccctacaagtgcaacgagtgcggcaaggtgttcagccagaacgcctacctgatcgaccaccagagactgcacaagggcgaggagccctacaagtgcaacaagtgccagaaggccttcatcctgaagaagagcctgatcctgcaccagagaatccacagcggcgagaagccctacaagtgcgacgagtgcggcaagaccttcgcccagaccacctacctgatcgaccaccagagactgcacagcgccgagaacccctacaagtgcaaggagtgcggcaaggtgttcatcagaagcaagagcctgctgctgcaccagagagtgcacaccgagaagaagaccttcggctgcaagaagtgcggcaagatcttcagcagcaagagcaacttcatcgaccacaagagaatgcacagcagagagaagccctacaagtgcaccgagtgcggcaaggccttcacccagagcgcctacctgttcgaccaccagagactgcacaacggcgagaagccctacgagtgcaacgagtgcggcaaggtgttcatcctgaagaagagcctgatcctgcaccagagattccacaccggcgagaacctgtacgagtgcaaggactgcggcaaggtgttcggcagcaacagaaacctgatcgaccacgagagactgcacaacggcgagaagccctacgagtgcagagagtgcggcaagaccttcatcatgagcaagagcttcatggtgcaccagaagctgcacacccaggagaaggcctacaagtgcgaggactgcggcaaggccttcagctacaacagcagcctgctggtgcacagaagaatccacaccggcgagaagcccttcgagtgcagcgagtgcggcagagccttcagcagcaacagaaacctgatcgagcacaagagaatccacagcggcgagaagccctacgagtgcgacgagtgcggcaagtgcttcatcctgaagaagagcctgatcggccaccagagaatccacaccagagagaagagctacaagtgcaacgactgcggcaaggtgttcagctacagaagcaacctgatcgcccaccagagaatccacaccggcgagaagccctacgcctgcagcgagtgcggcaagggcttcacctacaacagaaacctgatcgagcaccagagaatccacagcggcgagaagacctacgagtgccacgtgtgcagaaaggtgctgaccagcagcagaaacctgatggtgcaccagagaatccacaccggcgagaagccctacaagtgcaacgagtgcggcaaggacttcagccagaacaagaacctggtggtgcaccagagaatgcacaccggcgagaagccctacgagtgcgacaagtgcagaaagagcttcaccagcaagagaaacctggtgggccaccagagaatccacaccggcgagaagccctacggctgcaacgactgcagcaaggtgttcagacagagaaagaacctgaccgtgcaccagaagatccacaccgacgagaagccctgcgagtgcgacgtgagcgagaaggagttcagccagaccagcaacctgcacctgcagcagaagatccacaccatcgaggagttcagctggctgcagaacaccaacgagagcaagatcgagatccagaagatctag

SEQ ID NO: 10211 - DNA, 804 bp, Artificial Sequence
  Description of Artificial Sequence: Synthetic coding sequence
atgaccagagagaacgtggcccacaacgccctgagacaggagggcctggtgaagggcaaggacgacacctggaagtggggcaccagcttccagggcagcagcagcagcgtgtgggagaccagccacctgcacttcagacagctgagataccacgagaccagcggcccccaggaggccctgagcagactgagagagctgtgcagaagatggctgagacccgaggccagaaccaaggcccagatcctggagctgctggtgctggagcagttcctgagcatcctgcccggcgagatcagaacctgggtgcagctgcaccaccccggcagcggcgaggaggccgtggccctggtggaggagctgcagaaggacctggacggccccgccatccaggtgcccgtgctggtgaaggaccaggacaccctgcagaaggtggtgagcgcccccggcaccaccctgccccccgtgctgcccggcagccacatcgccgccgagatctgcccccacccccccaccgacctggtggccttcaacctgcaggacccccagcacgacagccccgcccccgaggccagcgccctgagccaggaggagaaccccagaaaccagctgatggccctgatgctgctgaccgcccagccccaggagctggtgatgttcgaggaggtgagcgtgtgcttcaccagcgaggagtgggcctgcctgggccccatccagagagccctgtactgggacgtgatgctggagaactacggcaacgtgaccagcctgggctacagaaagtacagaagacagagaaacaagtag

SEQ ID NO: 10212 - DNA, 804 bp, Artificial Sequence; identical to SEQ ID NO: 10211
  Description of Artificial Sequence: Synthetic coding sequence

SEQ ID NO: 10213 - DNA, 3090 bp, Artificial Sequence; identical to SEQ ID NO: 10210
  Description of Artificial Sequence: Synthetic coding sequence

SEQ ID NO: 10214 - DNA, 240 bp, Artificial Sequence
  Description of Artificial Sequence: Synthetic coding sequence
atgaccagagagaacgtggcccacaacgccctgagacaggagggcctggtgaagggcaaggacgacacctggaagtggggcaccagcttccagggcagcagcagcagcgtgtgggagaccagccacctgcacttcagacagctgagataccacgagaccagcggcccccaggaggccctgagcagactgagagagctgtgcagaagatggctgagacccgaggccagaaccaaggcctag

SEQ ID NO: 10215 - DNA, 966 bp, Artificial Sequence
  Description of Artificial Sequence: Synthetic coding sequence
atgaccagagagaacgtggcccacaacgccctgagacaggagggcctggtgaagggcaaggacgacacctggaagtggggcaccagcttccagggcagcagcagcagcgtgtgggagaccagccacctgcacttcagacagctgagataccacgagaccagcggcccccaggaggccctgagcagactgagagagctgtgcagaagatggctgagacccgaggccagaaccaaggcccagatcctggagctgctggtgctggagcagttcctgagcatcctgcccggcgagatcagaacctgggtgcagctgcaccaccccggcagcggcgaggaggccgtggccctggtggaggagctgcagaaggacctggacggccccgccatccaggtgcccgtgctggtgaaggaccaggacaccctgcagaaggtggtgagcgcccccggcaccaccctgccccccgtgctgcccggcagccacatcgccgccgagatctgcccccacccccccaccgacctggtggccttcaacctgcaggacccccagcacgacagccccgcccccgaggccagcgccctgagccaggaggagaaccccagaaaccagctgatggccctgatgctgctgaccgcccagccccaggagctggtgatgttcgaggaggtgagcgtgtgcttcaccagcgaggagtgggcctgcctgggccccatccagagagccctgtactgggacgtgatgctggagaactacggcaacgtgaccagcctggagtgggagaccatgaccgagaacgaggaggtgaccagcaagcccagcagcagccagagagccgacagccacaagggcaccagcaagagactgcagggcagcgtgccccaggtgctggacttcgaggaggagtgcgagtggcaggtgctggccagccagtggggcaacgagaccgacgagagagccgacaccgtgtag

SEQ ID NO: 10216 - DNA, 1386 bp, Artificial Sequence
  Description of Artificial Sequence: Synthetic coding sequence
atggagagagagggcatctggcacagcaccctgggcgagacctgggagcccaacaactggctggagggccagcaggacagccacctgagccaggtgggcgtgacccacaaggagaccttcaccgagatgagagtgtgcggcggcaacgagttcgagagatgcagcagccaggacagcatcctggacacccagcagagcatccccatggtgaagagaccccacaactgcaacagccacggcgaggacgccacccagaacagcgagctgatcaagacccagagaatgttcgtgggcaagaagatctacgagtgcaaccagtgcagcaagaccttcagccagagcagcagcctgctgaagcaccagagaatccacaccggcgagaagccctacaagtgcaacgtgtgcggcaagcacttcatcgagagaagcagcctgaccgtgcaccagagaatccacaccggcgagaagccctacaagtgcaacgagtgcggcaaggccttcagccagagcatgaacctgaccgtgcaccagagaacccacaccggcgagaagccctaccagtgcaaggagtgcggcaaggccttccacaagaacagcagcctgatccagcacgagagaatccacaccggcgagaagccctacaagtgcaacgagtgcggcaaggccttcacccagagcatgaacctgaccgtgcaccagagaacccacaccggcgagaagccctacgagtgcaacgagtgcggcaaggccttcagccagagcatgcacctgatcgtgcaccagagaagccacaccggcgagaagccctacgagtgcagccagtgcggcaaggccttcagcaagagcagcaccctgaccctgcaccagagaaaccacaccggcgagaagccctacaagtgcaacaagtgcggcaagagcttcagccagagcacctacctgatcgagcaccagagactgcacagcggcgtgaagcccttcgagtgcaacgagtgcggcaaggccttcagcaagaacagcagcctgacccagcacagaagaatccacaccggcgagaagccctacgagtgcatggtgtgcggcaagcacttcaccggcagaagcagcctgaccgtgcaccaggtgatccacaccggcgagaagccctacgagtgcaacgagtgcggcaaggccttcagccagagcgcctacctgatcgagcaccagagaatccacaccggcgagaagccctacgagtgcgaccagtgcggcaaggccttcatcaagaacagcagcctgaccgtgcaccagagaacccacaccggcgagaagccctaccagtgcaacgagtgcggcaaggccttcagcagaagcaccaacctgaccagacaccagagaacccacacctag

SEQ ID NO: 10217 - DNA, 1386 bp, Artificial Sequence; identical to SEQ ID NO: 10216
  Description of Artificial Sequence: Synthetic coding sequence

SEQ ID NO: 10218 - DNA, 1386 bp, Artificial Sequence; identical to SEQ ID NO: 10216
  Description of Artificial Sequence: Synthetic coding sequence

SEQ ID NO: 10219 - DNA, 72 bp, Artificial Sequence
  Description of Artificial Sequence: Synthetic coding sequence
atggagagagagggcatctggcacagcaccctgggcgagacctgggagcccaacaactggctggagggctag

SEQ ID NO: 10220 - DNA, 30 bp, Artificial Sequence
  Description of Artificial Sequence: Synthetic coding sequence
atggagagagagggcatctggcacagctag

SEQ ID NO: 10221 - DNA, 1386 bp, Artificial Sequence; identical to SEQ ID NO: 10216
  Description of Artificial Sequence: Synthetic coding sequence

SEQ ID NO: 10222 - DNA, 1734 bp, Artificial Sequence
  Description of Artificial Sequence: Synthetic coding sequence
atgctgggcttcccccccggcagaccccagctgcccgtgcagctgagaccccagaccagaatggccaccgccctgagagaccccgccagcgtgcccatcgccaccgaggtgctgttcaagctgacccagggcagcgtgaccttcgaggacgtggccgtgtacttcagctgggaggagtgggacctgctggacgaggcccagaagcacctgtacttcgacgtgatgctggagaacttcgccctgaccagcagcctgggctgctggtgcggcgtggagcacgaggagacccccagcgagcagagaatcagcggcgagagagtgccccagttcagaaccagcaaggagggcagcagcagccagaacgccgacagctgcgagatctgctgcctggtgctgagagacatcctgcacctggccgagcaccagggcaccaactgcggccagaagctgcacacctgcggcaagcagttctacatcagcgccaacctgcagcagcaccagagacagcacatcaccgaggcccccttcagaagctacgtggacaccgccagcttcacccagagctgcatcgtgcacgtgagcgagaagcccttcacctgcagagagatcagaaaggacttcctggccaacatgagattcctgcaccaggacgccacccagaccggcgagaagcccaacaacagcaacaagtgcgccgtggccttctacagcggcaagagccaccacaactggggcaagtgcagcaaggccttcagccacatcgacaccctggtgcaggaccagagaatcctgaccagagagggcctgttcgagtgcagcaagtgcggcaaggcctgcaccagaagatgcaacctgatccagcaccagaaggtgcacagcgaggagagaccctacgagtgcaacgagtgcggcaagttcttcacctactacagcagcttcatcatccaccagagagtgcacaccggcgagagaccctacgcctgccccgagtgcggcaagagcttcagccagatctacagcctgaacagccacagaaaggtgcacaccggcgagagaccctacgagtgcggcgagtgcggcaagagcttcagccagagaagcaacctgatgcagcacagaagagtgcacaccggcgagagaccctacgagtgcagcgagtgcggcaagagcttcagccagaacttcagcctgatctaccaccagagagtgcacaccggcgagagaccccacgagtgcaacgagtgcggcaagagcttcagcagaagcagcagcctgatccaccacagaagactgcacaccggcgagagaccctacgagtgcagcaagtgcggcaagagcttcaagcagagcagcagcttcagcagccacagaaaggtgcacaccggcgagagaccctacgtgtgcggcgagtgcggcaagagcttcagccacagcagcaacctgaagaaccaccagagagtgcacaccggcgagagacccgtggagtgcagcgagtgcagcaagagcttcagctgcaagagcaacctgatcaagcacctgagagtgcacaccggcgagagaccctacgagtgcagcgagtgcggcaagagcttcagccagagcagcagcctgatccagcacagaagagtgcacaccggcaagagaccctaccagtgcagccagtgcggcaagagcttcggctgcaagagcgtgctgatccagcaccagagagtgcacatcggcgagaagccctag

SEQ ID NO: 10223 - DNA, 1668 bp, Artificial Sequence
  Description of Artificial Sequence: Synthetic coding sequence
atgctggagaacttcgccctgaccagcagcctgggcctgatcagcagctggagccacgtggtggcccagctgggcctgggcgaggtgcccagcgtgctgcacagaatgttcatgacccccgccagcgccagatgggaccagagaggccccggcctgcacgagtggcacctgggcaagggcatgagcagcggctgctggtgcggcgtggagcacgaggagacccccagcgagcagagaatcagcggcgagagagtgccccagttcagaaccagcaaggagggcagcagcagccagaacgccgacagctgcgagatctgctgcctggtgctgagagacatcctgcacctggccgagcaccagggcaccaactgcggccagaagctgcacacctgcggcaagcagttctacatcagcgccaacctgcagcagcaccagagacagcacatcaccgaggcccccttcagaagctacgtggacaccgccagcttcacccagagctgcatcgtgcacgtgagcgagaagcccttcacctgcagagagatcagaaaggacttcctggccaacatgagattcctgcaccaggacgccacccagaccggcgagaagcccaacaacagcaacaagtgcgccgtggccttctacagcggcaagagccaccacaactggggcaagtgcagcaaggccttcagccacatcgacaccctggtgcaggaccagagaatcctgaccagagagggcctgttcgagtgcagcaagtgcggcaaggcctgcaccagaagatgcaacctgatccagcaccagaaggtgcacagcgaggagagaccctacgagtgcaacgagtgcggcaagttcttcacctactacagcagcttcatcatccaccagagagtgcacaccggcgagagaccctacgcctgccccgagtgcggcaagagcttcagccagatctacagcctgaacagccacagaaaggtgcacaccggcgagagaccctacgagtgcggcgagtgcggcaagagcttcagccagagaagcaacctgatgcagcacagaagagtgcacaccggcgagagaccctacgagtgcagcgagtgcggcaagagcttcagccagaacttcagcctgatctaccaccagagagtgcacaccggcgagagaccccacgagtgcaacgagtgcggcaagagcttcagcagaagcagcagcctgatccaccacagaagactgcacaccggcgagagaccctacgagtgcagcaagtgcggcaagagcttcaagcagagcagcagcttcagcagccacagaaaggtgcacaccggcgagagaccctacgtgtgcggcgagtgcggcaagagcttcagccacagcagcaacctgaagaaccaccagagagtgcacaccggcgagagacccgtggagtgcagcgagtgcagcaagagcttcagctgcaagagcaacctgatcaagcacctgagagtgcacaccggcgagagaccctacgagtgcagcgagtgcggcaagagcttcagccagagcagcagcctgatccagcacagaagagtgcacaccggcaagagaccctaccagtgcagccagtgcggcaagagcttcggctgcaagagcgtgctgatccagcaccagagagtgcacatcggcgagaagccctag

SEQ ID NO: 10224 - DNA, 1695 bp, Artificial Sequence
  Description of Artificial Sequence: Synthetic coding sequence
atgctgggcttcccccccggcagaccccagctgcccgtgcagctgagaccccagaccagaatggccaccgccctgagagaccccgccagcggcagcgtgaccttcgaggacgtggccgtgtacttcagctgggaggagtgggacctgctggacgaggcccagaagcacctgtacttcgacgtgatgctggagaacttcgccctgaccagcagcctgggctgctggtgcggcgtggagcacgaggagacccccagcgagcagagaatcagcggcgagagagtgccccagttcagaaccagcaaggagggcagcagcagccagaacgccgacagctgcgagatctgctgcctggtgctgagagacatcctgcacctggccgagcaccagggcaccaactgcggccagaagctgcacacctgcggcaagcagttctacatcagcgccaacctgcagcagcaccagagacagcacatcaccgaggcccccttcagaagctacgtggacaccgccagcttcacccagagctgcatcgtgcacgtgagcgagaagcccttcacctgcagagagatcagaaaggacttcctggccaacatgagattcctgcaccaggacgccacccagaccggcgagaagcccaacaacagcaacaagtgcgccgtggccttctacagcggcaagagccaccacaactggggcaagtgcagcaaggccttcagccacatcgacaccctggtgcaggaccagagaatcctgaccagagagggcctgttcgagtgcagcaagtgcggcaaggcctgcaccagaagatgcaacctgatccagcaccagaaggtgcacagcgaggagagaccctacgagtgcaacgagtgcggcaagttcttcacctactacagcagcttcatcatccaccagagagtgcacaccggcgagagaccctacgcctgccccgagtgcggcaagagcttcagccagatctacagcctgaacagccacagaaaggtgcacaccggcgagagaccctacgagtgcggcgagtgcggcaagagcttcagccagagaagcaacctgatgcagcacagaagagtgcacaccggcgagagaccctacgagtgcagcgagtgcggcaagagcttcagccagaacttcagcctgatctaccaccagagagtgcacaccggcgagagaccccacgagtgcaacgagtgcggcaagagcttcagcagaagcagcagcctgatccaccacagaagactgcacaccggcgagagaccctacgagtgcagcaagtgcggcaagagcttcaagcagagcagcagcttcagcagccacagaaaggtgcacaccggcgagagaccctacgtgtgcggcgagtgcggcaagagcttcagccacagcagcaacctgaagaaccaccagagagtgcacaccggcgagagacccgtggagtgcagcgagtgcagcaagagcttcagctgcaagagcaacctgatcaagcacctgagagtgcacaccggcgagagaccctacgagtgcagcgagtgcggcaagagcttcagccagagcagcagcctgatccagcacagaagagtgcacaccggcaagagaccctaccagtgcagccagtgcggcaagagcttcggctgcaagagcgtgctgatccagcaccagagagtgcacatcggcgagaagccctag

SEQ ID NO: 10225 - DNA, 1512 bp, Artificial Sequence
  Description of Artificial Sequence: Synthetic coding sequence
atgctggagaacttcgccctgaccagcagcctgggctgctggtgcggcgtggagcacgaggagacccccagcgagcagagaatcagcggcgagagagtgccccagttcagaaccagcaaggagggcagcagcagccagaacgccgacagctgcgagatctgctgcctggtgctgagagacatcctgcacctggccgagcaccagggcaccaactgcggccagaagctgcacacctgcggcaagcagttctacatcagcgccaacctgcagcagcaccagagacagcacatcaccgaggcccccttcagaagctacgtggacaccgccagcttcacccagagctgcatcgtgcacgtgagcgagaagcccttcacctgcagagagatcagaaaggacttcctggccaacatgagattcctgcaccaggacgccacccagaccggcgagaagcccaacaacagcaacaagtgcgccgtggccttctacagcggcaagagccaccacaactggggcaagtgcagcaaggccttcagccacatcgacaccctggtgcaggaccagagaatcctgaccagagagggcctgttcgagtgcagcaagtgcggcaaggcctgcaccagaagatgcaacctgatccagcaccagaaggtgcacagcgaggagagaccctacgagtgcaacgagtgcggcaagttcttcacctactacagcagcttcatcatccaccagagagtgcacaccggcgagagaccctacgcctgccccgagtgcggcaagagcttcagccagatctacagcctgaacagccacagaaaggtgcacaccggcgagagaccctacgagtgcggcgagtgcggcaagagcttcagccagagaagcaacctgatgcagcacagaagagtgcacaccggcgagagaccctacgagtgcagcgagtgcggcaagagcttcagccagaacttcagcctgatctaccaccagagagtgcacaccggcgagagaccccacgagtgcaacgagtgcggcaagagcttcagcagaagcagcagcctgatccaccacagaagactgcacaccggcgagagaccctacgagtgcagcaagtgcggcaagagcttcaagcagagcagcagcttcagcagccacagaaaggtgcacaccggcgagagaccctacgtgtgcggcgagtgcggcaagagcttcagccacagcagcaacctgaagaaccaccagagagtgcacaccggcgagagacccgtggagtgcagcgagtgcagcaagagcttcagctgcaagagcaacctgatcaagcacctgagagtgcacaccggcgagagaccctacgagtgcagcgagtgcggcaagagcttcagccagagcagcagcctgatccagcacagaagagtgcacaccggcaagagaccctaccagtgcagccagtgcggcaagagcttcggctgcaagagcgtgctgatccagcaccagagagtgcacatcggcgagaagccctag

SEQ ID NO: 10226 - DNA, 1707 bp, Artificial Sequence
  Description of Artificial Sequence: Synthetic coding sequence
atgatcagcgcctactgcaacctgcacctgctgggcagcagcgacagccccgccagcgccagccaggtggccggcaccaccggcatgagacaccacgcccagggcagcgtgaccttcgaggacgtggccgtgtacttcagctgggaggagtgggacctgctggacgaggcccagaagcacctgtacttcgacgtgatgctggagaacttcgccctgaccagcagcctgggctgctggtgcggcgtggagcacgaggagacccccagcgagcagagaatcagcggcgagagagtgccccagttcagaaccagcaaggagggcagcagcagccagaacgccgacagctgcgagatctgctgcctggtgctgagagacatcctgcacctggccgagcaccagggcaccaactgcggccagaagctgcacacctgcggcaagcagttctacatcagcgccaacctgcagcagcaccagagacagcacatcaccgaggcccccttcagaagctacgtggacaccgccagcttcacccagagctgcatcgtgcacgtgagcgagaagcccttcacctgcagagagatcagaaaggacttcctggccaacatgagattcctgcaccaggacgccacccagaccggcgagaagcccaacaacagcaacaagtgcgccgtggccttctacagcggcaagagccaccacaactggggcaagtgcagcaaggccttcagccacatcgacaccctggtgcaggaccagagaatcctgaccagagagggcctgttcgagtgcagcaagtgcggcaaggcctgcaccagaagatgcaacctgatccagcaccagaaggtgcacagcgaggagagaccctacgagtgcaacgagtgcggcaagttcttcacctactacagcagcttcatcatccaccagagagtgcacaccggcgagagaccctacgcctgccccgagtgcggcaagagcttcagccagatctacagcctgaacagccacagaaaggtgcacaccggcgagagaccctacgagtgcggcgagtgcggcaagagcttcagccagagaagcaacctgatgcagcacagaagagtgcacaccggcgagagaccctacgagtgcagcgagtgcggcaagagcttcagccagaacttcagcctgatctaccaccagagagtgcacaccggcgagagaccccacgagtgcaacgagtgcggcaagagcttcagcagaagcagcagcctgatccaccacagaagactgcacaccggcgagagaccctacgagtgcagcaagtgcggcaagagcttcaagcagagcagcagcttcagcagccacagaaaggtgcacaccggcgagagaccctacgtgtgcggcgagtgcggcaagagcttcagccacagcagcaacctgaagaaccaccagagagtgcacaccggcgagagacccgtggagtgcagcgagtgcagcaagagcttcagctgcaagagcaacctgatcaagcacctgagagtgcacaccggcgagagaccctacgagtgcagcgagtgcggcaagagcttcagccagagcagcagcctgatccagcacagaagagtgcacaccggcaagagaccctaccagtgcagccagtgcggcaagagcttcggctgcaagagcgtgctgatccagcaccagagagtgcacatcggcgagaagccctag

SEQ ID NO: 10227 - DNA, 1668 bp, Artificial Sequence; identical to SEQ ID NO: 10223
  Description of Artificial Sequence: Synthetic coding sequence

SEQ ID NO: 10228 - DNA, 1731 bp, Artificial Sequence
  Description of Artificial Sequence: Synthetic coding sequence
atgagaaccctgagacagagagaggtggagtacttcagcaaggccacccagctggtgagaggcagcaccaaggacagaggcgcccaggtgcccatcgccaccgaggtgctgttcaagctgacccagggcagcgtgaccttcgaggacgtggccgtgtacttcagctgggaggagtgggacctgctggacgaggcccagaagcacctgtacttcgacgtgatgctggagaacttcgccctgaccagcagcctgggctgctggtgcggcgtggagcacgaggagacccccagcgagcagagaatcagcggcgagagagtgccccagttcagaaccagcaaggagggcagcagcagccagaacgccgacagctgcgagatctgctgcctggtgctgagagacatcctgcacctggccgagcaccagggcaccaactgcggccagaagctgcacacctgcggcaagcagttctacatcagcgccaacctgcagcagcaccagagacagcacatcaccgaggcccccttcagaagctacgtggacaccgccagcttcacccagagctgcatcgtgcacgtgagcgagaagcccttcacctgcagagagatcagaaaggacttcctggccaacatgagattcctgcaccaggacgccacccagaccggcgagaagcccaacaacagcaacaagtgcgccgtggccttctacagcggcaagagccaccacaactggggcaagtgcagcaaggccttcagccacatcgacaccctggtgcaggaccagagaatcctgaccagagagggcctgttcgagtgcagcaagtgcggcaaggcctgcaccagaagatgcaacctgatccagcaccagaaggtgcacagcgaggagagaccctacgagtgcaacgagtgcggcaagttcttcacctactacagcagcttcatcatccaccagagagtgcacaccggcgagagaccctacgcctgccccgagtgcggcaagagcttcagccagatctacagcctgaacagccacagaaaggtgcacaccggcgagagaccctacgagtgcggcgagtgcggcaagagcttcagccagagaagcaacctgatgcagcacagaagagtgcacaccggcgagagaccctacgagtgcagcgagtgcggcaagagcttcagccagaacttcagcctgatctaccaccagagagtgcacaccggcgagagaccccacgagtgcaacgagtgcggcaagagcttcagcagaagcagcagcctgatccaccacagaagactgcacaccggcgagagaccctacgagtgcagcaagtgcggcaagagcttcaagcagagcagcagcttcagcagccacagaaaggtgcacaccggcgagagaccctacgtgtgcggcgagtgcggcaagagcttcagccacagcagcaacctgaagaaccaccagagagtgcacaccggcgagagacccgtggagtgcagcgagtgcagcaagagcttcagctgcaagagcaacctgatcaagcacctgagagtgcacaccggcgagagaccctacgagtgcagcgagtgcggcaagagcttcagccagagcagcagcctgatccagcacagaagagtgcacaccggcaagagaccctaccagtgcagccagtgcggcaagagcttcggctgcaagagcgtgctgatccagcaccagagagtgcacatcggcgagaagccctag

SEQ ID NO: 10229 - DNA, 1890 bp, Artificial Sequence
  Description of Artificial Sequence: Synthetic coding sequence
atgctgggcttcccccccggcagaccccagctgcccgtgcagctgagaccccagaccagaatggccaccgccctgagagaccccgccagcgtgcccatcgccaccgaggtgctgttcaagctgacccagggcagcgtgaccttcgaggacgtggccgtgtacttcagctgggaggagtgggacctgctggacgaggcccagaagcacctgtacttcgacgtgatgctggagaacttcgccctgaccagcagcctgggcctgatcagcagctggagccacgtggtggcccagctgggcctgggcgaggtgcccagcgtgctgcacagaatgttcatgacccccgccagcgccagatgggaccagagaggccccggcctgcacgagtggcacctgggcaagggcatgagcagcggctgctggtgcggcgtggagcacgaggagacccccagcgagcagagaatcagcggcgagagagtgccccagttcagaaccagcaaggagggcagcagcagccagaacgccgacagctgcgagatctgctgcctggtgctgagagacatcctgcacctggccgagcaccagggcaccaactgcggccagaagctgcacacctgcggcaagcagttctacatcagcgccaacctgcagcagcaccagagacagcacatcaccgaggcccccttcagaagctacgtggacaccgccagcttcacccagagctgcatcgtgcacgtgagcgagaagcccttcacctgcagagagatcagaaaggacttcctggccaacatgagattcctgcaccaggacgccacccagaccggcgagaagcccaacaacagcaacaagtgcgccgtggccttctacagcggcaagagccaccacaactggggcaagtgcagcaaggccttcagccacatcgacaccctggtgcaggaccagagaatcctgaccagagagggcctgttcgagtgcagcaagtgcggcaaggcctgcaccagaagatgcaacctgatccagcaccagaaggtgcacagcgaggagagaccctacgagtgcaacgagtgcggcaagttcttcacctactacagcagcttcatcatccaccagagagtgcacaccggcgagagaccctacgcctgccccgagtgcggcaagagcttcagccagatctacagcctgaacagccacagaaaggtgcacaccggcgagagaccctacgagtgcggcgagtgcggcaagagcttcagccagagaagcaacctgatgcagcacagaagagtgcacaccggcgagagaccctacgagtgcagcgagtgcggcaagagcttcagccagaacttcagcctgatctaccaccagagagtgcacaccggcgagagaccccacgagtgcaacgagtgcggcaagagcttcagcagaagcagcagcctgatccaccacagaagactgcacaccggcgagagaccctacgagtgcagcaagtgcggcaagagcttcaagcagagcagcagcttcagcagccacagaaaggtgcacaccggcgagagaccctacgtgtgcggcgagtgcggcaagagcttcagccacagcagcaacctgaagaaccaccagagagtgcacaccggcgagagacccgtggagtgcagcgagtgcagcaagagcttcagctgcaagagcaacctgatcaagcacctgagagtgcacaccggcgagagaccctacgagtgcagcgagtgcggcaagagcttcagccagagcagcagcctgatccagcacagaagagtgcacaccggcaagagaccctaccagtgcagccagtgcggcaagagcttcggctgcaagagcgtgctgatccagcaccagagagtgcacatcggcgagaagccctag

SEQ ID NO: 10230 - DNA, 117 bp, Artificial Sequence
  Description of Artificial Sequence: Synthetic coding sequence
atgctgggcttcccccccggcagaccccagctgcccgtgcagctgagaccccagaccagaatggccaccgccctgagagaccccgccagcgccgtgcagtggaagaagagactgtag

SEQ ID NO: 10231 - DNA, 1854 bp, Artificial Sequence
  Description of Artificial Sequence: Synthetic coding sequence
atgatcagccccagcctggagctgctgcacagcggcctgtgcaagttccccgaggtggagggcaagatgaccaccttcaaggaggccgtgaccttcaaggacgtggccgtggtgttcaccgaggaggagctgggcctgctggaccccgcccagagaaagctgtacagagacgtgatgctggagaacttcagaaacctgctgagcgtgggcaaccagcccttccaccaggacaccttccacttcctgggcaaggagaagttctggaagatgaagaccaccagccagagagagggcaacagcggcggcaagatccagatcgagatggagaccgtgcccgaggccggcccccacgaggagtggagctgccagcagatctgggagcagatcgccagcgacctgaccagaagccagaacagcatcagaaacagcagccagttcttcaaggagggcgacgtgccctgccagatcgaggccagactgagcatcagccacgtgcagcagaagccctacagatgcaacgagtgcaagcagagcttcagcgacgtgagcgtgttcgacctgcaccagcagagccacagcggcgagaagagccacacctgcggcgagtgcggcaagagcttctgctacagccccgccctgcacatccaccagagagtgcacatgggcgagaagtgctacaagtgcgacgtgtgcggcaaggagttcaaccagagcagccacctgcagacccaccagagagtgcacaccggcgagaagcccttcaagtgcggccagtgcggcaagggcttccacagcagaagcgccctgaacgtgcactgcaagctgcacaccggcgagaagccctacaactgcgaggagtgcggcaaggccttcatccacgacagccagctgcaggagcaccagagaatccacaccggcgagaagcccttcaagtgcgacatctgcggcaagagcttcagagtgagaagcagactgaacagacacagcatggtgcacaccggcgagaaggccttcagatgcgacacctgcggcaagaacttcagacagagaagcgccctgaacagccacagcatggtgcacatcgaggagaagccctacaagtgcgagcagtgcggcaagggcttcatctgcagaagagacttctgcaagcaccagatggtgcacaccggcgagaagccctacaactgcaaggagtgcggcaagaccttcagatggagcagctgcctgctgaaccaccagcaggtgcacagcggccagaagagcttcaagtgcgaggagtgcggcaagggcttctacaccaacagcagaagaagcagccaccagagaagccacaacggcgagaagccctacaactgcgaggagtgcggcaaggactacaagagaagactggacctggagttccaccagagagtgcacaccggcgagagaccctacaactgcaaggagtgcggcaagagcttcggctgggccagctgcctgctgaagcaccagagactgcacagcggcgagaagcccttcaagtgcgaggagtgcggcaagagattcacccagagcagccagctgcacagccaccagacctgccacaccggcgagaagctgtacaagtgcgagcagtgcgagaagggctacaacagcaagttcaacctggacatgcaccagagagtgcacggcggcgagagaccctacaactgcaaggagtgcggcaagagcttcggctgggccagctgcctgctgaagcaccagagactgcacagcggcgagaagcccctgaagagcggcgtgtgggaggagatctacagcgagttcaccgccagcttcaccagcgtgagcctgtgcggcagaaaggccatctag

SEQ ID NO: 10232 - DNA, 144 bp, Artificial Sequence
  Description of Artificial Sequence: Synthetic coding sequence
atgaccaccttcaaggaggccgtgaccttcaaggacgtggccgtggtgttcaccgaggaggagctgggcctgctggaccccgcccagagaaagctgtacagagacgtgatgctggagaacttcagaaacctgctgagcgtgtag

SEQ ID NO: 10233 - DNA, 1356 bp, Artificial Sequence
  Description of Artificial Sequence: Synthetic coding sequence
atggccaagctgtacgaggccgtgaccttcaaggacgtggccgtgatcttcaccgaggaggagctgggcctgctggaccccgcccagagaaagctgtacagagacgtgatgctggagaacttcagaaacctgctgagcgtgggcggcaagatccagaccgagatggagaccgtgcccgaggccggcacccacgaggagttcagctgcaagcagatctgggagcagatcgccagcgacctgaccagaagccaggacaccaccatcagcaacagccagctgttcgagcaggacgacaaccccagccagatcaaggccagactgagcaccgtgcacaccagagagaagcccttccagggcgagaactgcaagcagttcttcagcgacgtgagcttcttcgacctgccccagcagctgtacagcggcgagaagagccacacctgcgacgagtgcggcaagagcttctgctacatcagcgccctgcacatccaccagagagtgcacatgggcgtgaagtgctacaagtgcgacgtgtgcggcaaggagttcagccagagcagcagactgcagacccaccagagagtgcacaccggcgagaagcccttcaagtgcgagcagtgcggcaagggcttcagatgcagaagcgccctgaaggtgcactgcaagctgcacatgagagagaagccctacaactgcgagaagtgcggcaaggccttcatgcacaacttccagctgcagaagcaccacagaatccacaccggcgagaagcccttcaagtgcgagatctgcggcaagagcttctgcctgagaagcagcctgaacagacactgcatggtgcacaccgccgagaagctgtacaagagcgagaagtacggcagaggcttcatcgacagactggacctgcacaagcaccagatgatccacatgggccagaagccctacaactgcaaggagtgcggcaagagcttcaagtggagcagctacctgctggtgcaccagagagtgcacaccggcgagaagccctacaagtgcgaggagtgcggcaagggctacatcagcaagagcggcctggacttccaccacagaacccacaccggcgagagaagctacaactgcgacaactgcggcaagagcttcagacacgccagcagcatcctgaaccacaagaagctgcactgccagagaaagcccctgaagtgcgaggactgcggcaagagactggtgtgcagaagctactgcaaggaccagcagagagaccacagcggcgagaaccccagcaagtgcgaggactgcggcaagagatacaagagaagactgaacctggacatcatcctgagcctgttcctgaacgacatctag

SEQ ID NO: 10234 - DNA, 1194 bp, Artificial Sequence
  Description of Artificial Sequence: Synthetic coding sequence
atggagaccgtgcccgaggccggcacccacgaggagttcagctgcaagcagatctgggagcagatcgccagcgacctgaccagaagccaggacaccaccatcagcaacagccagctgttcgagcaggacgacaaccccagccagatcaaggccagactgagcaccgtgcacaccagagagaagcccttccagggcgagaactgcaagcagttcttcagcgacgtgagcttcttcgacctgccccagcagctgtacagcggcgagaagagccacacctgcgacgagtgcggcaagagcttctgctacatcagcgccctgcacatccaccagagagtgcacatgggcgtgaagtgctacaagtgcgacgtgtgcggcaaggagttcagccagagcagcagactgcagacccaccagagagtgcacaccggcgagaagcccttcaagtgcgagcagtgcggcaagggcttcagatgcagaagcgccctgaaggtgcactgcaagctgcacatgagagagaagccctacaactgcgagaagtgcggcaaggccttcatgcacaacttccagctgcagaagcaccacagaatccacaccggcgagaagcccttcaagtgcgagatctgcggcaagagcttctgcctgagaagcagcctgaacagacactgcatggtgcacaccgccgagaagctgtacaagagcgagaagtacggcagaggcttcatcgacagactggacctgcacaagcaccagatgatccacatgggccagaagccctacaactgcaaggagtgcggcaagagcttcaagtggagcagctacctgctggtgcaccagagagtgcacaccggcgagaagccctacaagtgcgaggagtgcggcaagggctacatcagcaagagcggcctggacttccaccacagaacccacaccggcgagagaagctacaactgcgacaactgcggcaagagcttcagacacgccagcagcatcctgaaccacaagaagctgcactgccagagaaagcccctgaagtgcgaggactgcggcaagagactggtgtgcagaagctactgcaaggaccagcagagagaccacagcggcgagaaccccagcaagtgcgaggactgcggcaagagatacaagagaagactgaacctggacatcatcctgagcctgttcctgaacgacatctag

SEQ ID NO: 10235 - DNA, 1476 bp, Artificial Sequence
  Description of Artificial Sequence: Synthetic coding sequence
atgatcgacagcggcgagaagaagcccggcagaagagccgaggaggccgtgaccttcaaggacgtggccgtgatcttcaccgaggaggagctgggcctgctggaccccgcccagagaaagctgtacagagacgtgatgctggagaacttcagaaacctgctgagcgtgggccaccagcccttccacggcgacaccttccacttcctgagagaggagaagttctgggtgatgggcaccaccagccagagagagggcaacctgggcggcaagatccagaccgagatggagaccgtgcccgaggccggcacccacgaggagttcagctgcaagcagatctgggagcagatcgccagcgacctgaccagaagccaggacaccaccatcagcaacagccagctgttcgagcaggacgacaaccccagccagatcaaggccagactgagcaccgtgcacaccagagagaagcccttccagggcgagaactgcaagcagttcttcagcgacgtgagcttcttcgacctgccccagcagctgtacagcggcgagaagagccacacctgcgacgagtgcggcaagagcttctgctacatcagcgccctgcacatccaccagagagtgcacatgggcgtgaagtgctacaagtgcgacgtgtgcggcaaggagttcagccagagcagcagactgcagacccaccagagagtgcacaccggcgagaagcccttcaagtgcgagcagtgcggcaagggcttcagatgcagaagcgccctgaaggtgcactgcaagctgcacatgagagagaagccctacaactgcgagaagtgcggcaaggccttcatgcacaacttccagctgcagaagcaccacagaatccacaccggcgagaagcccttcaagtgcgagatctgcggcaagagcttctgcctgagaagcagcctgaacagacactgcatggtgcacaccgccgagaagctgtacaagagcgagaagtacggcagaggcttcatcgacagactggacctgcacaagcaccagatgatccacatgggccagaagccctacaactgcaaggagtgcggcaagagcttcaagtggagcagctacctgctggtgcaccagagagtgcacaccggcgagaagccctacaagtgcgaggagtgcggcaagggctacatcagcaagagcggcctggacttccaccacagaacccacaccggcgagagaagctacaactgcgacaactgcggcaagagcttcagacacgccagcagcatcctgaaccacaagaagctgcactgccagagaaagcccctgaagtgcgaggactgcggcaagagactggtgtgcagaagctactgcaaggaccagcagagagaccacagcggcgagaaccccagcaagtgcgaggactgcggcaagagatacaagagaagactgaacctggacatcatcctgagcctgttcctgaacgacatctag

SEQ ID NO: 10236 - DNA, 1449 bp, Artificial Sequence
  Description of Artificial Sequence: Synthetic coding sequence
atgaccatgagcaaggaggccgtgaccttcaaggacgtggccgtggtgttcaccgaggaggagctgggcctgctggacctggcccagagaaagctgtacagagacgtgatgctggagaacttcagaaacctgctgagcgtgggccaccagcccttccacagagacaccttccacttcctgagagaggagaagttctggatgatggacatcgccacccagagagagggcaacagcggcggcaagatccagcccgagatgaagaccttccccgaggccggcccccacgagggctggagctgccagcagatctgggaggagatcgccagcgacctgaccagaccccaggacagcaccatcaagagcagccagttcttcgagcagggcgacgcccacagccaggtggaggagggcctgagcatcatgcacaccggccagaagcccagcaactgcggcaagtgcaagcagagcttcagcgacatgagcatcttcgacctgccccagcagatcagaagcgccgagaagagccacagctgcgacgagtgcggcaagagcttctgctacatcagcgccctgcacatccaccagagagtgcacctgggcgagaagctgttcaagtgcgacgtgtgcggcaaggagttcagccagagcctgcacctgcagacccaccagagagtgcacaccggcgagaagcccttcaagtgcgagcagtgcggcagaggcttcagatgcagaagcgccctgaccgtgcactgcaagctgcacatgggcgagaagcactacaactgcgaggcctgcggcagagccttcatccacgacttccagctgcagaagcaccagagaatccacaccggcgagaagcccttcaagtgcgagatctgcagcgtgagcttcagactgagaagcagcctgaacagacactgcgtggtgcacaccggcaagaagcccaacagcaccggcgagtacggcaagggcttcatcagaagactggacctgtgcaagcaccagaccatccacaccggcgagaagccctacaactgcaaggagtgcggcaagagcttcagaagaagcagctacctgctgatccaccagagagtgcacaccggcgagaagccctacaagtgcgacaagtgcggcaagagctacatcaccaagagcggcctggacctgcaccacagagcccacaccggcgagagaccctacaactgcgacgactgcggcaagagcttcagacaggccagcagcatcctgaaccacaagagactgcactgcagaaagaagcccttcaagtgcgaggactgcggcaagaagctggtgtacagaagctacagaaaggaccagcagaagaaccacagcggcgagaaccccagcaagtgcgaggactgcggcaagagatacaagagaagactgaacctggacatcatcctgagcctgttcctgaacgacacctag

SEQ ID NO: 10237 - DNA, 2121 bp, Artificial Sequence
  Description of Artificial Sequence: Synthetic coding sequence
atgaccaccctgaaggaggccgtgaccttcaaggacgtggccgtggtgttcaccgaggaggagctgagactgctggacctggcccagagaaagctgtacagagaggtgatgctggagaacttcagaaacctgctgagcgtgggccaccagagcctgcacagagacaccttccacttcctgaaggaggagaagttctggatgatggagaccgccacccagagagagggcaacctgggcggcaagatccagatggagatggagaccgtgagcgagagcggcacccacgagggcctgttcagccaccagacctgggagcagatcagcagcgacctgaccagattccaggacagcatggtgaacagcttccagttcagcaagcaggacgacatgccctgccaggtggacgccggcctgagcatcatccacgtgagacagaagcccagcgagggcagaacctgcaagaagagcttcagcgacgtgagcgtgctggacctgcaccagcagctgcagagcagagagaagagccacacctgcgacgagtgcggcaagagcttctgctacagcagcgccctgagaatccaccagagagtgcacatgggcgagaagctgtacaactgcgacgtgtgcggcaaggagttcaaccagagcagccacctgcagatccaccagagaatccacaccggcgagaagcccttcaagtgcgagcagtgcggcaagggcttcagcagaagaagcggcctgtacgtgcacagaaagctgcacaccggcgtgaagccccacatctgcgagaagtgcggcaaggccttcatccacgacagccagctgcaggagcaccagagaatccacaccggcgagaagcccttcaagtgcgacatctgctgcaagagcttcagaagcagagccaacctgaacagacacagcatggtgcacatgagagagaagcccttcagatgcgacacctgcggcaagagcttcggcctgaagagcgccctgaacagccacagaatggtgcacaccggcgagaagagatacaagtgcgaggagtgcggcaagagattcatctacagacaggacctgtacaagcaccagatcgaccacaccggcgagaagccctacaactgcaaggagtgcggcaagagcttcagatgggccagcggcctgagcagacacgtgagagtgcacagcggcgagaccaccttcaagtgcgaggagtgcggcaagggcttctacaccaacagccagagatacagccaccagagagcccacagcggcgagaagccctacagatgcgaggagtgcggcaagggctacaagagaagactggacctggacttccaccagagagtgcacagaggcgagaagccctacaactgcaaggagtgcggcaagagcttcggctgggccagctgcctgctgaaccaccagagaatccacagcggcgagaagcccttcaagtgcgaggagtgcggcaagagattcacccagaacagccagctgtacacccacagaagagtgcacagcggcgagaagcccttcaagtgcgaggagtgcggcaagagattcacccagaacagccagctgtacagccacagaagagtgcacaccggcgtgaagccctacaagtgcgaggagtgcggcaagggcttcaacagcaagttcaacctggacatgcaccagagagtgcacaccggcgagagaccctacaactgcaaggagtgcggcaagagcttcagcagagccagcagcatcctgaaccacaagagactgcacggcgacgagaagcccttcaagtgcgaggagtgcggcaagagattcaccgagaacagccagctgcacagccaccagagagtgcacaccggcgagaagccctacaagtgcgagaagtgcggcaagagcttcagatgggccagcacccacctgacccaccagagactgcacagcagagagaagctgctgcagtgcgaggactgcggcaagagcatcgtgcacagcagctgcctgaaggaccagcagagagaccagagcggcgagaagaccagcaagtgcgaggactgcggcaagagatacaagagaagactgaacctggacaccctgctgagcctgttcctgaacgacacctag

SEQ ID NO: 10238 - DNA, 2013 bp, Artificial Sequence
  Description of Artificial Sequence: Synthetic coding sequence
atgctggagaacttcagaaacctgctgagcgtgggccaccagagcctgcacagagacaccttccacttcctgaaggaggagaagttctggatgatggagaccgccacccagagagagggcaacctgggcggcaagatccagatggagatggagaccgtgagcgagagcggcacccacgagggcctgttcagccaccagacctgggagcagatcagcagcgacctgaccagattccaggacagcatggtgaacagcttccagttcagcaagcaggacgacatgccctgccaggtggacgccggcctgagcatcatccacgtgagacagaagcccagcgagggcagaacctgcaagaagagcttcagcgacgtgagcgtgctggacctgcaccagcagctgcagagcagagagaagagccacacctgcgacgagtgcggcaagagcttctgctacagcagcgccctgagaatccaccagagagtgcacatgggcgagaagctgtacaactgcgacgtgtgcggcaaggagttcaaccagagcagccacctgcagatccaccagagaatccacaccggcgagaagcccttcaagtgcgagcagtgcggcaagggcttcagcagaagaagcggcctgtacgtgcacagaaagctgcacaccggcgtgaagccccacatctgcgagaagtgcggcaaggccttcatccacgacagccagctgcaggagcaccagagaatccacaccggcgagaagcccttcaagtgcgacatctgctgcaagagcttcagaagcagagccaacctgaacagacacagcatggtgcacatgagagagaagcccttcagatgcgacacctgcggcaagagcttcggcctgaagagcgccctgaacagccacagaatggtgcacaccggcgagaagagatacaagtgcgaggagtgcggcaagagattcatctacagacaggacctgtacaagcaccagatcgaccacaccggcgagaagccctacaactgcaaggagtgcggcaagagcttcagatgggccagcggcctgagcagacacgtgagagtgcacagcggcgagaccaccttcaagtgcgaggagtgcggcaagggcttctacaccaacagccagagatacagccaccagagagcccacagcggcgagaagccctacagatgcgaggagtgcggcaagggctacaagagaagactggacctggacttccaccagagagtgcacagaggcgagaagccctacaactgcaaggagtgcggcaagagcttcggctgggccagctgcctgctgaaccaccagagaatccacagcggcgagaagcccttcaagtgcgaggagtgcggcaagagattcacccagaacagccagctgtacacccacagaagagtgcacagcggcgagaagcccttcaagtgcgaggagtgcggcaagagattcacccagaacagccagctgtacagccacagaagagtgcacaccggcgtgaagccctacaagtgcgaggagtgcggcaagggcttcaacagcaagttcaacctggacatgcaccagagagtgcacaccggcgagagaccctacaactgcaaggagtgcggcaagagcttcagcagagccagcagcatcctgaaccacaagagactgcacggcgacgagaagcccttcaagtgcgaggagtgcggcaagagattcaccgagaacagccagctgcacagccaccagagagtgcacaccggcgagaagccctacaagtgcgagaagtgcggcaagagcttcagatgggccagcacccacctgacccaccagagactgcacagcagagagaagctgctgcagtgcgaggactgcggcaagagcatcgtgcacagcagctgcctgaaggaccagcagagagaccagagcggcgagaagaccagcaagtgcgaggactgcggcaagagatacaagagaagactgaacctggacaccctgctgagcctgttcctgaacgacacctag

SEQ ID NO: 10239 - DNA, 285 bp, Artificial Sequence
  Description of Artificial Sequence: Synthetic coding sequence
atgaacatgttcaaggaggccgtgaccttcaaggacgtggccgtggccttcaccgaggaggagctgggcctgctgggccccgcccagagaaagctgtacagagacgtgatggtggagaacttcagaaacctgctgagcgtgggccacccccccttcaagcaggacgtgagccccatcgagagaaacgagcagctgtggatcatgaccaccgccaccagaagacagggcaacctggacaccctgctggtgaaggccctgctgctgtacgacctggcccagacctag

SEQ ID NO: 10240 - DNA, 2412 bp, Artificial Sequence
  Description of Artificial Sequence: Synthetic coding sequence
atgaacatgttcaaggaggccgtgaccttcaaggacgtggccgtggccttcaccgaggaggagctgggcctgctgggccccgcccagagaaagctgtacagagacgtgatggtggagaacttcagaaacctgctgagcgtgggccacccccccttcaagcaggacgtgagccccatcgagagaaacgagcagctgtggatcatgaccaccgccaccagaagacagggcaacctgggcgagaagaaccagagcaagctgatcaccgtgcaggacagagagagcgaggaggagctgagctgctggcagatctggcagcagatcgccaacgacctgaccagatgccaggacagcatgatcaacaacagccagtgccacaagcagggcgacttcccctaccaggtgggcaccgagctgagcatccagatcagcgaggacgagaactacatcgtgaacaaggccgacggccccaacaacaccggcaaccccgagttccccatcctgagaacccaggacagctggagaaagaccttcctgaccgagagccagagactgaacagagaccagcagatcagcatcaagaacaagctgtgccagtgcaagaagggcgtggaccccatcggctggatcagccaccacgacggccacagagtgcacaagagcgagaagagctacagacccaacgactacgagaaggacaacatgaagatcctgaccttcgaccacaacagcatgatccacaccggccagaagagctaccagtgcaacgagtgcaagaagcccttcagcgacctgagcagcttcgacctgcaccagcagctgcagagcggcgagaagagcctgacctgcgtggagagaggcaagggcttctgctacagccccgtgctgcccgtgcaccagaaggtgcacgtgggcgagaagctgaagtgcgacgagtgcggcaaggagttcagccagggcgcccacctgcagacccaccagaaggtgcacgtgatcgagaagccctacaagtgcaagcagtgcggcaagggcttcagcagaagaagcgccctgaacgtgcactgcaaggtgcacaccgccgagaagccctacaactgcgaggagtgcggcagagccttcagccaggccagccacctgcaggaccaccagagactgcacaccggcgagaagcccttcaagtgcgacgcctgcggcaagagcttcagcagaaacagccacctgcagagccaccagagagtgcacaccggcgagaagccctacaagtgcgaggagtgcggcaagggcttcatctgcagcagcaacctgtacatccaccagagagtgcacaccggcgagaagccctacaagtgcgaggagtgcggcaagggcttcagcagacccagcagcctgcaggcccaccagggcgtgcacaccggcgagaagagctacatctgcaccgtgtgcggcaagggcttcaccctgagcagcaacctgcaggcccaccagagagtgcacaccggcgagaagccctacaagtgcaacgagtgcggcaagagcttcagaagaaacagccactaccaggtgcacctggtggtgcacaccggcgagaagccctacaagtgcgagatctgcggcaagggcttcagccagagcagctacctgcagatccaccagaaggcccacagcatcgagaagcccttcaagtgcgaggagtgcggccagggcttcaaccagagcagcagactgcagatccaccagctgatccacaccggcgagaagccctacaagtgcgaggagtgcggcaagggcttcagcagaagagccgacctgaagatccactgcagaatccacaccggcgagaagccctacaactgcgaggagtgcggcaaggtgttcagacaggccagcaacctgctggcccaccagagagtgcacagcggcgagaagcccttcaagtgcgaggagtgcggcaagagcttcggcagaagcgcccacctgcaggcccaccagaaggtgcacaccggcgacaagccctacaagtgcgacgagtgcggcaagggcttcaagtggagcctgaacctggacatgcaccagagagtgcacaccggcgagaagccctacaagtgcggcgagtgcggcaagtacttcagccaggccagcagcctgcagctgcaccagagcgtgcacaccggcgagaagccctacaagtgcgacgtgtgcggcaaggtgttcagcagaagcagccagctgcagagccaccagagagtgcacaccggcgagaagccctacaagtgcgagatctgcggcaagagcttcagctggagaagcaacctgaccgtgcaccacagaatccacgtgggcgacaagagctacaagagcaacagaggcggcaagaacatcagagagagcacccaggagaagaagagcatcaagtag

SEQ ID NO: 10241 - DNA, 285 bp, Artificial Sequence; identical to SEQ ID NO: 10239
  Description of Artificial Sequence: Synthetic coding sequence

SEQ ID NO: 10242 - DNA, 2103 bp, Artificial Sequence
  Description of Artificial Sequence: Synthetic coding sequence
atgaccaccttcaaggagggcctgaccttcaaggacgtggccgtggtgttcaccgaggaggagctgggcctgctggaccccgtgcagagaaacctgtaccaggacgtgatgctggagaacttcagaaacctgctgagcgtgggccaccaccccttcaagcacgacgtgttcctgctggagaaggagaagaagctggacatcatgaagaccgccacccagagaaagggcaagagcgccgacaagatccagagcgaggtggagaccgtgcccgaggccggcagacacgaggagctgtactggggccagatctggaagcagatcgccagcgacctgatcaagtacgaggacagcatgatcagcatcagcagattccccagacagggcgacctgagctgccaggtgagagccggcctgtacaccacccacaccggccagaagttctaccagtgcgacgagtacaagaagagcttcaccgacgtgttcaacttcgacctgcaccagcagctgcacagcggcgagaagagccacacctgcgacgagtgcggcaagagcttctgctacatcagcgccctgcacatccaccagagagtgcacatgggcgagaagtgctacaagtgcgacgtgtgcggcaaggagttcagccagagcagccacctgcagacccaccagagagtgcacaccgtggagaagcccttcaagtgcgtggagtgcggcaagggcttcagcagaagaagcaccctgaccgtgcactgcaagctgcacagcggcgagaagccctacaactgcgaggagtgcggcagagccttcatccacgccagccacctgcaggagcaccagagaatccacaccggcgagaagcccttcaagtgcgacacctgcggcaagaacttcagaagaagaagcgccctgaacaaccactgcatggtgcacaccggcgagaagccctacaagtgcgaggactgcggcaagtgcttcacctgcagcagcaacctgagaatccaccagagagtgcacaccggcgagaagccctacaagtgcgaggagtgcggcaagtgcttcatccagcccagccagttccaggcccacagaagaatccacaccggcgagaagccctacgtgtgcaaggtgtgcggcaagggcttcatctacagcagcagcttccaggcccaccagggcgtgcacaccggcgagaagccctacaagtgcaacgagtgcggcaagagcttcagaatgaagatccactaccaggtgcacctggtggtgcacaccggcgagaagccctacaagtgcgaggtgtgcggcaaggccttcagacagagcagctacctgaagatccacctgaaggcccacagcgtgcagaagcccttcaagtgcgaggagtgcggccagggcttcaaccagagcagcagactgcagatccaccagctgatccacaccggcgagaagccctacaagtgcgaggagtgcggcaagggcttcagcagaagagccgacctgaagatccactgcagaatccacaccggcgagaagccctacaactgcgaggagtgcggcaaggtgttcagccaggccagccacctgctgacccaccagagagtgcacagcggcgagaagcccttcaagtgcgaggagtgcggcaagagcttcagcagaagcgcccacctgcaggcccaccagaaggtgcacaccggcgagaagccctacaagtgcggcgagtgcggcaagggcttcaagtggagcctgaacctggacatgcaccagagagtgcacaccggcgagaagccctacacctgcggcgagtgcggcaagcacttcagccaggccagcagcctgcagctgcaccagagcgtgcacaccggcgagaagccctacaagtgcgacgtgtgcggcaaggtgttcagcagaagcagccagctgcagtaccacagaagagtgcacaccggcgagaagccctacaagtgcgagatctgcggcaagagattcagctggagaagcaacctggtgagccaccacaagatccacgccgccggcaccttctacgagaacgacgagaacagcaagaacatcagagagctgagcgagggcggcagcagcaccagatag

SEQ ID NO: 10243 - DNA, 2412 bp, Artificial Sequence; identical to SEQ ID NO: 10240
  Description of Artificial Sequence: Synthetic coding sequence

SEQ ID NO: 10244 - DNA, 207 bp, Artificial Sequence
  Description of Artificial Sequence: Synthetic coding sequence
ctgaagagccccaccagcagcgagctgcacgtgggcgagaagctgaagtgcgacgagtgcggcaaggagttcagccagggcgcccacctgcagacccaccagaaggtgcacgtgatcgagaagccctacaagtgcaagcagtgcggcaagggcttcagcagaagaagcgccctgaacgtgcactgcaaggtgcacaccgccgagtag

SEQ ID NO: 10245 - DNA, 207 bp, Artificial Sequence
  Description of Artificial Sequence: Synthetic coding sequence
cacagcggcgagaagagccacacctgcgacgagtgcaaggccagcgtgaccagccagcccttcatccaccagagagtgcacatgggcgagaagtgctacaagtgcgacgtgtgcggcaaggagttcagccagagcagccacctgcagacccaccagagagtgcacaccgtggagaagcccttcaagtgcgtggagtgcggcaagtag

SEQ ID NO: 10246 - DNA, 2400 bp, Artificial Sequence
  Description of Artificial Sequence: Synthetic coding sequence
atgcccagccagaactacgacctgccccagaagaagcaggagaagatgaccaagttccaggaggccgtgaccttcaaggacgtggccgtggtgttcagcagagaggagctgagactgctggacctgacccagagaaagctgtacagagacgtgatggtggagaacttcaagaacctggtggccgtgggccacctgcccttccagcccgacatggtgagccagctggaggccgaggagaagctgtggatgatggagaccgagacccagagaagcagcaagcaccagaacaagatggagaccctgcagaagttcgccctgaagtacctgagcaaccaggagctgagctgctggcagatctggaagcaggtggccagcgagctgaccagatgcctgcagggcaagagcagccagctgctgcagggcgacagcatccaggtgagcgagaacgagaacaacatcatgaaccccaagggcgacagcagcatctacatcgagaaccaggagttccccttctggagaacccagcacagctgcggcaacacctacctgagcgagagccagatccagagcagaggcaagcagatcgacgtgaagaacaacctgcagatccacgaggacttcatgaagaagagccccttccacgagcacatcaagaccgacaccgagcccaagccctgcaagggcaacgagtacggcaagatcatcagcgacggcagcaaccagaagctgcccctgggcgagaagccccacccctgcggcgagtgcggcagaggcttcagctacagccccagactgcccctgcaccccaacgtgcacaccggcgagaagtgcttcagccagagcagccacctgagaacccaccagagaatccaccccggcgagaagctgaacagatgccacgagagcggcgactgcttcaacaagagcagcttccacagctaccagagcaaccacaccggcgagaagagctacagatgcgacagctgcggcaagggcttcagcagcagcaccggcctgatcatccactacagaacccacaccggcgagaagccctacaagtgcgaggagtgcggcaagtgcttcagccagagcagcaacttccagtgccaccagagagtgcacaccgaggagaagccctacaagtgcgaggagtgcggcaagggcttcggctggagcgtgaacctgagagtgcaccagagagtgcacagaggcgagaagccctacaagtgcgaggagtgcggcaagggcttcacccaggccgcccacttccacatccaccagagagtgcacaccggcgagaagccctacaagtgcgacgtgtgcggcaagggcttcagccacaacagccccctgatctgccacagaagagtgcacaccggcgagaagccctacaagtgcgaggcctgcggcaagggcttcaccagaaacaccgacctgcacatccacttcagagtgcacaccggcgagaagccctacaagtgcaaggagtgcggcaagggcttcagccaggccagcaacctgcaggtgcaccagaacgtgcacaccggcgagaagagattcaagtgcgagacctgcggcaagggcttcagccagagcagcaagctgcagacccaccagagagtgcacaccggcgagaagccctacagatgcgacgtgtgcggcaaggacttcagctacagcagcaacctgaagctgcaccaggtgatccacaccggcgagaagccctacaagtgcgaggagtgcggcaagggcttcagctggagaagcaacctgcacgcccaccagagagtgcacagcggcgagaagccctacaagtgcgagcagtgcgacaagagcttcagccaggccatcgacttcagagtgcaccagagagtgcacaccggcgagaagccctacaagtgcggcgtgtgcggcaagggcttcagccagagcagcggcctgcagagccaccagagagtgcacaccggcgagaagccctacaagtgcgacgtgtgcggcaagggcttcagatacagcagccagttcatctaccaccagagaggccacaccggcgagaagccctacaagtgcgaggagtgcggcaagggcttcggcagaagcctgaacctgagacaccaccagagagtgcacaccggcgagaagccccacatctgcgaggagtgcggcaaggccttcagcctgcccagcaacctgagagtgcacctgggcgtgcacaccagagagaagctgttcaagtgcgaggagtgcggcaagggcttcagccagagcgccagactggaggcccaccagagagtgcacaccggcgagaagccctacaagtgcgacatctgcgacaaggacttcagacacagaagcagactgacctaccaccagaaggtgcacaccggcaagaagctgtag

SEQ ID NO: 10247 - DNA, 2271 bp, Artificial Sequence
  Description of Artificial Sequence: Synthetic coding sequence
atgaccaagttccaggaggccgtgaccttcaaggacgtggccgtggtgttcagcagagaggagctgagactgctggacctgacccagagaaagctgtacagagacgtgatggtggagaacttcaagaacctggtggccgtgggcagcaagcaccagaacaagatggagaccctgcagaagttcgccctgaagtacctgagcaaccaggagctgagctgctggcagatctggaagcaggtggccagcgagctgaccagatgcctgcagggcaagagcagccagctgctgcagggcgacagcatccaggtgagcgagaacgagaacaacatcatgaaccccaagggcgacagcagcatctacatcgagaaccaggagttccccttctggagaacccagcacagctgcggcaacacctacctgagcgagagccagatccagagcagaggcaagcagatcgacgtgaagaacaacctgcagatccacgaggacttcatgaagaagagccccttccacgagcacatcaagaccgacaccgagcccaagccctgcaagggcaacgagtacggcaagatcatcagcgacggcagcaaccagaagctgcccctgggcgagaagccccacccctgcggcgagtgcggcagaggcttcagctacagccccagactgcccctgcaccccaacgtgcacaccggcgagaagtgcttcagccagagcagccacctgagaacccaccagagaatccaccccggcgagaagctgaacagatgccacgagagcggcgactgcttcaacaagagcagcttccacagctaccagagcaaccacaccggcgagaagagctacagatgcgacagctgcggcaagggcttcagcagcagcaccggcctgatcatccactacagaacccacaccggcgagaagccctacaagtgcgaggagtgcggcaagtgcttcagccagagcagcaacttccagtgccaccagagagtgcacaccgaggagaagccctacaagtgcgaggagtgcggcaagggcttcggctggagcgtgaacctgagagtgcaccagagagtgcacagaggcgagaagccctacaagtgcgaggagtgcggcaagggcttcacccaggccgcccacttccacatccaccagagagtgcacaccggcgagaagccctacaagtgcgacgtgtgcggcaagggcttcagccacaacagccccctgatctgccacagaagagtgcacaccggcgagaagccctacaagtgcgaggcctgcggcaagggcttcaccagaaacaccgacctgcacatccacttcagagtgcacaccggcgagaagccctacaagtgcaaggagtgcggcaagggcttcagccaggccagcaacctgcaggtgcaccagaacgtgcacaccggcgagaagagattcaagtgcgagacctgcggcaagggcttcagccagagcagcaagctgcagacccaccagagagtgcacaccggcgagaagccctacagatgcgacgtgtgcggcaaggacttcagctacagcagcaacctgaagctgcaccaggtgatccacaccggcgagaagccctacaagtgcgaggagtgcggcaagggcttcagctggagaagcaacctgcacgcccaccagagagtgcacagcggcgagaagccctacaagtgcgagcagtgcgacaagagcttcagccaggccatcgacttcagagtgcaccagagagtgcacaccggcgagaagccctacaagtgcggcgtgtgcggcaagggcttcagccagagcagcggcctgcagagccaccagagagtgcacaccggcgagaagccctacaagtgcgacgtgtgcggcaagggcttcagatacagcagccagttcatctaccaccagagaggccacaccggcgagaagccctacaagtgcgaggagtgcggcaagggcttcggcagaagcctgaacctgagacaccaccagagagtgcacaccggcgagaagccccacatctgcgaggagtgcggcaaggccttcagcctgcccagcaacctgagagtgcacctgggcgtgcacaccagagagaagctgttcaagtgcgaggagtgcggcaagggcttcagccagagcgccagactggaggcccaccagagagtgcacaccggcgagaagccctacaagtgcgacatctgcgacaaggacttcagacacagaagcagactgacctaccaccagaaggtgcacaccggcaagaagctgtag

SEQ ID NO: 10248 - DNA, 1317 bp, Artificial Sequence
  Description of Artificial Sequence: Synthetic coding sequence
cacgagagcggcgactgcttcaacaagagcagcttccacagctaccagagcaaccacaccggcgagaagagctacagatgcgacagctgcggcaagggcttcagcagcagcaccggcctgatcatccactacagaacccacaccggcgagaagccctacaagtgcgaggagtgcggcaagtgcttcagccagagcagcaacttccagtgccaccagagagtgcacaccgaggagaagccctacaagtgcgaggagtgcggcaagggcttcggctggagcgtgaacctgagagtgcaccagagagtgcacagaggcgagaagccctacaagtgcgaggagtgcggcaagggcttcacccaggccgcccacttccacatccaccagagagtgcacaccggcgagaagccctacaagtgcgacgtgtgcggcaagggcttcagccacaacagccccctgatctgccacagaagagtgcacaccggcgagaagccctacaagtgcgaggcctgcggcaagggcttcaccagaaacaccgacctgcacatccacttcagagtgcacaccggcgagaagccctacaagtgcaaggagtgcggcaagggcttcagccaggccagcaacctgcaggtgcaccagaacgtgcacaccggcgagaagagattcaagtgcgagacctgcggcaagggcttcagccagagcagcaagctgcagaccagagagaagccctacaagtgcgagcagtgcgacaagagcttcagccaggccatcgacttcagagtgcaccagagagtgcacaccggcgagaagccctacaagtgcggcgtgtgcggcaagggcttcagccagagcagcggcctgcagagccaccagagagtgcacaccggcgagaagccctacaagtgcgacgtgtgcggcaagggcttcagatacagcagccagttcatctaccaccagagaggccacaccggcgagaagccctacaagtgcgaggagtgcggcaagggcttcggcagaagcctgaacctgagacaccaccagagagtgcacaccggcgagaagccccacatctgcgaggagtgcggcaaggccttcagcctgcccagcaacctgagagtgcacctgggcgtgcacaccagagagaagctgttcaagtgcgaggagtgcggcaagggcttcagccagagcgccagactggaggcccaccagagagtgcacaccggcgagaagccctacaagtgcgacatctgcgacaaggacttcagacacagaagcagactgacctaccaccagaaggtgcacaccggcaagaagctgtag

SEQ ID NO: 10249 - DNA, 2247 bp, Artificial Sequence
  Description of Artificial Sequence: Synthetic coding sequence
atggtggagaacttcaagaacctggtggccgtgggccacctgcccttccagcccgacatggtgagccagctggaggccgaggagaagctgtggatgatggagaccgagacccagagaagcagcaagcaccagaacaagatggagaccctgcagaagttcgccctgaagtacctgagcaaccaggagctgagctgctggcagatctggaagcaggtggccagcgagctgaccagatgcctgcagggcaagagcagccagctgctgcagggcgacagcatccaggtgagcgagaacgagaacaacatcatgaaccccaagggcgacagcagcatctacatcgagaaccaggagttccccttctggagaacccagcacagctgcggcaacacctacctgagcgagagccagatccagagcagaggcaagcagatcgacgtgaagaacaacctgcagatccacgaggacttcatgaagaagagccccttccacgagcacatcaagaccgacaccgagcccaagccctgcaagggcaacgagtacggcaagatcatcagcgacggcagcaaccagaagctgcccctgggcgagaagccccacccctgcggcgagtgcggcagaggcttcagctacagccccagactgcccctgcaccccaacgtgcacaccggcgagaagtgcttcagccagagcagccacctgagaacccaccagagaatccaccccggcgagaagctgaacagatgccacgagagcggcgactgcttcaacaagagcagcttccacagctaccagagcaaccacaccggcgagaagagctacagatgcgacagctgcggcaagggcttcagcagcagcaccggcctgatcatccactacagaacccacaccggcgagaagccctacaagtgcgaggagtgcggcaagtgcttcagccagagcagcaacttccagtgccaccagagagtgcacaccgaggagaagccctacaagtgcgaggagtgcggcaagggcttcggctggagcgtgaacctgagagtgcaccagagagtgcacagaggcgagaagccctacaagtgcgaggagtgcggcaagggcttcacccaggccgcccacttccacatccaccagagagtgcacaccggcgagaagccctacaagtgcgacgtgtgcggcaagggcttcagccacaacagccccctgatctgccacagaagagtgcacaccggcgagaagccctacaagtgcgaggcctgcggcaagggcttcaccagaaacaccgacctgcacatccacttcagagtgcacaccggcgagaagccctacaagtgcaaggagtgcggcaagggcttcagccaggccagcaacctgcaggtgcaccagaacgtgcacaccggcgagaagagattcaagtgcgagacctgcggcaagggcttcagccagagcagcaagctgcagacccaccagagagtgcacaccggcgagaagccctacagatgcgacgtgtgcggcaaggacttcagctacagcagcaacctgaagctgcaccaggtgatccacaccggcgagaagccctacaagtgcgaggagtgcggcaagggcttcagctggagaagcaacctgcacgcccaccagagagtgcacagcggcgagaagccctacaagtgcgagcagtgcgacaagagcttcagccaggccatcgacttcagagtgcaccagagagtgcacaccggcgagaagccctacaagtgcggcgtgtgcggcaagggcttcagccagagcagcggcctgcagagccaccagagagtgcacaccggcgagaagccctacaagtgcgacgtgtgcggcaagggcttcagatacagcagccagttcatctaccaccagagaggccacaccggcgagaagccctacaagtgcgaggagtgcggcaagggcttcggcagaagcctgaacctgagacaccaccagagagtgcacaccggcgagaagccccacatctgcgaggagtgcggcaaggccttcagcctgcccagcaacctgagagtgcacctgggcgtgcacaccagagagaagctgttcaagtgcgaggagtgcggcaagggcttcagccagagcgccagactggaggcccaccagagagtgcacaccggcgagaagccctacaagtgcgacatctgcgacaaggacttcagacacagaagcagactgacctaccaccagaaggtgcacaccggcaagaagctgtag

SEQ ID NO: 10250 - DNA, 2337 bp, Artificial Sequence
  Description of Artificial Sequence: Synthetic coding sequence
aaggtgacccagctgcaggaggccgtgaccttcaaggacgtggccgtggtgttcagcagagaggagctgagactgctggacctgacccagagaaagctgtacagagacgtgatggtggagaacttcaagaacctggtggccgtggacatggtgagccagctggaggccgaggagaagctgtggatgatggagaccgagacccagagaagcagcaagcaccagaacaagatggagaccctgcagaagttcgccctgaagtacctgagcaaccaggagctgagctgctggcagatctggaagcaggtggccagcgagctgaccagatgcctgcagggcaagagcagccagctgctgcagggcgacagcatccaggtgagcgagaacgagaacaacatcatgaaccccaagggcgacagcagcatctacatcgagaaccaggagttccccttctggagaacccagcacagctgcggcaacacctacctgagcgagagccagatccagagcagaggcaagcagatcgacgtgaagaacaacctgcagatccacgaggacttcatgaagaagagccccttccacgagcacatcaagaccgacaccgagcccaagccctgcaagggcaacgagtacggcaagatcatcagcgacggcagcaaccagaagctgcccctgggcgagaagccccacccctgcggcgagtgcggcagaggcttcagctacagccccagactgcccctgcaccccaacgtgcacaccggcgagaagtgcttcagccagagcagccacctgagaacccaccagagaatccaccccggcgagaagctgaacagatgccacgagagcggcgactgcttcaacaagagcagcttccacagctaccagagcaaccacaccggcgagaagagctacagatgcgacagctgcggcaagggcttcagcagcagcaccggcctgatcatccactacagaacccacaccggcgagaagccctacaagtgcgaggagtgcggcaagtgcttcagccagagcagcaacttccagtgccaccagagagtgcacaccgaggagaagccctacaagtgcgaggagtgcggcaagggcttcggctggagcgtgaacctgagagtgcaccagagagtgcacagaggcgagaagccctacaagtgcgaggagtgcggcaagggcttcacccaggccgcccacttccacatccaccagagagtgcacaccggcgagaagccctacaagtgcgacgtgtgcggcaagggcttcagccacaacagccccctgatctgccacagaagagtgcacaccggcgagaagccctacaagtgcgaggcctgcggcaagggcttcaccagaaacaccgacctgcacatccacttcagagtgcacaccggcgagaagccctacaagtgcaaggagtgcggcaagggcttcagccaggccagcaacctgcaggtgcaccagaacgtgcacaccggcgagaagagattcaagtgcgagacctgcggcaagggcttcagccagagcagcaagctgcagacccaccagagagtgcacaccggcgagaagccctacagatgcgacgtgtgcggcaaggacttcagctacagcagcaacctgaagctgcaccaggtgatccacaccggcgagaagccctacaagtgcgaggagtgcggcaagggcttcagctggagaagcaacctgcacgcccaccagagagtgcacagcggcgagaagccctacaagtgcgagcagtgcgacaagagcttcagccaggccatcgacttcagagtgcaccagagagtgcacaccggcgagaagccctacaagtgcggcgtgtgcggcaagggcttcagccagagcagcggcctgcagagccaccagagagtgcacaccggcgagaagccctacaagtgcgacgtgtgcggcaagggcttcagatacagcagccagttcatctaccaccagagaggccacaccggcgagaagccctacaagtgcgaggagtgcggcaagggcttcggcagaagcctgaacctgagacaccaccagagagtgcacaccggcgagaagccccacatctgcgaggagtgcggcaaggccttcagcctgcccagcaacctgagagtgcacctgggcgtgcacaccagagagaagctgttcaagtgcgaggagtgcggcaagggcttcagccagagcgccagactggaggcccaccagagagtgcacaccggcgagaagccctacaagtgcgacatctgcgacaaggacttcagacacagaagcagactgacctaccaccagaaggtgcacaccggcaagaagctgtag

SEQ ID NO: 10251 - DNA, 2478 bp, Artificial Sequence
  Description of Artificial Sequence: Synthetic coding sequence
atggagaccctgaccagcagacacgagaagagagccctgcacagccaggccagcgccatcagccaggacagagaggagaagatcatgagccaggagcccctgagcttcaaggacgtggccgtggtgttcaccgaggaggagctggagctgctggacagcacccagagacagctgtaccaggacgtgatgcaggagaacttcagaaacctgctgagcgtgggcgagagaaaccccctgggcgacaagaacggcaaggacaccgagtacatccaggacgaggagctgagattcttcagccacaaggagctgagcagctgcaagatctgggaggaggtggccggcgagctgcccggcagccaggactgcagagtgaacctgcagggcaaggacttccagttcagcgaggacgccgccccccaccagggctgggagggcgccagcaccccctgcttccccatcgagaacagcctggacagcctgcagggcgacggcctgatcggcctggagaaccagcagttccccgcctggagagccatcagacccatccccatccagggcagctgggccaaggccttcgtgaaccagctgggcgacgtgcaggagagatgcaagaacctggacaccgaggacaccgtgtacaagtgcaactgggacgacgacagcttctgctggatcagctgccacgtggaccacagattccccgagatcgacaagccctgcggctgcaacaagtgcagaaaggactgcatcaagaacagcgtgctgcacagaatcaaccccggcgagaacggcctgaagagcaacgagtacagaaacggcttcagagacgacgccgacctgcccccccaccccagagtgcccctgaaggagaagctgtgccagtacgacgagttcagcgagggcctgagacacagcgcccacctgaacagacaccagagagtgcccaccggcgagaagagcgtgaagagcctggagagaggcagaggcgtgagacagaacacccacatcagaaaccaccccagagcccccgtgggcgacatgccctacagatgcgacgtgtgcggcaagggcttcagatacaagagcgtgctgctgatccaccagggcgtgcacaccggcagaagaccctacaagtgcgaggagtgcggcaaggccttcggcagaagcagcaacctgctggtgcaccagagagtgcacaccggcgagaagccctacaagtgcagcgagtgcggcaagggcttcagctacagcagcgtgctgcaggtgcaccagagactgcacaccggcgagaagccctacacctgcagcgagtgcggcaagggcttctgcgccaagagcgccctgcacaagcaccagcacatccaccccggcgagaagccctacagctgcggcgagtgcggcaagggcttcagctgcagcagccacctgagcagccaccagaagacccacaccggcgagagaccctaccagtgcgacaagtgcggcaagggcttcagccacaacagctacctgcaggcccaccagagagtgcacatgggccagcacctgtacaagtgcaacgtgtgcggcaagagcttcagctacagcagcggcctgctgatgcaccagagactgcacaccggcgagaagccctacaagtgcgagtgcggcaagagcttcggcagaagcagcgacctgcacatccaccagagagtgcacaccggcgagaagccctacaagtgcagcgagtgcggcaagggcttcagaagaaacagcgacctgcacagccaccagagagtgcacaccggcgagagaccctacgtgtgcgacgtgtgcggcaagggcttcatctacagcagcgacctgctgatccaccagagagtgcacaccggcgagaagccctacaagtgcgccgagtgcggcaagggcttcagctacagcagcggcctgctgatccaccagagagtgcacaccggcgagaagccctacagatgccaggagtgcggcaagggcttcagatgcaccagcagcctgcacaagcaccagagagtgcacaccggcaagaagccctacacctgcgaccagtgcggcaagggcttcagctacggcagcaacctgagaacccaccagagactgcacaccggcgagaagccctacacctgctgcgagtgcggcaagggcttcagatacggcagcggcctgctgagccacaagagagtgcacaccggcgagaagccctacagatgccacgtgtgcggcaagggctacagccagagcagccacctgcagggccaccagagagtgcacaccggcgagaagccctacaagtgcgaggagtgcggcaagggcttcggcagaaacagctgcctgcacgtgcaccagagagtgcacaccggcgagaagccctacacctgcggcgtgtgcggcaagggcttcagctacaccagcggcctgagaaaccaccagagagtgcacctgggcgagaacccctacaagtag

SEQ ID NO: 10252 - DNA, 2478 bp, Artificial Sequence; identical to SEQ ID NO: 10251
  Description of Artificial Sequence: Synthetic coding sequence

SEQ ID NO: 10253 - DNA, 1425 bp, Artificial Sequence
  Description of Artificial Sequence: Synthetic coding sequence
atgaccaccttcaaggaggccgtgaccttcaaggacgtggccgtgttcttcaccgaggaggagctgggcctgctggaccccgcccagagaaagctgtaccaggacgtgatgctggagaacttcaccaacctgctgagcgtgggccaccagcccttccaccccttccacttcctgagagaggagaagttctggatgatggagaccgccacccagagagagggcaacagcggcggcaagaccatcgccgaggccggcccccacgaggactgcccctgccagcagatctgggagcagaccgccagcgacctgacccagagccaggacagcatcatcaacaacagccacttcttcgagcagggcgacgtgcccagccaggtggaggccggcctgagcatcatccacaccggccagaagcccagccagaacggcaagtgcaagcagagcttcagcgacgtggccatcttcgaccccccccagcagttccacagcggcgagaagagccacacctgcaacgagtgcggcaagagcttctgctacatcagcgccctgagaatccaccagagagtgcacctgagagagaagctgagcaagtgcgacatgagaggcaaggagttcagccagagcagctgcctgcagaccagagagagagtgcacaccggcgagaagcccttcaagtgcgagcagtgcggcaagggcttcagatgcagagccatcctgcaggtgcactgcaagctgcacaccggcgagaagccctacatctgcgagaagtgcggcagagccttcatccacgacttccagctgcagaagcaccagatcatccacaccggcgagaagcccttcaagtgcgagatctgcggcaagagcttctgcctgagaagcagcctgaacagacactgcatggtgcacaccgccgagaagctgtacaagagcgaggagtgcggcaagggcttcaccgacagcctggacctgcacaagcaccagatcatccacaccggccagaagccctacaactgcaaggagtgcggcaagagcttcagatggagcagctacctgctgatccaccagagaatccacagcggcgagaagccctacagatgcgaggagtgcggcaagggctacatcagcaagagcggcctgaacctgcaccagagagtgcacaccggcgagagaccctacaactgcaaggagtgcggcaagagcttcagcagagccagcagcatcctgaaccacaagaagctgcactgcagaaagaagcccttcaagtgcgaggactgcggcaagagactggtgcacagaagcttctgcaaggaccagcagggcgaccacaacggcgagaacagcagcaagtgcgaggactgcggcaagagatacaagagaagactgaacctggacatcatcctgagcctgttcctgaacgacatgtag

SEQ ID NO: 10254 - DNA, 1335 bp, Artificial Sequence
  Description of Artificial Sequence: Synthetic coding sequence
atggagccccccggccccgtgagaggccccctgcaggacagcagctggtacgagcccagcgccgagctggtgcagaccagaatggccgtgagcctgaccgccgccgagaccctggccctgcagggcacccagggccaggagaagatgatgatgatgggccccaaggaggaggagcagagctgcgagtacgagaccagactgcccggcaaccacagcaccagccaggagatcttcagacagagattcagacacctgagataccaggagacccccggccccagagaggccctgagccagctgagagtgctgtgctgcgagtggctgagacccgagaagcacaccaaggagcagatcctggagttcctggtgctggagcagttcctgaccatcctgcccgaggagctgcagagctgggtgagaggccaccaccccaagagcggcgaggaggccgtgaccgtgctggaggacctggagaagggcctggagcccgagccccaggtgcccggccccgcccacggccccgcccaggaggagccctgggagaagaaggagagcctgggcgccgcccaggaggccctgagcatccagctgcagcccaaggagacccagcccttccccaagagcgagcaggtgtacctgcacttcctgagcgtggtgaccgaggacggccccgagcccaaggacaagggcagcctgccccagccccccatcaccgaggtggagagccaggtgttcagcgagaagctggccaccgacaccagcaccttcgaggccaccagcgagggcaccctggagctgcagcagagaaaccccaaggccgagagactgagatggagccccgcccaggaggagagcttcagacagatggtggtgatccacaaggagatccccaccggcaagaaggaccacgagtgcagcgagtgcggcaagaccttcatctacaacagccacctggtggtgcaccagagagtgcacagcggcgagaagccctacaagtgcagcgactgcggcaagaccttcaagcagagcagcaacctgggccagcaccagagaatccacaccggcgagaagcccttcgagtgcaacgagtgcggcaaggccttcagatggggcgcccacctggtgcagcaccagagaatccacagcggcgagaagccctacgagtgcaacgagtgcggcaaggccttcagccagagcagctacctgagccagcacagaagaatccacagcggcgagaagcccttcatctgcaaggagtgcggcaaggcctacggctggtgcagcgagctgatcagacacagaagagtgcacgccagaaaggagcccagccactag

SEQ ID NO: 10255 - DNA, 579 bp, Artificial Sequence
  Description of Artificial Sequence: Synthetic coding sequence
atggccgtgagcctgaccgccgccgagaccctggccctgcagggcacccagggccaggagaagatgatgatgatgggccccaaggaggaggagcagagctgcgagtacgagaccagactgcccggcaaccacagcaccagccaggagatcttcagacagagattcagacacctgagataccaggagacccccggccccagagaggccctgagccagctgagagtgctgtgctgcgagtggctgagacccgagaagcacaccaaggagcagatcctggagttcctggtgctggagcagttcctgaccatcctgcccgaggagctgcagagctgggtgagaggccaccaccccaagagcggcgaggaggccgtgaccgtgctggaggacctggagaagggcctggagcccgagccccaggtgggcagaggcatctggagcgtgatgggcgccagactgatgaccttcagactggacagaggcgccgccgtgggcggcggcgccaagttcaagcccctgctgggccaggtggagcagctggtgtgcgtgagcgtgagcgtgttcagcgccctggagccctag

SEQ ID NO: 10256 - DNA, 1704 bp, Artificial Sequence
  Description of Artificial Sequence: Synthetic coding sequence
ggccacaagaaccagaacgagatcgacaccctgcaggaggtgagactgagattcctgagctacgaggacctgatctgctggcagatctgggagcagttcaccagcaagctgaccagcaaccaggacctgatcatcaacctgcagggcaagagaagcaagctgctgaagcagggcgacagcccctgccaggtgtggaccggcgagagcagccaggtgagcgaggacgagaactacgtgatcaagctgcagggcgagagcagcaacagcatcaagaaccaggagctgcccctgagaaccacctgggacttctggagaaagatgtacctgagagagccccagaactaccagagcagatgccagcagatcgacgtgaagaacaagctgtgcaagtgcgaccactgcgtgagacagagaatcgcccaccagcacgacgaccacggcgtgcacaagagagagaaggccttcagccacaacaactgcggcaaggactgcgtgaaggagagcagccagcacagcatcatccagagcggcgagcagaccagcgacgagaacggcaagggcctgagcgtgggcagcaacctggagctgcaccagcagctgcacctgagagacaagccccacgtgaacgtggagtacggcaagggcatcggctacagcagcggcctgcccagacaccagtgcttccacatcggcgagaagtgctacagaaacggcgacagcggcgagggcttcagccagggcagccacctgcagccccaccagagagtgagcaccggcgagaacctgtacagatgccaggtgtacgccagaagcagcaaccagaacagctgcctgcccagccacgagctgacccaccccggcgagaagctgtgcacctgcggcagatgcggcaagggcttccaccacagcctggacttcgacatccactgcgtggacagcgccggcgagagagcctgcaagtgcgacgtgtacgacaagggcttcagccagaccagccagctgcaggcccaccagagagtgcacaccggcgagaagccctacaagtgcgaggtgtgcgacaagggcttcagcaaggccagcaacctgcaggcccaccagagaatccacaccggcgagaagccctacaagtgcgacgtgtgcgacaagaacttcagcagaaacagccacctgcaggcccaccagagagtgcacaccggcgagaagccctacaagtgcgacacctgcggcaaggacttcagccagatcagccacctgcaggcccaccagagagtgcacaagggcgagaagccctacaagtgcgagacctgcggcaagggcttcagccagagcagccacctgcaggaccaccagcaggtgcacaccggcgagaacccctacaagtgcgacgtgtgcggcaagggcttcagctggagcagccacctgcaggcccaccagagagtgcacaccggcgagaagccctacaagtgcgaggagtgcagaaagggcttcatctggaacagctacctgcacgtgcaccagagaatccacaccggcgagaagccctacaagtgcggcatgtgcggcaagagcttcagccagaccagccacctgcaggcccaccagagagtgcacaccggcgagaagccctacaagtgcttcgtgtgcggcaagggcttcagcaagagcagcctgcagatccaccagagagtgcacgacggcgactag

SEQ ID NO: 10257 - DNA, 1959 bp, Artificial Sequence
  Description of Artificial Sequence: Synthetic coding sequence
atggtgaagagaagcatgcagcaggaggagctgaccatcctgaacatctacgcccccaacaccggcgcccccagattcatcagagccgtggcctgcttcagaagcggcatcctgggcagcgtggtgcagaagcccctgcagccctgcgtgctgcccctgcaggagggcgaggccgccgtgatctaccccctgtgggaggtgagccagagaggcaccagcgccagcaccgccagcttccccggcctgggcgtgggcctggccgtgctgcccagccaggaccccgccctgccccagaaggagcaggagaagatgaccaagttccagctgctggccatcagactgagactgcacctgctggacgtggtgggcgacggcgacatccagggctgcggctgcggcctgcaccagggcggcgccggcgtggccggcccctgccccgagaaggccgtgcccagatgcgacgccggcgagctgcaggagcccgccgtgagcggcctgagcaccctgcagaccagatgcgacatcaccgtgggcaagagaagacaggccagcgacgacggcgacagaaaccccagaagatgggtgttcagacagagaatcgcccaccagcacgacgaccacggcgtgcacaagagagagaaggccttcagccacaacaactgcggcaaggactgcgtgaaggagagcagccagcacagcatcatccagagcggcgagcagaccagcgacgagaacggcaagggcctgagcgtgggcagcaacctggagctgcaccagcagctgcacctgagagacaagccccacgtgaacgtggagtacggcaagggcatcggctacagcagcggcctgcccagacaccagtgcttccacatcggcgagaagtgctacagaaacggcgacagcggcgagggcttcagccagggcagccacctgcagccccaccagagagtgagcaccggcgagaacctgtacagatgccaggtgtacgccagaagcagcaaccagaacagctgcctgcccagccacgagctgacccaccccggcgagaagctgtgcacctgcggcagatgcggcaagggcttccaccacagcctggacttcgacatccactgcgtggacagcgccggcgagagagcctgcaagtgcgacgtgtacgacaagggcttcagccagaccagccagctgcaggcccaccagagaggccacagcagagacaagacctacaagtgggaggtgagcgacagaatcttcaacagaaacagcggcctgcaccagagagtgcacaccggcgagaagccctacaagtgcgaggtgtgcgacaagggcttcagcaaggccagcaacctgcaggcccaccagagaatccacaccggcgagaagccctacaagtgcgacgtgtgcgacaagaacttcagcagaaacagccacctgcaggcccaccagagagtgcacaccggcgagaagccctacaagtgcgacacctgcggcaaggacttcagccagatcagccacctgcaggcccaccagagagtgcacaagggcgagaagccctacaagtgcgagacctgcggcaagggcttcagccagagcagccacctgcaggaccaccagcaggtgcacaccggcgagaacccctacaagtgcgacgtgtgcggcaagggcttcagctggagcagccacctgcaggcccaccagagagtgcacaccggcgagaagccctacaagtgcgaggagtgcagaaagggcttcatctggaacagctacctgcacgtgcaccagagaatccacaccggcgagaagccctacaagtgcggcatgtgcggcaagagcttcagccagaccagccacctgcaggcccaccagagagtgcacaccggcgagaagccctacaagtgcttcgtgtgcggcaagggcttcagcaagagcagcctgagcagcgacagcagcgagagcccctag

SEQ ID NO: 10258 - DNA, 2013 bp, Artificial Sequence
  Description of Artificial Sequence: Synthetic coding sequence
atgaccaagttccaggagatggtgaccttcaaggacgtggccgtggtgttcaccagagaggagctgggcctgctggacctggcccagagaaagctgtaccaggacgtgatgctggagaacttcagaaacctgctgagcgtgggctaccagcccttcaagctggacgtgatcctgcagctgggcaaggaggacaagctgagaatgatggagaccgagatccagggcgacggctgcagcggccacaagaaccagaacgagatcgacaccctgcaggaggtgagactgagattcctgagctacgaggacctgatctgctggcagatctgggagcagttcaccagcaagctgaccagcaaccaggacctgatcatcaacctgcagggcaagagaagcaagctgctgaagcagggcgacagcccctgccaggtgtggaccggcgagagcagccaggtgagcgaggacgagaactacgtgatcaagctgcagggcgagagcagcaacagcatcaagaaccaggagctgcccctgagaaccacctgggacttctggagaaagatgtacctgagagagccccagaactaccagagcagatgccagcagatcgacgtgaagaacaagctgtgcaagtgcgaccactgcgtgagacagagaatcgcccaccagcacgacgaccacggcgtgcacaagagagagaaggccttcagccacaacaactgcggcaaggactgcgtgaaggagagcagccagcacagcatcatccagagcggcgagcagaccagcgacgagaacggcaagggcctgagcgtgggcagcaacctggagctgcaccagcagctgcacctgagagacaagccccacgtgaacgtggagtacggcaagggcatcggctacagcagcggcctgcccagacaccagtgcttccacatcggcgagaagtgctacagaaacggcgacagcggcgagggcttcagccagggcagccacctgcagccccaccagagagtgagcaccggcgagaacctgtacagatgccaggtgtacgccagaagcagcaaccagaacagctgcctgcccagccacgagctgacccaccccggcgagaagctgtgcacctgcggcagatgcggcaagggcttccaccacagcctggacttcgacatccactgcgtggacagcgccggcgagagagcctgcaagtgcgacgtgtacgacaagggcttcagccagaccagccagctgcaggcccaccagagaggccacagcagagacaagacctacaagtgggaggtgagcgacagaatcttcaacagaaacagcggcctgcaccagagagtgcacaccggcgagaagccctacaagtgcgaggtgtgcgacaagggcttcagcaaggccagcaacctgcaggcccaccagagaatccacaccggcgagaagccctacaagtgcgacgtgtgcgacaagaacttcagcagaaacagccacctgcaggcccaccagagagtgcacaccggcgagaagccctacaagtgcgacacctgcggcaaggacttcagccagatcagccacctgcaggcccaccagagagtgcacaagggcgagaagccctacaagtgcgagacctgcggcaagggcttcagccagagcagccacctgcaggaccaccagcaggtgcacaccggcgagaacccctacaagtgcgacgtgtgcggcaagggcttcagctggagcagccacctgcaggcccaccagagagtgcacaccggcgagaagccctacaagtgcgaggagtgcagaaagggcttcatctggaacagctacctgcacgtgcaccagagaatccacaccggcgagaagccctacaagtgcggcatgtgcggcaagagcttcagccagaccagccacctgcaggcccaccagagagtgcacaccggcgagaagccctacaagtgcttcgtgtgcggcaagggcttcagcaagagcagcctgagcagcgacagcagcgagagcccctag

SEQ ID NO: 10259 - DNA, 321 bp, Artificial Sequence
  Description of Artificial Sequence: Synthetic coding sequence
ggccacaagaaccagaacgagatcgacaccctgcaggaggtgagactgagattcctgagctacgaggacctgatctgctggcagatctgggagcagttcaccagcaagctgaccagcaaccaggacctgatcatcaacctgcagggcaagagaagcaagctgctgaagcagggcgacagcccctgccaggtgtggaccggcgagagcagccaggtgagcgaggacgagaactacgtgatcaagctgcagggcgagagcagcaacagcatcaagaaccaggagctgcccagccagaagaagaagaagaagaagaagaagtag

SEQ ID NO: 10260 - DNA, 2217 bp, Artificial Sequence
  Description of Artificial Sequence: Synthetic coding sequence
atgaccaagttccaggaggccgtgaccttcaaggacgtggccgtggccttcaccgaggaggagctgggcctgctggacagcgcccagagaaagctgtacagagacgtgatgctggagaacttcagaaacctggtgagcgtgggccaccagagcttcaagcccgacatgatcagccagctggagagagaggagaagctgtggatgaaggagctgcagacccagagaggcaagcacagcggcgacagaaaccagaacgagatggccaccctgcacaaggccggcctgagatgcttcagcctgggcgagctgagctgctggcagatcaagagacacatcgccagcaagctggccagaagccaggacagcatgatcaacatcgagggcaagagcagccagttccccaagcaccacgacagcccctgccaggtgggcgccggcgagagcatccaggccagcgtggacgacaactgcctggtgaaccacatcggcgaccacagcagcatcatcgagaaccaggagttccccaccggcaaggtgcccaacagctggagcaagatctacctgaacgagacccagaactaccagagaagctgcaagcagacccagatgaagaacaagctgtgcatcttcgccccctacgtggacatcttcagctgcatcagccaccaccacgacgacaacatcgtgcacaagagagacaaggtgcacagcaacagcgactgcggcaaggacaccctgaaggtgagccccctgacccagagaagcatccacaccggccagaagacctaccagggcaacgagtgcgaggaggccttcaacgacagcagcagcctggagctgcacaagcaggtgcacctgggcaagaagagccccgcctgcagcacccacgagaaggacaccagctacagcagcggcatccccgtgcagcagagcgtgagaaccggcaagaagagatactggtgccacgagtgcggcaagggcttcagccagagcagcaacctgcagacccaccagagagtgcacaccggcgagaagccctacacctgccacgagtgcggcaagagcttcaaccagagcagccacctgtacgcccacctgcccatccacaccggcgagaagccctacagatgcgacagctgcggcaagggcttcagcagaagcaccgacctgaacatccactgcagagtgcacaccggcgagaagccctacaagtgcgaggtgtgcggcaagggcttcacccagagaagccacctgcaggcccacgagagaatccacaccggcgagaagccctacaagtgcggcgactgcggcaagagattcagctgcagcagcaacctgcacacccaccagagagtgcacaccgaggagaagccctacaagtgcgacgagtgcggcaagtgcttcagcctgagcttcaacctgcacagccaccagagagtgcacaccggcgagaagccctacaagtgcgaggagtgcggcaagggcttcagcagcgccagcagcttccagagccaccagagagtgcacaccggcgagaagcccttcagatgcaacgtgtgcggcaagggcttcagccagagcagctacttccaggcccaccagagagtgcacaccggcgagaagccctacaagtgcgaggtgtgcggcaagagattcaactggagcctgaacctgcacaaccaccagagagtgcacaccggcgagaagccctacaagtgcgaggagtgcggcaagggcttcagccaggccagcaacctgcaggcccaccagagcgtgcacaccggcgagaagcccttcaagtgcgacgcctgccagaagagattcagccaggccagccacctgcaggcccaccagagagtgcacaccggcgagaagccctacaagtgcgacacctgcggcaaggccttcagccagagaagcaacctgcaggtgcaccagatcatccacaccggcgagaagcccttcaagtgcgaggagtgcggcaaggagttcagctggagcgccggcctgagcgcccaccagagagtgcacaccggcgagaagccctacacctgccagcagtgcggcaagggcttcagccaggccagccacttccacacccaccagagagtgcacaccggcgagagaccctacatctgcgacgtgtgctgcaagggcttcagccagagaagccacctgatctaccaccagagagtgcacaccggcggcaacctgtag

SEQ ID NO: 10261 - DNA, 1767 bp, Artificial Sequence
  Description of Artificial Sequence: Synthetic coding sequence
agcggcgacagaaaccagaacgagatggccaccctgcacaaggccggcctgagatgcttcagcctgggcgagctgagctgctggcagatcaagagacacatcgccagcaagctggccagaagccaggacagcatgatcaacatcgagggcaagagcagccagttccccaagcaccacgacagcccctgccaggtgggcgccggcgagagcatccaggccagcgtggacgacaactgcctggtgaaccacatcggcgaccacagcagcatcatcgagaaccaggagttccccaccggcaaggtgcccaacagctggagcaagatctacctgaacgagacccagaactaccagagaagctgcaagcagacccagatgaagaacaagctgtgcatcttcgccccctacgtggacatcttcagctgcatcagccaccaccacgacgacaacatcgtgcacaagagagacaaggtgcacagcaacagcgactgcggcaaggacaccctgaaggtgagccccctgacccagagaagcatccacaccggccagaagacctaccagggcaacgagtgcgaggaggccttcaacgacagcagcagcctggagctgcacaagcaggtgcacctgggcaagaagagccccgcctgcagcacccacgagaaggacaccagctacagcagcggcatccccgtgcagcagagcgtgagaaccggcaagaagagatactggtgccacgagtgcggcaagggcttcagccagagcagcaacctgcagacccaccagagagtgcacaccggcgagaagccctacacctgccacgagtgcggcaagagcttcaaccagagcagccacctgtacgcccacctgcccatccacaccggcgagaagccctacagatgcgacagctgcggcaagggcttcagcagaagcaccgacctgaacatccactgcagagtgcacaccggcgagaagccctacaagtgcgaggtgtgcggcaagggcttcacccagagaagccacctgcaggcccacgagagaatccacaccggcgagaagccctacaagagccagatcttcatccccatcagagacttcaacctgcacagccaccagagagtgcacaccggcgagaagccctacaagtgcgaggagtgcggcaagggcttcagcagcgccagcagcttccagagccaccagagagtgcacaccggcgagaagcccttcagatgcaacgtgtgcggcaagggcttcagccagagcagctacttccaggcccaccagagagtgcacaccggcgagaagccctacaagtgcgaggtgtgcggcaagagattcaactggagcctgaacctgcacaaccaccagagagtgcacaccggcgagaagccctacaagtgcgaggagtgcggcaagggcttcagccaggccagcaacctgcaggcccaccagagcgtgcacaccggcgagaagcccttcaagtgcgacgcctgccagaagagattcagccaggccagccacctgcaggcccaccagagagtgcacaccggcgagaagccctacaagtgcgacacctgcggcaaggccttcagccagagaagcaacctgcaggtgcaccagatcatccacaccggcgagaagcccttcaagtgcgaggagtgcggcaaggagttcagctggagcgccggcctgagcgcccaccagagagtgcacaccggcgagaagccctacacctgccagcagtgcggcaagggcttcagccaggccagctag

SEQ ID NO: 10262 - DNA, 2217 bp, Artificial Sequence
  Description of Artificial Sequence: Synthetic coding sequence
atgggcagaatccaggaggccgtgaccttcaaggacgtggccgtggccttcaccgaggaggagctgggcctgctggacagcgcccagagaaagctgtacagagacgtgatgctggagaacttcagaaacctggtgagcgtgggccaccagagcttcaagcccgacatgatcagccagctggagagagaggagaagctgtggatgaaggagctgcagacccagagaggcaagcacagcggcgacagaaaccagaacgagatggccaccctgcacaaggccggcctgagatgcttcagcctgggcgagctgagctgctggcagatcaagagacacatcgccagcaagctggccagaagccaggacagcatgatcaacatcgagggcaagagcagccagttccccaagcaccacgacagcccctgccaggtgggcgccggcgagagcatccaggccagcgtggacgacaactgcctggtgaaccacatcggcgaccacagcagcatcatcgagaaccaggagttccccaccggcaaggtgcccaacagctggagcaagatctacctgaacgagacccagaactaccagagaagctgcaagcagacccagatgaagaacaagctgtgcatcttcgccccctacgtggacatcttcagctgcatcagccaccaccacgacgacaacatcgtgcacaagagagacaaggtgcacagcaacagcgactgcggcaaggacaccctgaaggtgagccccctgacccagagaagcatccacaccggccagaagacctaccagggcaacgagtgcgaggaggccttcaacgacagcagcagcctggagctgcacaagcaggtgcacctgggcaagaagagccccgcctgcagcacccacgagaaggacaccagctacagcagcggcatccccgtgcagcagagcgtgagaaccggcaagaagagatactggtgccacgagtgcggcaagggcttcagccagagcagcaacctgcagacccaccagagagtgcacaccggcgagaagccctacacctgccacgagtgcggcaagagcttcaaccagagcagccacctgtacgcccacctgcccatccacaccggcgagaagccctacagatgcgacagctgcggcaagggcttcagcagaagcaccgacctgaacatccactgcagagtgcacaccggcgagaagccctacaagtgcgaggtgtgcggcaagggcttcacccagagaagccacctgcaggcccacgagagaatccacaccggcgagaagccctacaagtgcggcgactgcggcaagagattcagctgcagcagcaacctgcacacccaccagagagtgcacaccgaggagaagccctacaagtgcgacgagtgcggcaagtgcttcagcctgagcttcaacctgcacagccaccagagagtgcacaccggcgagaagccctacaagtgcgaggagtgcggcaagggcttcagcagcgccagcagcttccagagccaccagagagtgcacaccggcgagaagcccttcagatgcaacgtgtgcggcaagggcttcagccagagcagctacttccaggcccaccagagagtgcacaccggcgagaagccctacaagtgcgaggtgtgcggcaagagattcaactggagcctgaacctgcacaaccaccagagagtgcacaccggcgagaagccctacaagtgcgaggagtgcggcaagggcttcagccaggccagcaacctgcaggcccaccagagcgtgcacaccggcgagaagcccttcaagtgcgacgcctgccagaagagattcagccaggccagccacctgcaggcccaccagagagtgcacaccggcgagaagccctacaagtgcgacacctgcggcaaggccttcagccagagaagcaacctgcaggtgcaccagatcatccacaccggcgagaagcccttcaagtgcgaggagtgcggcaaggagttcagctggagcgccggcctgagcgcccaccagagagtgcacaccggcgagaagccctacacctgccagcagtgcggcaagggcttcagccaggccagccacttccacacccaccagagagtgcacaccggcgagagaccctacatctgcgacgtgtgctgcaagggcttcagccagagaagccacctgatctaccaccagagagtgcacaccggcggcaacctgtag

SEQ ID NO: 10263 - DNA, 546 bp, Artificial Sequence
  Description of Artificial Sequence: Synthetic coding sequence
atgggcagaatccaggaggccgtgaccttcaaggacgtggccgtggccttcaccgaggaggagctgggcctgctggacagcgcccagagaaagctgtacagagacgtgatgctggagaacttcagaaacctggtgagcgtgggccaccagagcttcaagcccgacatgatcagccagctggagagagaggagaagctgtggatgaaggagctgcagacccagagaggcgacagaaaccagaacgagatggccaccctgcacaaggccggcctgagatgcttcagcctgggcgagctgagctgctggcagatcaagagacacatcgccagcaagctggccagaagccaggacagcatgatcaacatcgagggcaagagcagccagttccccaagcaccacgacagcccctgccaggtgggcgccggcgagagcatccaggccagcgtggacgacaactgcctggtgaaccacatcggcgaccacagcagcatcatcgagaaccaggagttccccaccggcaagaagaagaagaagaagaagcagtag

SEQ ID NO: 10264 - DNA, 1740 bp, Artificial Sequence
  Description of Artificial Sequence: Synthetic coding sequence
atgaacaagagccaggagcaggtgagcttcaaggacgtgtgcgtggacttcacccaggaggagtggtacctgctggaccccgcccagaagatcctgtacagagacgtgatcctggagaactacagcaacctggtgagcgtgggctactgcatcaccaagcccgaggtgatcttcaagatcgagcagggcgaggagccctggatcctggagaagggcttccccagccagtgccaccccgagagaaagtggaaggtggacgacgtgctggagagcagccaggagaacgaggacgaccacttctgggagctgctgttccacaacaacaagaccgtgagcgtggagaacggcgacagaggcagcaagaccttcaacctgggcaccgaccccgtgagcctgagaaactacccctacaagatctgcgacagctgcgagatgaacctgaagaacatcagcggcctgatcatcagcaagaagaactgcagcagaaagaagcccgacgagttcaacgtgtgcgagaagctgctgctggacatcagacacgagaagatccccatcggcgagaagagctacaagtacgaccagaagagaaacgccatcaactaccaccaggacctgagccagcccagcttcggccagagcttcgagtacagcaagaacggccagggcttccacgacgaggccgccttcttcaccaacaagagaagccagatcggcgagaccgtgtgcaagtacaacgagtgcggcagaaccttcatcgagagcctgaagctgaacatcagccagagaccccacctggagatggagccctacggctgcagcatctgcggcaagagcttctgcatgaacctgagattcggccaccagagagccctgaccaaggacaacccctacgagtacaacgagtacggcgagatcttctgcgacaacagcgccttcatcatccaccagggcgcctacaccagaaagatcctgagagagtacaaggtgagcgacaagacctgggagaagagcgccctgctgaagcaccagatcgtgcacatgggcggcaagagctacgactacaacgagaacggcagcaacttcagcaagaagagccacctgacccagctgagaagagcccacaccggcgagaagaccttcgagtgcggcgagtgcggcaagaccttctgggagaagagcaacctgacccagcaccagagaacccacaccggcgagaagccctacgagtgcaccgagtgcggcaaggccttctgccagaagccccacctgaccaaccaccagagaacccacaccggcgagaagccctacgagtgcaagcagtgcggcaagaccttctgcgtgaagagcaacctgaccgagcaccagagaacccacaccggcgagaagccctacgagtgcaacgcctgcggcaagagcttctgccacagaagcgccctgaccgtgcaccagagaacccacaccggcgagaagcccttcatctgcaacgagtgcggcaagagcttctgcgtgaagagcaacctgatcgtgcaccagagaacccacaccggcgagaagccctacaagtgcaacgagtgcggcaagaccttctgcgagaagagcgccctgaccaagcaccagagaacccacaccggcgagaagccctacgagtgcaacgcctgcggcaagaccttcagccagagaagcgtgctgaccaagcaccagagaatccacaccagagtgaaggccctgagcaccagctag

SEQ ID NO: 10265 - DNA, 360 bp, Artificial Sequence
  Description of Artificial Sequence: Synthetic coding sequence
atgaacaagagccaggagcaggtgagcttcaaggacgtgtgcgtggacttcacccaggaggagtggtacctgctggaccccgcccagaagatcctgtacagagacgtgatcctggagaactacagcaacctggtgagcgtgggctactgcatcaccaagcccgaggtgatcttcaagatcgagcagggcgaggagccctggatcctggagaagggcttccccagccagtgccaccccgagagaaagtggaaggtggacgacgtgctggagagcagccaggagaacgaggacgaccacttctgggagctgctgttccacaacaacaagacctggaacctgaagctgatcaaggtggagtag

SEQ ID NO: 10266 - DNA, 1740 bp, Artificial Sequence; identical to SEQ ID NO: 10264
  Description of Artificial Sequence: Synthetic coding sequence

SEQ ID NO: 10267 - DNA, 303 bp, Artificial Sequence
  Description of Artificial Sequence: Synthetic coding sequence
atgaacaagagccaggagcaggtgagcttcaaggacgtgtgcgtggacttcacccaggaggagtggtacctgctggaccccgcccagaagatcctgtacagagacgtgatcctggagaactacagcaacctggtgagcgtgggctactgcatcaccaagcccgaggtgatcttcaagatcgagcagggcgaggagccctggatcctggagaagggcttccccagccagtgccaccccgagagaaagtggaaggtggacgacgtgctggagagcagccaggagaacgaggacgaccacttctag

SEQ ID NO: 10268 - DNA, 210 bp, Artificial Sequence
  Description of Artificial Sequence: Synthetic coding sequence
atgaacaagagccaggagcaggtgagcttcaaggacgtgtgcgtggacttcacccaggaggagtggtacctgctggaccccgcccagaagatcctgtacagagacgtgatcctggagaactacagcaacctggtgagcgtgggctactgcatcaccaagcccgaggtgatcttcaagatcgagcagggcgaggagccctggatcctgtag

SEQ ID NO: 10269 - DNA, 1683 bp, Artificial Sequence
  Description of Artificial Sequence: Synthetic coding sequence
atggccgccgccagactgctgcccgtgcccgccggcccccagcccctgagcttccaggccaagctgaccttcgaggacgtggccgtgctgctgagccaggacgagtgggacagactgtgccccgcccagagaggcctgtacagaaacgtgatgatggagacctacggcaacgtggtgagcctgggcctgcccggcagcaagcccgacatcatcagccagctggagagaggcgaggacccctgggtgctggacagaaagggcgccaagaagagccagggcctgtggagcgactacagcgacaacctgaagtacgaccacaccaccgcctgcacccagcaggacagcctgagctgcccctgggagtgcgagaccaagggcgagagccagaacaccgacctgagccccaagcccctgatcagcgagcagaccgtgatcctgggcaagacccccctgggcagaatcgaccaggagaacaacgagaccaagcagagcttctgcctgagccccaacagcgtggaccacagagaggtgcaggtgctgagccagagcatgcccctgaccccccaccaggccgtgcccagcggcgagagaccctacatgtgcgtggagtgcggcaagtgcttcggcagaagcagccacctgctgcagcaccagagaatccacaccggcgagaagccctacgtgtgcagcgtgtgcggcaaggccttcagccagagcagcgtgctgagcaagcacagaagaatccacaccggcgagaagccctacgagtgcaacgagtgcggcaaggccttcagagtgagcagcgacctggcccagcaccacaagatccacaccggcgagaagccccacgagtgcctggagtgcagaaaggccttcacccagctgagccacctgatccagcaccagagaatccacaccggcgagagaccctacgtgtgccccctgtgcggcaaggccttcaaccacagcaccgtgctgagaagccaccagagagtgcacaccggcgagaagccccacagatgcaacgagtgcggcaagaccttcagcgtgaagagaaccctgctgcagcaccagagaatccacaccggcgagaagccctacacctgcagcgagtgcggcaaggccttcagcgacagaagcgtgctgatccagcaccacaacgtgcacaccggcgagaagccctacgagtgcagcgagtgcggcaagaccttcagccacagaagcaccctgatgaaccacgagagaatccacaccgaggagaagccctacgcctgctacgagtgcggcaaggccttcgtgcagcacagccacctgatccagcaccagagagtgcacaccggcgagaagccctacgtgtgcggcgagtgcggccacgccttcagcgccagaagaagcctgatccagcacgagagaatccacaccggcgagaagcccttccagtgcaccgagtgcggcaaggccttcagcctgaaggccaccctgatcgtgcacctgagaacccacaccggcgagaagccctacgagtgcaacagctgcggcaaggccttcagccagtacagcgtgctgatccagcaccagagaatccacaccggcgagaagccctacgagtgcggcgagtgcggcagagccttcaaccagcacggccacctgatccagcaccagaaggtgcacagaaagctgtag

SEQ ID NO: 10270 - DNA, 369 bp, Artificial Sequence
  Description of Artificial Sequence: Synthetic coding sequence
atggccgccgccagactgctgcccgtgcccgccggcccccaggccaagctgaccttcgaggacgtggccgtgctgctgagccaggacgagtgggacagactgtgccccgcccagagaggcctgtacagaaacgtgatgatggagacctacggcaacgtggtgagcctgggcctgcccggcagcaagcccgacatcatcagccagctggagagaggcgaggacccctgggtgctggacagaaagggcgccaagaagagccagggcctgtggagcgactacagcgacaacctgaagtacgaccacaccaccgcctgcacccagcaggacagcctgagctgcccctgggaccccgtgccccagaagccctag

SEQ ID NO: 10271 - DNA, 1332 bp, Artificial Sequence
  Description of Artificial Sequence: Synthetic coding sequence
atggccgccgccagactgctgcccgtgcccgccggcccccaggccaagctgaccttcgaggacgtggccgtgctgctgagccaggacgagtgggacagactgtgccccgcccagagaggcctgtacagaaacgtgatgatggagacctacggcaacgtggtgagcctgggcctgcccggcagcaagcccgacatcatcagccagctggagagaggcgaggacccctgggtgctggacagaaagggcgccaagaagagccagggcctgtggagcgactacagcgacaacctgaagtacgaccacaccaccgcctgcacccagcaggacagcctgagctgcccctgggagtgcgagaccaagggcgagagccagaacaccgacctgagccccaagcccctgatcagcgagcagaccgtgatcctgggcaagacccccctgggcagaatcgaccaggagaacaacgagaccaagcagagcttctgcctgagccccaacagcgtggaccacagagaggtgcaggtgctgagccagagcatgcccctgaccccccaccaggccgtgcccagcggcgagagaccctacatgtgcgtggagtgcggcaagtgcttcggcagaagcagccacctgctgcagcaccagagaatccacaccggcgagaagccctacgtgtgcagcgtgtgcggcaaggccttcagccagagcagcgtgctgagcaagcacagaagaatccacaccggcgagaagccctacgagtgcaacgagtgcggcaaggccttcagagtgagcagcgacctggcccagcaccacaagatccacaccggcgagaagccccacgagtgcctggagtgcagaaaggccttcacccagctgagccacctgatccagcaccagagaatccacaccggcgagagaccctacgtgtgccccctgtgcggcaaggccttcaaccacagcaccgtgctgagaagccaccagagagtgcacaccggcgagaagccccacagatgcaacgagtgcggcaagaccttcagcgtgaagagaaccctgctgcagcaccagagaatccacaccggcgagaagcccttccagtgcaccgagtgcggcaaggccttcagcctgaaggccaccctgatcgtgcacctgagaacccacaccggcgagaagccctacgagtgcaacagctgcggcaaggccttcagccagtacagcgtgctgatccagcaccagagaatccacaccggcgagaagccctacgagtgcggcgagtgcggcagagccttcaaccagcacggccacctgatccagcaccagaaggtgcacagaaagctgtag

SEQ ID NO: 10272 - DNA, 1668 bp, Artificial Sequence
  Description of Artificial Sequence: Synthetic coding sequence
atggccgccgccagactgctgcccgtgcccgccggcccccaggccaagctgaccttcgaggacgtggccgtgctgctgagccaggacgagtgggacagactgtgccccgcccagagaggcctgtacagaaacgtgatgatggagacctacggcaacgtggtgagcctgggcctgcccggcagcaagcccgacatcatcagccagctggagagaggcgaggacccctgggtgctggacagaaagggcgccaagaagagccagggcctgtggagcgactacagcgacaacctgaagtacgaccacaccaccgcctgcacccagcaggacagcctgagctgcccctgggagtgcgagaccaagggcgagagccagaacaccgacctgagccccaagcccctgatcagcgagcagaccgtgatcctgggcaagacccccctgggcagaatcgaccaggagaacaacgagaccaagcagagcttctgcctgagccccaacagcgtggaccacagagaggtgcaggtgctgagccagagcatgcccctgaccccccaccaggccgtgcccagcggcgagagaccctacatgtgcgtggagtgcggcaagtgcttcggcagaagcagccacctgctgcagcaccagagaatccacaccggcgagaagccctacgtgtgcagcgtgtgcggcaaggccttcagccagagcagcgtgctgagcaagcacagaagaatccacaccggcgagaagccctacgagtgcaacgagtgcggcaaggccttcagagtgagcagcgacctggcccagcaccacaagatccacaccggcgagaagccccacgagtgcctggagtgcagaaaggccttcacccagctgagccacctgatccagcaccagagaatccacaccggcgagagaccctacgtgtgccccctgtgcggcaaggccttcaaccacagcaccgtgctgagaagccaccagagagtgcacaccggcgagaagccccacagatgcaacgagtgcggcaagaccttcagcgtgaagagaaccctgctgcagcaccagagaatccacaccggcgagaagccctacacctgcagcgagtgcggcaaggccttcagcgacagaagcgtgctgatccagcaccacaacgtgcacaccggcgagaagccctacgagtgcagcgagtgcggcaagaccttcagccacagaagcaccctgatgaaccacgagagaatccacaccgaggagaagccctacgcctgctacgagtgcggcaaggccttcgtgcagcacagccacctgatccagcaccagagagtgcacaccggcgagaagccctacgtgtgcggcgagtgcggccacgccttcagcgccagaagaagcctgatccagcacgagagaatccacaccggcgagaagcccttccagtgcaccgagtgcggcaaggccttcagcctgaaggccaccctgatcgtgcacctgagaacccacaccggcgagaagccctacgagtgcaacagctgcggcaaggccttcagccagtacagcgtgctgatccagcaccagagaatccacaccggcgagaagccctacgagtgcggcgagtgcggcagagccttcaaccagcacggccacctgatccagcaccagaaggtgcacagaaagctgtag

SEQ ID NO: 10273 - DNA, 369 bp, Artificial Sequence; identical to SEQ ID NO: 10270
  Description of Artificial Sequence: Synthetic coding sequence

SEQ ID NO: 10274 - DNA, 384 bp, Artificial Sequence
  Description of Artificial Sequence: Synthetic coding sequence
atggccgccgccagactgctgcccgtgcccgccggcccccagcccctgagcttccaggccaagctgaccttcgaggacgtggccgtgctgctgagccaggacgagtgggacagactgtgccccgcccagagaggcctgtacagaaacgtgatgatggagacctacggcaacgtggtgagcctgggcctgcccggcagcaagcccgacatcatcagccagctggagagaggcgaggacccctgggtgctggacagaaagggcgccaagaagagccagggcctgtggagcgactacagcgacaacctgaagtacgaccacaccaccgcctgcacccagcaggacagcctgagctgcccctgggaccccgtgccccagaagccctag

SEQ ID NO: 10275 - DNA, 2016 bp, Artificial Sequence
  Description of Artificial Sequence: Synthetic coding sequence
atggccgccaccttccagctgcccggccaccaggagatgcccctgaccttccaggacgtggccgtgtacttcagccaggccgagggcagacagctgggcccccagcagagagccctgtacagagacgtgatgctggagaactacggcaacgtggccagcctgggcttccccgtgcccaagcccgagctgatcagccagctggagcagggcaaggagctgtgggtgctgaacctgctgggcgccgaggagcccgacatcctgaagagctgccagaaggacagcgaggtgggcaccaagaaggagctgagcatcctgaaccagaagttcagcgaggaggtgaagacccccgagttcgtgagcagaagactgctgagagacaacgcccaggccgccgagttcagagaggcctggggcagagagggcaagctgaaggagagagtgggcaacagcgccggccagagcctgaacaagcccaacatccacaagagagtgctgaccgaggccaccgtgggcagagagagaagcctgggcgagagaacccaggagtgcagcgccttcgacagaaacctgaacctggaccagaacgtggtgagactgcagagaaacaagaccggcgagagagtgttcaagtgcgacatctgcagcaagaccttcaagtacaacagcgacctgagcagacaccagagaagccacaccggcgagaagccctacgagtgcggcagatgcggcagagccttcacccacagcagcaacctggtgctgcaccaccacatccacaccggcaacaagcccttcaagtgcgacgagtgcggcaagaccttcggcctgaacagccacctgagactgcacagaagaatccacaccggcgagaagcccttcggctgcggcgagtgcggcaaggccttcagcagaagcagcaccctgatccagcacagaatcatccacaccggcgagaagccctacaagtgcaacgagtgcggcagaggcttcagccagagcccccagctgacccagcaccagagaatccacaccggcgagaagccccacgagtgcagccactgcggcaaggccttcagcagaagcagcagcctgatccagcacgagagaatccacaccggcgagaagccccacaagtgcaaccagtgcggcaaggccttcagccagagcagcagcctgttcctgcaccacagagtgcacaccggcgagaagccctacgtgtgcaacgagtgcggcagagccttcggcttcaacagccacctgaccgagcacgtgagaatccacaccggcgagaagccctacgtgtgcaacgagtgcggcaaggccttcagaagaagcagcaccctggtgcagcacagaagagtgcacaccggcgagaagccctaccagtgcgtggagtgcggcaaggccttcagccagagcagccagctgaccctgcaccagagagtgcacaccggcgagaagccctacgactgcggcgactgcggcaaggccttcagcagaagaagcaccctgatccagcaccagaaggtgcacagcggcgagaccagaaagtgcagaaagcacggccccgccttcgtgcacggcagcagcctgaccgccgacggccagatccccaccggcgagaagcacggcagagccttcaaccacggcgccaacctgatcctgagatggaccgtgcacaccggcgagaagagcttcggctgcaacgagtacggcaaggccttcagccccaccagcagacccaccgaggaccagatcatgcacgccggcgagaagccctacaagtgccaggagtgcggcaacgccttcagcggcaagagcaccctgatccagcaccaggtgacccacaccggccagaagccctgccactgcagcgtgtacggcaaggccttcagccagagcagccagctgacccccccccagcagaccagagtgggcgagaagcccgccctgaacgacggcagcaagagatacttcatccacatcaagaagatcttccaggagagacacttctag

SEQ ID NO: 10276 - DNA, 1602 bp, Artificial Sequence
  Description of Artificial Sequence: Synthetic coding sequence
atggccaccagcttcagaaccgccagctgctggggcctgctgagcttcaaggacatcagcatggagttcacctgggacgagtggcagctgctggacagcacccagaagtacctgtacagagacgtgatcctggagaactaccacaacctgatcagcgtgggctaccacggcaccaagcccgacctgatcttcaagctggagcagggcgaggacccctggatcatcaacgccaagatcagcagacagagctgccccgacggctgggaggagtggtaccagaacaaccaggacgagctggagagcatcgagagaagctacgcctgcagcgtgctgggcagactgaacctgagcaagacccacgacagcagcagacagagactgtacaacaccagaggcaagagcctgacccagaacagcgcccccagcagaagctacctgagaaagaaccccgacaagttccacggctacgaggagccctacttcctgaagcaccagagagcccacagcatcgagaagaactgcgtgtgcagcgagtgcggcaaggccttcagatgcaagagccagctgatcgtgcacctgagaatccacaccggcgagagaccctacgagtgcagcaagtgcgagagagccttcagcgccaagagcaacctgaacgcccaccagagagtgcacaccggcgagaagccctacagctgcagcgagtgcgagaaggtgttcagcttcagaagccagctgatcgtgcaccaggagatccacaccggcggcaagccctacggctgcagcgagtgcggcaaggcctacagctggaagagccagctgctgctgcaccagagaagccacaccggcgtgaagccctacgagtgcagcgagtgcggcaaggccttcagcctgaagagccccttcgtggtgcaccagagaacccacaccggcgtgaagccccacaagtgcagcgagtgcggcaaggccttcagaagcaagagctacctgctggtgcacatcagaatgcacaccggcgagaagccctaccagtgcagcgactgcggcaaggccttcaacatgaagacccagctgatcgtgcaccagggcgtgcacaccggcaacaacccctaccagtgcggcgagtgcggcaaggccttcggcagaaaggagcagctgaccgcccacctgagagcccacgccggcgagaagccctacggctgcagcgagtgcggcaaggccttcagcagcaagagctacctggtgatccacagaagaacccacaccggcgagagaccctacgagtgcagcctgtgcgagagagccttctgcggcaagagccagctgatcatccaccagagaacccacagcaccgagaagccctacgagtgcaacgagtgcgagaaggcctaccccagaaaggccagcctgcagatccaccagaagacccacagcggcgagaagcccttcaagtgcagcgagtgcggcaaggccttcacccagaagagcagcctgagcgagcaccagagagtgcacaccggcgagaagccctggaagtgcagcgagtgcggcaagagcttctgctggaacagcggcctgagaatccacagaaagacccacaagtag

SEQ ID NO: 10277 - DNA, 939 bp, Artificial Sequence
  Description of Artificial Sequence: Synthetic coding sequence
atgtgcagcccccaggagagcggcatgaccgccctgagcgccagaatgctgaccagaagcagaagcctgggccccggcgccggccccagaggctgcagagaggagcccggccccctgagaagaagagaggccgccgccgaggccagaaagagccacagccccgtgaagagacccagaaaggcccagagactgagagtggcctacgagggcagcgacagcgagaagggcgagggcgccgagcccctgaaggtgcccgtgtgggagccccaggactggcagcagcagctggtgaacatcagagccatgagaaacaagaaggacgcccccgtggaccacctgggcaccgagcactgctacgacagcagcgccccccccaaggtgagaagataccaggtgctgctgagcctgatgctgagcagccagaccaaggaccaggtgaccgccggcgccatgcagagactgagagccagaggcctgaccgtggacagcatcctgcagaccgacgacgccaccctgggcaagctgatctaccccgtgggcttctggagaagcaaggtgaagtacatcaagcagaccagcgccatcctgcagcagcactacggcggcgacatccccgccagcgtggccgagctggtggccctgcccggcgtgggccccaagatggcccacctggccatggccgtggcctggggcaccgtgagcggcatcgccgtggacacccacgtgcacagaatcgccaacagactgagatggaccaagaaggccaccaagagccccgaggagaccagagccgccctggaggagtggctgcccagagagctgtggcacgagatcaacggcctgctggtgggcttcggccagcagacctgcctgcccgtgcaccccagatgccacgcctgcctgaaccaggccctgtgccccgccgcccagggcctgtag

SEQ ID NO: 10278 - DNA, 996 bp, Artificial Sequence
  Description of Artificial Sequence: Synthetic coding sequence
atggagcaggccctggccggcgccagcagcggcagagagctgggcagacccaaggagctgcagcccaagaagctgcacctgtgccccctgtgcggcaagaacttcagcaacaacagcaacctgatcagacaccagagaatccacgccgccgagagactgtgcatgggcgtggactgcaccgagatcttcggcggcaaccccagattcctgagcctgcacagagcccacctgggcgaggaggcccacaagtgcctggagtgcggcaagtgcttcagccagaacacccacctgaccagacaccagagaacccacaccggcgagaagccctaccagtgcaacatctgcggcaagtgcttcagctgcaacagcaacctgcacagacaccagagaacccacaccggcgagaagccctacaagtgccccgagtgcggcgagatcttcgcccacagcagcaacctgctgagacaccagagaatccacaccggcgagagaccctacaagtgccccgagtgcggcaagagcttcagcagaagcagccacctggtgatccacgagagaacccacgagagagagagactgtaccccttcagcgagtgcggcgaggccgtgagcgacagcacccccttcctgaccaaccacggcgcccacaaggccgagaagaagctgttcgagtgcctgacctgcggcaagagcttcagacagggcatgcacctgaccagacaccagagaacccacaccggcgagaagccctacaagtgcaccctgtgcggcgagaacttcagccacagaagcaacctgatcagacaccagagaatccacaccggcgagaagccctacacctgccacgagtgcggcgacagcttcagccacagcagcaacagaatcagacacctgagaacccacaccggcgagagaccctacaagtgcagcgagtgcggcgagagcttcagcagaagcagcagactgatgagccaccagagaacccacaccggctag

SEQ ID NO: 10279 - DNA, 1515 bp, Artificial Sequence
  Description of Artificial Sequence: Synthetic coding sequence
atgctggacaactacagaaacctggtgttcctgggcatcgccgtgagcaagcccgacctgatcacctgcctggagcagggcaaggagccctgcaacatgaagagacacgccatggtggccaagccccccgtggtgtgcagccacttcgcccaggacctgtggcccaagcagggcctgaaggacagcttccagaaggtgatcctgagaagatacggcaagtacggccacgagaacctgcagctgagaaagggctgcaagagcgccgacgagcacaaggtgcacaagagaggctacaacggcctgaaccagtgcctgaccaccacccagagcaagatcttccagtgcgacaagtacgtgaaggtgctgcacaagttcagcaacagcaacatccacaagaagagacagaccggcaagaagcccttcaagtgcaaggagtgcggcaagagctgctgcatcctgagccagctgacccagcacaagaagaccgccaccagagtgaacttctacaagtgcaagacctgcggcaaggccttcaaccagttcagcaacctgaccaagcacaagatcatccaccccgaggtgaacccctacaagtgcgaggagtgcggcaaggccttcaaccagagcctgaccctgaccaagcacaagaagatccacaccgaggagaagccctacaagtgcgaggactgcggcaaggtgttcagcgtgttcagcgtgctgaccaagcacaagatcatccacaccggcaccaagccctacaactgcgaggagtgcggcaagggcttcagcatcttcagcaccctgaccaagcacaagatcatccacaccggcgagaagccctacaagtgcaacgagtgcggcaaggccttcaactggagcagcaccctgaccaagcacaagagaatccacaccggcgagaagccctacaagtgcgaggagtgcggcaaggccttcaaccagagcagcaccctgaccagacacaagatcgtgcacaccggcgagaagccctacaagtgcgaggagtgcggcaaggccttcaagagaagcaccaccctgaccaagcacaagagaatctacaccaaggagaagccctacaagtgcgaggagtgcggcaaggccttcagcgtgttcagcaccctgaccaagcacaagatcatccacaccggcgccaagccctacaagtgcgaggagtgcggcagcgccttcagagccttcagcaccctgaccgagcacaagagagtgcacaccggcgagaagccctacaagtgcaacgagtgcggcaaggccttcaactggagcagcaccctgaccaagcacaagagaatccacaccggcgagaagccctacaagtgcgaggagtgcggcaaggccttcaacagaagcagcaacctgaccagacacaagaagatccacaccggcgagaagccctacaagcccaagagatgcgacagcgccttcgacaacacccccaacttcagcagacacaagagaaaccacatgggcgagaagagctag

SEQ ID NO: 10280 - DNA, 1710 bp, Artificial Sequence
  Description of Artificial Sequence: Synthetic coding sequence
atgagcagcgcccccagaggcccccccagcgtggcccccctgcccgccggcatcggcagaagcaccgccaagacccccggcctgcccggcagcctggagatgggccccctgaccttcagagacgtggccatcgagttcagcctggaggagtggcagtgcctggacaccagccagcagaacctgtacagaaacgtgatgctggacaactacagaaacctggtgttcctgggcatcgccgtgagcaagcccgacctgatcacctgcctggagcagggcaaggagccctgcaacatgaagagacacgccatggtggccaagccccccgtggtgtgcagccacttcgcccaggacctgtggcccaagcagggcctgaaggacagcttccagaaggtgatcctgagaagatacggcaagtacggccacgagaacctgcagctgagaaagggctgcaagagcgccgacgagcacaaggtgcacaagagaggctacaacggcctgaaccagtgcctgaccaccacccagagcaagatcttccagtgcgacaagtacgtgaaggtgctgcacaagttcagcaacagcaacatccacaagaagagacagaccggcaagaagcccttcaagtgcaaggagtgcggcaagagctgctgcatcctgagccagctgacccagcacaagaagaccgccaccagagtgaacttctacaagtgcaagacctgcggcaaggccttcaaccagttcagcaacctgaccaagcacaagatcatccaccccgaggtgaacccctacaagtgcgaggagtgcggcaaggccttcaaccagagcctgaccctgaccaagcacaagaagatccacaccgaggagaagccctacaagtgcgaggactgcggcaaggtgttcagcgtgttcagcgtgctgaccaagcacaagatcatccacaccggcaccaagccctacaactgcgaggagtgcggcaagggcttcagcatcttcagcaccctgaccaagcacaagatcatccacaccggcgagaagccctacaagtgcaacgagtgcggcaaggccttcaactggagcagcaccctgaccaagcacaagagaatccacaccggcgagaagccctacaagtgcgaggagtgcggcaaggccttcaaccagagcagcaccctgaccagacacaagatcgtgcacaccggcgagaagccctacaagtgcgaggagtgcggcaaggccttcaagagaagcaccaccctgaccaagcacaagagaatctacaccaaggagaagccctacaagtgcgaggagtgcggcaaggccttcagcgtgttcagcaccctgaccaagcacaagatcatccacaccggcgccaagccctacaagtgcgaggagtgcggcagcgccttcagagccttcagcaccctgaccgagcacaagagagtgcacaccggcgagaagccctacaagtgcaacgagtgcggcaaggccttcaactggagcagcaccctgaccaagcacaagagaatccacaccggcgagaagccctacaagtgcgaggagtgcggcaaggccttcaacagaagcagcaacctgaccagacacaagaagatccacaccggcgagaagccctacaagcccaagagatgcgacagcgccttcgacaacacccccaacttcagcagacacaagagaaaccacatgggcgagaagagctag

SEQ ID NO: 10281 - DNA, 246 bp, Artificial Sequence
  Description of Artificial Sequence: Synthetic coding sequence
atgggccccctgaccttcagagacgtggccatcgagttcagcctggaggagtggcagtgcctggacaccagccagcagaacctgtacagaaacgtgatgctggacaactacagaaacctggtgttcctgggcatcgccgtgagcaagcccgacctgatcacctgcctggagcagggcaaggagccctgcaacatgaagagacacgccatggtggccaagccccccggctggagcgccgtggcctag

SEQ ID NO: 10282 - DNA, 1131 bp, Artificial Sequence
  Description of Artificial Sequence: Synthetic coding sequence
atgaagggcgaggacgcccagccccaggagatggccagcaccagcttccccagagccagcggccccagccccgagttcagacagcacggcgacagcgacggcaagagaggcagcccccagaacctgcccatcgagcaccacttcgcctgcaaggagtgcggcgacaccttcagactgaaggtgctgctggtgcagcaccagagagtgcacagcgaggagaagggctgggagtgcggcgactgcggcaaggtgttcagaggcgtggccgagttcaacgagcacagaaagagccacgtggccgccgagccccagcccggccccagcagagccctggagaacgccgccgagaagagagagcagatggagagagaggccaagcccttcgagtgcgaggagtgcggcaagagattcaagaagaacgccggcctgagccagcacctgagagtgcacagcagagagaagcccttcgactgcgaggagtgcggcagaagcttcaaggtgaacacccacctgttcagacaccagaagctgcacaccagcgagaagcccttcgcctgcaaggcctgcagcagagacttcctggacagacaggagctgctgaagcaccagagaatgcacaccggccacctgcccttcgactgcgacgactgcggcaagagcttcagaggcgtgaacggcctggccgagcaccagagaatccacagcggcgccaagccctacggctgcccccactgcggcaagctgttcagaagaagcagcgagctgaccaagcacagaagaatccacaccggcgagaagccctacgcctgcggccagtgcggcaaggccttcagacagagcagcagcctgctggagcacgccagaatccacagcggcgagagaccctacgcctgcggcgagtgcggcaaggccttcagaggccccagcgacctgatcaagcacagaagaatccacagcggcctgaagccctacgagtgcgacaagtgcggcaaggccttcagaagaagcagcggcctgagcagacacagaagaatccacagcggcgccagaagatgcgagtgcagccagtgcggcagagtgttcaagagaagaagcgccctgcagaagcaccagcccacccaccacgagtag

SEQ ID NO: 10283 - DNA, 990 bp, Artificial Sequence
  Description of Artificial Sequence: Synthetic coding sequence
atgatgagccacccctgcgtgagcctgctgggcgtgcccgtgctgaaccccgccctggtgccccacctggcccagggccaggtgctgctggtgagcgaccccagccccaacaccgaccccgccaagtacagcgagagcaccagcgccaccagacaccagatgaagggcgaggacgcccagccccaggagatggccagcaccagcttccccagagccagcggccccagccccgagttcagacagcacggcgacagcgacggcaagagaggcagcccccagaacctgcccatcgagcaccacttcgcctgcaaggagtgcggcgacaccttcagactgaaggtgctgctggtgcagcaccagagagtgcacagcgaggagaagggctgggagtgcggcgactgcggcaaggtgttcagaggcgtggccgagttcaacgagcacagaaagagccacgtggccgccgagccccagcccggccccagcagagccctggagaacgccgccgagaagagagagcagatggagagagaggccaagcccttcgagtgcgaggagtgcggcaagagattcaagaagaacgccggcctgagccagcacctgagagtgcacagcagagagaagcccttcgactgcgaggagtgcggcagaagcttcaaggtgaacacccacctgttcagacaccagaagctgcacaccagcgagaagcccttcgcctgcaaggcctgcagcagagacttcctggacagacaggagctgctgaagcaccagagaatgcacaccggccacctgcccttcgactgcgacgactgcggcaagagcttcagaggcgtgaacggcctggccgagcaccagagaatccacagcggcgccaagccctacggctgcccccactgcggcaagctgttcagaagaagcagcgagctgaccaagcacagaagaatccacaccggcgagaagccctacgcctgcggcctgccctgggccctgtag

SEQ ID NO: 10284 - DNA, 1290 bp, Artificial Sequence
  Description of Artificial Sequence: Synthetic coding sequence
atgatgagccacccctgcgtgagcctgctgggcgtgcccgtgctgaaccccgccctggtgccccacctggcccagggccaggtgctgctggtgagcgaccccagccccaacaccgaccccgccaagtacagcgagagcaccagcgccaccagacaccagatgaagggcgaggacgcccagccccaggagatggccagcaccagcttccccagagccagcggccccagccccgagttcagacagcacggcgacagcgacggcaagagaggcagcccccagaacctgcccatcgagcaccacttcgcctgcaaggagtgcggcgacaccttcagactgaaggtgctgctggtgcagcaccagagagtgcacagcgaggagaagggctgggagtgcggcgactgcggcaaggtgttcagaggcgtggccgagttcaacgagcacagaaagagccacgtggccgccgagccccagcccggccccagcagagccctggagaacgccgccgagaagagagagcagatggagagagaggccaagcccttcgagtgcgaggagtgcggcaagagattcaagaagaacgccggcctgagccagcacctgagagtgcacagcagagagaagcccttcgactgcgaggagtgcggcagaagcttcaaggtgaacacccacctgttcagacaccagaagctgcacaccagcgagaagcccttcgcctgcaaggcctgcagcagagacttcctggacagacaggagctgctgaagcaccagagaatgcacaccggccacctgcccttcgactgcgacgactgcggcaagagcttcagaggcgtgaacggcctggccgagcaccagagaatccacagcggcgccaagccctacggctgcccccactgcggcaagctgttcagaagaagcagcgagctgaccaagcacagaagaatccacaccggcgagaagccctacgcctgcggccagtgcggcaaggccttcagacagagcagcagcctgctggagcacgccagaatccacagcggcgagagaccctacgcctgcggcgagtgcggcaaggccttcagaggccccagcgacctgatcaagcacagaagaatccacagcggcctgaagccctacgagtgcgacaagtgcggcaaggccttcagaagaagcagcggcctgagcagacacagaagaatccacagcggcgccagaagatgcgagtgcagccagtgcggcagagtgttcaagagaagaagcgccctgcagaagcaccagcccacccaccacgagtag

SEQ ID NO: 10285 - DNA, 1380 bp, Artificial Sequence
  Description of Artificial Sequence: Synthetic coding sequence
atgcccgaggacctggtgaccttcgacgacgtggcctggtacctgaccaccagagagtggttcaagctggaccccgagcagagagccctggagtactacggcaacgtgaccagcgtggccggcgtgcccgtgctgaaccccgccctggtgccccacctggcccagggccaggtgctgctggtgagcgaccccagccccaacaccgaccccgccaagtacagcgagagcaccagcgccaccagacaccagatgaagggcgaggacgcccagccccaggagatggccagcaccagcttccccagagccagcggccccagccccgagttcagacagcacggcgacagcgacggcaagagaggcagcccccagaacctgcccatcgagcaccacttcgcctgcaaggagtgcggcgacaccttcagactgaaggtgctgctggtgcagcaccagagagtgcacagcgaggagaagggctgggagtgcggcgactgcggcaaggtgttcagaggcgtggccgagttcaacgagcacagaaagagccacgtggccgccgagccccagcccggccccagcagagccctggagaacgccgccgagaagagagagcagatggagagagaggccaagcccttcgagtgcgaggagtgcggcaagagattcaagaagaacgccggcctgagccagcacctgagagtgcacagcagagagaagcccttcgactgcgaggagtgcggcagaagcttcaaggtgaacacccacctgttcagacaccagaagctgcacaccagcgagaagcccttcgcctgcaaggcctgcagcagagacttcctggacagacaggagctgctgaagcaccagagaatgcacaccggccacctgcccttcgactgcgacgactgcggcaagagcttcagaggcgtgaacggcctggccgagcaccagagaatccacagcggcgccaagccctacggctgcccccactgcggcaagctgttcagaagaagcagcgagctgaccaagcacagaagaatccacaccggcgagaagccctacgcctgcggccagtgcggcaaggccttcagacagagcagcagcctgctggagcacgccagaatccacagcggcgagagaccctacgcctgcggcgagtgcggcaaggccttcagaggccccagcgacctgatcaagcacagaagaatccacagcggcctgaagccctacgagtgcgacaagtgcggcaaggccttcagaagaagcagcggcctgagcagacacagaagaatccacagcggcgccagaagatgcgagtgcagccagtgcggcagagtgttcaagagaagaagcgccctgcagaagcaccagcccacccaccacgagtag

SEQ ID NO: 10286 - DNA, 1620 bp, Artificial Sequence
  Description of Artificial Sequence: Synthetic coding sequence
atgggccactgcagactgtgccacggcaagttcagcagcagaagcctgagaagcatcagcgagagagcccccggcgccagcatggagagacccagcgccgaggagagagtgctggtgagagacttccagagactgctgggcgtggccgtgagacaggaccccaccctgagccccttcgtgtgcaagagctgccacgcccagttctaccagtgccacagcctgctgaagagcttcctgcagagagtgaacgccagccccgccggcagaagaaagccctgcgccaaggtgggcgcccagccccccaccggcgccgaggagggcgcctgcctggtggacctgatcaccagcagcccccagtgcctgcacggcctggtgggctgggtgcacggccacgccgccagctgcggcgccctgccccacctgcagagaaccctgagcagcgagtactgcggcgtgatccaggtggtgtggggctgcgaccagggccacgactacaccatggacaccagcagcagctgcaaggccttcctgctggacagcgccctggccgtgaagtggccctgggacaaggagaccgcccccagactgccccagcacagaggctggaaccccggcgacgccccccagaccagccagggcagaggcaccggcacccccgtgggcgccgagaccaagaccctgcccagcaccgacgtggcccagccccccagcgacagcgacgccgtgggccccagaagcggcttccccccccagcccagcctgcccctgtgcagagcccccggccagctgggcgagaagcagctgcccagcagcaccagcgacgacagagtgaaggacgagttcagcgacctgagcgagggcgacgtgctgagcgaggacgagaacgacaagaagcagaacgcccagagcagcgacgagagcttcgagccctaccccgagagaaaggtgagcggcaagaagagcgagagcaaggaggccaagaagagcgaggagcccagaatcagaaagaagcccggccccaagcccggctggaagaagaagctgagatgcgagagagaggagctgcccaccatctacaagtgcccctaccagggctgcaccgccgtgtacagaggcgccgacggcatgaagaagcacatcaaggagcaccacgaggaggtgagagagagaccctgcccccaccccggctgcaacaaggtgttcatgatcgacagatacctgcagagacacgtgaagctgatccacaccgaggtgagaaactacatctgcgacgagtgcggccagaccttcaagcagagaaagcacctgctggtgcaccagatgagacacagcggcgccaagcccctgcagtgcgaggtgtgcggcttccagtgcagacagagagccagcctgaagtaccacatgaccaagcacaaggccgagaccgagctggacttcgcctgcgaccagtgcggcagaagattcgagaaggcccacaacctgaacgtgcacatgagcatggtgcaccccctgacccagacccaggacaaggccctgcccctggaggccgagcccccccccggcccccccagccccagcgtgaccaccgagggccaggccgtgaagcccgagcccacctag

SEQ ID NO: 10287 - DNA, 1845 bp, Artificial Sequence
  Description of Artificial Sequence: Synthetic coding sequence
atgaagagagacagactgggcagattcctgagccccggcagcagcagacagtgcggcgccagcgacggcggcggcggcgtgagcagaaccagaggcagacccagcctgagcggcggccccagagtggacggcgccaccgccagaagagcctggggccccgtgggcagctgcggcgacgccggcgaggacggcgccgacgaggccggcgccggcagagccctggccatgggccactgcagactgtgccacggcaagttcagcagcagaagcctgagaagcatcagcgagagagcccccggcgccagcatggagagacccagcgccgaggagagagtgctggtgagagacttccagagactgctgggcgtggccgtgagacaggaccccaccctgagccccttcgtgtgcaagagctgccacgcccagttctaccagtgccacagcctgctgaagagcttcctgcagagagtgaacgccagccccgccggcagaagaaagccctgcgccaaggtgggcgcccagccccccaccggcgccgaggagggcgcctgcctggtggacctgatcaccagcagcccccagtgcctgcacggcctggtgggctgggtgcacggccacgccgccagctgcggcgccctgccccacctgcagagaaccctgagcagcgagtactgcggcgtgatccaggtggtgtggggctgcgaccagggccacgactacaccatggacaccagcagcagctgcaaggccttcctgctggacagcgccctggccgtgaagtggccctgggacaaggagaccgcccccagactgccccagcacagaggctggaaccccggcgacgccccccagaccagccagggcagaggcaccggcacccccgtgggcgccgagaccaagaccctgcccagcaccgacgtggcccagccccccagcgacagcgacgccgtgggccccagaagcggcttccccccccagcccagcctgcccctgtgcagagcccccggccagctgggcgagaagcagctgcccagcagcaccagcgacgacagagtgaaggacgagttcagcgacctgagcgagggcgacgtgctgagcgaggacgagaacgacaagaagcagaacgcccagagcagcgacgagagcttcgagccctaccccgagagaaaggtgagcggcaagaagagcgagagcaaggaggccaagaagagcgaggagcccagaatcagaaagaagcccggccccaagcccggctggaagaagaagctgagatgcgagagagaggagctgcccaccatctacaagtgcccctaccagggctgcaccgccgtgtacagaggcgccgacggcatgaagaagcacatcaaggagcaccacgaggaggtgagagagagaccctgcccccaccccggctgcaacaaggtgttcatgatcgacagatacctgcagagacacgtgaagctgatccacaccgaggtgagaaactacatctgcgacgagtgcggccagaccttcaagcagagaaagcacctgctggtgcaccagatgagacacagcggcgccaagcccctgcagtgcgaggtgtgcggcttccagtgcagacagagagccagcctgaagtaccacatgaccaagcacaaggccgagaccgagctggacttcgcctgcgaccagtgcggcagaagattcgagaaggcccacaacctgaacgtgcacatgagcatggtgcaccccctgacccagacccaggacaaggccctgcccctggaggccgagcccccccccggcccccccagccccagcgtgaccaccgagggccaggccgtgaagcccgagcccacctag

SEQ ID NO: 10288 - DNA, 1203 bp, Artificial Sequence
  Description of Artificial Sequence: Synthetic coding sequence
atggacatgagacccgccgccggcccctgccccaccttcagaggccactgcccccccagcaccgccgccagcagcagaagctgcggcgccgccaccagagccaccaccaccccctggatccccgcccccgccgccagacccagctgctggaccgtgagatggcagagcagcggccacggcaccaagagaagaagacacggctgccccagcaccgagggcggcaccctgggcatgcccctgagaccccccagagtggagggccagggcccccagctgggcctgagacccagaccctgccccgccagaatgtggcccagcctgctgagaaccgccaccagatggggccccggcagagccagccacctgagccaggcctgccccttcgccggcccccagggcagctgggtgagaagcagcttccacctgcagcccagaatgatcggcgacgtgctgagcgaggacgagaacgacaagaagcagaacgcccagagcagcgacgagagcttcgagccctaccccgagagaaaggtgagcggcaagaagagcgagagcaaggaggccaagaagagcgaggagcccagaatcagaaagaagcccggccccaagcccggctggaagaagaagctgagatgcgagagagaggagctgcccaccatctacaagtgcccctaccagggctgcaccgccgtgtacagaggcgccgacggcatgaagaagcacatcaaggagcaccacgaggaggtgagagagagaccctgcccccaccccggctgcaacaaggtgttcatgatcgacagatacctgcagagacacgtgaagctgatccacaccgaggtgagaaactacatctgcgacgagtgcggccagaccttcaagcagagaaagcacctgctggtgcaccagatgagacacagcggcgccaagcccctgcagtgcgaggtgtgcggcttccagtgcagacagagagccagcctgaagtaccacatgaccaagcacaaggccgagaccgagctggacttcgcctgcgaccagtgcggcagaagattcgagaaggcccacaacctgaacgtgcacatgagcatggtgcaccccctgacccagacccaggacaaggccctgcccctggaggccgagcccccccccggcccccccagccccagcgtgaccaccgagggccaggccgtgaagcccgagcccacctag

SEQ ID NO: 10289 - DNA, 1998 bp, Artificial Sequence
  Description of Artificial Sequence: Synthetic coding sequence
atgatgaagaccttcttcagcaccggccagggcaacaccgaggccttccacaccggcaccctgcagagacaggccagccaccacatcggcgacttctgcttccagaagatcgagaaggacatccacggcttccagttccagtggaaggaggacgagaccaacgaccacgccgcccccatgaccgagatcaaggagctgaccggcagcaccggccagcacgaccagagacacgccggcaacaagcacatcaaggaccagctgggcctgagcttccacagccacctgcccgagctgcacatcttccagcccgagggcaagatcggcaaccaggtggagaagagcatcaacaacgccagcagcgtgagcaccagccagagaatctgctgcagacccaagacccacatcagcaacaagtacggcaacaacagcctgcacagcagcctgctgacccagaagagaaacgtgcacatgagagagaagagcttccagtgcatcgagagcggcaagagcttcaactgcagcagcctgctgaagaagcaccagatcacccacctggaggagaagcagtgcaagtgcgacgtgtacggcaaggtgttcaaccagaagagatacctggcctgccacagaagaagccacatcgacgagaagccctacaagtgcaacgagtgcggcaagatcttcggccacaacaccagcctgttcctgcacaaggccctgcacaccgccgacaagccctacgagtgcgaggagtgcgacaaggtgttcagcagaaagagccacctggagacccacaagatcatctacaccggcggcaagccctacaagtgcaaggtgtgcgacaaggccttcacctgcaacagctacctggccaagcacaccatcatccacaccggcgagaagccctacaagtgcaacgagtgcggcaaggtgttcaacagactgagcaccctggccagacacagaagactgcacaccggcgagaagccctacgagtgcgaggagtgcgagaaggtgttcagcagaaagagccacctggagagacacaagagaatccacaccggcgagaagccctacaagtgcaaggtgtgcgacaaggccttcgcctacaacagctacctggccaagcacagcatcatccacaccggcgagaagccctacaagtgcaacgagtgcggcaaggtgttcaaccagcagagcaccctggccagacaccacagactgcacaccgccgagaagccctacaagtgcgaggagtgcgacaaggtgttcagatgcaagagccacctggagagacacagaagaatccacaccggcgagaagccctacaagtgcaaggtgtgcgacaaggccttcagaagcgacagctgcctgaccgagcaccagagagtgcacaccggcgagaagccctacatgtgcaacgagtgcggcaaggtgttcagcaccaaggccaacctggcctgccaccacaagctgcacaccgccgagaagccctacaagtgcgaggagtgcgagaaggtgttcagcagaaagagccacatggagagacacagaagaatccacaccggcgagaagccctacaagtgcaaggtgtgcgacaaggccttcagaagagacagccacctggcccagcaccagagagtgcacaccggcgagaagccctacaagtgcaacgagtgcggcaagaccttcagacagaccagcagcctgatcatccacagaagactgcacaccggcgagaagccctacaagtgcaacgagtgcggcaagaccttcagccagatgagcagcctggtgtaccaccacagactgcacagcggcgagaagccctacaagtgcaacgagtgcggcaaggtgttcaaccagcaggcccacctggcccagcaccagagagtgcacaccggcgagaagccctacaagtgcaacgagtgcggcaagaccttcagccagatgagcaacctggtgtaccaccacagactgcacagcggcgagaagccctag

SEQ ID NO: 10290 - DNA, 1998 bp, Artificial Sequence; identical to SEQ ID NO: 10289
  Description of Artificial Sequence: Synthetic coding sequence

SEQ ID NO: 10291 - DNA, 2157 bp, Artificial Sequence
  Description of Artificial Sequence: Synthetic coding sequence
atggccctgccccagggcctgctgaccttcagagacgtggccatcgagttcagccaggaggagtggaagtgcctggaccccgcccagagaaccctgtacagagacgtgatgctggagaactacagaaacctggtgagcctggacatcagcagcaagtgcatgatgaagaccttcttcagcaccggccagggcaacaccgaggccttccacaccggcaccctgcagagacaggccagccaccacatcggcgacttctgcttccagaagatcgagaaggacatccacggcttccagttccagtggaaggaggacgagaccaacgaccacgccgcccccatgaccgagatcaaggagctgaccggcagcaccggccagcacgaccagagacacgccggcaacaagcacatcaaggaccagctgggcctgagcttccacagccacctgcccgagctgcacatcttccagcccgagggcaagatcggcaaccaggtggagaagagcatcaacaacgccagcagcgtgagcaccagccagagaatctgctgcagacccaagacccacatcagcaacaagtacggcaacaacagcctgcacagcagcctgctgacccagaagagaaacgtgcacatgagagagaagagcttccagtgcatcgagagcggcaagagcttcaactgcagcagcctgctgaagaagcaccagatcacccacctggaggagaagcagtgcaagtgcgacgtgtacggcaaggtgttcaaccagaagagatacctggcctgccacagaagaagccacatcgacgagaagccctacaagtgcaacgagtgcggcaagatcttcggccacaacaccagcctgttcctgcacaaggccctgcacaccgccgacaagccctacgagtgcgaggagtgcgacaaggtgttcagcagaaagagccacctggagacccacaagatcatctacaccggcggcaagccctacaagtgcaaggtgtgcgacaaggccttcacctgcaacagctacctggccaagcacaccatcatccacaccggcgagaagccctacaagtgcaacgagtgcggcaaggtgttcaacagactgagcaccctggccagacacagaagactgcacaccggcgagaagccctacgagtgcgaggagtgcgagaaggtgttcagcagaaagagccacctggagagacacaagagaatccacaccggcgagaagccctacaagtgcaaggtgtgcgacaaggccttcgcctacaacagctacctggccaagcacagcatcatccacaccggcgagaagccctacaagtgcaacgagtgcggcaaggtgttcaaccagcagagcaccctggccagacaccacagactgcacaccgccgagaagccctacaagtgcgaggagtgcgacaaggtgttcagatgcaagagccacctggagagacacagaagaatccacaccggcgagaagccctacaagtgcaaggtgtgcgacaaggccttcagaagcgacagctgcctgaccgagcaccagagagtgcacaccggcgagaagccctacatgtgcaacgagtgcggcaaggtgttcagcaccaaggccaacctggcctgccaccacaagctgcacaccgccgagaagccctacaagtgcgaggagtgcgagaaggtgttcagcagaaagagccacatggagagacacagaagaatccacaccggcgagaagccctacaagtgcaaggtgtgcgacaaggccttcagaagagacagccacctggcccagcaccagagagtgcacaccggcgagaagccctacaagtgcaacgagtgcggcaagaccttcagacagaccagcagcctgatcatccacagaagactgcacaccggcgagaagccctacaagtgcaacgagtgcggcaagaccttcagccagatgagcagcctggtgtaccaccacagactgcacagcggcgagaagccctacaagtgcaacgagtgcggcaaggtgttcaaccagcaggcccacctggcccagcaccagagagtgcacaccggcgagaagccctacaagtgcaacgagtgcggcaagaccttcagccagatgagcaacctggtgtaccaccacagactgcacagcggcgagaagccctag

SEQ ID NO: 10292 - DNA, 2607 bp, Artificial Sequence
  Description of Artificial Sequence: Synthetic coding sequence
atgagaggcgccgccagcgccagcgtgagagagcccacccccctgcccggcagaggcgcccccagaaccaagcccagagccggcagaggccccaccgtgggcacccccgccaccctggccctgcccgccagaggcagacccagaagcagaaacggcctggccagcaagggccagagaggcgccgcccccaccggccccggccacagagccctgcccagcagagacaccgccctgccccaggagagaaacaagaagctggaggccgtgggcaccggcatcgagcccaaggccatgagccagggcctggtgaccttcggcgacgtggccgtggacttcagccaggaggagtgggagtggctgaaccccatccagagaaacctgtacagaaaggtgatgctggagaactacagaaacctggccagcctgggcctgtgcgtgagcaagcccgacgtgatcagcagcctggagcagggcaaggagccctggaccgtgaagagaaagatgaccagagcctggtgccccgacctgaaggccgtgtggaagatcaaggagctgcccctgaagaaggacttctgcgagggcaagctgagccaggccgtgatcaccgagagactgaccagctacaacctggagtacagcctgctgggcgagcactgggactacgacgccctgttcgagacccagcccggcctggtgaccatcaagaacctggccgtggacttcagacagcagctgcaccccgcccagaagaacttctgcaagaacggcatctgggagaacaacagcgacctgggcagcgccggccactgcgtggccaagcccgacctggtgagcctgctggagcaggagaaggagccctggatggtgaagagagagctgaccggcagcctgttcagcggccagagaagcgtgcacgagacccaggagctgttccccaagcaggacagctacgccgagggcgtgaccgacagaaccagcaacaccaagctggactgcagcagcttcagagagaactgggacagcgactacgtgttcggcagaaagctggccgtgggccaggagacccagttcagacaggagcccatcacccacaacaagaccctgagcaaggagagagagagaacctacaacaagagcggcagatggttctacctggacgacagcgaggagaaggtgcacaacagagacagcatcaagaacttccagaagagcagcgtggtgatcaagcagaccggcatctacgccggcaagaagctgttcaagtgcaacgagtgcaagaagaccttcacccagagcagcagcctgaccgtgcaccagagaatccacaccggcgagaagccctacaagtgcaacgagtgcggcaaggccttcagcgacggcagcagcttcgccagacaccagagatgccacaccggcaagaagccctacgagtgcatcgagtgcggcaaggccttcatccagaacaccagcctgatcagacactggagatactaccacaccggcgagaagcccttcgactgcatcgactgcggcaaggccttcagcgaccacatcggcctgaaccagcacagaagaatccacaccggcgagaagccctacaagtgcgacgtgtgccacaagagcttcagatacggcagcagcctgaccgtgcaccagagaatccacaccggcgagaagccctacgagtgcgacgtgtgcagaaaggccttcagccaccacgccagcctgacccagcaccagagagtgcacagcggcgagaagcccttcaagtgcaaggagtgcggcaaggccttcagacagaacatccacctggccagccacctgagaatccacaccggcgagaagcccttcgagtgcgccgagtgcggcaagagcttcagcatcagcagccagctggccacccaccagagaatccacaccggcgagaagccctacgagtgcaaggtgtgcagcaaggccttcacccagaaggcccacctggcccagcaccagaagacccacaccggcgagaagccctacgagtgcaaggagtgcggcaaggccttcagccagaccacccacctgatccagcaccagagagtgcacaccggcgagaagccctacaagtgcatggagtgcggcaaggccttcggcgacaacagcagctgcacccagcaccagagactgcacaccggccagagaccctacgagtgcatcgagtgcggcaaggccttcaagaccaagagcagcctgatctgccacagaagaagccacaccggcgagaagccctacgagtgcagcgtgtgcggcaaggccttcagccacagacagagcctgagcgtgcaccagagaatccacagcggcaagaagccctacgagtgcaaggagtgcagaaagaccttcatccagatcggccacctgaaccagcacaagagagtgcacaccggcgagagaagctacaactacaagaagagcagaaaggtgttcagacagaccgcccacctggcccaccaccagagaatccacaccggcgagagcagcacctgccccagcctgcccagcaccagcaaccccgtggacctgttccccaagttcctgtggaaccccagcagcctgcccagcccctag

SEQ ID NO: 10293 - DNA, 1629 bp, Artificial Sequence
  Description of Artificial Sequence: Synthetic coding sequence
atgggcgacatcttcctgtgcaagaaggtggagagccccaagaagaacctgagagagagcaagcagagagaggaggacgacgaggaccccgacctgatctacgtgggcgtggagcacgtgcacagagacgccgaggtgctgttcgtgggcatgatcagcaacagcaagcccgtggtgagcaacatcctgaacagagtgacccccggcagcaagagcagaagaaagaagggccacttcagacagtaccccgcccacgtgagccagcccgccaaccacgtgaccagcatggccaaggccatcatgcccgtgagcctgagcgagggcagaagcaccgacagccccgtgaccatgaagagcagcagcgagcccggctacaagatgagcagcccccaggtggtgagccccaactacagcgacagcctgccccccggcacccagtgcctggtgggcgccatggtgagcggcggcggcagaaacgagagcagccccgacagcaagagactgagcaccagcgacatcaacagcagagacagcaagagagtgaagctgagagacggcatccccggcgtgcccagcctggccgtggtgcccagcgacatgagcagcaccatcagcaccaacacccccagccagggcatctgcaacagcagcaaccacgtgcagaacggcgtgaccttcccctggcccgacgccaacggcaaggcccacttcaacctgaccgaccccgagagagccaacgagagcggcctggccatgaccgacatcagcagcctggccagccagaacaagaccttcgaccccaagaaggagaaccccatcgtgctgctgagcaacttctactacggccagcacaagggcgacggccagcccgagcagaagacccacaccaccttcaagtgcctgagctgcgtgaaggtgctgaagaacatcaagttcatgaaccacatgaagcaccacctggagttcgagaagcagagaaacgacagctgggaggaccacaccacctgccagcactgccacagacagttccccacccccttccagctgcagtgccacatcgacagcgtgcacatcgccatgggccccagcgccgtgtgcaagatctgcgagctgagcttcgagaccgaccaggtgctgctgcagcacatgaaggaccaccacaagcccggcgagatgccctacgtgtgccaggtgtgccactacagaagcagcgtgttcgccgacgtggagacccacttcagaacctgccacgagaacaccaagaacctgctgtgcctgttctgcctgaagctgttcaagaccgccatcccctacatgaaccactgctggagacacagcagaagaagagtgctgcagtgcagcaagtgcagactgcagttcctgaccctgaaggaggagatcgagcacaagaccaaggaccaccagaccttcaagaagcccgagcagctgcagggcttccccagagagaccaaggtgatcatccagaccagcgtgcagcccggcagcagcggcatggccagcgtgatcgtgagcaacaccgacccccagagcagccccgtgaagaccaagaagaagaccgccatgaacaccagagacagcagactgccctgcagcaaggacagcagctag

SEQ ID NO: 10294 - DNA, 1632 bp, Artificial Sequence
  Description of Artificial Sequence: Synthetic coding sequence
atggagcagagctgcgaggaggagaaggagcccgagccccagaagaacatccaggagaccaagcaggtggacgacgaggacgccgagctgatcttcgtgggcgtggagcacgtgaacgaggacgccgagctgatcttcgtgggcgtgaccagcaacagcaagcccgtggtgagcaacatcctgaacagagtgacccccggcagctggagcagaagaaagaagtacgaccacctgagaaaggacaccgccagaaagctgcagcccaagagccacgagaccgtgaccagcgaggccgtgaccgtgctgcccgccagccagctggagagcagaagcaccgacagccccatcatcatcgagcccctgagcaagcccgactacagaaacagcagcccccaggtggtgcccaacaacagcagcgagctgcccagccccctgatcaccttcaccgacagcctgcaccaccccgtgagcaccgccctgagcgtgggcggcatcaacgagagccccagagtgagcaagcagctgagcaccttcgaggtgaacagcatcaaccccaagagagccaagctgagagacggcatcatcgagggcaacagcagcgccagcttccccagcgacaccttccacaccatgaacacccagcagagcacccccagcaacaacgtgcacaccagcctgagccacgtgcagaacggcgcccccttccccgccgccttccccaaggacaacatccacttcaagcccatcaacaccaacctggacagagagaacgagctggccaagaccgacatcctgagcctgaccagccagaacaagaccttcgaccccaagaaggagaaccccatcgtgctgctgagcgacttctactacggccagcacaagggcgagggccagcccgagcagaagacccacaccaccttcaagtgcctgagctgcgtgaaggtgctgaagaacgtgaagttcatgaaccacgtgaagcaccacctggagttcgagaagcagagaaacgacagctgggagaaccacaccacctgccagcactgccacagacagttccccacccccttccagctgcagtgccacatcgagaacgtgcacaccgcccaggagcccagcaccgtgtgcaagatctgcgagctgagcttcgagaccgaccaggtgctgctgcagcacatgaaggaccaccacaagcccggcgagatgccctacgtgtgccaggtgtgccactacagaagcagcgtgttcgccgacgtggagacccacttcagaacctgccacgagaacaccaagaacctgctgtgccccttctgcctgaagatcttcaagaccgccaccccctacatgtgccactacagaggccactggggcaagagcgcccaccagtgcagcaagtgcagactgcagttcctgaccttcaaggagaagatggagcacaagacccagtgccaccagatgttcaagaagcccaagcagctggagggcctgccccccgagaccaaggtgaccatccaggtgagcctggagcccctgcagcccggcagcgtggacgtggccagcatcaccgtgagcaccagcgacagcgagcccagcctgcccagaagcaagagcaagatcagcaagaagagccactag

SEQ ID NO: 10295 - DNA, 1632 bp, Artificial Sequence; identical to SEQ ID NO: 10294
  Description of Artificial Sequence: Synthetic coding sequence

SEQ ID NO: 10296 - DNA, 1833 bp, Artificial Sequence
  Description of Artificial Sequence: Synthetic coding sequence
atggacgacgacaagcccttccagcccaagaacatcagcaagatggccgagctgttcatggagtgcgaggaggaggagctggagccctggcagaagaaggtggaggagacccaggacgaggacgacgacgagctgatcttcgtgggcgagatcagcagcagcaagcccgccatcagcaacatcctgaacagaggccacagcagcagcagcagcaagggcatcaagagcgagccccacagccccggcatccccgagatcttcagaaccgccagccagagatgcagagacccccccagcaaccccgtggccgccagccccagattccacctggtgagcaagagcagccagagcagcgtgaccgtggagaacgccagcaagcccgacttcaccaagaacagccaggtgggcagcgacaacagcagcatcctgctgttcgacagcacccaggagagcctgccccccagccaggacatccccgccatcttcagagagggcatgaagaacaccagctacgtgctgaagcaccccagcaccagcaaggtgaacagcgtgacccccaagaagcccaagaccagcgaggacgtgccccagatcaaccccagcaccagcctgcccctgatcggcagcccccccgtgaccagcagccaggtgatgctgagcaagggcaccaacaccagcagcccctacgacgccggcgccgactacctgagagcctgccccaagtgcaacgtgcagttcaacctgctggaccccctgaagtaccacatgaagcactgctgccccgacatgatcaccaagttcctgggcgtgatcgtgaagagcgagagaccctgcgacgaggacaagaccgacagcgagaccggcaagctgatcatgctggtgaacgagttctactacggcagacacgagggcgtgaccgagaaggagcccaagacctacaccaccttcaagtgcttcagctgcagcaaggtgctgaagaacaacatcagattcatgaaccacatgaagcaccacctggagctggagaagcagaacaacgagagctgggagaaccacaccacctgccagcactgctacagacagtaccccacccccttccagctgcagtgccacatcgagagcacccacaccccccacgagttcagcaccatctgcaagatctgcgagctgagcttcgagaccgagcacatcctgctgcagcacatgaaggacacccacaagcccggcgagatgccctacgtgtgccagaagaagggcgtgcacagatgccccaagtgcagactgcagttcctgaccagcaaggagaaggccgagcacaaggcccagcacagaaccttcatcaagcccaaggagctggagggcctgccccccggcgccaaggtgaccatcagagccagcctgggccccctgcagagcaagctgcccaccgcccccttcggctgcgcccccggcaccagcttcctgcaggtgaccccccccaccagccagaacaccaccgccagaaaccccagaaagagcaacgccagcagaagcaagaccagcaagctgcacgccaccaccagcaccgccagcaaggtgaacaccagcaagcccagaggcagaatcgccaagagcaaggccaagcccagctacaagcagaagagacagagaaacagaaagaacaagatgagcctggccctgaagaacatcagatgcagaagaggcatccacaagtgcatcgagtgccacagcaagatcaaggacttcgccagccacttcagcatctacatccactgcagcttctgcaagtacaacaccaactgcaacaaggccttcgtgaaccacatgatgtag

SEQ ID NO: 10297 - DNA, 2214 bp, Artificial Sequence
  Description of Artificial Sequence: Synthetic coding sequence
atggacgacgacaagcccttccagcccaagaacatcagcaagatggccgagctgttcatggagtgcgaggaggaggagctggagccctggcagaagaaggtggaggagacccaggacgaggacgacgacgagctgatcttcgtgggcgagatcagcagcagcaagcccgccatcagcaacatcctgaacagaggccacagcagcagcagcagcaagggcatcaagagcgagccccacagccccggcatccccgagatcttcagaaccgccagccagagatgcagagacccccccagcaaccccgtggccgccagccccagattccacctggtgagcaagagcagccagagcagcgtgaccgtggagaacgccagcaagcccgacttcaccaagaacagccaggtgggcagcgacaacagcagcatcctgctgttcgacagcacccaggagagcctgccccccagccaggacatccccgccatcttcagagagggcatgaagaacaccagctacgtgctgaagcaccccagcaccagcaaggtgaacagcgtgacccccaagaagcccaagaccagcgaggacgtgccccagatcaaccccagcaccagcctgcccctgatcggcagcccccccgtgaccagcagccaggtgatgctgagcaagggcaccaacaccagcagcccctacgacgccggcgccgactacctgagagcctgccccaagtgcaacgtgcagttcaacctgctggaccccctgaagtaccacatgaagcactgctgccccgacatgatcaccaagttcctgggcgtgatcgtgaagagcgagagaccctgcgacgaggacaagaccgacagcgagaccggcaagctgatcatgctggtgaacgagttctactacggcagacacgagggcgtgaccgagaaggagcccaagacctacaccaccttcaagtgcttcagctgcagcaaggtgctgaagaacaacatcagattcatgaaccacatgaagcaccacctggagctggagaagcagaacaacgagagctgggagaaccacaccacctgccagcactgctacagacagtaccccacccccttccagctgcagtgccacatcgagagcacccacaccccccacgagttcagcaccatctgcaagatctgcgagctgagcttcgagaccgagcacatcctgctgcagcacatgaaggacacccacaagcccggcgagatgccctacgtgtgccaggtgtgccagttcagaagcagcaccttcagcgacgtggaggcccacttcagagccgcccacgagaacaccaagaacctgctgtgccccttctgcctgaaggtgagcaagatggccaccccctacatgaaccactacatgaagcaccagaagaagggcgtgcacagatgccccaagtgcagactgcagttcctgaccagcaaggagaaggccgagcacaaggcccagcacagaaccttcatcaagcccaaggagctggagggcctgccccccggcgccaaggtgaccatcagagccagcctgggccccctgcagagcaagctgcccaccgcccccttcggctgcgcccccggcaccagcttcctgcaggtgaccccccccaccagccagaacaccaccgccagaaaccccagaaagagcaacgccagcagaagcaagaccagcaagctgcacgccaccaccagcaccgccagcaaggtgaacaccagcaagcccagaggcagaatcgccaagagcaaggccaagcccagctacaagcagaagagacagagaaacagaaagaacaagatgagcctggccctgaagaacatcagatgcagaagaggcatccacaagtgcatcgagtgccacagcaagatcaaggacttcgccagccacttcagcatctacatccactgcagcttctgcaagtacaacaccaactgcaacaaggccttcgtgaaccacatgatgagcagccacagcaaccaccccggcaagagattctgcatcttcaagaagcacagcggcaccctgagaggcatcaccctggtgtgcctgaagtgcgacttcctggccgacagcagcggcctggacagaatggccaagcacctgagccagagaaagacccacacctgccaggtgatcatcgagaacgtgagcaagagcaccagcaccagcgagcccaccaccggctgcagcctgaagtag

SEQ ID NO: 10298 - DNA, 1833 bp, Artificial Sequence; identical to SEQ ID NO: 10296
  Description of Artificial Sequence: Synthetic coding sequence

SEQ ID NO: 10299 - DNA, 909 bp, Artificial Sequence
  Description of Artificial Sequence: Synthetic coding sequence
atggccggcatgagcgagagcagcttcctgagcaagagacccagcaccagcgaggtgaacaacgtgaaccccaagaagcccaagcccagcgagagcgtgagcggcgccaacagcagcgccgtgctgcccagcgtgaagagccccagcgtgaccagcagccaggccatgctggccaagggcaccaacaccagcagcaaccagagcaagaacggcacccccttccccagagcctgccccaagtgcaacatccacttcaacctgctggaccccctgaagaaccacatgaagtactgctgccccgacatgatcaacaacttcctgggcctggccaagaccgagttcagcagcaccgtgaacaagaacaccaccatcgacagcgagaagggcaagctgatcatgctggtgaacgacttctactacggcaagcacgagggcgacgtgcaggaggagcagaagacccacaccaccttcaagtgcttcagctgcctgaagatcctgaagaacaacatcagattcatgaaccacatgaagcaccacctggagctggagaagcagagcagcgagagctgggagaaccacaccacctgccagcactgctacagacagttccccacccccttccagctgcagtgccacatcgagagcacccacaccccccacgagttcagcaccatctgcaagatctgcgagctgagcttcgagaccgagcacgtgctgctgcagcacatgaaggacaaccacaagcccggcgagatgccctacgtgtgccaggtgtgcaactacagaagcagcagcttcagcgacgtggagacccacttcagaaccagccacgagaacaccaagacctgctacgccagattcgccagcaagctgctgaagctgcagcaccacatctgcatcatcatctag

SEQ ID NO: 10300 - DNA, 2940 bp, Artificial Sequence
  Description of Artificial Sequence: Synthetic coding sequence
atgggcgacaaccccttccagcccaagagcaacagcaagatggccgagctgttcatggagtgcgaggaggaggagctggagccctggcagaagaaggtgaaggaggtggaggacgacgacgacgacgagcccatcttcgtgggcgagatcagcagcagcaagcccgccatcagcaacatcctgaacagagtgaaccccagcagctacagcagaggcctgaagaacggcgccctgagcagaggcatcaccgccgccttcaagcccaccagccagcactacaccaaccccaccagcaaccccgtgcccgccagccccatcaacttccaccccgagagcagaagcagcgacagcagcgtgatcgtgcagcccttcagcaagcccggctacatcaccaacagcagcagagtggtgagcaacaagagcagcgagctgctgttcgacctgacccaggacaccggcctgagccactaccagggcggccccaccctgagcatggccggcatgagcgagagcagcttcctgagcaagagacccagcaccagcgaggtgaacaacgtgaaccccaagaagcccaagcccagcgagagcgtgagcggcgccaacagcagcgccgtgctgcccagcgtgaagagccccagcgtgaccagcagccaggccatgctggccaagggcaccaacaccagcagcaaccagagcaagaacggcacccccttccccagagcctgccccaagtgcaacatccacttcaacctgctggaccccctgaagaaccacatgaagtactgctgccccgacatgatcaacaacttcctgggcctggccaagaccgagttcagcagcaccgtgaacaagaacaccaccatcgacagcgagaagggcaagctgatcatgctggtgaacgacttctactacggcaagcacgagggcgacgtgcaggaggagcagaagacccacaccaccttcaagtgcttcagctgcctgaagatcctgaagaacaacatcagattcatgaaccacatgaagcaccacctggagctggagaagcagagcagcgagagctgggagaaccacaccacctgccagcactgctacagacagttccccacccccttccagctgcagtgccacatcgagagcacccacaccccccacgagttcagcaccatctgcaagatctgcgagctgagcttcgagaccgagcacgtgctgctgcagcacatgaaggacaaccacaagcccggcgagatgccctacgtgtgccaggtgtgcaactacagaagcagcagcttcagcgacgtggagacccacttcagaaccagccacgagaacaccaagaacctgctgtgccccttctgcctgaaggtgatcaagatcgccaccccctacatgcaccactacatgaagcaccagaagaagggcatccacagatgcaccaagtgcagactgcagttcctgacctgcaaggagaagatggaccacaagacccagcaccacagaaccttcatcaagcccaagcagctggagggcctgccccccggcaccaaggtgaccatcagagccagcgtgggccccctgcagagcggcgccagccccacccccagcatcagcgccagcgccagcaccctgcagctgagcccccccagaaccaagaacatcaccgccaagaaccccgccaagagcaacaccagcaagcccaacaccgtgaagagcaacgccagcaagcccaacaccagcaagcccaacggcagcaagagcaagtacaagcccaagatcagcaacatgcagaagaagcagagcaccctggccagcagcaacaagaagagcaaggtgaacaccgccctgagaaacctgagatacagaagaggcatccacaagtgcatcgagtgctgcagcgagatcaaggacttcgccaaccacttccccacctacgtgcactgcagcttctgcagatacaacaccagctgcagcaaggcctacgtgaaccacatgatgagcttccacagcaacagacccagcaagagattctgcatcttcaagaagcacagcgagaacctgagaggcatcaccctggtgtgcctgaactgcgacttcctgagcgacgtgagcggcctggacaacatggccacccacctgagccagcacaagacccacacctgccaggtggtgatgcagaaggtgagcgtgtgcatccccaccagcgagcacctgagcgagctgaagaaggaggcccccgccaaggagcaggagcccgtgagcaaggagatcgccagacccaacatggccgagagagagaccgagaccagcaacagcgagagcaagcaggacaaggccgccagcagcaaggagaagaacggctgcaacgccaacagcttcgagggcagcagcaccaccaagagcgaggagagcatcaccgtgagcgacaaggagaacgagacctgcctggccgaccaggagaccggcagcaagaacatcgtgagctgcgacagcaacatcggcgccgacaaggtggagaagaagaagcagatccagcacgtgtgccaggagatggagctgaagatgtgccagagcagcgagaacatcatcctgagcgaccagatcaaggaccacaacagcagcgaggccagattcagcagcaagaacatcaaggacctgagactggccagcgacaacgtgagcatcgaccagttcctgagaaagagacacgagcccgagagcgtgagcagcgacgtgagcgagcagggcagcatccacctggagcccctgacccccagcgaggtgctggagtacgaggccaccgagatcctgcagaagggcagcggcgaccccagcgccaagaccgacgaggtggtgagcgaccagaccgacgacatccccggcggcaacaaccccagcaccaccgaggccaccgtggacctggaggacgagaaggagagaagctag

SEQ ID NO: 10301 - DNA, 1266 bp, Artificial Sequence
  Description of Artificial Sequence: Synthetic coding sequence
atgctggtgaacgacttctactacggcaagcacgagggcgacgtgcaggaggagcagaagacccacaccaccttcaagtgcttcagctgcctgaagatcctgaagaacaacatcagattcatgaaccacatgaagcaccacctggagctggagaagcagagcagcgagagctgggagaaccacaccacctgccagcactgctacagacagttccccacccccttccagctgcagtgccacatcgagagcacccacaccccccacgagttcagcaccatctgcaagatctgcgagctgagcttcgagaccgagcacgtgctgctgcagcacatgaaggacaaccacaagcccggcgagatgccctacgtgtgccaggtgtgcaactacagaagcagcagcttcagcgacgtggagacccacttcagaaccagccacgagaacaccaagaacctgctgtgccccttctgcctgaaggtgatcaagatcgccaccccctacatgcaccactacatgaagcaccagaagaagggcatccacagatgcaccaagtgcagactgcagttcctgacctgcaaggagaagatggaccacaagacccagcaccacagaaccttcatcaagcccaagcagctggagggcctgccccccggcaccaaggtgaccatcagagccagcgtgggccccctgcagagcggcgccagccccacccccagcatcagcgccagcgccagcaccctgcagctgagcccccccagaaccaagaacatcaccgccaagaaccccgccaagagcaacaccagcaagcccaacaccgtgaagagcaacgccagcaagcccaacaccagcaagcccaacggcagcaagagcaagtacaagcccaagatcagcaacatgcagaagaagcagagcaccctggccagcagcaacaagaagagcaaggtgaacaccgccctgagaaacctgagatacagaagaggcatccacaagtgcatcgagtgctgcagcgagatcaaggacttcgccaaccacttccccacctacgtgcactgcagcttctgcagatacaacaccagctgcagcaaggcctacgtgaaccacatgatgagcttccacagcaacagacccagcaagagattctgcatcttcaagaagcacagcgagaacctgagatgcgtgggcggccagatcgagtgcgacctgcccaagctgcacaagctggtggtggagcccagactgaccctgggcctgctgacccccaacttctag

SEQ ID NO: 10302 - DNA, 2901 bp, Artificial Sequence
  Description of Artificial Sequence: Synthetic coding sequence
atggccgagctgttcatggagtgcgaggaggaggagctggagccctggcagaagaaggtgaaggaggtggaggacgacgacgacgacgagcccatcttcgtgggcgagatcagcagcagcaagcccgccatcagcaacatcctgaacagagtgaaccccagcagctacagcagaggcctgaagaacggcgccctgagcagaggcatcaccgccgccttcaagcccaccagccagcactacaccaaccccaccagcaaccccgtgcccgccagccccatcaacttccaccccgagagcagaagcagcgacagcagcgtgatcgtgcagcccttcagcaagcccggctacatcaccaacagcagcagagtggtgagcaacaagagcagcgagctgctgttcgacctgacccaggacaccggcctgagccactaccagggcggccccaccctgagcatggccggcatgagcgagagcagcttcctgagcaagagacccagcaccagcgaggtgaacaacgtgaaccccaagaagcccaagcccagcgagagcgtgagcggcgccaacagcagcgccgtgctgcccagcgtgaagagccccagcgtgaccagcagccaggccatgctggccaagggcaccaacaccagcagcaaccagagcaagaacggcacccccttccccagagcctgccccaagtgcaacatccacttcaacctgctggaccccctgaagaaccacatgaagtactgctgccccgacatgatcaacaacttcctgggcctggccaagaccgagttcagcagcaccgtgaacaagaacaccaccatcgacagcgagaagggcaagctgatcatgctggtgaacgacttctactacggcaagcacgagggcgacgtgcaggaggagcagaagacccacaccaccttcaagtgcttcagctgcctgaagatcctgaagaacaacatcagattcatgaaccacatgaagcaccacctggagctggagaagcagagcagcgagagctgggagaaccacaccacctgccagcactgctacagacagttccccacccccttccagctgcagtgccacatcgagagcacccacaccccccacgagttcagcaccatctgcaagatctgcgagctgagcttcgagaccgagcacgtgctgctgcagcacatgaaggacaaccacaagcccggcgagatgccctacgtgtgccaggtgtgcaactacagaagcagcagcttcagcgacgtggagacccacttcagaaccagccacgagaacaccaagaacctgctgtgccccttctgcctgaaggtgatcaagatcgccaccccctacatgcaccactacatgaagcaccagaagaagggcatccacagatgcaccaagtgcagactgcagttcctgacctgcaaggagaagatggaccacaagacccagcaccacagaaccttcatcaagcccaagcagctggagggcctgccccccggcaccaaggtgaccatcagagccagcgtgggccccctgcagagcggcgccagccccacccccagcatcagcgccagcgccagcaccctgcagctgagcccccccagaaccaagaacatcaccgccaagaaccccgccaagagcaacaccagcaagcccaacaccgtgaagagcaacgccagcaagcccaacaccagcaagcccaacggcagcaagagcaagtacaagcccaagatcagcaacatgcagaagaagcagagcaccctggccagcagcaacaagaagagcaaggtgaacaccgccctgagaaacctgagatacagaagaggcatccacaagtgcatcgagtgctgcagcgagatcaaggacttcgccaaccacttccccacctacgtgcactgcagcttctgcagatacaacaccagctgcagcaaggcctacgtgaaccacatgatgagcttccacagcaacagacccagcaagagattctgcatcttcaagaagcacagcgagaacctgagaggcatcaccctggtgtgcctgaactgcgacttcctgagcgacgtgagcggcctggacaacatggccacccacctgagccagcacaagacccacacctgccaggtggtgatgcagaaggtgagcgtgtgcatccccaccagcgagcacctgagcgagctgaagaaggaggcccccgccaaggagcaggagcccgtgagcaaggagatcgccagacccaacatggccgagagagagaccgagaccagcaacagcgagagcaagcaggacaaggccgccagcagcaaggagaagaacggctgcaacgccaacagcttcgagggcagcagcaccaccaagagcgaggagagcatcaccgtgagcgacaaggagaacgagacctgcctggccgaccaggagaccggcagcaagaacatcgtgagctgcgacagcaacatcggcgccgacaaggtggagaagaagaagcagatccagcacgtgtgccaggagatggagctgaagatgtgccagagcagcgagaacatcatcctgagcgaccagatcaaggaccacaacagcagcgaggccagattcagcagcaagaacatcaaggacctgagactggccagcgacaacgtgagcatcgaccagttcctgagaaagagacacgagcccgagagcgtgagcagcgacgtgagcgagcagggcagcatccacctggagcccctgacccccagcgaggtgctggagtacgaggccaccgagatcctgcagaagggcagcggcgaccccagcgccaagaccgacgaggtggtgagcgaccagaccgacgacatccccggcggcaacaaccccagcaccaccgaggccaccgtggacctggaggacgagaaggagagaagctag

SEQ ID NO: 10303 - DNA, 2244 bp, Artificial Sequence
  Description of Artificial Sequence: Synthetic coding sequence
atggccgagctgttcatggagtgcgaggaggaggagctggagccctggcagaagaaggtgaaggaggtggaggacgacgacgacgacgagcccatcttcgtgggcgagatcagcagcagcaagcccgccatcagcaacatcctgaacagagtgaaccccagcagctacagcagaggcctgaagaacggcgccctgagcagaggcatcaccgccgccttcaagcccaccagccagcactacaccaaccccaccagcaaccccgtgcccgccagccccatcaacttccaccccgagagcagaagcagcgacagcagcgtgatcgtgcagcccttcagcaagcccggctacatcaccaacagcagcagagtggtgagcaacaagagcagcgagctgctgttcgacctgacccaggacaccggcctgagccactaccagggcggccccaccctgagcatggccggcatgagcgagagcagcttcctgagcaagagacccagcaccagcgaggtgaacaacgtgaaccccaagaagcccaagcccagcgagagcgtgagcggcgccaacagcagcgccgtgctgcccagcgtgaagagccccagcgtgaccagcagccaggccatgctggccaagggcaccaacaccagcagcaaccagagcaagaacggcacccccttccccagagcctgccccaagtgcaacatccacttcaacctgctggaccccctgaagaaccacatgaagtactgctgccccgacatgatcaacaacttcctgggcctggccaagaccgagttcagcagcaccgtgaacaagaacaccaccatcgacagcgagaagggcaagctgatcatgctggtgaacgacttctactacggcaagcacgagggcgacgtgcaggaggagcagaagacccacaccaccttcaagtgcttcagctgcctgaagatcctgaagaacaacatcagattcatgaaccacatgaagcaccacctggagctggagaagcagagcagcgagagctgggagaaccacaccacctgccagcactgctacagacagttccccacccccttccagctgcagtgccacatcgagagcacccacaccccccacgagttcagcaccatctgcaagatctgcgagctgagcttcgagaccgagcacgtgctgctgcagcacatgaaggacaaccacaagcccggcgagatgccctacgtgtgccaggtgtgcaactacagaagcagcagcttcagcgacgtggagacccacttcagaaccagccacgagaacaccaagaacctgctgtgccccttctgcctgaaggtgatcaagatcgccaccccctacatgcaccactacatgaagcaccagaagaagggcatccacagatgcaccaagtgcagactgcagttcctgacctgcaaggagaagatggaccacaagacccagcaccacagaaccttcatcaagcccaagcagctggagggcctgccccccggcaccaaggtgaccatcagagccagcgtgggccccctgcagagcggcgccagccccacccccagcatcagcgccagcgccagcaccctgcagctgagcccccccagaaccaagaacatcaccgccaagaaccccgccaagagcaacaccagcaagcccaacaccgtgaagagcaacgccagcaagcccaacaccagcaagcccaacggcagcaagagcaagtacaagcccaagatcagcaacatgcagaagaagcagagcaccctggccagcagcaacaagaagagcaaggtgaacaccgccctgagaaacctgagatacagaagaggcatccacaagtgcatcgagtgctgcagcgagatcaaggacttcgccaaccacttccccacctacgtgcactgcagcttctgcagatacaacaccagctgcagcaaggcctacgtgaaccacatgatgagcttccacagcaacagacccagcaagagattctgcatcttcaagaagcacagcgagaacctgagaggcatcaccctggtgtgcctgaactgcgacttcctgagcgacgtgagcggcctggacaacatggccacccacctgagccagcacaagacccacacctgccaggtggtgatgcagaaggacgccgaggccgcccagagattccagaagatcagcagagtgtacctggacagcgtgcccctgagatggacccagctgatgcccgtgctgagcttccagggcatgtag

SEQ ID NO: 10304 - DNA, 243 bp, Artificial Sequence
  Description of Artificial Sequence: Synthetic coding sequence
atgggcgacaaccccttccagcccaagagcaacagcaagatggccgagctgttcatggagtgcgaggaggaggagctggagccctggcagaagaaggtgaaggaggtggaggacgacgacgacgacgagcccatcttcgtgggcgagatcagcagcagcaagcccgccatcagcaacatcctgaacagagtgaaccccagcagctacagcagaggcctgaagaacggcgccctgagcagatag

SEQ ID NO: 10305 - DNA, 477 bp, Artificial Sequence
  Description of Artificial Sequence: Synthetic coding sequence
atgggcgacaaccccttccagcccaagagcaacagcaagatggccgagctgttcatggagtgcgaggaggaggagctggagccctggcagaagaaggtgaaggaggtggaggacgacgacgacgacgagcccatcttcgtgggcgagatcagcagcagcaagcccgccatcagcaacatcctgaacagagtgaaccccagcagctacagcagaggcctgaagaacggcgccctgagcagaggcatcaccgccgccttcaagcccaccagccagcactacaccaaccccaccagcaaccccgtgcccgccagccccatcaacttccaccccgagagcagaagcagcgacagcagcgtgatcgtgcagcccttcagcaagcccgtgagcgtgagcaagaccatcagacccgcccagggcagcatcggctgctgcctgagcatcagcaccgtgcccagctacaacagcggcctgagctag

SEQ ID NO: 10306 - DNA, 2901 bp, Artificial Sequence; identical to SEQ ID NO: 10302
  Description of Artificial Sequence: Synthetic coding sequence

SEQ ID NO: 10307 - DNA, 2688 bp, Artificial Sequence
  Description of Artificial Sequence: Synthetic coding sequence
atgaagatcggcagcggcttcctgagcggcggcggcggcaccggcagcagcggcggcagcggcagcggcggcggcggcagcggcggcggcggcggcggcggcagcagcggcagaagagccgagatggagcccaccttcccccagggcatggtgatgttcaaccacagactgccccccgtgaccagcttcaccagacccgccggcagcgccgccccccccccccagtgcgtgctgagcagcagcaccagcgccgcccccgccgccgagcccccccccccccccgcccccgacatgaccttcaagaaggagcccgccgccagcgccgccgccttccccagccagagaaccagctggggcttcctgcagagcctggtgagcatcaagcaggagaagcccgccgaccccgaggagcagcagagccaccaccaccaccaccaccaccactacggcggcctgttcgccggcgccgaggagagaagccccggcctgggcggcggcgagggcggcagccacggcgtgatccaggacctgagcatcctgcaccagcacgtgcagcagcagcccgcccagcaccacagagacgtgctgctgagcagcagcagcagaaccgacgaccaccacggcaccgaggagcccaagcaggacaccaacgtgaagaaggccaagagacccaagcccgagagccagggcatcaaggccaagagaaagcccagcgccagcagcaagcccagcctggtgggcgacggcgagggcgccatcctgagccccagccagaagccccacatctgcgaccactgcagcgccgccttcagaagcagctaccacctgagaagacacgtgctgatccacaccggcgagagacccttccagtgcagccagtgcagcatgggcttcatccagaagtacctgctgcagagacacgagaagatccacagcagagagaagcccttcggctgcgaccagtgcagcatgaagttcatccagaagtaccacatggagagacacaagagaacccacagcggcgagaagccctacaagtgcgacacctgccagcagtacttcagcagaaccgacagactgctgaagcacagaagaacctgcggcgaggtgatcgtgaagggcgccaccagcgccgagcccggcagcagcaaccacaccaacatgggcaacctggccgtgctgagccagggcaacaccagcagcagcagaagaaagaccaagagcaagagcatcgccatcgagaacaaggagcagaagaccggcaagaccaacgagagccagatcagcaacaacatcaacatgcagagctacagcgtggagatgcccaccgtgagcagcagcggcggcatcatcggcaccggcatcgacgagctgcagaagagagtgcccaagctgatcttcaagaagggcagcagaaagaacaccgacaagaactacctgaacttcgtgagccccctgcccgacatcgtgggccagaagagcctgagcggcaagcccagcggcagcctgggcatcgtgagcaacaacagcgtggagaccatcggcctgctgcagagcaccagcggcaagcagggccagatcagcagcaactacgacgacgccatgcagttcagcaagaagagaagatacctgcccaccgccagcagcaacagcgccttcagcatcaacgtgggccacatggtgagccagcagagcgtgatccagagcgccggcgtgagcgtgctggacaacgaggcccccctgagcctgatcgacagcagcgccctgaacgccgagatcaagagctgccacgacaagagcggcatccccgacgaggtgctgcagagcatcctggaccagtacagcaacaagagcgagagccagaaggaggaccccttcaacatcgccgagcccagagtggacctgcacaccagcggcgagcacagcgagctggtgcaggaggagaacctgagccccggcacccagacccccagcaacgacaaggccagcatgctgcaggagtacagcaagtacctgcagcaggccttcgagaagagcaccaacgccagcttcaccctgggccacggcttccagttcgtgagcctgagcagccccctgcacaaccacaccctgttccccgagaagcagatctacaccaccagccccctggagtgcggcttcggccagagcgtgaccagcgtgctgcccagcagcctgcccaagccccccttcggcatgctgttcggcagccagcccggcctgtacctgagcgccctggacgccacccaccagcagctgacccccagccaggagctggacgacctgatcgacagccagaagaacctggagaccagcagcgccttccagagcagcagccagaagctgaccagccagaaggagcagaagaacctggagagcagcaccggcttccagatccccagccaggagctggccagccagatcgacccccagaaggacatcgagcccagaaccacctaccagatcgagaacttcgcccaggccttcggcagccagttcaagagcggcagcagagtgcccatgaccttcatcaccaacagcaacggcgaggtggaccacagagtgagaaccagcgtgagcgacttcagcggctacaccaacatgatgagcgacgtgagcgagccctgcagcaccagagtgaagacccccaccagccagagctacagatag

SEQ ID NO: 10308 - DNA, 2580 bp, Artificial Sequence
  Description of Artificial Sequence: Synthetic coding sequence
atgaagatcggcagcggcttcctgagcggcggcggcggcaccggcagcagcggcggcagcggcagcggcggcggcggcagcggcggcggcggcggcggcggcagcagcggcagaagagccgagatggagcccaccttcccccaggcccccgccgccgagcccccccccccccccgcccccgacatgaccttcaagaaggagcccgccgccagcgccgccgccttccccagccagagaaccagctggggcttcctgcagagcctggtgagcatcaagcaggagaagcccgccgaccccgaggagcagcagagccaccaccaccaccaccaccaccactacggcggcctgttcgccggcgccgaggagagaagccccggcctgggcggcggcgagggcggcagccacggcgtgatccaggacctgagcatcctgcaccagcacgtgcagcagcagcccgcccagcaccacagagacgtgctgctgagcagcagcagcagaaccgacgaccaccacggcaccgaggagcccaagcaggacaccaacgtgaagaaggccaagagacccaagcccgagagccagggcatcaaggccaagagaaagcccagcgccagcagcaagcccagcctggtgggcgacggcgagggcgccatcctgagccccagccagaagccccacatctgcgaccactgcagcgccgccttcagaagcagctaccacctgagaagacacgtgctgatccacaccggcgagagacccttccagtgcagccagtgcagcatgggcttcatccagaagtacctgctgcagagacacgagaagatccacagcagagagaagcccttcggctgcgaccagtgcagcatgaagttcatccagaagtaccacatggagagacacaagagaacccacagcggcgagaagccctacaagtgcgacacctgccagcagtacttcagcagaaccgacagactgctgaagcacagaagaacctgcggcgaggtgatcgtgaagggcgccaccagcgccgagcccggcagcagcaaccacaccaacatgggcaacctggccgtgctgagccagggcaacaccagcagcagcagaagaaagaccaagagcaagagcatcgccatcgagaacaaggagcagaagaccggcaagaccaacgagagccagatcagcaacaacatcaacatgcagagctacagcgtggagatgcccaccgtgagcagcagcggcggcatcatcggcaccggcatcgacgagctgcagaagagagtgcccaagctgatcttcaagaagggcagcagaaagaacaccgacaagaactacctgaacttcgtgagccccctgcccgacatcgtgggccagaagagcctgagcggcaagcccagcggcagcctgggcatcgtgagcaacaacagcgtggagaccatcggcctgctgcagagcaccagcggcaagcagggccagatcagcagcaactacgacgacgccatgcagttcagcaagaagagaagatacctgcccaccgccagcagcaacagcgccttcagcatcaacgtgggccacatggtgagccagcagagcgtgatccagagcgccggcgtgagcgtgctggacaacgaggcccccctgagcctgatcgacagcagcgccctgaacgccgagatcaagagctgccacgacaagagcggcatccccgacgaggtgctgcagagcatcctggaccagtacagcaacaagagcgagagccagaaggaggaccccttcaacatcgccgagcccagagtggacctgcacaccagcggcgagcacagcgagctggtgcaggaggagaacctgagccccggcacccagacccccagcaacgacaaggccagcatgctgcaggagtacagcaagtacctgcagcaggccttcgagaagagcaccaacgccagcttcaccctgggccacggcttccagttcgtgagcctgagcagccccctgcacaaccacaccctgttccccgagaagcagatctacaccaccagccccctggagtgcggcttcggccagagcgtgaccagcgtgctgcccagcagcctgcccaagccccccttcggcatgctgttcggcagccagcccggcctgtacctgagcgccctggacgccacccaccagcagctgacccccagccaggagctggacgacctgatcgacagccagaagaacctggagaccagcagcgccttccagagcagcagccagaagctgaccagccagaaggagcagaagaacctggagagcagcaccggcttccagatccccagccaggagctggccagccagatcgacccccagaaggacatcgagcccagaaccacctaccagatcgagaacttcgcccaggccttcggcagccagttcaagagcggcagcagagtgcccatgaccttcatcaccaacagcaacggcgaggtggaccacagagtgagaaccagcgtgagcgacttcagcggctacaccaacatgatgagcgacgtgagcgagccctgcagcaccagagtgaagacccccaccagccagagctacagatag

SEQ ID NO: 10309 - DNA, 2688 bp, Artificial Sequence; identical to SEQ ID NO: 10307
  Description of Artificial Sequence: Synthetic coding sequence

SEQ ID NO: 10310 - DNA, 1803 bp, Artificial Sequence
  Description of Artificial Sequence: Synthetic coding sequence
atgggcttcatccagaagtacctgctgcagagacacgagaagatccacagcagagagaagcccttcggctgcgaccagtgcagcatgaagttcatccagaagtaccacatggagagacacaagagaacccacagcggcgagaagccctacaagtgcgacacctgccagcagtacttcagcagaaccgacagactgctgaagcacagaagaacctgcggcgaggtgatcgtgaagggcgccaccagcgccgagcccggcagcagcaaccacaccaacatgggcaacctggccgtgctgagccagggcaacaccagcagcagcagaagaaagaccaagagcaagagcatcgccatcgagaacaaggagcagaagaccggcaagaccaacgagagccagatcagcaacaacatcaacatgcagagctacagcgtggagatgcccaccgtgagcagcagcggcggcatcatcggcaccggcatcgacgagctgcagaagagagtgcccaagctgatcttcaagaagggcagcagaaagaacaccgacaagaactacctgaacttcgtgagccccctgcccgacatcgtgggccagaagagcctgagcggcaagcccagcggcagcctgggcatcgtgagcaacaacagcgtggagaccatcggcctgctgcagagcaccagcggcaagcagggccagatcagcagcaactacgacgacgccatgcagttcagcaagaagagaagatacctgcccaccgccagcagcaacagcgccttcagcatcaacgtgggccacatggtgagccagcagagcgtgatccagagcgccggcgtgagcgtgctggacaacgaggcccccctgagcctgatcgacagcagcgccctgaacgccgagatcaagagctgccacgacaagagcggcatccccgacgaggtgctgcagagcatcctggaccagtacagcaacaagagcgagagccagaaggaggaccccttcaacatcgccgagcccagagtggacctgcacaccagcggcgagcacagcgagctggtgcaggaggagaacctgagccccggcacccagacccccagcaacgacaaggccagcatgctgcaggagtacagcaagtacctgcagcaggccttcgagaagagcaccaacgccagcttcaccctgggccacggcttccagttcgtgagcctgagcagccccctgcacaaccacaccctgttccccgagaagcagatctacaccaccagccccctggagtgcggcttcggccagagcgtgaccagcgtgctgcccagcagcctgcccaagccccccttcggcatgctgttcggcagccagcccggcctgtacctgagcgccctggacgccacccaccagcagctgacccccagccaggagctggacgacctgatcgacagccagaagaacctggagaccagcagcgccttccagagcagcagccagaagctgaccagccagaaggagcagaagaacctggagagcagcaccggcttccagatccccagccaggagctggccagccagatcgacccccagaaggacatcgagcccagaaccacctaccagatcgagaacttcgcccaggccttcggcagccagttcaagagcggcagcagagtgcccatgaccttcatcaccaacagcaacggcgaggtggaccacagagtgagaaccagcgtgagcgacttcagcggctacaccaacatgatgagcgacgtgagcgagccctgcagcaccagagtgaagacccccaccagccagagctacagatag

SEQ ID NO: 10311 - DNA, 2016 bp, Artificial Sequence
  Description of Artificial Sequence: Synthetic coding sequence
atgcagttcgtgagcaccagaccccagccccagcagctgggcatccagggcctgggcctggacagcggcagctggagctgggcccaggccctgccccccgaggaggtgtgccaccaggagcccgccctgagaggcgagatggccgagggcatgccccccatgcaggcccaggagtgggacatggacgccagaagacccatgcccttccagttcccccccttccccgacagagcccccgtgttccccgacagaatgatgagagagccccagctgcccaccgccgagatcagcctgtggaccgtggtggccgccatccaggccgtggagagaaaggtggacgcccaggccagccagctgctgaacctggagggcagaaccggcaccgccgagaagaagctggccgactgcgagaagaccgccgtggagttcggcaaccacatggagagcaagtgggccgtgctgggcaccctgctgcaggagtacggcctgctgcagagaagactggagaacctggagaacctgctgagaaacagaaacttctgggtgctgagactgccccccggcagcaagggcgaggcccccaaggtgcccgtgaccttcgtggacatcgccgtgtacttcagcgaggacgagtggaagaacctggacgagtggcagaaggagctgtacaacaacctggtgaaggagaactacaagaccctgatgagcctggacgccgagggcagcgtgcccaagcccgacgcccccgtgcaggccgagcccagagaggagccctgcgtgtgggagcagagacaccccgaggagagagagatccccatggaccccgaggccggcgccgagcccctggtgcccgcccaggacgccagcagccaggtgaagagagaggacaccctgtgcgtgagaggccagagaggcctggaggagagagccatccccaccgagagcatcaccgacagccccatcagcgcccaggacctgctgagcagaatcaagcaggaggagcaccagtgcgtgtgggaccagcaggacctggccgacagagacatccccaccgaccccaacagcgagagcctgatcagcgcccacgacatcctgagctggatcaagcaggaggagcagccctacccctggggccccagagacagcatggacggcgagctgggcctggacagcggccccagcgacagcctgctgatggtgaagaaccccccccccgcccccccccagccccagccccagccccagcccccccagccccagctgcagagccagccccagccccagagcctgccccccatcgccgtggccgagaaccccggcggcccccccagcagaggcctgctggacgacggcttccaggtgctgcccggcgagagaggcagcggcgaggccccccccggcggcgacagaagcaccggcggcggcggcggcgacggcggcggcggcggcggcggcgccgaggccggcaccggcgccggcggcggctgcggcagctgctgccccggcggcctgagaagaagcctgctgctgcacggcgccagaagcaagccctacagctgccccgagtgcggcaagagcttcggcgtgagaaagagcctgatcatccaccacagaagccacaccaaggagagaccctacgagtgcgccgagtgcgagaagagcttcaactgccacagcggcctgatcagacaccagatgacccacagaggcgagagaccctacaagtgcagcgagtgcgagaagacctacagcagaaaggagcacctgcagaaccaccagagactgcacaccggcgagagacccttccagtgcgccctgtgcggcaagagcttcatcagaaagcagaacctgctgaagcaccagagaatccacaccggcgagagaccctacacctgcggcgagtgcggcaagagcttcagatacaaggagagcctgaaggaccacctgagagtgcacagcggcggccccggccccggcgcccccagacagctgccccccccccccgagagagactag

SEQ ID NO: 10312 - DNA, 975 bp, Artificial Sequence
  Description of Artificial Sequence: Synthetic coding sequence
atgagagagccccagctgcccaccgccgagatcagcctgtggaccgtggtggccgccatccaggccgtggagagaaaggtggacgcccaggccagccagctgctgaacctggagggcagaaccggcaccgccgagaagaagctggccgactgcgagaagaccgccgtggagttcggcaaccacatggagagcaagtgggccgtgctgggcaccctgctgcaggagtacggcctgctgcagagaagactggagaacctggagaacctgctgagaaacagaaacttctgggtgctgagactgccccccggcagcaagggcgaggcccccaaggtgcccgtgaccttcgtggacatcgccgtgtacttcagcgaggacgagtggaagaacctggacgagtggcagaaggagctgtacaacaacctggtgaaggagaactacaagaccctgatgagcctggacgccgagggcagcgtgcccaagcccgacgcccccgtgcaggccgagcccagctacagctgccccgagtgcggcaagagcttcggcgtgagaaagagcctgatcatccaccacagaagccacaccaaggagagaccctacgagtgcgccgagtgcgagaagagcttcaactgccacagcggcctgatcagacaccagatgacccacagaggcgagagaccctacaagtgcagcgagtgcgagaagacctacagcagaaaggagcacctgcagaaccaccagagactgcacaccggcgagagacccttccagtgcgccctgtgcggcaagagcttcatcagaaagcagaacctgctgaagcaccagagaatccacaccggcgagagaccctacacctgcggcgagtgcggcaagagcttcagatacaaggagagcctgaaggaccacctgagagtgcacagcggcggccccggccccggcgcccccagacagctgccccccccccccgagagagactag

SEQ ID NO: 10313 - DNA, 1392 bp, Artificial Sequence
  Description of Artificial Sequence: Synthetic coding sequence
atgcagttcgtgagcaccagaccccagccccagcagctgggcatccagggcctgggcctggacagcggcagctggagctgggcccaggccctgccccccgaggaggtgtgccaccaggagcccgccctgagaggcgagatggccgagggcatgccccccatgcaggcccaggagtgggacatggacgccagaagacccatgcccttccagttcccccccttccccgacagagcccccgtgttccccgacagaatgatgagagagccccagctgcccaccgccgagatcagcctgtggaccgtggtggccgccatccaggccgtggagagaaaggtggacgcccaggccagccagctgctgaacctggagggcagaaccggcaccgccgagaagaagctggccgactgcgagaagaccgccgtggagttcggcaaccacatggagagcaagtgggccgtgctgggcaccctgctgcaggagtacggcctgctgcagagaagactggagaacctggagaacctgctgagaaacagaaacttctgggtgctgagactgccccccggcagcaagggcgaggcccccaaggtgcccgtgaccttcgtggacatcgccgtgtacttcagcgaggacgagtggaagaacctggacgagtggcagaaggagctgtacaacaacctggtgaaggagaactacaagaccctgatgagcctggacgccgagggcagcgtgcccaagcccgacgcccccgtgcaggccgagcccagagaggagccctgcgtgtgggagcagagacaccccgaggagagagagatccccatggaccccgaggccggcgccgagcccctggtgcccgcccaggacgccagcagccaggtgaagagagaggacaccctgtgcgtgagaggccagagaggcctggaggagagagccatccccaccgagagcatcaccgacagccccatcagcgcccaggacctgctgagcagaatcaagcaggaggagcaccagtgcgtgtgggaccagcaggacctggccgacagagacatccccaccgaccccaacagcgagagcctgatcagcgcccacgacatcctgagctggatcaagcaggaggagcagccctacccctggggccccagagacagcatggacggcgagctgggcctggacagcggccccagcgacagcctgctgatggtgaagaaccccccccccgcccccccccagccccagccccagccccagcccccccagccccagctgcagagccagccccagccccagagcctgccccccatcgccgtggccgagaaccccggcggcccccccagcagaggcctgctggacgacggcttccagccccaccagggcgccgccctgagagtgagatag

SEQ ID NO: 10314 - DNA, 252 bp, Artificial Sequence
  Description of Artificial Sequence: Synthetic coding sequence
atgttcgagagctgcagcggcttcagcggcttctgcgccagccccatcgaggagagccacggcgccctgatcagcagctgcaacagcagaaccatgaccgacggcctggtgaccttcagagacgtggccatcgacttcagccaggaggagtgggagtgcctggaccccgcccagagagacctgtacgtggacgtgatgctggagaactacagcaacctggtgagcctgggcaaggtgatctgcctgaagtag

SEQ ID NO: 10315 - DNA, 2040 bp, Artificial Sequence
  Description of Artificial Sequence: Synthetic coding sequence
atggagagcagaagcgtggcccaggccggcgtgcagtggtgcgacctgggcagcctgcaggcccccccccccggcttcaccctgttcagctgcctgagcctgctgagcagctgggactacagcagcggcttcagcggcttctgcgccagccccatcgaggagagccacggcgccctgatcagcagctgcaacagcagaaccatgaccgacggcctggtgaccttcagagacgtggccatcgacttcagccaggaggagtgggagtgcctggaccccgcccagagagacctgtacgtggacgtgatgctggagaactacagcaacctggtgagcctggacctggagagcaagacctacgagaccaagaagatcttcagcgagaacgacatcttcgagatcaacttcagccagtgggagatgaaggacaagagcaagaccctgggcctggaggccagcatcttcagaaacaactggaagtgcaagagcatcttcgagggcctgaagggccaccaggagggctacttcagccagatgatcatcagctacgagaagatccccagctacagaaagagcaagagcctgaccccccaccagagaatccacaacaccgagaagagctacgtgtgcaaggagtgcggcaaggcctgcagccacggcagcaagctggtgcagcacgagagaacccacaccgccgagaagcacttcgagtgcaaggagtgcggcaagaactacctgagcgcctaccagctgaacgtgcaccagagattccacaccggcgagaagccctacgagtgcaaggagtgcggcaagaccttcagctggggcagcagcctggtgaagcacgagagaatccacaccggcgagaagccctacgagtgcaaggagtgcggcaaggccttcagcagaggctaccacctgacccagcaccagaagatccacaccggcgtgaagagctacaagtgcaaggagtgcggcaaggccttcttctggggcagcagcctggccaagcacgagatcatccacaccggcgagaagccctacaagtgcaaggagtgcggcaaggccttcagcagaggctaccagctgacccagcaccagaagatccacaccggcaagaagccctacgagtgcaagatctgcggcaaggccttctgctggggctaccagctgaccagacaccagatcttccacaccggcgagaagccctacgagtgcaaggagtgcggcaaggccttcaactgcggcagcagcctgatccagcacgagagaatccacaccggcgagaagccctacgagtgcaaggagtgcggcaaggccttcagcagaggctaccacctgagccagcaccagaagatccacaccggcgagaagcccttcgagtgcaaggagtgcggcaaggccttcagctggggcagcagcctggtgaagcacgagagagtgcacaccggcgagaagagccacgagtgcaaggagtgcggcaagaccttctgcagcggctaccagctgaccagacaccaggtgttccacaccggcgagaagccctacgagtgcaaggagtgcggcaaggccttcaactgcggcagcagcctggtgcagcacgagagaatccacaccggcgagaagccctacgagtgcaaggagtgcggcaaggccttcagcagaggctaccacctgacccagcaccagaagatccacaccggcgagaagcccttcaagtgcaaggagtgcggcaaggccttcagctggggcagcagcctggtgaagcacgagagagtgcacaccaacgagaagagctacgagtgcaaggactgcggcaaggccttcggcagcggctaccagctgagcgtgcaccagagattccacaccggcgagaagctgtaccagagaaaggagttcggcaagaccttcacctgcggcagcaagctggtgcacgagagaacccacagcaacgacaagccctacaagtacaacgagtgcggcgaggccttcctgtggaccacctacagcaacgagaagatcgacaccgacgagaccctgtag

SEQ ID NO: 10316 - DNA, 1782 bp, Artificial Sequence
  Description of Artificial Sequence: Synthetic coding sequence
atgaccatgttcaaggaggccgtgaccttcaaggacgtggccgtggtgttcaccgaggaggagctgggcctgctggacgtgagccagagaaagctgtacagagacgtgatgctggagaacttcagaaacctgctgagcgtgggccaccagctgagccacagagacaccttccacttccagagagaggagaagttctggatcatggagaccgccacccagagagagggcaacagcggcggcaagatccagaccgagctggagagcgtgcccgagaccggcccccacgaggagtggagctgccagcagatctgggagcagaccgccagcgagctgaccagaccccaggacagcatcagcagcagccagttcagcacccagggcgacgtgcccagccaggtggacgccggcctgagcatcatccacatcggcgagacccccagcgagcacggcaagtgcaagaagttcttcagcgacgtgagcatcctggacctgcaccagcagctgcacagcggcaagatcagccacacctgcaacgagtacagaaagagattctgctacagcagcgccctgtgcctgcaccagaaggtgcacatgggcgagaagagatacaagtgcgacgtgtgcagcaaggccttcagccagaacagccagctgcagacccaccagagaatccacaccggcgagaagcccttcaagtgcgagcagtgcggcaagagcttcagcagaagaagcggcatgtacgtgcactgcaagctgcacaccggcgagaagccccacatctgcgaggagtgcggcaaggccttcatccacaacagccagctgagagagcaccagagaatccacaccggcgagaagcccttcaagtgctacatctgcggcaagagcttccacagcagaagcaacctgaacagacacagcatggtgcacatgcaggagaagagcttcagatgcgacacctgcagcaacagcttcggccagagaagcgccctgaacagccactgcatggaccacaccaaggagaagctgtacaagtgcgaggagtgcggcagaagcttcacctgcagacaggacctgtgcaagcaccagatggaccacaccggcgacaagccctacaactgcaacgtgtgcggcaagggcttcagatggagcagctgcctgagcagacaccagagagtgcacaacggcgagaccaccttcaagtgcgacggctgcggcaagagattctacatgaacagccagggccacagccaccagagagcctacagagaggaggagctgtacaagtgccagaagtgcggcaagggctacatcagcaagttcaacctggacctgcaccagagagtgcacaccggcgagagaccctacaactgcaaggagtgcggcaagagcttcagatgggccagcggcatcctgagacacaagagactgcacaccggcgagaagcccttcaagtgcgaggagtgcggcaagagattcaccgagaacagcaagctgagattccaccagagaatccacaccggcgagaagccctacaagtgcgaggagtgcggcaagggcttcagatgggccagcacccacctgacccaccagagactgcacagcagagagaagctgttccagtgcgaggactgcggcaagagcagcgagcacagcagctgcctgcaggaccagcagagcgaccacagcggcgagaagaccagcaagtgcgaggactgcggcaagagatacgagagaagactgaacctggacatgatcctgagcctgttcctgaacgacatctag

SEQ ID NO: 10317 - DNA, 2739 bp, Artificial Sequence
  Description of Artificial Sequence: Synthetic coding sequence
atgatcaagttccagatggtgaccttcaaggacgtggccgtggtgttcaccgaggaggagctgggcctgctggacagcgtgcagagaaagctgtacagagacgtgatgctggagaacttcagaaacctgctgctggtggcccaccagcccttcaagcccgacctgatcagccagctggagagagaggagaagctgctgatggtggagaccgagacccccagagacggctgcagcggcagaaagaaccagcagaagatggagagcatccaggaggtgaccgtgagctacttcagccccaaggagctgagcagcagacagacctggcagcagagcgccggcggcctgatcagatgccaggacttcctgaaggtgttccagggcaagaacagccagctgcaggagcagggcaacagcctgggccaggtgtgggccggcatccccgtgcagatcagcgaggacaagaactacatcttcacccacatcggcaacggcagcaactacatcaagagccagggctaccccagctggagagcccaccacagctggagaaagatgtacctgaaggagagccacaactaccagtgcagatgccagcagatcagcatgaagaaccacttctgcaagtgcgacagcgtgagctggctgagccaccacaacgacaagctggaggtgcacagaaaggagaactacagctgccacgactgcggcgaggacatcatgaaggtgagcctgctgaaccaggagagcatccagaccgaggagaagccctacccctgcaccggctacagaaaggccttcagcaacgacagcagcagcgaggtgcaccagcagttccacctggagggcaagccctacacctacagcagctgcggcaagggctgcaactacagcagcctgctgcacatccaccagaacatcgagagagaggacgacatcgagaacagccacctgaagagctaccagagagtgcacaccgaggagaagccctgcaagtgcggcgagtacggcgagaacttcaaccactgcagccccctgaacacctacgagctgatccacaccggcgagatgagctacagacacaacatctacgagaaggccttcagccacagcctggacctgaacagcatcttcagagtgcacaccagagacgagccccacgagtacgaggagaacgagaacgtgttcaaccagagcagctgcctgcaggtgcaccagaagatccacaccgaggagaagctgtacaccgacatcgagtacggcaagagcttcatctgcagcagcaacctggacatccagcacagagtgcacatggaggagaacagctacaacagcgaggagtgcggcaacggcttcagcctggccagccacttccaggacctgcagatcgtgcacaccaaggagcagccctacaagagatacgtgtgcagcaacagcttcagccacaacctgtacctgcagggccaccccaagatccacatcggcgagaagcccagaaaggagcacggcaacggcttcaactggagcagcaagctgaaggaccaccagagagtgcacaccggccagaagccctacaagtgcaacatctgcggcaagggcttcaaccacagaagcgtgctgaacgtgcaccagagagtgcacaccggcgagaagccctacaagtgcgaggagtgcgacaagggcttcagcagaagcagctacctgcaggcccaccagagagtgcacaccggcgagaagccctacaagtgcgaggagtgcggcaagggcttcagcagaaacagctacctgcagggccaccagagagtgcacaccggcgagaagccctacaagtgcgaggagtgcggcaagggcttcagcagaagcagccacctgcagggccaccagagagtgcacaccggcgagaagcccttcaagtgcgaggagtgcggcaagggcttcagctggagcttcaacctgcagatccaccagagagtgcacaccggcgagaagccctacaagtgcgaggagtgcggcaagggcttcagcaaggccagcaccctgctggcccaccagagagtgcacaccggcgagaagccctaccagtgcgacgagtgcggcaagagcttcagccagagaagctacctgcagagccaccagagcgtgcacagcggcgagagaccctacatctgcgaggtgtgcggcaagggcttcagccagagagcctacctgcagggccaccagagagtgcacaccagagtgaagccctacaagtgcgagatgtgcggcaagggcttcagccagagcagcagactggaggcccacagaagagtgcacaccggcggcaagccctacaagtgcgaggtgtgcaccaagggcttcagcgagagcagcagactgcaggcccaccagagagtgcacgtggagggcagaccctacaagtgcgagcagtgcggcaagggcttcagcggctacagcagcctgcaggcccaccacagagtgcacaccggcgagaagccctacaagtgcgaggtgtgcggcaagggcttcagccagagaagcaacctgcaggcccaccagagagtgcacaccggcgagaagccctacaagtgcgacgcctgcggcaagggcttcagatggagcagcggcctgctgatccaccagagagtgcacagcagcgacaagttctacaagagcgaggactacggcaaggactaccccagcagcgagaacctgcacagaaacgaggacagcgtgctgttctag

SEQ ID NO: 10318 - DNA, 1773 bp, Artificial Sequence
  Description of Artificial Sequence: Synthetic coding sequence
atgatcaagttccaggagagagtgaccttcaaggacgtggccgtggtgttcaccaaggaggagctggccctgctggacaaggcccagatcaacctgtaccaggacgtgatgctggagaacttcagaaacctgatgctggtgagagacggcatcaagaacaacatcctgaacctgcaggccaagggcctgagctacctgagccaggaggtgctgcactgctggcagatctggaagcagagaatcagagacctgaccgtgagccaggactacatcgtgaacctgcaggaggagtgcagcccccacctggaggacgtgagcctgagcgaggagtgggccggcatcagcctgcagatcagcgagaacgagaactacgtggtgaacgccatcatcaagaaccaggacatcaccgcctggcagagcctgacccaggtgctgacccccgagagctggagaaaggccaacatcatgaccgagccccagaacagccagggcagatacaagggcatctacatggaggagaagctgtacagaagagcccagcacgacgacagcctgagctggaccagctgcgaccaccacgagagccaggagtgcaagggcgaggaccccggcagacaccccaactgcggcaagaacctgggcatgaagagcaccgtggagaagagaaacgccgcccacgtgctgccccagcccttcccctgcaacaactgcggcgtggccttcgccgacgacaccgacccccacgtgcaccacagcacccacctgggcgagaagagctacaagtgcgaccagtacggcaagaacttcagccagagccaggacctgatcgtgcactgcaagacccacagcggcaagaccccctacgagttccacgagtggcccatgggctgcaagcagagcagcgacctgcccagataccagaaggtgagcagcggcgacaagccctacaagtgcaaggagtgcggcaagggcttcagaagaagcagcagcctgcacaaccaccacagagtgcacaccggcgagatgccctacaagtgcgacgagtgcggcaagggcttcggcttcagaagcctgctgtgcatccaccagggcgtgcacaccggcaagaagccctacaagtgcgaggagtgcggcaagggcttcgaccagagcagcaacctgctggtgcaccagagagtgcacaccggcgagaagccctacaagtgcagcgagtgcggcaagtgcttcagcagcagcagcgtgctgcaggtgcactggagattccacaccggcgagaagccctacagatgcggcgagtgcggcaagggcttcagccagtgcacccacctgcacatccaccagagagtgcacaccggcgagaagccctacaagtgcaacgtgtgcggcaaggacttcgcctacagcagcgtgctgcacacccaccagagagtgcacaccggcgagaagccctacaagtgcgaggtgtgcggcaagtgcttcagctacagcagctacttccacctgcaccagagagaccacatcagagagaagccctacaagtgcgacgagtgcggcaagggcttcagcagaaacagcgacctgaacgtgcacctgagagtgcacaccagagagagaccctacaagtgcaaggcctgcggcaagggcttcagcagaaacagctacctgctggcccaccagagagtgcacatcgacgagacccagtacacccactgcgagagaggcaaggacctgctgacccaccagagactgcacgagcagagagagaccctgtag

SEQ ID NO: 10319 - DNA, 2742 bp, Artificial Sequence
  Description of Artificial Sequence: Synthetic coding sequence
atgaccaagttccaggagatggtgaccttcaaggacgtggccgtggtgttcaccgaggaggagctgggcctgctggacagcgtgcagagaaagctgtacagagacgtgatgctggagaacttcagaaacctgctgctggtggcccaccagcccttcaagcccgacctgatcagccagctggagagagaggagaagctgctgatggtggagaccgagacccccagagacggctgcagcggcagaaagaaccagcagaagatggagagcatccaggaggtgaccgtgagctacttcagccccaaggagctgagcagcagacagacctggcagcagagcgccggcggcctgatcagatgccaggacttcctgaaggtgttccagggcaagaacagccagctgcaggagcagggcaacagcctgggccaggtgtgggccggcatccccgtgcagatcagcgaggacaagaactacatcttcacccacatcggcaacggcagcaactacatcaagagccagggctaccccagctggagagcccaccacagctggagaaagatgtacctgaaggagagccacaactaccagtgcagatgccagcagatcagcatgaagaaccacttctgcaagtgcgacagcgtgagctggctgagccaccacaacgacaagctggaggtgcacagaaaggagaactacagctgccacgactgcggcgaggacatcatgaaggtgagcctgctgaaccaggagagcatccagaccgaggagaagccctacccctgcaccggctacagaaaggccttcagcaacgacagcagcagcgaggtgcaccagcagttccacctggagggcaagccctacacctacagcagctgcggcaagggctgcaactacagcagcctgctgcacatccaccagaacatcgagagagaggacgacatcgagaacagccacctgaagagctaccagagagtgcacaccgaggagaagccctgcaagtgcggcgagtacggcgagaacttcaaccactgcagccccctgaacacctacgagctgatccacaccggcgagatgagctacagacacaacatctacgagaaggccttcagccacagcctggacctgaacagcatcttcagagtgcacaccagagacgagccccacgagtacgaggagaacgagaacgtgttcaaccagagcagctgcctgcaggtgcaccagaagatccacaccgaggagaagctgtacaccgacatcgagtacggcaagagcttcatctgcagcagcaacctggacatccagcacagagtgcacatggaggagaacagctacaacagcgaggagtgcggcaacggcttcagcctggccagccacttccaggacctgcagatcgtgcacaccaaggagcagccctacaagagatacgtgtgcagcaacagcttcagccacaacctgtacctgcagggccaccccaagatccacatcggcgagaagcccagaaaggagcacggcaacggcttcaactggagcagcaagctgaaggaccaccagagagtgcacaccggccagaagccctacaagtgcaacatctgcggcaagggcttcaaccacagaagcgtgctgaacgtgcaccagagagtgcacaccggcgagaagccctacaagtgcgaggagtgcgacaagggcttcagcagaagcagctacctgcaggcccaccagagagtgcacaccggcgagaagccctacaagtgcgaggagtgcggcaagggcttcagcagaaacagctacctgcagggccaccagagagtgcacaccggcgagaagccctacaagtgcgaggagtgcggcaagggcttcagcagaagcagccacctgcagggccaccagagagtgcacaccggcgagaagcccttcaagtgcgaggagtgcggcaagggcttcagctggagcttcaacctgcagatccaccagagagtgcacaccggcgagaagccctacaagtgcgaggagtgcggcaagggcttcagcaaggccagcaccctgctggcccaccagagagtgcacaccggcgagaagccctaccagtgcgacgagtgcggcaagagcttcagccagagaagctacctgcagagccaccagagcgtgcacagcggcgagagaccctacatctgcgaggtgtgcggcaagggcttcagccagagagcctacctgcagggccaccagagagtgcacaccagagtgaagccctacaagtgcgagatgtgcggcaagggcttcagccagagcagcagactggaggcccacagaagagtgcacaccggcggcaagccctacaagtgcgaggtgtgcaccaagggcttcagcgagagcagcagactgcaggcccaccagagagtgcacgtggagggcagaccctacaagtgcgagcagtgcggcaagggcttcagcggctacagcagcctgcaggcccaccacagagtgcacaccggcgagaagccctacaagtgcgaggtgtgcggcaagggcttcagccagagaagcaacctgcaggcccaccagagagtgcacaccggcgagaagccctacaagtgcgacgcctgcggcaagggcttcagatggagcagcggcctgctgatccaccagagagtgcacagcagcgacaagttctacaagagcgaggactacggcaaggactaccccagcagcgagaacctgcacagaaacgaggacagcgtgctgttctag

SEQ ID NO: 10320 - DNA, 2724 bp, Artificial Sequence
  Description of Artificial Sequence: Synthetic coding sequence
atggtgaccttcaaggacgtggccgtggtgttcaccgaggaggagctgggcctgctggacagcgtgcagagaaagctgtacagagacgtgatgctggagaacttcagaaacctgctgctggtggcccaccagcccttcaagcccgacctgatcagccagctggagagagaggagaagctgctgatggtggagaccgagacccccagagacggctgcagcggcagaaagaaccagcagaagatggagagcatccaggaggtgaccgtgagctacttcagccccaaggagctgagcagcagacagacctggcagcagagcgccggcggcctgatcagatgccaggacttcctgaaggtgttccagggcaagaacagccagctgcaggagcagggcaacagcctgggccaggtgtgggccggcatccccgtgcagatcagcgaggacaagaactacatcttcacccacatcggcaacggcagcaactacatcaagagccagggctaccccagctggagagcccaccacagctggagaaagatgtacctgaaggagagccacaactaccagtgcagatgccagcagatcagcatgaagaaccacttctgcaagtgcgacagcgtgagctggctgagccaccacaacgacaagctggaggtgcacagaaaggagaactacagctgccacgactgcggcgaggacatcatgaaggtgagcctgctgaaccaggagagcatccagaccgaggagaagccctacccctgcaccggctacagaaaggccttcagcaacgacagcagcagcgaggtgcaccagcagttccacctggagggcaagccctacacctacagcagctgcggcaagggctgcaactacagcagcctgctgcacatccaccagaacatcgagagagaggacgacatcgagaacagccacctgaagagctaccagagagtgcacaccgaggagaagccctgcaagtgcggcgagtacggcgagaacttcaaccactgcagccccctgaacacctacgagctgatccacaccggcgagatgagctacagacacaacatctacgagaaggccttcagccacagcctggacctgaacagcatcttcagagtgcacaccagagacgagccccacgagtacgaggagaacgagaacgtgttcaaccagagcagctgcctgcaggtgcaccagaagatccacaccgaggagaagctgtacaccgacatcgagtacggcaagagcttcatctgcagcagcaacctggacatccagcacagagtgcacatggaggagaacagctacaacagcgaggagtgcggcaacggcttcagcctggccagccacttccaggacctgcagatcgtgcacaccaaggagcagccctacaagagatacgtgtgcagcaacagcttcagccacaacctgtacctgcagggccaccccaagatccacatcggcgagaagcccagaaaggagcacggcaacggcttcaactggagcagcaagctgaaggaccaccagagagtgcacaccggccagaagccctacaagtgcaacatctgcggcaagggcttcaaccacagaagcgtgctgaacgtgcaccagagagtgcacaccggcgagaagccctacaagtgcgaggagtgcgacaagggcttcagcagaagcagctacctgcaggcccaccagagagtgcacaccggcgagaagccctacaagtgcgaggagtgcggcaagggcttcagcagaaacagctacctgcagggccaccagagagtgcacaccggcgagaagccctacaagtgcgaggagtgcggcaagggcttcagcagaagcagccacctgcagggccaccagagagtgcacaccggcgagaagcccttcaagtgcgaggagtgcggcaagggcttcagctggagcttcaacctgcagatccaccagagagtgcacaccggcgagaagccctacaagtgcgaggagtgcggcaagggcttcagcaaggccagcaccctgctggcccaccagagagtgcacaccggcgagaagccctaccagtgcgacgagtgcggcaagagcttcagccagagaagctacctgcagagccaccagagcgtgcacagcggcgagagaccctacatctgcgaggtgtgcggcaagggcttcagccagagagcctacctgcagggccaccagagagtgcacaccagagtgaagccctacaagtgcgagatgtgcggcaagggcttcagccagagcagcagactggaggcccacagaagagtgcacaccggcggcaagccctacaagtgcgaggtgtgcaccaagggcttcagcgagagcagcagactgcaggcccaccagagagtgcacgtggagggcagaccctacaagtgcgagcagtgcggcaagggcttcagcggctacagcagcctgcaggcccaccacagagtgcacaccggcgagaagccctacaagtgcgaggtgtgcggcaagggcttcagccagagaagcaacctgcaggcccaccagagagtgcacaccggcgagaagccctacaagtgcgacgcctgcggcaagggcttcagatggagcagcggcctgctgatccaccagagagtgcacagcagcgacaagttctacaagagcgaggactacggcaaggactaccccagcagcgagaacctgcacagaaacgaggacagcgtgctgttctag

SEQ ID NO: 10321 - DNA, 2742 bp, Artificial Sequence
  Description of Artificial Sequence: Synthetic coding sequence
ctgaccgtgtgccaggagatggtgaccttcaaggacgtggccgtggtgttcaccgaggaggagctgggcctgctggacagcgtgcagagaaagctgtacagagacgtgatgctggagaacttcagaaacctgctgctggtggcccaccagcccttcaagcccgacctgatcagccagctggagagagaggagaagctgctgatggtggagaccgagacccccagagacggctgcagcggcagaaagaaccagcagaagatggagagcatccaggaggtgaccgtgagctacttcagccccaaggagctgagcagcagacagacctggcagcagagcgccggcggcctgatcagatgccaggacttcctgaaggtgttccagggcaagaacagccagctgcaggagcagggcaacagcctgggccaggtgtgggccggcatccccgtgcagatcagcgaggacaagaactacatcttcacccacatcggcaacggcagcaactacatcaagagccagggctaccccagctggagagcccaccacagctggagaaagatgtacctgaaggagagccacaactaccagtgcagatgccagcagatcagcatgaagaaccacttctgcaagtgcgacagcgtgagctggctgagccaccacaacgacaagctggaggtgcacagaaaggagaactacagctgccacgactgcggcgaggacatcatgaaggtgagcctgctgaaccaggagagcatccagaccgaggagaagccctacccctgcaccggctacagaaaggccttcagcaacgacagcagcagcgaggtgcaccagcagttccacctggagggcaagccctacacctacagcagctgcggcaagggctgcaactacagcagcctgctgcacatccaccagaacatcgagagagaggacgacatcgagaacagccacctgaagagctaccagagagtgcacaccgaggagaagccctgcaagtgcggcgagtacggcgagaacttcaaccactgcagccccctgaacacctacgagctgatccacaccggcgagatgagctacagacacaacatctacgagaaggccttcagccacagcctggacctgaacagcatcttcagagtgcacaccagagacgagccccacgagtacgaggagaacgagaacgtgttcaaccagagcagctgcctgcaggtgcaccagaagatccacaccgaggagaagctgtacaccgacatcgagtacggcaagagcttcatctgcagcagcaacctggacatccagcacagagtgcacatggaggagaacagctacaacagcgaggagtgcggcaacggcttcagcctggccagccacttccaggacctgcagatcgtgcacaccaaggagcagccctacaagagatacgtgtgcagcaacagcttcagccacaacctgtacctgcagggccaccccaagatccacatcggcgagaagcccagaaaggagcacggcaacggcttcaactggagcagcaagctgaaggaccaccagagagtgcacaccggccagaagccctacaagtgcaacatctgcggcaagggcttcaaccacagaagcgtgctgaacgtgcaccagagagtgcacaccggcgagaagccctacaagtgcgaggagtgcgacaagggcttcagcagaagcagctacctgcaggcccaccagagagtgcacaccggcgagaagccctacaagtgcgaggagtgcggcaagggcttcagcagaaacagctacctgcagggccaccagagagtgcacaccggcgagaagccctacaagtgcgaggagtgcggcaagggcttcagcagaagcagccacctgcagggccaccagagagtgcacaccggcgagaagcccttcaagtgcgaggagtgcggcaagggcttcagctggagcttcaacctgcagatccaccagagagtgcacaccggcgagaagccctacaagtgcgaggagtgcggcaagggcttcagcaaggccagcaccctgctggcccaccagagagtgcacaccggcgagaagccctaccagtgcgacgagtgcggcaagagcttcagccagagaagctacctgcagagccaccagagcgtgcacagcggcgagagaccctacatctgcgaggtgtgcggcaagggcttcagccagagagcctacctgcagggccaccagagagtgcacaccagagtgaagccctacaagtgcgagatgtgcggcaagggcttcagccagagcagcagactggaggcccacagaagagtgcacaccggcggcaagccctacaagtgcgaggtgtgcaccaagggcttcagcgagagcagcagactgcaggcccaccagagagtgcacgtggagggcagaccctacaagtgcgagcagtgcggcaagggcttcagcggctacagcagcctgcaggcccaccacagagtgcacaccggcgagaagccctacaagtgcgaggtgtgcggcaagggcttcagccagagaagcaacctgcaggcccaccagagagtgcacaccggcgagaagccctacaagtgcgacgcctgcggcaagggcttcagatggagcagcggcctgctgatccaccagagagtgcacagcagcgacaagttctacaagagcgaggactacggcaaggactaccccagcagcgagaacctgcacagaaacgaggacagcgtgctgttctag

SEQ ID NO: 10322 - DNA, 2793 bp, Artificial Sequence
  Description of Artificial Sequence: Synthetic coding sequence
atgggcctgggccccagaagcctgcccttcagcagaaagagaaagagaaagatgaccaagttccaggagatggtgaccttcaaggacgtggccgtggtgttcaccgaggaggagctgggcctgctggacagcgtgcagagaaagctgtacagagacgtgatgctggagaacttcagaaacctgctgctggtggcccaccagcccttcaagcccgacctgatcagccagctggagagagaggagaagctgctgatggtggagaccgagacccccagagacggctgcagcggcagaaagaaccagcagaagatggagagcatccaggaggtgaccgtgagctacttcagccccaaggagctgagcagcagacagacctggcagcagagcgccggcggcctgatcagatgccaggacttcctgaaggtgttccagggcaagaacagccagctgcaggagcagggcaacagcctgggccaggtgtgggccggcatccccgtgcagatcagcgaggacaagaactacatcttcacccacatcggcaacggcagcaactacatcaagagccagggctaccccagctggagagcccaccacagctggagaaagatgtacctgaaggagagccacaactaccagtgcagatgccagcagatcagcatgaagaaccacttctgcaagtgcgacagcgtgagctggctgagccaccacaacgacaagctggaggtgcacagaaaggagaactacagctgccacgactgcggcgaggacatcatgaaggtgagcctgctgaaccaggagagcatccagaccgaggagaagccctacccctgcaccggctacagaaaggccttcagcaacgacagcagcagcgaggtgcaccagcagttccacctggagggcaagccctacacctacagcagctgcggcaagggctgcaactacagcagcctgctgcacatccaccagaacatcgagagagaggacgacatcgagaacagccacctgaagagctaccagagagtgcacaccgaggagaagccctgcaagtgcggcgagtacggcgagaacttcaaccactgcagccccctgaacacctacgagctgatccacaccggcgagatgagctacagacacaacatctacgagaaggccttcagccacagcctggacctgaacagcatcttcagagtgcacaccagagacgagccccacgagtacgaggagaacgagaacgtgttcaaccagagcagctgcctgcaggtgcaccagaagatccacaccgaggagaagctgtacaccgacatcgagtacggcaagagcttcatctgcagcagcaacctggacatccagcacagagtgcacatggaggagaacagctacaacagcgaggagtgcggcaacggcttcagcctggccagccacttccaggacctgcagatcgtgcacaccaaggagcagccctacaagagatacgtgtgcagcaacagcttcagccacaacctgtacctgcagggccaccccaagatccacatcggcgagaagcccagaaaggagcacggcaacggcttcaactggagcagcaagctgaaggaccaccagagagtgcacaccggccagaagccctacaagtgcaacatctgcggcaagggcttcaaccacagaagcgtgctgaacgtgcaccagagagtgcacaccggcgagaagccctacaagtgcgaggagtgcgacaagggcttcagcagaagcagctacctgcaggcccaccagagagtgcacaccggcgagaagccctacaagtgcgaggagtgcggcaagggcttcagcagaaacagctacctgcagggccaccagagagtgcacaccggcgagaagccctacaagtgcgaggagtgcggcaagggcttcagcagaagcagccacctgcagggccaccagagagtgcacaccggcgagaagcccttcaagtgcgaggagtgcggcaagggcttcagctggagcttcaacctgcagatccaccagagagtgcacaccggcgagaagccctacaagtgcgaggagtgcggcaagggcttcagcaaggccagcaccctgctggcccaccagagagtgcacaccggcgagaagccctaccagtgcgacgagtgcggcaagagcttcagccagagaagctacctgcagagccaccagagcgtgcacagcggcgagagaccctacatctgcgaggtgtgcggcaagggcttcagccagagagcctacctgcagggccaccagagagtgcacaccagagtgaagccctacaagtgcgagatgtgcggcaagggcttcagccagagcagcagactggaggcccacagaagagtgcacaccggcggcaagccctacaagtgcgaggtgtgcaccaagggcttcagcgagagcagcagactgcaggcccaccagagagtgcacgtggagggcagaccctacaagtgcgagcagtgcggcaagggcttcagcggctacagcagcctgcaggcccaccacagagtgcacaccggcgagaagccctacaagtgcgaggtgtgcggcaagggcttcagccagagaagcaacctgcaggcccaccagagagtgcacaccggcgagaagccctacaagtgcgacgcctgcggcaagggcttcagatggagcagcggcctgctgatccaccagagagtgcacagcagcgacaagttctacaagagcgaggactacggcaaggactaccccagcagcgagaacctgcacagaaacgaggacagcgtgctgttctag

SEQ ID NO: 10323 - DNA, 1842 bp, Artificial Sequence
  Description of Artificial Sequence: Synthetic coding sequence
tgcagcagcgccttccccgagagctgccccttccagaaggaggacggcatgatcaagttccaggtgagactgagcaacctgcaggagagagtgaccttcaaggacgtggccgtggtgttcaccaaggaggagctggccctgctggacaaggcccagatcaacctgtaccaggacgtgatgctggagaacttcagaaacctgatgctggtgagagacggcatcaagaacaacatcctgaacctgcaggccaagggcctgagctacctgagccaggaggtgctgcactgctggcagatctggaagcagagaatcagagacctgaccgtgagccaggactacatcgtgaacctgcaggaggagtgcagcccccacctggaggacgtgagcctgagcgaggagtgggccggcatcagcctgcagatcagcgagaacgagaactacgtggtgaacgccatcatcaagaaccaggacatcaccgcctggcagagcctgacccaggtgctgacccccgagagctggagaaaggccaacatcatgaccgagccccagaacagccagggcagatacaagggcatctacatggaggagaagctgtacagaagagcccagcacgacgacagcctgagctggaccagctgcgaccaccacgagagccaggagtgcaagggcgaggaccccggcagacaccccaactgcggcaagaacctgggcatgaagagcaccgtggagaagagaaacgccgcccacgtgctgccccagcccttcccctgcaacaactgcggcgtggccttcgccgacgacaccgacccccacgtgcaccacagcacccacctgggcgagaagagctacaagtgcgaccagtacggcaagaacttcagccagagccaggacctgatcgtgcactgcaagacccacagcggcaagaccccctacgagttccacgagtggcccatgggctgcaagcagagcagcgacctgcccagataccagaaggtgagcagcggcgacaagccctacaagtgcaaggagtgcggcaagggcttcagaagaagcagcagcctgcacaaccaccacagagtgcacaccggcgagatgccctacaagtgcgacgagtgcggcaagggcttcggcttcagaagcctgctgtgcatccaccagggcgtgcacaccggcaagaagccctacaagtgcgaggagtgcggcaagggcttcgaccagagcagcaacctgctggtgcaccagagagtgcacaccggcgagaagccctacaagtgcagcgagtgcggcaagtgcttcagcagcagcagcgtgctgcaggtgcactggagattccacaccggcgagaagccctacagatgcggcgagtgcggcaagggcttcagccagtgcacccacctgcacatccaccagagagtgcacaccggcgagaagccctacaagtgcaacgtgtgcggcaaggacttcgcctacagcagcgtgctgcacacccaccagagagtgcacaccggcgagaagccctacaagtgcgaggtgtgcggcaagtgcttcagctacagcagctacttccacctgcaccagagagaccacatcagagagaagccctacaagtgcgacgagtgcggcaagggcttcagcagaaacagcgacctgaacgtgcacctgagagtgcacaccagagagagaccctacaagtgcaaggcctgcggcaagggcttcagcagaaacagctacctgctggcccaccagagagtgcacatcgacgagacccagtacacccactgcgagagaggcaaggacctgctgacccaccagagactgcacgagcagagagagaccctgtag

SEQ ID NO: 10324 - DNA, 426 bp, Artificial Sequence
  Description of Artificial Sequence: Synthetic coding sequence
atggagaccgacctggccgagatgcccgagaagggcgccctgagcagccaggacagcccccacttccaggagaagagcaccgaggagggcgaggtggccgccctgagactgaccgccagaagccaggagaccgtgaccttcaaggacgtggccatggacttcacccccgaggagtggggcaagctggaccccgcccagagagacgtgatgctggagaactacagaaacctggtgagcctgtggctgcccgtgagcaagcccgagagctacaacctggagaacggcaaggagcccctgaagctggagagaaaggcccccaagagcagctacagcgccgtggccgtgatcatcctgttcctgatcccctacgtgcacctggagagctggttcagagagatcaccggcagaagaatcagcagaagctag

SEQ ID NO: 10325 - DNA, 1566 bp, Artificial Sequence
  Description of Artificial Sequence: Synthetic coding sequence
atggagaccgacctggccgagatgcccgagaagggcgccctgagcagccaggacagcccccacttccaggagaagagcaccgaggagggcgaggtggccgccctgagactgaccgccagaagccaggagaccgtgaccttcaaggacgtggccatggacttcacccccgaggagtggggcaagctggaccccgcccagagagacgtgatgctggagaactacagaaacctggtgagcctgtggctgcccgtgagcaagcccgagagctacaacctggagaacggcaaggagcccctgaagctggagagaaaggcccccaagagcagctacagcgacatggagaccagaccccagagcaaggacagcaccagcgtgcaggacttcagcaaggccgagagctgcaaggtggccatcatcgacagactgaccagaaacagcgtgtacgacagcaacctggaggccgccctggagtgcgagaactggctggagaaccagcagggcaaccaggagagacacctgagagagatgttcacccacatgaacagcctgagcgaggagaccgaccacaagcacgacgtgtactggaagagcttcaaccagaagagcgtgctgatcaccgaggacagagtgcccaagggcagctacgccttccacaccctggagaagagcctgaagcagaagagcaacctgatgaagaagcagagaacctacaaggagaagaagccccacaagtgcaacgactgcggcgagctgttcacctaccacagcgtgctgatcagacaccagagagtgcacaccggcgagaagccctacacctgcaacgagtgcggcaagagcttcagccacagagccaacctgaccaagcaccagagaacccacaccagaatcctgttcgagtgcagcgagtgcaagaagaccttcaccgagagcagcagcctggccacccaccagagaatccacgtgggcgagagaccctacgagtgcaacgagtgcggcaagggcttcaacagaagcacccacctggtgcagcaccagctgatccacaccggcgtgaagccctacgagtgcaacgagtgcgacaaggccttcatccacagcagcgccctgatcaagcaccagagaacccacaccggcgagaagccctacaagtgccaggagtgcggcaaggccttcagccactgcagcagcctgaccaagcaccagagagtgcacaccggcgagaagccctacgagtgcagcgagtgcggcaagaccttcagccagagcacccacctggtgcagcaccagagaatccacaccggcgagaagccctacgagtgcaacgagtgcggcaagaccttcagcagaagcagcaacttcgccaagcaccagagaatccacatcggcaagaagccctacaagtgcagcgagtgcggcaaggccttcatccacagcagcgccctgatccagcaccagagaacccacaccggcgagaagcccttcagatgcaacgagtgcggcaagagcttcaagtgcagcagcagcctgatcagacaccagagagtgcacaccgaggagcagccctag

SEQ ID NO: 10326 - DNA, 1536 bp, Artificial Sequence
  Description of Artificial Sequence: Synthetic coding sequence
atgggcgccctgagcagccaggacagcccccacttccaggagaagagcaccgaggagggcgaggtggccgccctgagactgaccgccagaagccaggagaccgtgaccttcaaggacgtggccatggacttcacccccgaggagtggggcaagctggaccccgcccagagagacgtgatgctggagaactacagaaacctggtgagcctgtggctgcccgtgagcaagcccgagagctacaacctggagaacggcaaggagcccctgaagctggagagaaaggcccccaagagcagctacagcgacatggagaccagaccccagagcaaggacagcaccagcgtgcaggacttcagcaaggccgagagctgcaaggtggccatcatcgacagactgaccagaaacagcgtgtacgacagcaacctggaggccgccctggagtgcgagaactggctggagaaccagcagggcaaccaggagagacacctgagagagatgttcacccacatgaacagcctgagcgaggagaccgaccacaagcacgacgtgtactggaagagcttcaaccagaagagcgtgctgatcaccgaggacagagtgcccaagggcagctacgccttccacaccctggagaagagcctgaagcagaagagcaacctgatgaagaagcagagaacctacaaggagaagaagccccacaagtgcaacgactgcggcgagctgttcacctaccacagcgtgctgatcagacaccagagagtgcacaccggcgagaagccctacacctgcaacgagtgcggcaagagcttcagccacagagccaacctgaccaagcaccagagaacccacaccagaatcctgttcgagtgcagcgagtgcaagaagaccttcaccgagagcagcagcctggccacccaccagagaatccacgtgggcgagagaccctacgagtgcaacgagtgcggcaagggcttcaacagaagcacccacctggtgcagcaccagctgatccacaccggcgtgaagccctacgagtgcaacgagtgcgacaaggccttcatccacagcagcgccctgatcaagcaccagagaacccacaccggcgagaagccctacaagtgccaggagtgcggcaaggccttcagccactgcagcagcctgaccaagcaccagagagtgcacaccggcgagaagccctacgagtgcagcgagtgcggcaagaccttcagccagagcacccacctggtgcagcaccagagaatccacaccggcgagaagccctacgagtgcaacgagtgcggcaagaccttcagcagaagcagcaacttcgccaagcaccagagaatccacatcggcaagaagccctacaagtgcagcgagtgcggcaaggccttcatccacagcagcgccctgatccagcaccagagaacccacaccggcgagaagcccttcagatgcaacgagtgcggcaagagcttcaagtgcagcagcagcctgatcagacaccagagagtgcacaccgaggagcagccctag

SEQ ID NO: 10327 - DNA, 1566 bp, Artificial Sequence; identical to SEQ ID NO: 10325
  Description of Artificial Sequence: Synthetic coding sequence

SEQ ID NO: 10328 - DNA, 1566 bp, Artificial Sequence; identical to SEQ ID NO: 10325
  Description of Artificial Sequence: Synthetic coding sequence

SEQ ID NO: 10329 - DNA, 1569 bp, Artificial Sequence
  Description of Artificial Sequence: Synthetic coding sequence
atggagaccgacctggccgagatgcccgagaagggcgtgctgagcagccaggacagcccccacttccaggagaagagcaccgaggagggcgaggtggccgccctgagactgaccgccagaagccaggccgccgccgccgccgccgcccccggcagcagaagcctgagaggcgtgcacgtgcccccccccctgcaccccgcccccgccagagaggagatcaagagcacctgcagcctgaaggcctgcttcagcctgagcctgaccctgacctactacagaaccgccttcctgctgagcaccgagaacgagggcaacctgcacttccagtgccccagcgacgtggagaccagaccccagagcaaggacagcaccagcgtgcaggacttcagcaaggccgagagctgcaaggtggccatcatcgacagactgaccagaaacagcgtgtacgacagcaacctggaggccgccctggagtgcgagaactggctggagaagcagcagggcaaccaggagagacacctgagagagatgttcacccacatgaacagcctgagcgaggagaccgaccacgagcacgacgtgtactggaagagcttcaaccagaagagcgtgctgatcaccgaggacagagtgcccaagggcagctacgccttccacaccctggagaagagcctgaagcagaagagcaacctgatgaagaagcagagaacctacaaggagaagaagccccacaagtgcaacgactgcggcgagctgttcacctgccacagcgtgcacatccagcaccagagagtgcacaccggcgagaagccctacacctgcaacgagtgcggcaagagcttcagccacagagccaacctgaccaagcaccagagaacccacaccagaatcctgttcgagtgcagagagtgcaagaagaccttcaccgagagcagcagcctggccacccaccagagaatccacgtgggcgagagaccctacgagtgcaacgagtgcggcaagggcttcaacagaagcacccacctggtgcagcaccagctgatccacaccggcgtgagaccctacgagtgcaacgagtgcgacaaggccttcatccacagcagcgccctgatcaagcaccagagaacccacaccggcgagaagccctacaagtgccaggagtgcggcaaggccttcagccactgcagcagcctgaccaagcaccagagagtgcacaccggcgagaagccctacgagtgcagcgagtgcggcaagaccttcagccagagcacccacctggtgcagcaccagagaatccacaccggcgagaagccctacgagtgcagcgagtgcggcaagaccttcagccagagcagcaacttcgccaagcaccagagaatccacatcggcaagaagccctacaagtgcagcgagtgcggcaaggccttcatccacagcagcgccctgatccagcaccagagaacccacaccggcgagaagcccttcagatgcaacgagtgcggcaagagcttcaagtgcagcagcagcctgatcagacaccagagagtgcacaccgaggagcagccctag

SEQ ID NO: 10330 - DNA, 2286 bp, Artificial Sequence
  Description of Artificial Sequence: Synthetic coding sequence
atgctggccagcagcaagagaatgaacagcagcagcagaagccagatcctgctgagatggaagagcgacaaggcccagagcggcccctacaacgtggagaaggagatcctgaccagcagattcctgagagacaccgagacctgcagacagaacttcagaaacttcccctaccccgacctggccggccccagaaaggccctgagccagctgagagagctgtgcctgaagtggctgagacccgagatccacagcaaggagcagatcctggagctgctggtgctggagcagttcctgaccatcctgcccggcgaggtgagaacctgggtgaagagccagtaccccgagagcagcgaggaggccgtgaccctggtggaggacctgacccagatcctggaggaggaggccccccagaacagcaccctgagccaggacacccccgaggaggaccccagaggcaagcacgccttccagaccggctggctgaacgacctggtgaccaaggagagcatgaccttcaaggacgtggccgtggacatcacccaggaggactgggagctgatgagacccgtgcagaaggagctgtacaagaccgtgaccctgcagaactactggaacatggtgagcctgggcctgaccgtgtacagacccaccgtgatccccatcctggaggagccctggatggtgatcaaggagatcctggagggccccagccccgagtgggagaccaaggcccaggcctgcacccccgtggaggacatgagcaagctgaccaaggaggagacccacaccatcaagctggaggacagctacgactacgacgacagactggagagaagaggcaagggcggcttctggaagatccacaccgacgagagaggcttcagcctgaagagcgtgctgagccaggagtacgaccccaccgaggagtgcctgagcaagtacgacatctacagaaacaacttcgagaagcacagcaacctgatcgtgcagttcgacacccagctggacaacaagaccagcgtgtacaacgagggcagagccaccttcaaccacgtgagctacggcatcgtgcacagaaagatcctgcccggcgagaagccctacaagtgcaacgtgtgcggcaagaagttcagaaagtaccccagcctgctgaagcaccagagcacccacgccaaggagaagagctacgagtgcgaggagtgcggcaaggagttcagacacatcagcagcctgatcgcccaccagagaatgcacaccggcgagaagccctacgagtgccaccagtgcggcaaggccttcagccagagagcccacctgaccatccaccagagaatccacaccggcgagaagccctacaagtgcgacgactgcggcaaggacttcagccagagagcccacctgaccatccaccagagaacccacaccggcgagaagccctacaagtgcctggagtgcggcaagaccttcagccacagcagcagcctgatcaaccaccagagagtgcacaccggcgagaagccctacatctgcaacgagtgcggcaagaccttcagccagagcacccacctgctgcagcaccagaagatccacaccggcaagaagccctacaagtgcaacgagtgctggaaggtgttcagccagagcacctacctgatcagacaccagagaatccacagcggcgagaagtgctacaagtgcaacgagtgcggcaaggccttcgcccacagcagcaccctgatccagcaccagaccacccacaccggcgagaagagctacatctgcaacatctgcggcaaggccttcagccagagcgccaacctgacccagcaccacagaacccacaccggcgagaagccctacaagtgcagcgtgtgcggcaaggccttcagccagagcgtgcacctgacccagcaccagagaatccacaacggcgagaagcccttcaagtgcaacatctgcggcaaggcctacagacagggcgccaacctgacccagcaccagagaatccacaccggcgagaagccctacaagtgcaacgagtgcggcaaggccttcatctacagcagcagcctgaaccagcaccagagaacccacaccggcgagagaccctacaagtgcaacgagtgcgacaaggacttcagccagagaacctgcctgatccagcaccagagaatccacaccggcgagaagccctacgcctgcagaatctgcggcaagaccttcacccagagcaccaacctgatccagcaccagagagtgcacaccggcgccaagcacagaaactag

SEQ ID NO: 10331 - DNA, 2286 bp, Artificial Sequence; identical to SEQ ID NO: 10330
  Description of Artificial Sequence: Synthetic coding sequence

SEQ ID NO: 10332 - DNA, 174 bp, Artificial Sequence
  Description of Artificial Sequence: Synthetic coding sequence
atgctggccagcagcaagagaatgaacagcagcagcagaagccagatcctgctgagatggaagagcgacaaggcccagagcggcccctacaacgtggagaaggagatcctgaccagcagattcctgagagacaccgagacctgcagacagaacttcagaaacttcccctactag

SEQ ID NO: 10333 - DNA, 8157 bp, Artificial Sequence
  Description of Artificial Sequence: Synthetic coding sequence
atggccgacgaggaggccgagcaggagagactgagctgcggcgagggcggctgcgtggccgagctgcagagactgggcgagagactgcaggagctggagctgcagctgagagagagcagagtgcccgccgtggaggccgccaccgactactgccagcagctgtgccagaccctgctggagtacgccgagaagtggaagaccagcgaggaccccctgcccctgctggaggtgtacaccgtggccatccagagctacgtgaaggccagaccctacctgaccagcgagtgcgagaacgtggccctggtgctggagagactggccctgagctgcgtggagctgctgctgtgcctgcccgtggagctgagcgacaagcagtgggagcagttccagaccctggtgcaggtggcccacgagaagctgatggagaacggcagctgcgagctgcacttcctggccaccctggcccaggagaccggcgtgtggaagaaccccgtgctgtgcaccatcctgagccaggagcccctggacaaggacaaggccttcgagggccccatcctgctggacatgagaatcaagcacctgatcaagaccaaccagctgagccaggccaccgccctggccaagctgtgcagcgaccaccccgagatcggcatcaagggcagcttcaagcagacctacctggtgtgcctgtgcaccagcagccccaacggcaagctgatcgaggagatcagcgaggtggactgcaaggacgccctggagatgatctgcaacctggagagcgagggcgacgagaagagcgccctggtgctgtgcaccgccttcctgagcagacagctgcagcagggcgacatgtactgcgcctgggagctgaccctgttctggagcaagctgcagcagagagtggagcccagcatccaggtgtacctggagagatgcagacagctgagcctgctgaccaagaccgtgtaccacatcttcttcctgatcaaggtgatcaacagcgagaccgagggcgccggcctggccacctgcatcgagctgtgcgtgaaggccctgagactggagagcaccgagaacaccgaggtgaagatcagcatctgcaagaccatcagctgcctgctgcccgacgacctggaggtgaagagagcctgccagctgagcgagttcctgatcgagcccaccgtggacgcctactacgccgtggagatgctgtacaaccagcccgaccagaagtacgacgaggagaacctgcccatccccaacagcctgagatgcgagctgctgctggtgctgaagacccagtggcccttcgaccccgagttctgggactggaagaccctgaagagacagtgcctggccctgatgggcgaggaggccagcatcgtgagcagcatcgacgagctgaacgacagcgaggtgtacgagaaggtggtggactaccaggaggagagcaaggagaccagcatgaacggcctgagcggcggcgtgggcgccaacagcggcctgctgaaggacatcggcgacgagaagcagaagaagagagagatcaagcagctgagagagagaggcttcatcagcgccagattcagaaactggcaggcctacatgcagtactgcgtgctgtgcgacaaggagttcctgggccacagaatcgtgagacacgcccagaagcactacaaggacggcatctacagctgccccatctgcgccaagaacttcaacagcaaggagaccttcgtgccccacgtgaccctgcacgtgaagcagagcagcaaggagagactggccgccatgaagcccctgagaagactgggcagaccccccaagatcaccaccaccaacgagaaccagaagaccaacaccgtggccaagcaggagcagagacccatcaagaagaacagcctgtacagcaccgacttcatcgtgttcaacgacaacgacggcagcgacgacgagaacgacgacaaggacaagagctacgagcccgaggtgatccccgtgcagaagcccgtgcccgtgaacgagttcaactgccccgtgaccttctgcaagaagggcttcaagtacttcaagaacctgatcgcccacgtgaagggccacaaggacaacgaggacgccaagagattcctggagatgcagagcaagaaggtgatctgccagtactgcagaagacacttcgtgagcgtgacccacctgaacgaccacctgcagatgcactgcggcagcaagccctacatctgcatccagatgaagtgcaaggccggcttcaacagctacgccgagctgctgacccacagaaaggagcaccaggtgttcagagccaagtgcatgttccccaagtgcggcagaatcttcagcgaggcctacctgctgtacgaccacgaggcccagcactacaacacctacacctgcaagttcaccggctgcggcaaggtgtacagaagccagggcgagctggagaagcacctggacgaccacagcaccccccccgagaaggtgctgccccccgaggcccagctgaacagcagcggcgacagcatccagcccagcgaggtgaaccagaacaccgccgagaacatcgagaaggagagaagcatgctgcccagcgagaacaacatcgagaacagcctgctggccgacagaagcgacgcctgggacaagagcaaggccgagagcgccgtgaccaagcaggaccagatcagcgccagcgagctgagacaggccaacggccccctgagcaacggcctggagaaccccgccaccacccccctgctgcagagcagcgaggtggccgtgagcatcaaggtgagcctgaaccagggcatcgaggacaacttcggcaagcaggagaacagcaccgtggagggcagcggcgaggccctggtgaccgacctgcacacccccgtggaggacacctgcaacgacctgtgccaccccggcttccaggagagaaaggagcaggactgcttcaacgacgcccacgtgacccagaacagcctggtgaacagcgagaccctgaagatcggcgacctgaccccccagaacctggagagacaggtgaacaacctgatgaccttcagcgtgcagaaccaggccgccttccagaacaacctgcccaccagcaagttcgagtgcggcgacaacgtgaagaccagcagcaacctgtacaacctgcccctgaagaccctggagagcatcgccttcgtgcccccccagagcgacctgagcaacagcctgggcacccccagcgtgccccccaaggcccccgtgcagaagttcagctgccaggtggagggctgcaccagaacctacaacagcagccagagcatcggcaagcacatgaagaccgcccaccccgaccagtacgccgccttcaagatgcagagaaagagcaagaagggccagaaggccaacaacctgaacacccccaacaacggcaagttcgtgtacttcctgcccagccccgtgaacagcagcaaccccttcttcaccagccagaccaaggccaacggcaaccccgcctgcagcgcccagctgcagcacgtgagcccccccatcttccccgcccacctggccagcgtgagcacccccctgctgagcagcatggagagcgtgatcaaccccaacatcaccagccaggacaagaacgagcagggcggcatgctgtgcagccagatggagaacctgcccagcaccgccctgcccgcccagatggaggacctgaccaagaccgtgctgcccctgaacatcgacagcggcagcgaccccttcctgcccctgcccgccgagagcagcagcatgagcctgttccccagccccgccgacagcggcaccaacagcgtgttcagccagctggagaacaacaccaaccactacagcagccagatcgagggcaacaccaacagcagcttcctgaagggcggcaacggcgagaacgccgtgttccccagccaggtgaacgtggccaacaacttcagcagcaccaacgcccagcagagcgcccccgagaaggtgaagaaggacagaggcagaggccccaacggcaaggagagaaagcccaagcacaacaagagagccaagtggcccgccatcatcagagacggcaagttcatctgcagcagatgctacagagccttcaccaaccccagaagcctgggcggccacctgagcaagagaagctactgcaagcccctggacggcgccgagatcgcccaggagctgctgcagagcaacggccagcccagcctgctggccagcatgatcctgagcaccaacgccgtgaacctgcagcagccccagcagagcaccttcaaccccgaggcctgcttcaaggaccccagcttcctgcagctgctggccgagaacagaagccccgccttcctgcccaacaccttccccagaagcggcgtgaccaacttcaacaccagcgtgagccaggagggcagcgagatcatcaagcaggccctggagaccgccggcatccccagcaccttcgagggcgccgagatgctgagccacgtgagcaccggctgcgtgagcgacgccagccaggtgaacgccaccgtgatgcccaaccccaccgtgccccccctgctgcacaccgtgtgccaccccaacaccctgctgaccaaccagaacagaaccagcaacagcaagaccagcagcatcgaggagtgcagcagcctgcccgtgttccccaccaacgacctgctgctgaagaccgtggagaacggcctgtgcagcagcagcttccccaacagcggcggccccagccagaacttcaccagcaacagcagcagagtgagcgtgatcagcggcccccagaacaccagaagcagccacctgaacaagaagggcaacagcgccagcaagagaagaaagaaggtggccccccccctgatcgcccccaacgccagccagaacctggtgaccagcgacctgaccaccatgggcctgatcgccaagagcgtggagatccccaccaccaacctgcacagcaacgtgatccccacctgcgagccccagagcctggtggagaacctgacccagaagctgaacaacgtgaacaaccagctgttcatgaccgacgtgaaggagaacttcaagaccagcctggagagccacaccgtgctggcccccctgaccctgaagaccgagaacggcgacagccagatgatggccctgaacagctgcaccaccagcatcaacagcgacctgcagatcagcgaggacaacgtgatccagaacttcgagaagaccctggagatcatcaagaccgccatgaacagccagatcctggaggtgaagagcggcagccagggcgccggcgagaccagccagaacgcccagatcaactacaacatccagctgcccagcgtgaacaccgtgcagaacaacaagctgcccgacagcagccccttcagcagcttcatcagcgtgatgcccaccaagagcaacatcccccagagcgaggtgagccacaaggaggaccagatccaggagatcctggagggcctgcagaagctgaagctggagaacgacctgagcacccccgccagccagtgcgtgctgatcaacaccagcgtgaccctgacccccacccccgtgaagagcaccgccgacatcaccgtgatccagcccgtgagcgagatgatcaacatccagttcaacgacaaggtgaacaagcccttcgtgtgccagaaccagggctgcaactacagcgccatgaccaaggacgccctgttcaagcactacggcaagatccaccagtacacccccgagatgatcctggagatcaagaagaaccagctgaagttcgcccccttcaagtgcgtggtgcccacctgcaccaagaccttcaccagaaacagcaacctgagagcccactgccagctggtgcaccacttcaccaccgaggagatggtgaagctgaagatcaagagaccctacggcagaaagagccagagcgagaacgtgcccgccagcagaagcacccaggtgaagaagcagctggccatgaccgaggagaacaagaaggagagccagcccgccctggagctgagagccgagacccagaacacccacagcaacgtggccgtgatccccgagaagcagctggtggagaagaagagccccgacaagaccgagagcagcctgcaggtgatcaccgtgaccagcgagcagtgcaacaccaacgccctgaccaacacccagaccaagggcagaaagatcagaagacacaagaaggagaaggaggagaagaagagaaagaagcccgtgagccagagcctggagttccccaccagatacagcccctacagaccctacagatgcgtgcaccagggctgcttcgccgccttcaccatccagcagaacctgatcctgcactaccaggccgtgcacaagagcgacctgcccgccttcagcgccgaggtggaggaggagagcgaggccggcaaggagagcgaggagaccgagaccaagcagaccctgaaggagttcagatgccaggtgagcgactgcagcagaatcttccaggccatcaccggcctgatccagcactacatgaagctgcacgagatgacccccgaggagatcgagagcatgaccgccagcgtggacgtgggcaagttcccctgcgaccagctggagtgcaagagcagcttcaccacctacctgaactacgtggtgcacctggaggccgaccacggcatcggcctgagagccagcaagaccgaggaggacggcgtgtacaagtgcgactgcgagggctgcgacagaatctacgccaccagaagcaacctgctgagacacatcttcaacaagcacaacgacaagcacaaggcccacctgatcagacccagaagactgacccccggccaggagaacatgagcagcaaggccaaccaggagaagagcaagagcaagcacagaggcaccaagcacagcagatgcggcaaggagggcatcaagatgcccaagaccaagagaaagaagaagaacaacctggagaacaagaacgccaagatcgtgcagatcgaggagaacaagccctacagcctgaagagaggcaagcacgtgtacagcatcaaggccagaaacgacgccctgagcgagtgcaccagcagattcgtgacccagtacccctgcatgatcaagggctgcaccagcgtggtgaccagcgagagcaacatcatcagacactacaagtgccacaagctgagcaaggccttcaccagccagcacagaaacctgctgatcgtgttcaagagatgctgcaacagccaggtgaaggagaccagcgagcaggagggcgccaagaacgacgtgaaggacagcgacacctgcgtgagcgagagcaacgacaacagcagaaccaccgccaccgtgagccagaaggaggtggagaagaacgagaaggacgagatggacgagctgaccgagctgttcatcaccaagctgatcaacgaggacagcaccagcgtggagacccaggccaacaccagcagcaacgtgagcaacgacttccaggaggacaacctgtgccagagcgagagacagaaggccagcaacctgaagagagtgaacaaggagaagaacgtgagccagaacaagaagagaaaggtggagaaggccgagcccgccagcgccgccgagctgagcagcgtgagaaaggaggaggagaccgccgtggccatccagaccatcgaggagcaccccgccagcttcgactggagcagcttcaagcccatgggcttcgaggtgagcttcctgaagttcctggaggagagcgccgtgaagcagaagaagaacaccgacaaggaccaccccaacaccggcaacaagaagggcagccacagcaacagcagaaagaacatcgacaagaccgccgtgaccagcggcaaccacgtgtgcccctgcaaggagagcgagaccttcgtgcagttcgccaaccccagccagctgcagtgcagcgacaacgtgaagatcgtgctggacaagaacctgaaggactgcaccgagctggtgctgaagcagctgcaggagatgaagcccaccgtgagcctgaagaagctggaggtgcacagcaacgaccccgacatgagcgtgatgaaggacatcagcatcggcaaggccaccggcagaggccagtactag

SEQ ID NO: 10334 - DNA, 8172 bp, Artificial Sequence
  Description of Artificial Sequence: Synthetic coding sequence
atggccgacgaggaggccgagcaggagagactgagctgcggcgagggcggctgcgtggccgagctgcagagactgggcgagagactgcaggagctggagctgcagctgagagagagcagagtgcccgccgtggaggccgccaccgactactgccagcagctgtgccagaccctgctggagtacgccgagaagtggaagaccagcgaggaccccctgcccctgctggaggtgtacaccgtggccatccagagctacgtgaaggccagaccctacctgaccagcgagtgcgagaacgtggccctggtgctggagagactggccctgagctgcgtggagctgctgctgtgcctgcccgtggagctgagcgacaagcagtgggagcagttccagaccctggtgcaggtggcccacgagaagctgatggagaacggcagctgcgagctgcacttcctggccaccctggcccaggagaccggcgtgtggaagaaccccgtgctgtgcaccatcctgagccaggagcccctggacaaggacaaggtgaacgagttcctggccttcgagggccccatcctgctggacatgagaatcaagcacctgatcaagaccaaccagctgagccaggccaccgccctggccaagctgtgcagcgaccaccccgagatcggcatcaagggcagcttcaagcagacctacctggtgtgcctgtgcaccagcagccccaacggcaagctgatcgaggagatcagcgaggtggactgcaaggacgccctggagatgatctgcaacctggagagcgagggcgacgagaagagcgccctggtgctgtgcaccgccttcctgagcagacagctgcagcagggcgacatgtactgcgcctgggagctgaccctgttctggagcaagctgcagcagagagtggagcccagcatccaggtgtacctggagagatgcagacagctgagcctgctgaccaagaccgtgtaccacatcttcttcctgatcaaggtgatcaacagcgagaccgagggcgccggcctggccacctgcatcgagctgtgcgtgaaggccctgagactggagagcaccgagaacaccgaggtgaagatcagcatctgcaagaccatcagctgcctgctgcccgacgacctggaggtgaagagagcctgccagctgagcgagttcctgatcgagcccaccgtggacgcctactacgccgtggagatgctgtacaaccagcccgaccagaagtacgacgaggagaacctgcccatccccaacagcctgagatgcgagctgctgctggtgctgaagacccagtggcccttcgaccccgagttctgggactggaagaccctgaagagacagtgcctggccctgatgggcgaggaggccagcatcgtgagcagcatcgacgagctgaacgacagcgaggtgtacgagaaggtggtggactaccaggaggagagcaaggagaccagcatgaacggcctgagcggcggcgtgggcgccaacagcggcctgctgaaggacatcggcgacgagaagcagaagaagagagagatcaagcagctgagagagagaggcttcatcagcgccagattcagaaactggcaggcctacatgcagtactgcgtgctgtgcgacaaggagttcctgggccacagaatcgtgagacacgcccagaagcactacaaggacggcatctacagctgccccatctgcgccaagaacttcaacagcaaggagaccttcgtgccccacgtgaccctgcacgtgaagcagagcagcaaggagagactggccgccatgaagcccctgagaagactgggcagaccccccaagatcaccaccaccaacgagaaccagaagaccaacaccgtggccaagcaggagcagagacccatcaagaagaacagcctgtacagcaccgacttcatcgtgttcaacgacaacgacggcagcgacgacgagaacgacgacaaggacaagagctacgagcccgaggtgatccccgtgcagaagcccgtgcccgtgaacgagttcaactgccccgtgaccttctgcaagaagggcttcaagtacttcaagaacctgatcgcccacgtgaagggccacaaggacaacgaggacgccaagagattcctggagatgcagagcaagaaggtgatctgccagtactgcagaagacacttcgtgagcgtgacccacctgaacgaccacctgcagatgcactgcggcagcaagccctacatctgcatccagatgaagtgcaaggccggcttcaacagctacgccgagctgctgacccacagaaaggagcaccaggtgttcagagccaagtgcatgttccccaagtgcggcagaatcttcagcgaggcctacctgctgtacgaccacgaggcccagcactacaacacctacacctgcaagttcaccggctgcggcaaggtgtacagaagccagggcgagctggagaagcacctggacgaccacagcaccccccccgagaaggtgctgccccccgaggcccagctgaacagcagcggcgacagcatccagcccagcgaggtgaaccagaacaccgccgagaacatcgagaaggagagaagcatgctgcccagcgagaacaacatcgagaacagcctgctggccgacagaagcgacgcctgggacaagagcaaggccgagagcgccgtgaccaagcaggaccagatcagcgccagcgagctgagacaggccaacggccccctgagcaacggcctggagaaccccgccaccacccccctgctgcagagcagcgaggtggccgtgagcatcaaggtgagcctgaaccagggcatcgaggacaacttcggcaagcaggagaacagcaccgtggagggcagcggcgaggccctggtgaccgacctgcacacccccgtggaggacacctgcaacgacctgtgccaccccggcttccaggagagaaaggagcaggactgcttcaacgacgcccacgtgacccagaacagcctggtgaacagcgagaccctgaagatcggcgacctgaccccccagaacctggagagacaggtgaacaacctgatgaccttcagcgtgcagaaccaggccgccttccagaacaacctgcccaccagcaagttcgagtgcggcgacaacgtgaagaccagcagcaacctgtacaacctgcccctgaagaccctggagagcatcgccttcgtgcccccccagagcgacctgagcaacagcctgggcacccccagcgtgccccccaaggcccccgtgcagaagttcagctgccaggtggagggctgcaccagaacctacaacagcagccagagcatcggcaagcacatgaagaccgcccaccccgaccagtacgccgccttcaagatgcagagaaagagcaagaagggccagaaggccaacaacctgaacacccccaacaacggcaagttcgtgtacttcctgcccagccccgtgaacagcagcaaccccttcttcaccagccagaccaaggccaacggcaaccccgcctgcagcgcccagctgcagcacgtgagcccccccatcttccccgcccacctggccagcgtgagcacccccctgctgagcagcatggagagcgtgatcaaccccaacatcaccagccaggacaagaacgagcagggcggcatgctgtgcagccagatggagaacctgcccagcaccgccctgcccgcccagatggaggacctgaccaagaccgtgctgcccctgaacatcgacagcggcagcgaccccttcctgcccctgcccgccgagagcagcagcatgagcctgttccccagccccgccgacagcggcaccaacagcgtgttcagccagctggagaacaacaccaaccactacagcagccagatcgagggcaacaccaacagcagcttcctgaagggcggcaacggcgagaacgccgtgttccccagccaggtgaacgtggccaacaacttcagcagcaccaacgcccagcagagcgcccccgagaaggtgaagaaggacagaggcagaggccccaacggcaaggagagaaagcccaagcacaacaagagagccaagtggcccgccatcatcagagacggcaagttcatctgcagcagatgctacagagccttcaccaaccccagaagcctgggcggccacctgagcaagagaagctactgcaagcccctggacggcgccgagatcgcccaggagctgctgcagagcaacggccagcccagcctgctggccagcatgatcctgagcaccaacgccgtgaacctgcagcagccccagcagagcaccttcaaccccgaggcctgcttcaaggaccccagcttcctgcagctgctggccgagaacagaagccccgccttcctgcccaacaccttccccagaagcggcgtgaccaacttcaacaccagcgtgagccaggagggcagcgagatcatcaagcaggccctggagaccgccggcatccccagcaccttcgagggcgccgagatgctgagccacgtgagcaccggctgcgtgagcgacgccagccaggtgaacgccaccgtgatgcccaaccccaccgtgccccccctgctgcacaccgtgtgccaccccaacaccctgctgaccaaccagaacagaaccagcaacagcaagaccagcagcatcgaggagtgcagcagcctgcccgtgttccccaccaacgacctgctgctgaagaccgtggagaacggcctgtgcagcagcagcttccccaacagcggcggccccagccagaacttcaccagcaacagcagcagagtgagcgtgatcagcggcccccagaacaccagaagcagccacctgaacaagaagggcaacagcgccagcaagagaagaaagaaggtggccccccccctgatcgcccccaacgccagccagaacctggtgaccagcgacctgaccaccatgggcctgatcgccaagagcgtggagatccccaccaccaacctgcacagcaacgtgatccccacctgcgagccccagagcctggtggagaacctgacccagaagctgaacaacgtgaacaaccagctgttcatgaccgacgtgaaggagaacttcaagaccagcctggagagccacaccgtgctggcccccctgaccctgaagaccgagaacggcgacagccagatgatggccctgaacagctgcaccaccagcatcaacagcgacctgcagatcagcgaggacaacgtgatccagaacttcgagaagaccctggagatcatcaagaccgccatgaacagccagatcctggaggtgaagagcggcagccagggcgccggcgagaccagccagaacgcccagatcaactacaacatccagctgcccagcgtgaacaccgtgcagaacaacaagctgcccgacagcagccccttcagcagcttcatcagcgtgatgcccaccaagagcaacatcccccagagcgaggtgagccacaaggaggaccagatccaggagatcctggagggcctgcagaagctgaagctggagaacgacctgagcacccccgccagccagtgcgtgctgatcaacaccagcgtgaccctgacccccacccccgtgaagagcaccgccgacatcaccgtgatccagcccgtgagcgagatgatcaacatccagttcaacgacaaggtgaacaagcccttcgtgtgccagaaccagggctgcaactacagcgccatgaccaaggacgccctgttcaagcactacggcaagatccaccagtacacccccgagatgatcctggagatcaagaagaaccagctgaagttcgcccccttcaagtgcgtggtgcccacctgcaccaagaccttcaccagaaacagcaacctgagagcccactgccagctggtgcaccacttcaccaccgaggagatggtgaagctgaagatcaagagaccctacggcagaaagagccagagcgagaacgtgcccgccagcagaagcacccaggtgaagaagcagctggccatgaccgaggagaacaagaaggagagccagcccgccctggagctgagagccgagacccagaacacccacagcaacgtggccgtgatccccgagaagcagctggtggagaagaagagccccgacaagaccgagagcagcctgcaggtgatcaccgtgaccagcgagcagtgcaacaccaacgccctgaccaacacccagaccaagggcagaaagatcagaagacacaagaaggagaaggaggagaagaagagaaagaagcccgtgagccagagcctggagttccccaccagatacagcccctacagaccctacagatgcgtgcaccagggctgcttcgccgccttcaccatccagcagaacctgatcctgcactaccaggccgtgcacaagagcgacctgcccgccttcagcgccgaggtggaggaggagagcgaggccggcaaggagagcgaggagaccgagaccaagcagaccctgaaggagttcagatgccaggtgagcgactgcagcagaatcttccaggccatcaccggcctgatccagcactacatgaagctgcacgagatgacccccgaggagatcgagagcatgaccgccagcgtggacgtgggcaagttcccctgcgaccagctggagtgcaagagcagcttcaccacctacctgaactacgtggtgcacctggaggccgaccacggcatcggcctgagagccagcaagaccgaggaggacggcgtgtacaagtgcgactgcgagggctgcgacagaatctacgccaccagaagcaacctgctgagacacatcttcaacaagcacaacgacaagcacaaggcccacctgatcagacccagaagactgacccccggccaggagaacatgagcagcaaggccaaccaggagaagagcaagagcaagcacagaggcaccaagcacagcagatgcggcaaggagggcatcaagatgcccaagaccaagagaaagaagaagaacaacctggagaacaagaacgccaagatcgtgcagatcgaggagaacaagccctacagcctgaagagaggcaagcacgtgtacagcatcaaggccagaaacgacgccctgagcgagtgcaccagcagattcgtgacccagtacccctgcatgatcaagggctgcaccagcgtggtgaccagcgagagcaacatcatcagacactacaagtgccacaagctgagcaaggccttcaccagccagcacagaaacctgctgatcgtgttcaagagatgctgcaacagccaggtgaaggagaccagcgagcaggagggcgccaagaacgacgtgaaggacagcgacacctgcgtgagcgagagcaacgacaacagcagaaccaccgccaccgtgagccagaaggaggtggagaagaacgagaaggacgagatggacgagctgaccgagctgttcatcaccaagctgatcaacgaggacagcaccagcgtggagacccaggccaacaccagcagcaacgtgagcaacgacttccaggaggacaacctgtgccagagcgagagacagaaggccagcaacctgaagagagtgaacaaggagaagaacgtgagccagaacaagaagagaaaggtggagaaggccgagcccgccagcgccgccgagctgagcagcgtgagaaaggaggaggagaccgccgtggccatccagaccatcgaggagcaccccgccagcttcgactggagcagcttcaagcccatgggcttcgaggtgagcttcctgaagttcctggaggagagcgccgtgaagcagaagaagaacaccgacaaggaccaccccaacaccggcaacaagaagggcagccacagcaacagcagaaagaacatcgacaagaccgccgtgaccagcggcaaccacgtgtgcccctgcaaggagagcgagaccttcgtgcagttcgccaaccccagccagctgcagtgcagcgacaacgtgaagatcgtgctggacaagaacctgaaggactgcaccgagctggtgctgaagcagctgcaggagatgaagcccaccgtgagcctgaagaagctggaggtgcacagcaacgaccccgacatgagcgtgatgaaggacatcagcatcggcaaggccaccggcagaggccagtactag

SEQ ID NO: 10335 - DNA, 3201 bp, Artificial Sequence
  Description of Artificial Sequence: Synthetic coding sequence
atggagggcctgctgcactacatcaaccccgcccacgccatcagcctgctgagcgccctgaacgaggagagactgaagggccagctgtgcgacgtgctgctgatcgtgggcgaccagaagttcagagcccacaagaacgtgctggccgccagcagcgagtacttccagagcctgttcaccaacaaggagaacgagagccagaccgtgttccagctggacttctgcgagcccgacgccttcgacaacgtgctgaactacatctacagcagcagcctgttcgtggagaagagcagcctggccgccgtgcaggagctgggctacagcctgggcatcagcttcctgaccaacatcgtgagcaagaccccccaggcccccttccccacctgccccaacagaaagaaggtgttcgtggaggacgacgagaacagcagccagaagagaagcgtgatcgtgtgccagagcagaaacgaggcccagggcaagaccgtgagccagaaccagcccgacgtgagccacaccagcagacccagccccagcatcgccgtgaaggccaacaccaacaagccccacgtgcccaagcccatcgagcccctgcacaacctgagcctgaccgagaagagctggcccaaggacagcagcgtggtgtacgccaagagcctggagcacagcggcagcctggacgaccccaacagaatcagcctggtgaagagaaacgccgtgctgcccagcaagcccctgcaggacagagaggccatggacgacaagcccggcgtgagcggccagctgcccaagggcaaggccctggagctggccctgaagagacccagaccccccgtgctgagcgtgtgcagcagcagcgagaccccctacctgctgaaggagaccaacaagggcaacggccagggcgaggacagaaacctgctgtactacagcaagctgggcctggtgatccccagcagcggcagcggcagcggcaaccagagcatcgacagaagcggccccctggtgaagagcctgctgagaagaagcctgagcatggacagccaggtgcccgtgtacagccccagcatcgacctgaagagcagccagggcagcagcagcgtgagcagcgacgcccccggcaacgtgctgtgcgccctgagccagaagagcagcctgaaggactgcagcgagaagaccgccctggacgacagaccccaggtgctgcagccccacagactgagaagcttcagcgccagccagagcaccgacagagagggcgccagccccgtgaccgaggtgagaatcaagaccgagcccagcagccccctgagcgaccccagcgacatcatcagagtgaccgtgggcgacgccgccaccaccgccgccgccagcagcagcagcgtgaccagagacctgagcctgaagaccgaggacgaccagaaggacatgagcagactgcccgccaagagaagattccaggccgacagaagactgcccttcaagaagctgaaggtgaacgagcacggcagccccgtgagcgaggacaacttcgaggagggcagcagccccaccctgctggacgccgacttccccgacagcgacctgaacaaggacgagttcggcgagctggagggcaccagacccaacaagaagttcaagtgcaagcactgcctgaagatcttcagaagcaccgccggcctgcacagacacgtgaacatgtaccacaaccccgagaagccctacgcctgcgacatctgccacaagagattccacaccaacttcaaggtgtggacccactgccagacccagcacggcatcgtgaagaaccccagccccgccagcagcagccacgccgtgctggacgagaagttccagagaaagctgatcgacatcgtgagagagagagagatcaagaaggccctgatcatcaagctgagaagaggcaagcccggcttccagggccagagcagcagccaggcccagcaggtgatcaagagaaacctgagaagcagagccaagggcgcctacatctgcacctactgcggcaaggcctacagattcctgagccagttcaagcagcacatcaagatgcaccccggcgagaagcccctgggcgtgaacaaggtggccaagcccaaggagcacgcccccctggccagccccgtggagaacaaggaggtgtaccagtgcagactgtgcaacgccaagctgagcagcctgctggagcagggcagccacgagagactgtgcagaaacgccgccgtgtgcccctactgcagcctgagattcttcagccccgagctgaagcaggagcacgagagcaagtgcgagtacaagaagctgacctgcctggagtgcatgagaaccttcaagagcagcttcagcatctggagacaccaggtggaggtgcacaaccagaacaacatggcccccaccgagaacttcagcctgcccgtgctggaccacaacggcgacgtgaccggcagcagcagaccccagagccagcccgagcccaacaaggtgaaccacatcgtgaccaccaaggacgacaacgtgttcagcgacagcagcgagcaggtgaacttcgacagcgaggacagcagctgcctgcccgaggacctgagcctgagcaagcagctgaagatccaggtgaaggaggagcccgtggaggaggccgaggaggaggcccccgaggccagcaccgcccccaaggaggccggccccagcaaggaggccagcctgtggccctgcgagaagtgcggcaagatgttcaccgtgcacaagcagctggagagacaccaggagctgctgtgcagcgtgaagcccttcatctgccacgtgtgcaacaaggccttcagaaccaacttcagactgtggagccacttccagagccacatgagccaggccagcgaggagagcgcccacaaggagagcgaggtgtgccccgtgcccaccaacagccccagccccccccccctgcccccccccccccccctgcccaagatccagcccctggagcccgacagccccaccggcctgagcgagaaccccacccccgccaccgagaagctgttcgtgccccaggagagcgacaccctgttctaccacgccccccccctgagcgccatcaccttcaagagacagttcatgtgcaagctgtgccacagaaccttcaagaccgccttcagcctgtggagccacgagcagacccacaactag

SEQ ID NO: 10336 - DNA, 150 bp, Artificial Sequence
  Description of Artificial Sequence: Synthetic coding sequence
atggagggcctgctgcactacatcaaccccgcccacgccatcagcctgctgagcgccctgaacgaggagagactgaagggccagctgtgcgacgtgctgctgatcgtgggcgaccagaagttcagagcccacaagaacgtgctggcctag

SEQ ID NO: 10337 - DNA, 3201 bp, Artificial Sequence; identical to SEQ ID NO: 10335
  Description of Artificial Sequence: Synthetic coding sequence

SEQ ID NO: 10338 - DNA, 2598 bp, Artificial Sequence
  Description of Artificial Sequence: Synthetic coding sequence
atggagggcctgctgcactacatcaaccccgcccacgccatcagcctgctgagcgccctgaacgaggagagactgaagggccagctgtgcgacgtgctgctgatcgtgggcgaccagaagttcagagcccacaagaacgtgctggccgccagcagcgagtacttccagagcctgttcaccaacaaggagaacgagagccagaccgtgttccagctggacttctgcgagcccgacgccttcgacaacgtgctgaactacatctacagcagcagcctgttcgtggagaagagcagcctggccgccgtgcaggagctgggctacagcctgggcatcagcttcctgaccaacatcgtgagcaagaccccccaggcccccttccccacctgccccaacagaaagaaggtgttcgtggaggacgacgagaacagcagccagaagagaagcgtgatcgtgtgccagagcagaaacgaggcccagggcaagaccgtgagccagaaccagcccgacgtgagccacaccagcagacccagccccagcatcgccgtgaaggccaacaccaacaagccccacgtgcccaagcccatcgagcccctgcacaacctgagcctgaccgagaagagctggcccaaggacagcagcgtggtgtacgccaagagcctggagcacagcggcagcctggacgaccccaacagaatcagcctggtgaagagaaacgccgtgctgcccagcaagcccctgcaggacagagaggccatggacgacaagcccggcgtgagcggccagctgcccaagggcaaggccctggagctggccctgaagagacccagaccccccgtgctgagcgtgtgcagcagcagcgagaccccctacctgctgaaggagaccaacaagggcaacggccagggcgaggacagaaacctgctgtactacagcaagctgggcctggtgatccccagcagcggcagcggcagcggcaaccagagcatcgacagaagcggccccctggtgaagagcctgctgagaagaagcctgagcatggacagccaggtgcccgtgtacagccccagcatcgacctgaagagcagccagggcagcagcagcgtgagcagcgacgcccccggcaacgtgctgtgcgccctgagccagaagagcagcctgaaggactgcagcgagaagaccgccctggacgacagaccccaggtgctgcagccccacagactgagaagcttcagcgccagccagagcaccgacagagagggcgccagccccgtgaccgaggtgagaatcaagaccgagcccagcagccccctgagcgaccccagcgacatcatcagagtgaccgtgggcgacgccgccaccaccgccgccgccagcagcagcagcgtgaccagagacctgagcctgaagaccgaggacgaccagaaggacatgagcagactgcccgccaagagaagattccaggccgacagaagactgcccttcaagaagctgaaggtgaacgagcacggcagccccgtgagcgaggacaacttcgaggagggcagcagccccaccctgctggacgccgacttccccgacagcgacctgaacaaggacgagttcgagcagggcagccacgagagactgtgcagaaacgccgccgtgtgcccctactgcagcctgagattcttcagccccgagctgaagcaggagcacgagagcaagtgcgagtacaagaagctgacctgcctggagtgcatgagaaccttcaagagcagcttcagcatctggagacaccaggtggaggtgcacaaccagaacaacatggcccccaccgagaacttcagcctgcccgtgctggaccacaacggcgacgtgaccggcagcagcagaccccagagccagcccgagcccaacaaggtgaaccacatcgtgaccaccaaggacgacaacgtgttcagcgacagcagcgagcaggtgaacttcgacagcgaggacagcagctgcctgcccgaggacctgagcctgagcaagcagctgaagatccaggtgaaggaggagcccgtggaggaggccgaggaggaggcccccgaggccagcaccgcccccaaggaggccggccccagcaaggaggccagcctgtggccctgcgagaagtgcggcaagatgttcaccgtgcacaagcagctggagagacaccaggagctgctgtgcagcgtgaagcccttcatctgccacgtgtgcaacaaggccttcagaaccaacttcagactgtggagccacttccagagccacatgagccaggccagcgaggagagcgcccacaaggagagcgaggtgtgccccgtgcccaccaacagccccagccccccccccctgcccccccccccccccctgcccaagatccagcccctggagcccgacagccccaccggcctgagcgagaaccccacccccgccaccgagaagctgttcgtgccccaggagagcgacaccctgttctaccacgccccccccctgagcgccatcaccttcaagagacagttcatgtgcaagctgtgccacagaaccttcaagaccgccttcagcctgtggagccacgagcagacccacaactag

SEQ ID NO: 10339 - DNA, 3201 bp, Artificial Sequence; identical to SEQ ID NO: 10335
  Description of Artificial Sequence: Synthetic coding sequence

SEQ ID NO: 10340 - DNA, 360 bp, Artificial Sequence
  Description of Artificial Sequence: Synthetic coding sequence
atggagggcctgctgcactacatcaaccccgcccacgccatcagcctgctgagcgccctgaacgaggagagactgaagggccagctgtgcgacgtgctgctgatcgtgggcgaccagaagttcagagcccacaagaacgtgctggccgccagcagcgagtacttccagagcctgttcaccaacaaggagaacgagagccagaccgtgttccagctggacttctgcgagcccgacgccttcgacaacgtgctgaactacatctacagcagcagcctgttcgtggagaagagcagcctggccgccgtgcaggagctgggctacagcctgggcatcagcttcctgaccaacatcgtgagctag

SEQ ID NO: 10341 - DNA, 150 bp, Artificial Sequence; identical to SEQ ID NO: 10336
  Description of Artificial Sequence: Synthetic coding sequence

SEQ ID NO: 10342 - DNA, 1872 bp, Artificial Sequence
  Description of Artificial Sequence: Synthetic coding sequence
atggcccacaagtacgtgggcctgcagtaccacggcagcgtgaccttcgaggacgtggccatcgccttcagccagcaggagtgggagagcctggacagcagccagagaggcctgtacagagacgtgatgctggagaactacagaaacctggtgagcatgggccacagcagaagcaagccccacgtgatcgccctgctggagcagtggaaggagcccgaggtgaccgtgagaaaggacggcagaagatggtgcaccgacctgcagctggaggacgacaccatcggctgcaaggagatgcccaccagcgagaactgccccagcttcgccctgcaccagaagatcagcagacagaagcccagagagtgccaggagtacggcaagaccctgtgccaggacagcaagcccgtgcagcacgagagaatccacagcagcgagaagcccaacagatgcaaggagtgcggcaagaacttcagcaacggccaccagctgaccatccaccagagactgcacgtgggcgagaagccctacaagtacgagaagtgcggcaaggccttcatcagcggcagcgccttcgtgaagcacggcagaatccacaccggcgagaagcccctgaagtgcaagcagtgcggcaagaccatcagcggcagctaccagctgaccgtgcacaagagcatccacaccggcaagaagccctacgagtgcggcgagtgcggcaaggccttcctggtgtacggcaagctgaccagacaccagagcacccacaccggcgagaagcccttcggctgcgaggagtgcggcaaggccttcagcaccttcagctacctggtgcagcaccagagaatccacaccagcgagaagccctacgagtgcaaggagtgcggcaaggccttcagcaccagcagccccctggccaagcaccagagaatccacaccggcgagaagccctacgagtgcaaggagtgcggcaagagcttcaccgtgtacggccagctgaccagacaccagagcatccacaccggcgagaagcccttcgagtgcaaggagtgcggcaaggccttcagactgagcagcttcctgcacgcccaccagagaatccacgccgagatcaagccctacggctgcaaggagtgcggcagaaccttcagcagagccagctacctggtgcagcacggcagactgcacaccggcgagaagccctacgagtgcaaggagtgcggcaaggccttcagcaccggcagctacctggtgcagcaccagagaatccacaccggcgagaagccctacgagtgcaaggagtgcggcaaggccttcatcagcagacaccagctgaccgtgcaccagagagtgcacaccggcgagaagccctacgagtgcaaggagtgcggcaaggccttcagagtgcacgtgcacctgacccagcacagaaagatccacaccgacgtgaagccctacgagtgcaaggagtgcggcaagaccttcagcagagccagctacctggtgcagcacagcagaatccacaccggcaagaagccctacgagtgcaaggagtgcggcaaggccttcagcagcggcagctacctggtgcagcaccagagaatccacaccggcgagaagccctacgagtgcaacaagtgcggcaaggccttcaccgtgtacggccagctgatcggccaccagagcgtgcacaccggcgagaagcccttcgagtgcaaggagtgcggcaaggccttcagactgaacagcttcctgaccgagcaccagagagtgcacaccggcgagaagcccttcaagtgcaagaagtgcggcaagaccttcagatacagcagcgccctgaaggtgcacctgagaaagcacatgagcgtgatcccctag

SEQ ID NO: 10343 - DNA, 945 bp, Artificial Sequence
  Description of Artificial Sequence: Synthetic coding sequence
gagtgcggcaaggccttcagcaccttcagctacctggtgcagcaccagagaatccacaccagcgagaagccctacgagtgcaaggagtgcggcaaggccttcagcaccagcagccccctggccaagcaccagagaatccacaccggcgagaagccctacgagtgcaaggagtgcggcaagagcttcaccgtgtacggccagctgaccagacaccagagcatccacaccggcgagaagcccttcgagtgcaaggagtgcggcagaaccttcagcagagccagctacctggtgcagcacggcagactgcacaccggcgagaagccctacgagtgcaaggagtgcggcaaggccttcagcaccggcagctacctggtgcagcaccagagaatccacaccggcgagaagccctacgagtgcaaggagtgcggcaaggccttcatcagcagacaccagctgaccgtgcaccagagagtgcacaccggcgagaagccctacgagtgcaaggagtgcggcaaggccttcagagtgcacgtgcacctgacccagcacagaaagatccacaccgacgtgaagccctacgagtgcaaggagtgcggcaagaccttcagcagagccagctacctggtgcagcacagcagaatccacaccggcaagaagccctacgagtgcaaggagtgcggcaaggccttcagcagcggcagctacctggtgcagcaccagagaatccacaccggcgagaagccctacgagtgcaacaagtgcggcaaggccttcaccgtgtacggccagctgatcggccaccagagcgtgcacaccggcgagaagcccttcgagtgcaaggagtgcggcaaggccttcagactgaacagcttcctgaccgagcaccagagagtgcacaccggcgagaagcccttcaagtgcaagaagtgcggcaagaccttctag

SEQ ID NO: 10344 - DNA, 1629 bp, Artificial Sequence
  Description of Artificial Sequence: Synthetic coding sequence
atggagcccaaggacctgcagctggaggacgacaccatcggctgcaaggagatgcccaccagcgagaactgccccagcttcgccctgcaccagaagatcagcagacagaagcccagagagtgccaggagtacggcaagaccctgtgccaggacagcaagcccgtgcagcacgagagaatccacagcagcgagaagcccaacagatgcaaggagtgcggcaagaacttcagcaacggccaccagctgaccatccaccagagactgcacgtgggcgagaagccctacaagtacgagaagtgcggcaaggccttcatcagcggcagcgccttcgtgaagcacggcagaatccacaccggcgagaagcccctgaagtgcaagcagtgcggcaagaccatcagcggcagctaccagctgaccgtgcacaagagcatccacaccggcaagaagccctacgagtgcggcgagtgcggcaaggccttcctggtgtacggcaagctgaccagacaccagagcacccacaccggcgagaagcccttcggctgcgaggagtgcggcaaggccttcagcaccttcagctacctggtgcagcaccagagaatccacaccagcgagaagccctacgagtgcaaggagtgcggcaaggccttcagcaccagcagccccctggccaagcaccagagaatccacaccggcgagaagccctacgagtgcaaggagtgcggcaagagcttcaccgtgtacggccagctgaccagacaccagagcatccacaccggcgagaagcccttcgagtgcaaggagtgcggcaaggccttcagactgagcagcttcctgcacgcccaccagagaatccacgccgagatcaagccctacggctgcaaggagtgcggcagaaccttcagcagagccagctacctggtgcagcacggcagactgcacaccggcgagaagccctacgagtgcaaggagtgcggcaaggccttcagcaccggcagctacctggtgcagcaccagagaatccacaccggcgagaagccctacgagtgcaaggagtgcggcaaggccttcatcagcagacaccagctgaccgtgcaccagagagtgcacaccggcgagaagccctacgagtgcaaggagtgcggcaaggccttcagagtgcacgtgcacctgacccagcacagaaagatccacaccgacgtgaagccctacgagtgcaaggagtgcggcaagaccttcagcagagccagctacctggtgcagcacagcagaatccacaccggcaagaagccctacgagtgcaaggagtgcggcaaggccttcagcagcggcagctacctggtgcagcaccagagaatccacaccggcgagaagccctacgagtgcaacaagtgcggcaaggccttcaccgtgtacggccagctgatcggccaccagagcgtgcacaccggcgagaagcccttcgagtgcaaggagtgcggcaaggccttcagactgaacagcttcctgaccgagcaccagagagtgcacaccggcgagaagcccttcaagtgcaagaagtgcggcaagaccttcagatacagcagcgccctgaaggtgcacctgagaaagcacatgagcgtgatcccctag

SEQ ID NO: 10345 - DNA, 1875 bp, Artificial Sequence
  Description of Artificial Sequence: Synthetic coding sequence
atggcccacaagtacgtgggcctgcagtaccacggcagcgtgaccttcgaggacgtggccatcgccttcagccagcaggagtgggagagcctggacagcagccagagaggcctgtacagagacgtgatgctggagaactacagaaacctggtgagcatggccggccacagcagaagcaagccccacgtgatcgccctgctggagcagtggaaggagcccgaggtgaccgtgagaaaggacggcagaagatggtgcaccgacctgcagctggaggacgacaccatcggctgcaaggagatgcccaccagcgagaactgccccagcttcgccctgcaccagaagatcagcagacagaagcccagagagtgccaggagtacggcaagaccctgtgccaggacagcaagcccgtgcagcacgagagaatccacagcagcgagaagcccaacagatgcaaggagtgcggcaagaacttcagcaacggccaccagctgaccatccaccagagactgcacgtgggcgagaagccctacaagtacgagaagtgcggcaaggccttcatcagcggcagcgccttcgtgaagcacggcagaatccacaccggcgagaagcccctgaagtgcaagcagtgcggcaagaccatcagcggcagctaccagctgaccgtgcacaagagcatccacaccggcaagaagccctacgagtgcggcgagtgcggcaaggccttcctggtgtacggcaagctgaccagacaccagagcacccacaccggcgagaagcccttcggctgcgaggagtgcggcaaggccttcagcaccttcagctacctggtgcagcaccagagaatccacaccagcgagaagccctacgagtgcaaggagtgcggcaaggccttcagcaccagcagccccctggccaagcaccagagaatccacaccggcgagaagccctacgagtgcaaggagtgcggcaagagcttcaccgtgtacggccagctgaccagacaccagagcatccacaccggcgagaagcccttcgagtgcaaggagtgcggcaaggccttcagactgagcagcttcctgcacgcccaccagagaatccacgccgagatcaagccctacggctgcaaggagtgcggcagaaccttcagcagagccagctacctggtgcagcacggcagactgcacaccggcgagaagccctacgagtgcaaggagtgcggcaaggccttcagcaccggcagctacctggtgcagcaccagagaatccacaccggcgagaagccctacgagtgcaaggagtgcggcaaggccttcatcagcagacaccagctgaccgtgcaccagagagtgcacaccggcgagaagccctacgagtgcaaggagtgcggcaaggccttcagagtgcacgtgcacctgacccagcacagaaagatccacaccgacgtgaagccctacgagtgcaaggagtgcggcaagaccttcagcagagccagctacctggtgcagcacagcagaatccacaccggcaagaagccctacgagtgcaaggagtgcggcaaggccttcagcagcggcagctacctggtgcagcaccagagaatccacaccggcgagaagccctacgagtgcaacaagtgcggcaaggccttcaccgtgtacggccagctgatcggccaccagagcgtgcacaccggcgagaagcccttcgagtgcaaggagtgcggcaaggccttcagactgaacagcttcctgaccgagcaccagagagtgcacaccggcgagaagcccttcaagtgcaagaagtgcggcaagaccttcagatacagcagcgccctgaaggtgcacctgagaaagcacatgagcgtgatcccctag

SEQ ID NO: 10346 - DNA, 1872 bp, Artificial Sequence; identical to SEQ ID NO: 10342
  Description of Artificial Sequence: Synthetic coding sequence

SEQ ID NO: 10347 - DNA, 1560 bp, Artificial Sequence
  Description of Artificial Sequence: Synthetic coding sequence
atggccagagacctggtgatgttcagagacgtggccgtggacttcagccaggaggagtgggagtgcctgaacagctaccagagaaacctgtacagagacgtgatcctggagaactacagcaacctggtgagcctggccggctgcagcatcagcaagcccgacgtgatcaccctgctggagcagggcaaggagccctggatggtggtgagagacgagaagagaagatggaccctggacctggagagcagatacgacaccaagaagctgttccagggcaaggacatctacgagatgaacctgagccagtggaaggtgatggagagaatcaagagctgcggcctggaggagcaggagagcccccacgaggtgtgcttcagacaggtgaccaagaccaccagcgagaagatgcccacctacagaaagctgaccagcctgcccctgtaccagaagagccacaacagagagaagccctacgagtgcggcgagtgcggcaaggccttcagagtgagacagcagctgaccttccaccagagaatccacaccggcgagaagccctacgagtgcaaggagtgcggcaaggccttcagacagtgcgcccacctgagcagacaccagagaatccacaccagcgacaagctgtacgagtgcaagaagtgcggcaagatcttcacctgcggcagcgacctgagagtgcaccagagaatccacatcggcgagaagccctacgagtgcaaggagtgcggcaaggccttcagagtgagaggccagctgaacctgcaccagagaatccacaccggcgagaagccctacgagtgcaaggagtgcggcaaggccttcagacagtacgcccacctgaccagacaccagagactgaacatcgccgagaagtgctacgagtgcaaggagtgcggccaggccttcctgtgcagcaccggcctgagactgcaccacaagctgcacaccggcgagaagccctacgagtgcaaggagtgcggcaaggccttcagagtgagacagcagctgaccctgcaccagagaatccacaccggcgagaagccctacgactgcaaggagtgcggcaagaccttcagcagaggctaccacctgaccctgcaccagagaatccacaccggcgagaagccctacgagtgcaaggagtgccagaagttcttcagaagatacagcgagctgatcagccaccagggcatccacatcggcgagaagccctacgagtgcaaggagtgcggcaaggccttcagactgttcagccagctgacccagcaccagagcatccacttcggcgagaagcccttcaagtgcaaggagtgcgagaagaccttcagactgctgagccagctgacccagcaccagagcatccacaccggcgagaagccctacgactgcaaggagtgcggcaaggccttcagactgcacagcagcctgatccagcaccagagaatccacagcggcgagaagccctacaagtgcaaggagtgcaagaaggccttcagacagcacagccacctgacctaccaccagagaatccacaacgtgacctag

SEQ ID NO: 10348 - DNA, 1560 bp, Artificial Sequence; identical to SEQ ID NO: 10347
  Description of Artificial Sequence: Synthetic coding sequence

SEQ ID NO: 10349 - DNA, 1305 bp, Artificial Sequence
  Description of Artificial Sequence: Synthetic coding sequence
atggccagagacctggtgatgttcagagacgtggccgtggacttcagccaggaggagtgggagtgcctgaacagctaccagagaaacctgtacagagacgtgatcctggagaactacagcaacctggtgagcctgggctgcagcatcagcaagcccgacgtgatcaccctgctggagcagggcaaggagccctggatggtggtgagagacgagaagagaagatggaccctggacctggagagcagatacgacaccaagaagctgttccagggcaaggacatctacgagatgaacctgagccagtggaaggtgatggagagaatcaagagctgcggcctggaggagcaggagagcccccacgaggtgtgcttcagacaggtgaccaagaccaccagcgagaagatgcccacctacagaaagctgaccagcctgcccctgtaccagaagagccacaacagagagaagccctacgagtgcggcgagtgcggcaaggccttcagagtgagacagcagctgaccttccaccagagaatccacaccggcgagaagccctacgagtgcaaggagtgcggcaaggccttcagacagtgcgcccacctgagcagacaccagagaatccacaccagcgacaagctgtacgagtgcaagaagtgcggcaagatcttcacctgcggcagcgacctgagactgcaccacaagctgcacaccggcgagaagccctacgagtgcaaggagtgcggcaaggccttcagagtgagacagcagctgaccctgcaccagagaatccacaccggcgagaagccctacgactgcaaggagtgcggcaagaccttcagcagaggctaccacctgaccctgcaccagagaatccacaccggcgagaagccctacgagtgcaaggagtgccagaagttcttcagaagatacagcgagctgatcagccaccagggcatccacatcggcgagaagccctacgagtgcaaggagtgcggcaaggccttcagactgttcagccagctgacccagcaccagagcatccacttcggcgagaagcccttcaagtgcaaggagtgcgagaagaccttcagactgctgagccagctgacccagcaccagagcatccacaccggcgagaagccctacgactgcaaggagtgcggcaaggccttcagactgcacagcagcctgatccagcaccagagaatccacagcggcgagaagccctacaagtgcaaggagtgcaagaaggccttcagacagcacagccacctgacctaccaccagagaatccacaacgtgacctag

SEQ ID NO: 10350 - DNA, 1560 bp, Artificial Sequence; identical to SEQ ID NO: 10347
  Description of Artificial Sequence: Synthetic coding sequence

SEQ ID NO: 10351 - DNA, 2001 bp, Artificial Sequence
  Description of Artificial Sequence: Synthetic coding sequence
atgcaggaggtggtgctgctggacgagagcagcggcccccccagccagctgctgtggaccagacaggacacccagctgccccaggagagcgccctgctgcccgccccctaccccgccttcaccaaggacggcagccagggcaacctgccccaggccgacatcaccctgatgagccaggcccaggagagcgtgaccttcgaggacgtggccgtgaacttcaccaacagagagtggcagtgcctgacctacgcccagagacacctgtacaaggacgtgatgctggagaactacggcaacatggtgagcctgggcttccccttccccaagccccccctgatcagccacctggagagagaggtggacccctgcgtgcaggacccccaggacagagagagcctgagctgcagctaccccgtgagcgccgacaagatgtggcccgagaacgagaaggccagcagccagcaggagatcttcgagaacggcgaggcctactggatgaagttcaacagcctgctgaaggtggacagcagagaccccaaggtgagagaggtgtgcgtgcaggacgtgaagctggagaaccagtgggagaccagcatcagagagaagctgagagaggagaaggagggcagcgaggaggtgacctgcaagaagggcaagaaccagaaggtgctgagcaagaacctgaaccccaacagcaagcacagccagtgcaacaaggtgctgatcgcccagaagctgcacgagtgcgccagatgcggcaagaacttcagctggcacagcgacctgatcctgcacgagcagatccacagcggcgagaagccccacgtgtgcaacgagtgcggcaaggccttcaagaccagaaaccagctgagcatgcacagaatcatccacaccggcgagaagcccttcaactgcacccagtgcggcaaggccttcaacagcagaagcgccctgtgcagacacaagaagacccacagcggcgagaagccccacgagtgcagagactgcggcaaggccttcaagaccagaaacagactgtgcatgcaccagctgatccacaccggcgagaagccctacaagtgcaactgctgcggcaaggccttccagttcaagcacagcctgaccatccacggcagaatccacaccggcgagaagccctacgagtgcgaggagtgcggcaaggccttcagcggcagcagcgacctgaccaagcacatcagaatccacaccggcgagagaccctacgagtgcagcaagtgcggcagagccttcagcagaagcagcgacctgagcaagcacaagagaatccacaccagagagaagcactacggctgcccccagtgcggcaaggacttcagcatcaaggccgagctgaccaagcacagaagaatccacaccgaggagaagagatacagatgcgaggagtgcggcaaggccttcagacacaactgcaagagaagagcccacgagagagagcacaccggcgagaagccctaccagtgcagagactgcggcaagaccttccaggacaagcactgcctgaccatccaccagagaatccacaccggcgagaagccctacaagtgcctggagtgcggcaaggccttcagcggcaagagcaacctgaccaaccacagaagaatccacaccggcgagaagccccacaagtgcgaggtgtgcggcatggccttccaccacagcagcgtgctgagacagcacaagagaatccacaccggcgagaagccctacacctgcagcgagtgcggcaccagcttcagacagggcagcgccctgatcggccacaagagagtgcacaccggcgagaagccctacgagtgcgaggagtgcggcaaggccttcagagtgagcagcaacctgaccggccacaagaagagaaagcaccaggtgtggagcacccacgagctggacggcagcagaaagagcctgagccccgtgaccgtgagccagaccagcgtggtgagcatcctgaccagcgcctag

SEQ ID NO: 10352 - DNA, 2001 bp, Artificial Sequence; identical to SEQ ID NO: 10351
  Description of Artificial Sequence: Synthetic coding sequence

SEQ ID NO: 10353 - DNA, 2001 bp, Artificial Sequence; identical to SEQ ID NO: 10351
  Description of Artificial Sequence: Synthetic coding sequence

SEQ ID NO: 10354 - DNA, 2001 bp, Artificial Sequence; identical to SEQ ID NO: 10351
  Description of Artificial Sequence: Synthetic coding sequence

SEQ ID NO: 10355 - DNA, 2001 bp, Artificial Sequence; identical to SEQ ID NO: 10351
  Description of Artificial Sequence: Synthetic coding sequence

SEQ ID NO: 10356 - DNA, 2001 bp, Artificial Sequence; identical to SEQ ID NO: 10351
  Description of Artificial Sequence: Synthetic coding sequence

SEQ ID NO: 10357 - DNA, 1725 bp, Artificial Sequence
  Description of Artificial Sequence: Synthetic coding sequence
atgctggagaactacggcaacatggtgagcctgggcttccccttccccaagccccccctgatcagccacctggagagagaggtggacccctgcgtgcaggacccccaggacagagagagcctgagctgcagctaccccgtgagcgccgacaagatgtggcccgagaacgagaaggccagcagccagcaggagatcttcgagaacggcgaggcctactggatgaagttcaacagcctgctgaaggtggacagcagagaccccaaggtgagagaggtgtgcgtgcaggacgtgaagctggagaaccagtgggagaccagcatcagagagaagctgagagaggagaaggagggcagcgaggaggtgacctgcaagaagggcaagaaccagaaggtgctgagcaagaacctgaaccccaacagcaagcacagccagtgcaacaaggtgctgatcgcccagaagctgcacgagtgcgccagatgcggcaagaacttcagctggcacagcgacctgatcctgcacgagcagatccacagcggcgagaagccccacgtgtgcaacgagtgcggcaaggccttcaagaccagaaaccagctgagcatgcacagaatcatccacaccggcgagaagcccttcaactgcacccagtgcggcaaggccttcaacagcagaagcgccctgtgcagacacaagaagacccacagcggcgagaagccccacgagtgcagagactgcggcaaggccttcaagaccagaaacagactgtgcatgcaccagctgatccacaccggcgagaagccctacaagtgcaactgctgcggcaaggccttccagttcaagcacagcctgaccatccacggcagaatccacaccggcgagaagccctacgagtgcgaggagtgcggcaaggccttcagcggcagcagcgacctgaccaagcacatcagaatccacaccggcgagagaccctacgagtgcagcaagtgcggcagagccttcagcagaagcagcgacctgagcaagcacaagagaatccacaccagagagaagcactacggctgcccccagtgcggcaaggacttcagcatcaaggccgagctgaccaagcacagaagaatccacaccgaggagaagagatacagatgcgaggagtgcggcaaggccttcagacacaactgcaagagaagagcccacgagagagagcacaccggcgagaagccctaccagtgcagagactgcggcaagaccttccaggacaagcactgcctgaccatccaccagagaatccacaccggcgagaagccctacaagtgcctggagtgcggcaaggccttcagcggcaagagcaacctgaccaaccacagaagaatccacaccggcgagaagccccacaagtgcgaggtgtgcggcatggccttccaccacagcagcgtgctgagacagcacaagagaatccacaccggcgagaagccctacacctgcagcgagtgcggcaccagcttcagacagggcagcgccctgatcggccacaagagagtgcacaccggcgagaagccctacgagtgcgaggagtgcggcaaggccttcagagtgagcagcaacctgaccggccacaagaagagaaagcaccaggtgtggagcacccacgagctggacggcagcagaaagagcctgagccccgtgaccgtgagccagaccagcgtggtgagcatcctgaccagcgcctag

SEQ ID NO: 10358 - DNA, 1725 bp, Artificial Sequence; identical to SEQ ID NO: 10357
  Description of Artificial Sequence: Synthetic coding sequence

SEQ ID NO: 10359 - DNA, 1725 bp, Artificial Sequence; identical to SEQ ID NO: 10357
  Description of Artificial Sequence: Synthetic coding sequence

SEQ ID NO: 10360 - DNA, 1725 bp, Artificial Sequence; identical to SEQ ID NO: 10357
  Description of Artificial Sequence: Synthetic coding sequence

SEQ ID NO: 10361 - DNA, 1725 bp, Artificial Sequence; identical to SEQ ID NO: 10357
  Description of Artificial Sequence: Synthetic coding sequence

SEQ ID NO: 10362 - DNA, 1725 bp, Artificial Sequence; identical to SEQ ID NO: 10357
  Description of Artificial Sequence: Synthetic coding sequence

SEQ ID NO: 10363 - DNA, 1749 bp, Artificial Sequence
  Description of Artificial Sequence: Synthetic coding sequence
atgagcgagagctggcagcagcccccccagacccagccccagcagccccagcccccccagccccagcaccacgccgagcccccccccgccctggccgagcacaccctgccccccggcaccgccgagaaccccctgggctgcgccgtgtacggcatcctgctgcagcccgaccccggcctgcagcccccccagcacgcccccctgcaggccgccggcgagcccggccccaagtgcggcgtgtgcggccacgacctggcccacctgagcagcccccacgagcaccagtgcctggccggccacgacagaagcttccagtgcacccagtgcctgaagatcttccaccaggccaccgacctgctggagcaccagtgcgtgcaggccgagcagaagcccttcgtgtgcggcgtgtgcaagatgggcttcagcctgctgaccagcctggcccagcaccacagcagccacagcggcctggtgaagtgcagcatctgcgagaagacctacaagcccgccgaggccgccgagcccgccaccaccgccgcccccagcctgcccgccgcccccgcccccagcaccgtgacccccgccgagcaggccgacaagccctacagctgccccatctgccagaagcccttcaagcacctgagcgagctgagcagacacgagagaatccacaccggcgagaagccctacaagtgcaccctgtgcgacaagagcttcagccagagcagccacctggtgcaccacaagagaacccacagcagcgagagaccctacaagtgcgccgtgtgcgagaagaccttcaagcacagaagccacctggtgagacacatgtacgcccacagcggcgagcaccacctgttcagatgcaacgtgtgcgagctgcacttcaaggagagcagcgagctgctgcagcacccctgcacccccagcggcgagagacccttcagatgcggcgagtgccagaaggccttcaagagacccagcgacctgagacagcacgagagaacccacagcgccgagagacccttcaagtgcgacctgtgccccatgggcttcaagcagcagtacgccctgatgagacacagaagaacccacaagaccgaggagcccttcaagtgcggcctgtgcgagaagggcttcggccagcccagccacctgctgtaccaccagcacgtgcacaccctggagaccctgttcaagtgccccgtgtgccagaagggcttcgaccagagcgccgagctgctgagacacaagtgcctgcccggcgccgccgagagacccttcaagtgccccgtgtgcaacaaggcctacaagagagccagcgccctgcagaagcaccagctggcccactgcgccgccgccgagaagcccctgagatgcaccctgtgcgagagaagattcttcagcagcagcgagttcgtgcagcacagatgcgaccccgccagagagaagcccctgaagtgccccgactgcgagaagagattcaagtacgccagcgacctgcagagacacagaagagtgcacaccggcgagaagccctacaagtgccccaactgcgacaaggccttcaagcagagagagcacctgaacaagcaccagggcgtgcacgccagagagcagcagttcaagtgcgtgtggtgcggcgagagattcctggacgtggccctgctgcaggagcacagcgcccagcacagcgccgccgccgccgccgccgagggcgcctaccaggtggccgcctgcctgccctag

SEQ ID NO: 10364 - DNA, 1209 bp, Artificial Sequence
  Description of Artificial Sequence: Synthetic coding sequence
atgtacaccagcgaggagaagtgcaaccagagaacccagaagagaaagatctacaacgtgtgccccagaaagggcaagaagatcttcatccacatgcacgagatcatccagatcgacggccacatctaccagtgcctggagtgcaagcagaacctgtgcgagaacctggccctgatcatgtgcgagagaacccacaccggcgagaagccctacaagtgcgacatgtgcgagaagaccttcgtgcagagcagcgacctgaccagccaccagagaatccacaactacgagaagccctacaagtgcagcaagtgcgagaagagcttctggcaccacctggtgctgagcggccaccagagaacccacgccggcaagaagttctacacctgcgacatctgcggcaagaacttcggccagagcagcgacctgctggtgcaccagagaagccacaccggcgagaagccctacctgtgcagcgagtgcgacaagtgcttcagcagaagcaccaacctgatcagacacagaagaacccacaccggcgagaagcccttcaagtgcctggagtgcgagaaggccttcagcggcaagagcgacctgatcagccaccagagaacccacaccggcgagagaccctacaagtgcaacaagtgcgagaagagctacagacacagaagcgccttcatcgtgcacaagagagtgcacaccggcgagaagccctacaagtgcggcgcctgcgagaagtgcttcggccagaagagcgacctgatcgtgcaccagagagtgcacaccggcgagaagccctacaagtgcctggagtgcatgagaagcttcaccagaagcgccaacctgatcagacaccaggccacccacacccacaccttcaagtgcctggagtacgagaagagcttcaactgcagcagcgacctgatcgtgcaccagagaatccacatggaggagaagccccaccagtggagcgcctgcgagagcggcttcctgctgggcatggacttcgtggcccagcagaagatgagaacccagaccgaggagctgcactacaagtacaccgtgtgcgacaagagcttccaccagagcagcgccctgctgcagcaccagaccgtgagaatcggcgagaagcccttcgtgtgcaacgtgagcgagaagggcctggagctgagccccccccacgccagcgaggccagccagatgagctag

SEQ ID NO: 10365 - DNA, 1662 bp, Artificial Sequence
  Description of Artificial Sequence: Synthetic coding sequence
atggccttcgaggacgtggccgtgtacttcagccaggaggagtggggcctgctggacaccgcccagagagccctgtacagaagagtgatgctggacaacttcgccctggtggccagcctgggcctgagcaccagcagacccagagtggtgatccagctggagagaggcgaggagccctgggtgcccagcggcaccgacaccaccctgagcagaaccacctacagaagaagaaaccccggcagctggagcctgaccgaggacagagacgtgagcggcgagtggcccagagccttccccgacaccccccccggcatgaccaccagcgtgttccccgtggccggcgcctgccacagcgtgaagagcctgcagagacagagaggcgccagccccagcagagagagaaagcccaccggcgtgagcgtgatctactgggagagactgctgctgggcagcggcagcggccaggccagcgtgagcctgagactgaccagccccctgagaccccccgagggcgtgagactgagagagaagaccctgaccgagcacgccctgctgggcagacagcccagaacccccgagagacagaagccctgcgcccaggaggtgcccggcagaaccttcggcagcgcccaggacctggaggccgccggcggcagaggccaccacagaatgggcgccgtgtggcaggagccccacagactgctgggcggccaggagcccagcacctgggacgagctgggcgaggccctgcacgccggcgagaagagcttcgagtgcagagcctgcagcaaggtgttcgtgaagagcagcgacctgctgaagcacctgagaacccacaccggcgagagaccctacgagtgcgcccagtgcggcaaggccttcagccagaccagccacctgacccagcaccagagaatccacagcggcgagaccccctacgcctgccccgtgtgcggcaaggccttcagacacagcagcagcctggtgagacaccagagaatccacaccgccgagaagagcttcagatgcagcgagtgcggcaaggccttcagccacggcagcaacctgagccagcacagaaagatccacgccggcggcagaccctacgcctgcgcccagtgcggcagaagattctgcagaaacagccacctgatccagcacgagagaacccacaccggcgagaagcccttcgtgtgcgccctgtgcggcgccgccttcagccagggcagcagcctgttcaagcaccagagagtgcacaccggcgagaagcccttcgcctgcccccagtgcggcagagccttcagccacagcagcaacctgacccagcaccagctgctgcacaccggcgagagacccttcagatgcgtggactgcggcaaggccttcgccaagggcgccgtgctgctgagccacagaagaatccacaccggcgagaagcccttcgtgtgcacccagtgcggcagagccttcagagagagacccgccctgttccaccaccagagaatccacaccggcgagaagaccgtgagaagaagcagagccagcctgcacccccaggccagaagcgtggccggcgccagcagcgagggcgcccccgccaaggagaccgagcccacccccgccagcggccccgccgccgtgagccagcccgccgaggtgtag

SEQ ID NO: 10366 - DNA, 861 bp, Artificial Sequence
  Description of Artificial Sequence: Synthetic coding sequence
atggccttcgaggacgtggccgtgtacttcagccaggaggagtggggcctgctggacaccgcccagagagccctgtacagaagagtgatgctggacaacttcgccctggtggccagcctgggcctgagcaccagcagacccagagtggtgatccagctggagagaggcgaggagccctgggtgcccagcggcaccgacaccaccctgagcagaaccacctacagaagaagaaaccccggcagctggagcctgaccgaggacagagacgtgagcggcgagtggcccagagccttccccgacaccccccccggcatgaccaccagcgtgttccccgtggccggcgcctgccacagcgtgaagagcctgcagagacagagaggcgccagccccagcagagagagaaagcccaccggcgtgagcgtgatctactgggagagactgctgctgggcagcggcagcggccaggccagcgtgagcctgagactgaccagccccctgagaccccccgagggcgtgagactgagagagaagaccctgaccgagcacgccctgctgggcagacagcccagaacccccgagagacagaagccctgcgcccaggaggtgcccggcagaaccttcggcagcgcccaggacctggaggccgccggcggcagaggccaccacagaatgggcgccgtgtggcaggagccccacagactgctgggcggccaggagcccagcacctgggacgagctgggcgaggccctgcacgccggcgagaagagcttcgagtgcagagcctgcagcaaggtgttcgtgaagagcagcgacctgctgaagcacctgagaaccagagtgagacagggcctgcccgcctag

SEQ ID NO: 10367 - DNA, 993 bp, Artificial Sequence
  Description of Artificial Sequence: Synthetic coding sequence
atgggcgccgtgtggcaggagccccacagactgctgggcggccaggagcccagcacctgggacgagctgggcgaggccctgcacgccggcgagaagagcttcgagtgcagagcctgcagcaaggtgttcgtgaagagcagcgacctgctgaagcacctgagaacccacaccggcgagagaccctacgagtgcgcccagtgcggcaaggccttcagccagaccagccacctgacccagcaccagagaatccacagcggcgagaccccctacgcctgccccgtgtgcggcaaggccttcagacacagcagcagcctggtgagacaccagagaatccacaccgccgagaagagcttcagatgcagcgagtgcggcaaggccttcagccacggcagcaacctgagccagcacagaaagatccacgccggcggcagaccctacgcctgcgcccagtgcggcagaagattctgcagaaacagccacctgatccagcacgagagaacccacaccggcgagaagcccttcgtgtgcgccctgtgcggcgccgccttcagccagggcagcagcctgttcaagcaccagagagtgcacaccggcgagaagcccttcgcctgcccccagtgcggcagagccttcagccacagcagcaacctgacccagcaccagctgctgcacaccggcgagagacccttcagatgcgtggactgcggcaaggccttcgccaagggcgccgtgctgctgagccacagaagaatccacaccggcgagaagcccttcgtgtgcacccagtgcggcagagccttcagagagagacccgccctgttccaccaccagagaatccacaccggcgagaagaccgtgagaagaagcagagccagcctgcacccccaggccagaagcgtggccggcgccagcagcgagggcgcccccgccaaggagaccgagcccacccccgccagcggccccgccgccgtgagccagcccgccgaggtgtag

SEQ ID NO: 10368 - DNA, 1662 bp, Artificial Sequence; identical to SEQ ID NO: 10365
  Description of Artificial Sequence: Synthetic coding sequence

SEQ ID NO: 10369 - DNA, 1605 bp, Artificial Sequence
  Description of Artificial Sequence: Synthetic coding sequence
atgggcgtgcccagcgtggtgagcgccatccccatcagagccgactgcagcagcaagccccagcccctgctgcagggccagccccacctgtacttcagccccaagctgctgtgccagctgagaggcagcttcctgcccgtgcacagcgcctgccccggccccctgctgaccagaatgccccaggccaccaccgtgagcctgcccctgggcagctggagcctgaccgaggacagagacgtgagcggcgagtggcccagagccttccccgacaccccccccggcatgaccaccagcgtgttccccgtggccggcgcctgccacagcgtgaagagcctgcagagacagagaggcgccagccccagcagagagagaaagcccaccggcgtgagcgtgatctactgggagagactgctgctgggcagcggcagcggccaggccagcgtgagcctgagactgaccagccccctgagaccccccgagggcgtgagactgagagagaagaccctgaccgagcacgccctgctgggcagacagcccagaacccccgagagacagaagccctgcgcccaggaggtgcccggcagaaccttcggcagcgcccaggacctggaggccgccggcggcagaggccaccacagaatgggcgccgtgtggcaggagccccacagactgctgggcggccaggagcccagcacctgggacgagctgggcgaggccctgcacgccggcgagaagagcttcgagtgcagagcctgcagcaaggtgttcgtgaagagcagcgacctgctgaagcacctgagaacccacaccggcgagagaccctacgagtgcgcccagtgcggcaaggccttcagccagaccagccacctgacccagcaccagagaatccacagcggcgagaccccctacgcctgccccgtgtgcggcaaggccttcagacacagcagcagcctggtgagacaccagagaatccacaccgccgagaagagcttcagatgcagcgagtgcggcaaggccttcagccacggcagcaacctgagccagcacagaaagatccacgccggcggcagaccctacgcctgcgcccagtgcggcagaagattctgcagaaacagccacctgatccagcacgagagaacccacaccggcgagaagcccttcgtgtgcgccctgtgcggcgccgccttcagccagggcagcagcctgttcaagcaccagagagtgcacaccggcgagaagcccttcgcctgcccccagtgcggcagagccttcagccacagcagcaacctgacccagcaccagctgctgcacaccggcgagagacccttcagatgcgtggactgcggcaaggccttcgccaagggcgccgtgctgctgagccacagaagaatccacaccggcgagaagcccttcgtgtgcacccagtgcggcagagccttcagagagagacccgccctgttccaccaccagagaatccacaccggcgagaagaccggcgaccccggccccgcctgcacccccagacccggcctgctgcccggccaccaccagaaggtgagacagagaagaaagcccagccccctgccccccagagcccagccctag

SEQ ID NO: 10370 - DNA, 1635 bp, Artificial Sequence
  Description of Artificial Sequence: Synthetic coding sequence
atgaccttcgaggacgtggccgtgtacttcagccaggaggagtggggcctgctggacaccgcccagagagccctgtacagacacgtgatgctggagaacttcaccctggtgaccagcctgggcctgagcaccagcagacccagagtggtgatccagctggagagaggcgaggagccctgggtgcccagcggcaaggacatgaccctggccagaaacacctacggcagactgaacagcggcagctggagcctgaccgaggacagagacgtgagcggcgagtggcccagagccttccccgacaccccccccggcatgaccaccagcgtgttccccgtggccgacgcctgccacagcgtgaagagcctgcagagacagcccggcgccagccccagccaggagagaaagcccaccggcgtgagcgtgatctactgggagagactgctgctgggcagcagaagcgaccaggccagcatcagcctgagactgaccagccccctgagaccccccaagagcagcagacccagagagaagaccttcaccgagtacagagtgcccggcagacagcccagaacccccgagagacagaagccctgcgcccaggaggtgcccggcagagccttcggcaacgccagcgacctgaaggccgccagcggcggcagagacagaagaatgggcgccgcctggcaggagccccacagactgctgggcggccaggagcccagcacctgggacgagctgggcgaggccctgcacgccggcgagaagagcttcgagtgcagagcctgcagcaaggtgttcgtgaagagcagcgacctgctgaagcacctgagaacccacaccggcgagagaccctacgagtgcacccagtgcggcaaggccttcagccagaccagccacctgacccagcaccagagaatccacagcggcgagaccccctacgcctgccccgtgtgcggcaaggccttcagacacagcagcagcctggtgagacaccagagaatccacaccgccgagaagagcttcagatgcagcgagtgcggcaaggccttcagccacggcagcaacctgagccagcacagaaagatccacgccggcggcagaccctacgcctgcgcccagtgcggcagaagattctgcagaaacagccacctgatccagcacgagagaacccacaccggcgagaagcccttcgtgtgcgccctgtgcggcgccgccttcagccagggcagcagcctgttcctgcaccagagagtgcacaccggcgagaagcccttcgcctgcgcccagtgcggcagaagcttcagcagaagcagcaacctgacccagcaccagctgctgcacaccggcgagagacccttcagatgcgtggactgcggcaagggcttcgccaagggcgccgtgctgctgagccacagaagaatccacaccggcgagaagcccttcgtgtgcacccagtgcggcagagccttcagagagagacccgccctgctgcaccaccagagaatccacaccaccgagaagaccaacgccgccgcccccgactgcacccccggccccggcttcctgcagggccaccacagaaaggtgagaagaggcggcaagcccagccccgtgctgaagcccgccaaggtgtag

SEQ ID NO: 10371 - DNA, 1605 bp, Artificial Sequence
  Description of Artificial Sequence: Synthetic coding sequence
atgggcgtgcccaccgccgtgagcgccacccccgtgagagccgacgccagcagcaagccccagcccctgctgcagagccagccccacctgttcttcttccccaagctgctgagcagactgctgggcagccccctgcccgtgcacagcgcctgccccggccccctgctgaccagaatgccccaggccaccaccgtgagcctgagactgggcagctggagcctgaccgaggacagagacgtgagcggcgagtggcccagagccttccccgacaccccccccggcatgaccaccagcgtgttccccgtggccgacgcctgccacagcgtgaagagcctgcagagacagcccggcgccagccccagccaggagagaaagcccaccggcgtgagcgtgatctactgggagagactgctgctgggcagcagaagcgaccaggccagcatcagcctgagactgaccagccccctgagaccccccaagagcagcagacccagagagaagaccttcaccgagtacagagtgcccggcagacagcccagaacccccgagagacagaagccctgcgcccaggaggtgcccggcagagccttcggcaacgccagcgacctgaaggccgccagcggcggcagagacagaagaatgggcgccgcctggcaggagccccacagactgctgggcggccaggagcccagcacctgggacgagctgggcgaggccctgcacgccggcgagaagagcttcgagtgcagagcctgcagcaaggtgttcgtgaagagcagcgacctgctgaagcacctgagaacccacaccggcgagagaccctacgagtgcacccagtgcggcaaggccttcagccagaccagccacctgacccagcaccagagaatccacagcggcgagaccccctacgcctgccccgtgtgcggcaaggccttcagacacagcagcagcctggtgagacaccagagaatccacaccgccgagaagagcttcagatgcagcgagtgcggcaaggccttcagccacggcagcaacctgagccagcacagaaagatccacgccggcggcagaccctacgcctgcgcccagtgcggcagaagattctgcagaaacagccacctgatccagcacgagagaacccacaccggcgagaagcccttcgtgtgcgccctgtgcggcgccgccttcagccagggcagcagcctgttcctgcaccagagagtgcacaccggcgagaagcccttcgcctgcgcccagtgcggcagaagcttcagcagaagcagcaacctgacccagcaccagctgctgcacaccggcgagagacccttcagatgcgtggactgcggcaagggcttcgccaagggcgccgtgctgctgagccacagaagaatccacaccggcgagaagcccttcgtgtgcacccagtgcggcagagccttcagagagagacccgccctgctgcaccaccagagaatccacaccaccgagaagaccaacgccgccgcccccgactgcacccccggccccggcttcctgcagggccaccacagaaaggtgagaagaggcggcaagcccagccccgtgctgaagcccgccaaggtgtag

SEQ ID NO: 10372 - DNA, 1635 bp, Artificial Sequence; identical to SEQ ID NO: 10370
  Description of Artificial Sequence: Synthetic coding sequence

SEQ ID NO: 10373 - DNA, 1749 bp, Artificial Sequence
  Description of Artificial Sequence: Synthetic coding sequence
atggacttcgaggacgactacacccacagcgcctgcagaaacacctaccagggcttcaacggcatggacagagactacggccccggcagctacggcggcatggacagagactacggccacggcagctacggcggccagagaagcatggacagctacctgaaccagagctacggcatggacaaccacagcggcggcggcggcggcagcagattcggcccctacgagagctacgacagcagaagcagcctgggcggcagagacctgtacagaagcggctacggcttcaacgagcccgagcagagcagattcggcggcagctacggcggcagattcgagagcagctacagaaacagcctggacagcttcggcggcagaaaccagggcggcagcagctgggaggccccctacagcagaagcaagctgagacccggcttcatggaggacagaggcagagagaactacagcagctacagcagcttcagcagcccccacatgaagcccgcccccgtgggcagcagaggcagaggcacccccgcctaccccgagagcaccttcggcagcagaaactacgacgccttcggcggccccagcaccggcagaggcagaggcagaggccacatgggcgacttcggcagcatccacagacccggcatcgtggtggactaccagaacaagagcaccaacgtgaccgtggccgccgccagaggcatcaagagaaagatgatgcagcccttcaacaagcccagcggcaccttcatcaagaagcccaagctggccaagcccatggagaagatcagcctgagcaagagccccaccaagaccgaccccaagaacgaggaggaggagaagagaagaatcgaggccagaagagagaagcagagaagaagaagagagaagaacagcgagaagtacggcgacggctacagaatggccttcacctgcagcttctgcaagttcagaaccttcgaggagaaggacatcgagctgcacctggagagcagcagccaccaggagaccctggaccacatccagaagcagaccaagttcgacaaggtggtgatggagttcctgcacgagtgcatggtgaacaagttcaagaagaccagcatcagaaagcagcagaccaacaaccagaccgaggtggtgaagatcatcgagaaggacgtgatggagggcgtgaccgtggacgaccacatgatgaaggtggagaccgtgcactgcagcgcctgcagcgtgtacatccccgccctgcacagcagcgtgcagcagcacctgaagagccccgaccacatcaagggcaagcaggcctacaaggagcagatcaagagagagagcgtgctgaccgccaccagcatcctgaacaaccccatcgtgaaggccagatacgagagattcgtgaagggcgagaaccccttcgagatccaggaccacagccaggaccagcagatcgagggcgacgaggaggacgaggagaagatcgacgagcccatcgaggaggaggaggacgaggacgaggaggaggaggccgaggaggtgggcgaggtggaggaggtggaggaggtggaggaggtgagagagggcggcatcgagggcgagggcaacatccagggcgtgggcgagggcggcgaggtgggcgtggtgggcgaggtggagggcgtgggcgaggtggaggaggtggaggagctggaggaggagaccgccaaggaggagcccgccgacttccccgtggagcagcccgaggagaactag

SEQ ID NO: 10374 - DNA, 213 bp, Artificial Sequence
  Description of Artificial Sequence: Synthetic coding sequence
atggacttcgaggacgactacacccacagcgcctgcagaaacacctaccagggcttcaacggcatggacagagactacggccccggcagctacggcggcatggacagagactacggccacggcagctacggcggccagagaagcatggacagctacctgaaccagagctacggcatggacaaccacagcggcggcggcggcggcagcagatag

SEQ ID NO: 10375 - DNA, 1482 bp, Artificial Sequence
  Description of Artificial Sequence: Synthetic coding sequence
atggacttcgaggacgactacacccacagcgcctgcagaaacacctaccagggcttcaacggcatggacagagactacggccccggcagctacggcggcatggacagagactacggccacggcagctacggcggccagagaagcatggacagctacctgaaccagagctacggcatggacaaccacagcggcggcggcggcggcagcagcttcagcagcccccacatgaagcccgcccccgtgggcagcagaggcagaggcacccccgcctaccccgagagcaccttcggcagcagaaactacgacgccttcggcggccccagcaccggcagaggcagaggcagaggccacatgggcgacttcggcagcatccacagacccggcatcgtggtggactaccagaacaagagcaccaacgtgaccgtggccgccgccagaggcatcaagagaaagatgatgcagcccttcaacaagcccagcggcaccttcatcaagaagcccaagctggccaagcccatggagaagatcagcctgagcaagagccccaccaagaccgaccccaagaacgaggaggaggagaagagaagaatcgaggccagaagagagaagcagagaagaagaagagagaagaacagcgagaagtacggcgacggctacagaatggccttcacctgcagcttctgcaagttcagaaccttcgaggagaaggacatcgagctgcacctggagagcagcagccaccaggagaccctggaccacatccagaagcagaccaagttcgacaaggtggtgatggagttcctgcacgagtgcatggtgaacaagttcaagaagaccagcatcagaaagcagcagaccaacaaccagaccgaggtggtgaagatcatcgagaaggacgtgatggagggcgtgaccgtggacgaccacatgatgaaggtggagaccgtgcactgcagcgcctgcagcgtgtacatccccgccctgcacagcagcgtgcagcagcacctgaagagccccgaccacatcaagggcaagcaggcctacaaggagcagatcaagagagagagcgtgctgaccgccaccagcatcctgaacaaccccatcgtgaaggccagatacgagagattcgtgaagggcgagaaccccttcgagatccaggaccacagccaggaccagcagatcgagggcgacgaggaggacgaggagaagatcgacgagcccatcgaggaggaggaggacgaggacgaggaggaggaggccgaggaggtgggcgaggtggaggaggtggaggaggtggaggaggtgagagagggcggcatcgagggcgagggcaacatccagggcgtgggcgagggcggcgaggtgggcgtggtgggcgaggtggagggcgtgggcgaggtggaggaggtggaggagctggaggaggagaccgccaaggaggagcccgccgacttccccgtggagcagcccgaggagaactag

SEQ ID NO: 10376 - DNA, 1749 bp, Artificial Sequence
  Description of Artificial Sequence: Synthetic coding sequence
atgatgttcaacagagactacacccacagcgcctgcagaaacacctaccagggcttcaacggcatggacagagactacggccccggcagctacggcggcatggacagagactacggccacggcagctacggcggccagagaagcatggacagctacctgaaccagagctacggcatggacaaccacagcggcggcggcggcggcagcagattcggcccctacgagagctacgacagcagaagcagcctgggcggcagagacctgtacagaagcggctacggcttcaacgagcccgagcagagcagattcggcggcagctacggcggcagattcgagagcagctacagaaacagcctggacagcttcggcggcagaaaccagggcggcagcagctgggaggccccctacagcagaagcaagctgagacccggcttcatggaggacagaggcagagagaactacagcagctacagcagcttcagcagcccccacatgaagcccgcccccgtgggcagcagaggcagaggcacccccgcctaccccgagagcaccttcggcagcagaaactacgacgccttcggcggccccagcaccggcagaggcagaggcagaggccacatgggcgacttcggcagcatccacagacccggcatcgtggtggactaccagaacaagagcaccaacgtgaccgtggccgccgccagaggcatcaagagaaagatgatgcagcccttcaacaagcccagcggcaccttcatcaagaagcccaagctggccaagcccatggagaagatcagcctgagcaagagccccaccaagaccgaccccaagaacgaggaggaggagaagagaagaatcgaggccagaagagagaagcagagaagaagaagagagaagaacagcgagaagtacggcgacggctacagaatggccttcacctgcagcttctgcaagttcagaaccttcgaggagaaggacatcgagctgcacctggagagcagcagccaccaggagaccctggaccacatccagaagcagaccaagttcgacaaggtggtgatggagttcctgcacgagtgcatggtgaacaagttcaagaagaccagcatcagaaagcagcagaccaacaaccagaccgaggtggtgaagatcatcgagaaggacgtgatggagggcgtgaccgtggacgaccacatgatgaaggtggagaccgtgcactgcagcgcctgcagcgtgtacatccccgccctgcacagcagcgtgcagcagcacctgaagagccccgaccacatcaagggcaagcaggcctacaaggagcagatcaagagagagagcgtgctgaccgccaccagcatcctgaacaaccccatcgtgaaggccagatacgagagattcgtgaagggcgagaaccccttcgagatccaggaccacagccaggaccagcagatcgagggcgacgaggaggacgaggagaagatcgacgagcccatcgaggaggaggaggacgaggacgaggaggaggaggccgaggaggtgggcgaggtggaggaggtggaggaggtggaggaggtgagagagggcggcatcgagggcgagggcaacatccagggcgtgggcgagggcggcgaggtgggcgtggtgggcgaggtggagggcgtgggcgaggtggaggaggtggaggagctggaggaggagaccgccaaggaggagcccgccgacttccccgtggagcagcccgaggagaactag

SEQ ID NO: 10377 - DNA, 1131 bp, Artificial Sequence
  Description of Artificial Sequence: Synthetic coding sequence
atgggcgacttcggcagcatccacagacccggcatcgtggtggactaccagaacaagagcaccaacgtgaccgtggccgccgccagaggcatcaagagaaagatgatgcagcccttcaacaagcccagcggcaccttcatcaagaagcccaagctggccaagcccatggagaagatcagcctgagcaagagccccaccaagaccgaccccaagaacgaggaggaggagaagagaagaatcgaggccagaagagagaagcagagaagaagaagagagaagaacagcgagaagtacggcgacggctacagaatggccttcacctgcagcttctgcaagttcagaaccttcgaggagaaggacatcgagctgcacctggagagcagcagccaccaggagaccctggaccacatccagaagcagaccaagttcgacaaggtggtgatggagttcctgcacgagtgcatggtgaacaagttcaagaagaccagcatcagaaagcagcagaccaacaaccagaccgaggtggtgaagatcatcgagaaggacgtgatggagggcgtgaccgtggacgaccacatgatgaaggtggagaccgtgcactgcagcgcctgcagcgtgtacatccccgccctgcacagcagcgtgcagcagcacctgaagagccccgaccacatcaagggcaagcaggcctacaaggagcagatcaagagagagagcgtgctgaccgccaccagcatcctgaacaaccccatcgtgaaggccagatacgagagattcgtgaagggcgagaaccccttcgagatccaggaccacagccaggaccagcagatcgagggcgacgaggaggacgaggagaagatcgacgagcccatcgaggaggaggaggacgaggacgaggaggaggaggccgaggaggtgggcgaggtggaggaggtggaggaggtggaggaggtgagagagggcggcatcgagggcgagggcaacatccagggcgtgggcgagggcggcgaggtgggcgtggtgggcgaggtggagggcgtgggcgaggtggaggaggtggaggagctggaggaggagaccgccaaggaggagcccgccgacttccccgtggagcagcccgaggagaactag

SEQ ID NO: 10378 - DNA, 1626 bp, Artificial Sequence
  Description of Artificial Sequence: Synthetic coding sequence
atgagactgaagatgaccaccagaaacttccccgagagagaggtgccctgcgacgtggaggtggagagattcaccagagaggtgccctgcctgagcagcctgggcgacggctgggactgcgagaaccaggagggccacctgagacagagcgccctgaccctggagaagcccggcacccaggaggccatctgcgagtaccccggcttcggcgagcacctgatcgccagcagcgacctgccccccagccagagagtgctggccaccaacggcttccacgcccccgacagcaacgtgagcggcctggactgcgaccccgccctgcccagctaccccaagagctacgccgacaagagaaccggcgacagcgacgcctgcggcaagggcttcaaccacagcatggaggtgatccacggcagaaaccccgtgagagagaagccctacaagtaccccgagagcgtgaagagcttcaaccacttcaccagcctgggccaccagaagatcatgaagagaggcaagaagagctacgagggcaagaacttcgagaacatcttcaccctgagcagcagcctgaacgagaaccagagaaacctgcccggcgagaagcagtacagatgcaccgagtgcggcaagtgcttcaagagaaacagcagcctggtgctgcaccacagaacccacaccggcgagaagccctacacctgcaacgagtgcggcaagagcttcagcaagaactacaacctgatcgtgcaccagagaatccacaccggcgagaagccctacgagtgcagcaagtgcggcaaggccttcagcgacggcagcgccctgacccagcaccagagaatccacaccggcgagaagccctacgagtgcctggagtgcggcaagaccttcaacagaaacagcagcctgatcctgcaccagagaacccacaccggcgagaagccctacagatgcaacgagtgcggcaagcccttcaccgacatcagccacctgaccgtgcacctgagaatccacaccggcgagaagccctacgagtgcagcaagtgcggcaaggccttcagagacggcagctacctgacccagcacgagagaacccacaccggcgagaagcccttcgagtgcgccgagtgcggcaagagcttcaacagaaacagccacctgatcgtgcaccagaagatccacagcggcgagaagccctacgagtgcaaggagtgcggcaagaccttcatcgagagcgcctacctgatcagacaccagagaatccacaccggcgagaagccctacggctgcaaccagtgccagaagctgttcagaaacatcgccggcctgatcagacaccagagaacccacaccggcgagaagccctacgagtgcaaccagtgcggcaaggccttcagagacagcagctgcctgaccaagcaccagagaatccacaccaaggagaccccctaccagtgccccgagtgcggcaagagcttcaagcagaacagccacctggccgtgcaccagagactgcacagcagagagggccccagcagatgcccccagtgcggcaagatgttccagaagagcagcagcctggtgagacaccagagagcccacctgggcgagcagcccatggagacctag

SEQ ID NO: 10379 - DNA, 1626 bp, Artificial Sequence; identical to SEQ ID NO: 10378
  Description of Artificial Sequence: Synthetic coding sequence

SEQ ID NO: 10380 - DNA, 1626 bp, Artificial Sequence; identical to SEQ ID NO: 10378
  Description of Artificial Sequence: Synthetic coding sequence

SEQ ID NO: 10381 - DNA, 2043 bp, Artificial Sequence
  Description of Artificial Sequence: Synthetic coding sequence
atgaagatgaagaagttccagatccccgtgagcttccaggacctgaccgtgaacttcacccaggaggagtggcagcagctggaccccgcccagagactgctgtacagagacgtgatgctggagaactacagcaacctggtgagcgtgggctaccacgtgagcaagcccgacgtgatcttcaagctggagcagggcgaggagccctggatcgtggaggagttcagcaaccagaactaccccgacatcgacgacgccctggagaagaacaaggagatccaggacaagcacctgacccagaccgtgttcttcagcaacaagaccctgatcaccgagagagagaacgtgttcggcaagaccctgaacctgggcatgaacagcgtgcccagcagaaagatgccctacaagtgcaaccccggcggcaacagcctgaagaccaacagcgaggtgatcgtggccaagaagagcaaggagaacagaaagatccccgacggctacagcggcttcggcaagcacgagaagagccacctgggcatgaagaagtacagatacaaccccatgagaaaggccagcaaccagaacgagaacctgatcctgcaccagaacatccagatcctgaagcagcccttcgactacaacaagtgcggcaagaccttcttcaagagagccatcctgatcacccagaagggcagacagaccgagagaaagcccaacgagtgcaacgagtgcagaaagaccttcagcaagagaagcaccctgatcgtgcaccagagaatccacaccggcgagaagccctacgtgtgcagcgactgcagaaagaccttcagagtgaagaccagcctgaccagacacagaagaatccacaccggcgagagaccctacgagtgcagcgagtgcagaaagaccttcatcgacaagagcgccctgatcgtgcaccagaagatccacggcggcgagaagagctacgagtgcaacgagtgcggcaagaccttcttcagaaagagcgccctggccgagcacttcagaagccacaccggcgagaagccctacgagtgcaaggagtgcggcaacgccttcagcaagaagagctacctggtggtgcaccagagaacccacagaggcgagaagcccaacgagtgcaaggagtgcggcaagaccttcttctgccagagcgccctgaccgcccaccagagaatccacaccggcgagaagccctacgagtgcagcgagtgcgagaagaccttcttctgccagagcgccctgaacgtgcacagaagaagccacaccggcgagaagccctacgagtgcagccagtgcggcaagttcctgtgcaccaagagcgccctgatcgcccaccagatcacccacagaggcaagaagagctacgagtgcaacgagtgcggcaagttcttctgccacaagagcaccctgaccatccaccagagaacccacaccggcgagaagcacggcgtgttcaacaagtgcggcagaatcagcatcgtgaagagcaactgcagccagtgcaagagaatgaacaccaaggagaacctgtacgagtgcagcgagcacggccacgccgtgagcaagaacagccacctgatcgtgcaccagagaaccatctgggagagaccctacgagtgcaacgagtgcggcagaacctactgcagaaagagcgccctgacccaccaccagagaacccacaccggccagagaccctacgagtgcaacgagtgcggcaagaccttctgccagaagttcagcttcgtggagcaccagagaacccacaccggcgagaagccctacgagtgcaacgagtgcggcaagagcttctgccacaagagcgccttcagagtgcacagaagaatccacaccggcgagaagccctacgagtgcaaccagtgcggcaagacctacagaagactgtggaccctgaccgagcaccagaagatccacaccggcgagaagccctacgagtgcaacaagtgcgagaagaccttcagacacaagagcaacttcctgctgcaccagaagagccacaaggagtag

SEQ ID NO: 10382 - DNA, 1929 bp, Artificial Sequence
  Description of Artificial Sequence: Synthetic coding sequence
atgctggagaactacagcaacctggtgagcgtgggctaccacgtgagcaagcccgacgtgatcttcaagctggagcagggcgaggagccctggatcgtggaggagttcagcaaccagaactaccccgacatcgacgacgccctggagaagaacaaggagatccaggacaagcacctgacccagaccgtgttcttcagcaacaagaccctgatcaccgagagagagaacgtgttcggcaagaccctgaacctgggcatgaacagcgtgcccagcagaaagatgccctacaagtgcaaccccggcggcaacagcctgaagaccaacagcgaggtgatcgtggccaagaagagcaaggagaacagaaagatccccgacggctacagcggcttcggcaagcacgagaagagccacctgggcatgaagaagtacagatacaaccccatgagaaaggccagcaaccagaacgagaacctgatcctgcaccagaacatccagatcctgaagcagcccttcgactacaacaagtgcggcaagaccttcttcaagagagccatcctgatcacccagaagggcagacagaccgagagaaagcccaacgagtgcaacgagtgcagaaagaccttcagcaagagaagcaccctgatcgtgcaccagagaatccacaccggcgagaagccctacgtgtgcagcgactgcagaaagaccttcagagtgaagaccagcctgaccagacacagaagaatccacaccggcgagagaccctacgagtgcagcgagtgcagaaagaccttcatcgacaagagcgccctgatcgtgcaccagaagatccacggcggcgagaagagctacgagtgcaacgagtgcggcaagaccttcttcagaaagagcgccctggccgagcacttcagaagccacaccggcgagaagccctacgagtgcaaggagtgcggcaacgccttcagcaagaagagctacctggtggtgcaccagagaacccacagaggcgagaagcccaacgagtgcaaggagtgcggcaagaccttcttctgccagagcgccctgaccgcccaccagagaatccacaccggcgagaagccctacgagtgcagcgagtgcgagaagaccttcttctgccagagcgccctgaacgtgcacagaagaagccacaccggcgagaagccctacgagtgcagccagtgcggcaagttcctgtgcaccaagagcgccctgatcgcccaccagatcacccacagaggcaagaagagctacgagtgcaacgagtgcggcaagttcttctgccacaagagcaccctgaccatccaccagagaacccacaccggcgagaagcacggcgtgttcaacaagtgcggcagaatcagcatcgtgaagagcaactgcagccagtgcaagagaatgaacaccaaggagaacctgtacgagtgcagcgagcacggccacgccgtgagcaagaacagccacctgatcgtgcaccagagaaccatctgggagagaccctacgagtgcaacgagtgcggcagaacctactgcagaaagagcgccctgacccaccaccagagaacccacaccggccagagaccctacgagtgcaacgagtgcggcaagaccttctgccagaagttcagcttcgtggagcaccagagaacccacaccggcgagaagccctacgagtgcaacgagtgcggcaagagcttctgccacaagagcgccttcagagtgcacagaagaatccacaccggcgagaagccctacgagtgcaaccagtgcggcaagacctacagaagactgtggaccctgaccgagcaccagaagatccacaccggcgagaagccctacgagtgcaacaagtgcgagaagaccttcagacacaagagcaacttcctgctgcaccagaagagccacaaggagtag

SEQ ID NO: 10383 - DNA, 2256 bp, Artificial Sequence
  Description of Artificial Sequence: Synthetic coding sequence
atgggcccccagggcgccagaagacaggccttcctggccttcggcgacgtgaccgtggacttcacccagaaggagtggagactgctgagccccgcccagagagccctgtacagagaggtgaccctggagaactacagccacctggtgagcctgggcatcctgcacagcaagcccgagctgatcagaagactggagcagggcgaggtgccctggggcgaggagagaagaagaagacccggcccctgcgccggcatctacgccgagcacgtgctgagacccaagaacctgggcctggcccaccagagacagcagcagctgcagttcagcgaccagagcttccagagcgacaccgccgagggccaggagaaggagaagagcaccaagcccatggccttcagcagcccccccctgagacacgccgtgagcagcagaagaagaaacagcgtggtggagatcgagagcagccagggccagagagagaaccccaccgagatcgacaaggtgctgaagggcatcgagaacagcagatggggcgccttcaagtgcgccgagagaggccaggacttcagcagaaagatgatggtgatcatccacaagaaggcccacagcagacagaagctgttcacctgcagagagtgccaccagggcttcagagacgagagcgccctgctgctgcaccagaacacccacaccggcgagaagagctacgtgtgcagcgtgtgcggcagaggcttcagcctgaaggccaacctgctgagacaccagagaacccacagcggcgagaagcccttcctgtgcaaggtgtgcggcagaggctacaccagcaagagctacctgaccgtgcacgagagaacccacaccggcgagaagccctacgagtgccaggagtgcggcagaagattcaacgacaagagcagctacaacaagcacctgaaggcccacagcggcgagaagcccttcgtgtgcaaggagtgcggcagaggctacaccaacaagagctacttcgtggtgcacaagagaatccacagcggcgagaagccctacagatgccaggagtgcggcagaggcttcagcaacaagagccacctgatcacccaccagagaacccacagcggcgagaagcccttcgcctgcagacagtgcaagcagagcttcagcgtgaagggcagcctgctgagacaccagagaacccacagcggcgagaagcccttcgtgtgcaaggactgcgagagaagcttcagccagaagagcaccctggtgtaccaccagagaacccacagcggcgagaagcccttcgtgtgcagagagtgcggccagggcttcatccagaagagcaccctggtgaagcaccagatcacccacagcgaggagaagcccttcgtgtgcaaggactgcggcagaggcttcatccagaagagcaccttcaccctgcaccagagaacccacagcgaggagaagccctacggctgcagagagtgcggcagaagattcagagacaagagcagctacaacaagcacctgagagcccacctgggcgagaagagattcttctgcagagactgcggcagaggcttcaccctgaagcccaacctgaccatccaccagagaacccacagcggcgagaagcccttcatgtgcaagcagtgcgagaagagcttcagcctgaaggccaacctgctgagacaccagtggacccacagcggcgagagacccttcaactgcaaggactgcggcagaggcttcatcctgaagagcaccctgctgttccaccagaagacccacagcggcgagaagcccttcatctgcagcgagtgcggccagggcttcatctggaagagcaacctggtgaagcaccagctggcccacagcggcaagcagcccttcgtgtgcaaggagtgcggcagaggcttcaactggaagggcaacctgctgacccaccagagaacccacagcggcgagaagcccttcgtgtgcaacgtgtgcggccagggcttcagctggaagagaagcctgaccagacaccactggagaatccacagcaaggagaagcccttcgtgtgccaggagtgcaagagaggctacaccagcaagagcgacctgaccgtgcacgagagaatccacaccggcgagagaccctacgagtgccaggagtgcggcagaaagttcagcaacaagagctactacagcaagcacctgaagagacacctgagagagaagagattctgcaccggcagcgtgggcgaggccagcagctag

SEQ ID NO: 10384 - DNA, 1920 bp, Artificial Sequence
  Description of Artificial Sequence: Synthetic coding sequence
atgggcccccagggcgccagaagacaggccttcctggccttcggcgacgtgaccgtggacttcacccagaaggagtggagactgctgagccccgcccagagagccctgtacagagaggtgaccctggagaactacagccacctggtgagcctgggcatcctgcacagcaagcccgagctgatcagaagactggagcagggcgaggtgccctggggcgaggagagaagaagaagacccggcccctgcgccggcatctacgccgagcacgtgctgagacccaagaacctgggcctggcccaccagagacagcagcagctgcagttcagcgaccagagcttccagagcgacaccgccgagggccaggagaaggagaagagcaccaagcccatggccttcagcagcccccccctgagacacgccgtgagcagcagaagaagaaacagcgtggtggagatcgagagcagccagggccagagagagaaccccaccgagatcgacaaggtgctgaagggcatcgagaacagcagatggggcgccttcaagtgcgccgagagaggccaggacttcagcagaaagatgatggtgatcatccacaagaaggcccacagcagacagaagctgttcacctgcagagagtgccaccagggcttcagagacgagagcgccctgctgctgcaccagaacacccacaccggcgagaagagctacgtgtgcagcgtgtgcggcagaggcttcagcctgaaggccaacctgctgagacaccagagaacccacagcggcgagaagcccttcctgtgcaaggtgtgcggcagaggctacaccagcaagagctacctgaccgtgcacgagagaacccacaccggcgagaagccctacgagtgccaggagtgcggcagaagattcaacgacaagagcagctacaacaagcacctgaaggcccacagcggcgagaagcccttcgtgtgcaaggagtgcggcagaggctacaccaacaagagctacttcgtggtgcacaagagaatccacagcggcgagaagccctacagatgccaggagtgcggcagaggcttcagcaacaagagccacctgatcacccaccagagaacccacagcggcgagaagcccttcgcctgcagacagtgcaagcagagcttcagcgtgaagggcagcctgctgagacaccagagaacccacagcggcgagaagcccttcgtgtgcaaggactgcgagagaagcttcagccagaagagcaccctggtgtaccaccagagaacccacagcggcgagaagcccttcgtgtgcagagagtgcggccagggcttcatccagaagagcaccctggtgaagcaccagatcacccacagcgaggagaagcccttcgtgtgcaaggactgcggcagaggcttcatccagaagagcaccttcaccctgcaccagagaacccacagcgaggagaagccctacggctgcagagagtgcggcagaagattcagagacaagagcagctacaacaagcacctgagagcccacctgggcgagaagagattcttctgcagagactgcggcagaggcttcaccctgaagcccaacctgaccatccaccagagaacccacagcggcgagaagcccttcgtgtgcaacgtgtgcggccagggcttcagctggaagagaagcctgaccagacaccactggagaatccacagcaaggagaagcccttcgtgtgccaggagtgcaagagaggctacaccagcaagagcgacctgaccgtgcacgagagaatccacaccggcgagagaccctacgagtgccaggagtgcggcagaaagttcagcaacaagagctactacagcaagcacctgaagagacacctgagagagaagagattctgcaccggcagcgtgggcgaggccagcagctag

SEQ ID NO: 10385 - DNA, 2256 bp, Artificial Sequence; identical to SEQ ID NO: 10383
  Description of Artificial Sequence: Synthetic coding sequence

SEQ ID NO: 10386 - DNA, 2160 bp, Artificial Sequence
  Description of Artificial Sequence: Synthetic coding sequence
atgggcccccagggcgccagaagacaggccttcctggccttcggcgacgtgaccgtggacttcacccagaaggagtggagactgctgagccccgcccagagagccctgtacagagaggtgaccctggagaactacagccacctggtgagcctgggcatctacgccgagcacgtgctgagacccaagaacctgggcctggcccaccagagacagcagcagctgcagttcagcgaccagagcttccagagcgacaccgccgagggccaggagaaggagaagagcaccaagcccatggccttcagcagcccccccctgagacacgccgtgagcagcagaagaagaaacagcgtggtggagatcgagagcagccagggccagagagagaaccccaccgagatcgacaaggtgctgaagggcatcgagaacagcagatggggcgccttcaagtgcgccgagagaggccaggacttcagcagaaagatgatggtgatcatccacaagaaggcccacagcagacagaagctgttcacctgcagagagtgccaccagggcttcagagacgagagcgccctgctgctgcaccagaacacccacaccggcgagaagagctacgtgtgcagcgtgtgcggcagaggcttcagcctgaaggccaacctgctgagacaccagagaacccacagcggcgagaagcccttcctgtgcaaggtgtgcggcagaggctacaccagcaagagctacctgaccgtgcacgagagaacccacaccggcgagaagccctacgagtgccaggagtgcggcagaagattcaacgacaagagcagctacaacaagcacctgaaggcccacagcggcgagaagcccttcgtgtgcaaggagtgcggcagaggctacaccaacaagagctacttcgtggtgcacaagagaatccacagcggcgagaagccctacagatgccaggagtgcggcagaggcttcagcaacaagagccacctgatcacccaccagagaacccacagcggcgagaagcccttcgcctgcagacagtgcaagcagagcttcagcgtgaagggcagcctgctgagacaccagagaacccacagcggcgagaagcccttcgtgtgcaaggactgcgagagaagcttcagccagaagagcaccctggtgtaccaccagagaacccacagcggcgagaagcccttcgtgtgcagagagtgcggccagggcttcatccagaagagcaccctggtgaagcaccagatcacccacagcgaggagaagcccttcgtgtgcaaggactgcggcagaggcttcatccagaagagcaccttcaccctgcaccagagaacccacagcgaggagaagccctacggctgcagagagtgcggcagaagattcagagacaagagcagctacaacaagcacctgagagcccacctgggcgagaagagattcttctgcagagactgcggcagaggcttcaccctgaagcccaacctgaccatccaccagagaacccacagcggcgagaagcccttcatgtgcaagcagtgcgagaagagcttcagcctgaaggccaacctgctgagacaccagtggacccacagcggcgagagacccttcaactgcaaggactgcggcagaggcttcatcctgaagagcaccctgctgttccaccagaagacccacagcggcgagaagcccttcatctgcagcgagtgcggccagggcttcatctggaagagcaacctggtgaagcaccagctggcccacagcggcaagcagcccttcgtgtgcaaggagtgcggcagaggcttcaactggaagggcaacctgctgacccaccagagaacccacagcggcgagaagcccttcgtgtgcaacgtgtgcggccagggcttcagctggaagagaagcctgaccagacaccactggagaatccacagcaaggagaagcccttcgtgtgccaggagtgcaagagaggctacaccagcaagagcgacctgaccgtgcacgagagaatccacaccggcgagagaccctacgagtgccaggagtgcggcagaaagttcagcaacaagagctactacagcaagcacctgaagagacacctgagagagaagagattctgcaccggcagcgtgggcgaggccagcagctag

SEQ ID NO: 10387 - DNA, 2544 bp, Artificial Sequence
  Description of Artificial Sequence: Synthetic coding sequence
atggcccaggccatcttcgaggccctggagggcatggacaaccagaccgtgctggccgtgcagagcctgctggacggccagggcgccgtgcccgaccccaccggccagagcgtgaacgccccccccgccatccagcccctggacgacgaggacgtgttcctgtgcggcaagtgcaagaagcagttcaacagcctgcccgccttcatgacccacaagagagagcagtgccagggcaacgcccccgccctggccaccgtgagcctggccaccaacagcatctacccccccagcgccgcccccaccgccgtgcagcaggcccccacccccgccaacagacagatcagcacctacatcaccgtgccccccagccccctgatccagaccctggtgcagggcaacatcctggtgagcgacgacgtgctgatgagcgccatgagcgccttcaccagcctggaccagcccatgccccagggccccccccccgtgcagagcagcctgaacatgcacagcgtgcccagctacctgacccagccccccccccccccccccccccccccccccctgcccccccccccccccccccagcccccccccccccccccccagagcctgggcccccccggcagacccaaccccggcggcaacggcgtggtggaggtgtacagcgccgccgcccccctggccggcagcggcaccgtggagatccaggccctgggcatgcagccctacccccccctggaggtgcccaaccagtgcgtggagccccccgtgtaccccacccccaccgtgtacagccccggcaagcagggcttcaagcccaagggccccaaccccgccgcccccatgaccagcgccaccggcggcaccgtggccaccttcgacagccccgccaccctgaagaccagaagagccaaggccgccggcaagcccaaggcccagaagctgaagtgcagctactgcgacaagagcttcaccaagaacttcgacctgcagcagcacatcagaagccacaccggcgagaagcccttccagtgcatcgcctgcggcagagccttcgcccagaagagcaacgtgaagaagcacatgcagacccacaaggtgtggccccccggccacagcggcggcaccgtgagcagaaacagcgtgaccgtgcaggtgatggccctgaaccccagcagacaggaggacgaggagagcaccggcctgggccagcccctgcccggcgccccccagccccaggccctgagcaccgccggcgaggaggagggcgacaagcccgagagcaagcaggtggtgctgatcgacagcagctacctgtgccagttctgccccagcaagttcagcacctacttccagctgaagagccacatgacccagcacaagaacgagcaggtgtacaagtgcgtggtgaagagctgcgcccagaccttccccaagctggacaccttcctggagcacatcaagagccaccaggaggagctgagctacagatgccacctgtgcggcaaggacttccccagcctgtacgacctgggcgtgcaccagtacagccacagcctgctgccccagcacagccccaagaaggacaacgccgtgtacaagtgcgtgaagtgcgtgaacaagtacagcacccccgaggccctggagcaccacctgcagaccgccacccacaacttcccctgcccccactgccagaaggtgttcccctgcgagagatacctgagaagacacctgcccacccacggcagcggcggcagattcaagtgccaggtgtgcaagaagttcttcagaagagagcactacctgaagctgcacgcccacatccacagcggcgagaagccctacaagtgcagcgtgtgcgagagcgccttcaacagaaaggacaagctgaagagacacatgctgatccacgagcccttcaagaagtacaagtgccccttcagcacccacaccggctgcagcaaggagttcaacagacccgacaagctgaaggcccacatcctgagccacagcggcatgaagctgcacaagtgcgccctgtgcagcaagagcttcagcagaagagcccacctggccgagcaccagagagcccacaccggcaactacaagttcagatgcgccggctgcgccaagggcttcagcagacacaagtacctgaaggaccacagatgcagactgggcccccagaaggacaaggacctgcagaccagaagacccccccagagaagagccgcccccagaagctgcggcagcggcggcagaaaggtgctgacccccctgcccgaccccctgggcctggaggagctgaaggacaccggcgccggcctggtgcccgaggccgtgcccggcaagccccccttcgccgagcccgacgccgtgctgagcatcgtggtgggcggcgccgtgggcgccgagaccgagctggtggtgcccggccacgccgagggcctgggcagcaacctggccctggccgagctgcaggccggcgccgagggcccctgcgccatgctggccgtgcccgtgtacatccaggccagcgagtag

SEQ ID NO: 10388 - DNA, 2565 bp, Artificial Sequence
  Description of Artificial Sequence: Synthetic coding sequence
atggcccaggccatcttcgaggccctggagggcatggacaaccagaccgtgctggccgtgcagagcctgctggacggccagggcgccgtgcccgaccccaccggccagagcgtgaacgccccccccgccatccagcccctggacgacgaggacgtgttcctgtgcggcaagtgcaagaagcagttcaacagcctgcccgccttcatgacccacaagagagagcagtgccagggcaacgcccccgccctggccaccgtgagcctggccaccaacagcatctacccccccagcgccgcccccaccgccgtgcagcaggcccccacccccgccaacagacagatcagcacctacatcaccgtgccccccagccccctgatccagaccctggtgcagggcaacatcctggtgagcgacgacgtgctgatgagcgccatgagcgccttcaccagcctggaccagcccatgccccagggccccccccccgtgcagagcagcctgaacatgcacagcgtgcccagctacctgacccagccccccccccccccccccccccccccccccctgcccccccccccccccccccagcccccccccccccccccccagagcctgggcccccccggcagacccaaccccggcggcaacggcgtggtggaggtgtacagcgccgccgcccccctggccggcagcggcaccgtggagatccaggccctgggcatgcagccctacccccccctggaggtgcccaaccagtgcgtggagccccccgtgtaccccacccccaccgtgtacagccccggcaagcagggcttcaagcccaagggccccaaccccgccgcccccatgaccagcgccaccggcggcaccgtggccaccttcgacagccccgccaccctgaagaccagaagagccaagggcgccagaggcctgcccgaggccgccggcaagcccaaggcccagaagctgaagtgcagctactgcgacaagagcttcaccaagaacttcgacctgcagcagcacatcagaagccacaccggcgagaagcccttccagtgcatcgcctgcggcagagccttcgcccagaagagcaacgtgaagaagcacatgcagacccacaaggtgtggccccccggccacagcggcggcaccgtgagcagaaacagcgtgaccgtgcaggtgatggccctgaaccccagcagacaggaggacgaggagagcaccggcctgggccagcccctgcccggcgccccccagccccaggccctgagcaccgccggcgaggaggagggcgacaagcccgagagcaagcaggtggtgctgatcgacagcagctacctgtgccagttctgccccagcaagttcagcacctacttccagctgaagagccacatgacccagcacaagaacgagcaggtgtacaagtgcgtggtgaagagctgcgcccagaccttccccaagctggacaccttcctggagcacatcaagagccaccaggaggagctgagctacagatgccacctgtgcggcaaggacttccccagcctgtacgacctgggcgtgcaccagtacagccacagcctgctgccccagcacagccccaagaaggacaacgccgtgtacaagtgcgtgaagtgcgtgaacaagtacagcacccccgaggccctggagcaccacctgcagaccgccacccacaacttcccctgcccccactgccagaaggtgttcccctgcgagagatacctgagaagacacctgcccacccacggcagcggcggcagattcaagtgccaggtgtgcaagaagttcttcagaagagagcactacctgaagctgcacgcccacatccacagcggcgagaagccctacaagtgcagcgtgtgcgagagcgccttcaacagaaaggacaagctgaagagacacatgctgatccacgagcccttcaagaagtacaagtgccccttcagcacccacaccggctgcagcaaggagttcaacagacccgacaagctgaaggcccacatcctgagccacagcggcatgaagctgcacaagtgcgccctgtgcagcaagagcttcagcagaagagcccacctggccgagcaccagagagcccacaccggcaactacaagttcagatgcgccggctgcgccaagggcttcagcagacacaagtacctgaaggaccacagatgcagactgggcccccagaaggacaaggacctgcagaccagaagacccccccagagaagagccgcccccagaagctgcggcagcggcggcagaaaggtgctgacccccctgcccgaccccctgggcctggaggagctgaaggacaccggcgccggcctggtgcccgaggccgtgcccggcaagccccccttcgccgagcccgacgccgtgctgagcatcgtggtgggcggcgccgtgggcgccgagaccgagctggtggtgcccggccacgccgagggcctgggcagcaacctggccctggccgagctgcaggccggcgccgagggcccctgcgccatgctggccgtgcccgtgtacatccaggccagcgagtag

SEQ ID NO: 10389 - DNA, 1800 bp, Artificial Sequence
  Description of Artificial Sequence: Synthetic coding sequence
atgatgctgccctaccccagcgccctgggcgaccagtactgggaggagatcctgctgcccaagaacggcgagaacgtggagaccatgaagaagctgacccagaaccacaaggccaagggcctgcccagcaacgacaccgactgcccccagaagaaggagggcaaggcccagatcgtggtgcccgtgaccttcagagacgtgaccgtgatcttcaccgaggccgagtggaagagactgagccccgagcagagaaacctgtacaaggaggtgatgctggagaactacagaaacctgctgagcctggccgagcccaagcccgagatctacacctgcagcagctgcctgctggccttcagctgccagcagttcctgagccagcacgtgctgcagatcttcctgggcctgtgcgccgagaaccacttccaccccggcaacagcagccccggccactggaagcagcagggccagcagtacagccacgtgagctgctggttcgagaacgccgagggccaggagagaggcggcggcagcaagccctggagcgccagaaccgaggagagagagaccagcagagccttccccagccccctgcagagacagagcgccagccccagaaagggcaacatggtggtggagaccgagcccagcagcgcccagagacccaaccccgtgcagctggacaagggcctgaaggagctggagaccctgagattcggcgccatcaactgcagagagtacgagcccgaccacaacctggagagcaacttcatcaccaaccccagaaccctgctgggcaagaagccctacatctgcagcgactgcggcagaagcttcaaggacagaagcaccctgatcagacaccacagaatccacagcatggagaagccctacgtgtgcagcgagtgcggcagaggcttcagccagaagagcaacctgagcagacaccagagaacccacagcgaggagaagccctacctgtgcagagagtgcggccagagcttcagaagcaagagcatcctgaacagacaccagtggacccacagcgaggagaagccctacgtgtgcagcgagtgcggcagaggcttcagcgagaagagcagcttcatcagacaccagagaacccacagcggcgagaagccctacgtgtgcctggagtgcggcagaagcttctgcgacaagagcaccctgagaaagcaccagagaatccacagcggcgagaagccctacgtgtgcagagagtgcggcagaggcttcagccagaacagcgacctgatcaagcaccagagaacccacctggacgagaagccctacgtgtgcagagagtgcggcagaggcttctgcgacaagagcaccctgatcatccacgagagaacccacagcggcgagaagccctacgtgtgcggcgagtgcggcagaggcttcagcagaaagagcctgctgctggtgcaccagagaacccacagcggcgagaagcactacgtgtgcagagagtgcagaagaggcttcagccagaagagcaacctgatcagacaccagagaacccacagcaacgagaagccctacatctgcagagagtgcggcagaggcttctgcgacaagagcaccctgatcgtgcacgagagaacccacagcggcgagaagccctacgtgtgcagcgagtgcggcagaggcttcagcagaaagagcctgctgctggtgcaccagagaacccacagcggcgagaagcactacgtgtgcagagagtgcggcagaggcttcagccacaagagcaacctgatcagacaccagagaacccactag

SEQ ID NO: 10390 - DNA, 357 bp, Artificial Sequence
  Description of Artificial Sequence: Synthetic coding sequence
atgatgctgccctaccccagcgccctgggcgaccagtactgggaggagatcctgctgcccaagaacggcgagaacgtggagaccatgaagaagctgacccagaaccacaaggccaagggcctgcccagcaacgacaccgactgcccccagaagaaggagggcaaggcccagatcgtggtgcccgtgaccttcagagacgtgaccgtgatcttcaccgaggccgagtggaagagactgagccccgagcagagaaacctgtacaaggaggtgatgctggagaactacagaaacctgctgagcctgggccaggagatcgagaccatcctggccaacatcgtgaagagccacctgtactag

SEQ ID NO: 10391 - DNA, 306 bp, Artificial Sequence
  Description of Artificial Sequence: Synthetic coding sequence
atgatgctgccctaccccagcgccctgggcgaccagtactgggaggagatcctgctgcccaagaacggcgagaacgtggagaccatgaagaagctgacccagaaccacaaggccaagggcctgcccagcaacgacaccgactgcccccagaagaaggagggcaaggcccagatcgtggtgcccgtgaccttcagagacgtgaccgtgatcttcaccgaggccgagtggaagagactgagccccgagcagagaaacctgtacaaggaggtgatgctggagaactacagaaacctgctgagcctgtag

SEQ ID NO: 10392 - DNA, 435 bp, Artificial Sequence
  Description of Artificial Sequence: Synthetic coding sequence
atgatgctgccctaccccagcgccctgggcgaccagtactgggaggagatcctgctgcccaagaacggcgagaacgtggagaccatgaagaagctgacccagaaccacaaggccaagggcctgcccagcaacgacaccgactgcccccagaagaaggagggcaaggcccagatcgtggtgcccgtgaccttcagagacgtgaccgtgatcttcaccgaggccgagtggaagagactgagccccgagcagagaaacctgtacaaggaggtgatgctggagaactacagaaacctgctgagcctggccgagcccaagcccgagatctacacctgcagcagctgcctgctggccttcagctgccagcagttcctgagccagcacgtgctgcagatcttcctgggcctgtgcgccgagaaccacttccaccccggctag

SEQ ID NO: 10393 - DNA, 342 bp, Artificial Sequence
  Description of Artificial Sequence: Synthetic coding sequence
atggagaacctgaccaagcacagcatcgagtgcagcagcttcagaggcgactgggagtgcaagaaccagttcgagagaaagcagggcagccaggagggccacttcagcgagatgatcttcacccccgaggacatgcccaccttcagcatccagcaccagagaatccacaccgacgagaagctgctggagtgcaaggagtgcggcaaggacttcagcttcgtgagcgtgctggtgagacaccagagaatccacaccggcgagaagccctacgagtgcaaggagtgcggcaaggccttcggcagcggcgccaacctggcctaccaccagagaatccacacctag

SEQ ID NO: 10394 - DNA, 759 bp, Artificial Sequence
  Description of Artificial Sequence: Synthetic coding sequence
atggccttcagcagcggcagcgccctgaccagacaccagagaatccacaccggcgagaagccctacatctgcaacgagtgcggcaaggccttcagcttcggcagcgccctgaccagacaccagagaatccacaccggcgagaagccctacgtgtgcaaggagtgcggcaaggccttcaacagcggcagcgacctgacccagcaccagagaatccacaccggcgagaagccctacgagtgcaaggagtgcgagaaggccttcagaagcggcagcaagctgatccagcaccagagaatgcacaccggcgagaagccctacgagtgcaaggagtgcggcaagaccttcagcagcggcagcgacctgacccagcaccacagaatccacaccggcgagaagccctacgagtgcaaggagtgcggcaaggccttcggcagcggcagcaagctgatccagcaccagctgatccacaccggcgagagaccctacgagtgcaaggagtgcggcaagagcttcagcagcggcagcgccctgaacagacaccagagaatccacaccggcgagaagccctacgagtgcaaggagtgcggcaaggccttctacagcggcagcagcctgacccagcaccagagaatccacaccggcgagaagctgtacgagtgcaagaactgcggcaaggcctacggcagagacagcgagttccagcagcacaagaagagccacaacggcaagaagctgtgcgagctggagaccatcaactag

SEQ ID NO: 10395 - DNA, 1467 bp, Artificial Sequence
  Description of Artificial Sequence: Synthetic coding sequence
atggagaacctgaccaagcacagcatcgagtgcagcagcttcagaggcgactgggagtgcaagaaccagttcgagagaaagcagggcagccaggagggccacttcagcgagatgatcttcacccccgaggacatgcccaccttcagcatccagcaccagagaatccacaccgacgagaagctgctggagtgcaaggagtgcggcaaggacttcagcttcgtgagcgtgctggtgagacaccagagaatccacaccggcgagaagccctacgagtgcaaggagtgcggcaaggccttcggcagcggcgccaacctggcctaccaccagagaatccacaccggcgagaagcccttcgagtgcaaggagtgcggcaaggccttcggcagcggcagcaacctgacccaccaccagagaatccacaccggcgagaagccctacgagtgcaaggagtgcggcaaggccttcagcttcggcagcggcctgatcagacaccagatcatccacagcggcgagaagccctacgagtgcaaggagtgcggcaagagcttcagcttcgagagcgccctgatcagacaccacagaatccacaccggcgagaagccctacgagtgcatcgactgcggcaaggccttcggcagcggcagcaacctgacccagcacagaagaatccacaccggcgagaagccctacgagtgcaaggcctgcggcatggccttcagcagcggcagcgccctgaccagacaccagagaatccacaccggcgagaagccctacatctgcaacgagtgcggcaaggccttcagcttcggcagcgccctgaccagacaccagagaatccacaccggcgagaagccctacgtgtgcaaggagtgcggcaaggccttcaacagcggcagcgacctgacccagcaccagagaatccacaccggcgagaagccctacgagtgcaaggagtgcgagaaggccttcagaagcggcagcaagctgatccagcaccagagaatgcacaccggcgagaagccctacgagtgcaaggagtgcggcaagaccttcagcagcggcagcgacctgacccagcaccacagaatccacaccggcgagaagccctacgagtgcaaggagtgcggcaaggccttcggcagcggcagcaagctgatccagcaccagctgatccacaccggcgagagaccctacgagtgcaaggagtgcggcaagagcttcagcagcggcagcgccctgaacagacaccagagaatccacaccggcgagaagccctacgagtgcaaggagtgcggcaaggccttctacagcggcagcagcctgacccagcaccagagaatccacaccggcgagaagctgtacgagtgcaagaactgcggcaaggcctacggcagagacagcgagttccagcagcacaagaagagccacaacggcaagaagctgtgcgagctggagaccatcaactag

SEQ ID NO: 10396 - DNA, 1467 bp, Artificial Sequence; identical to SEQ ID NO: 10395
  Description of Artificial Sequence: Synthetic coding sequence

SEQ ID NO: 10397 - DNA, 228 bp, Artificial Sequence
  Description of Artificial Sequence: Synthetic coding sequence
atggagaacctgaccaagcacagcatcgagtgcagcagcttcagaggcgactgggagtgcaagaaccagttcgagagaaagcagggcagccaggagggccacttcagcgagatgatcttcacccccgaggacatgcccaccttcagcatccagcaccagagaatccacaccgacgagaagctgctggagtgcaaggagtgcggcaaggacttcagcttcgtgagctag

SEQ ID NO: 10398 - DNA, 1467 bp, Artificial Sequence; identical to SEQ ID NO: 10395
  Description of Artificial Sequence: Synthetic coding sequence

SEQ ID NO: 10399 - DNA, 960 bp, Artificial Sequence
  Description of Artificial Sequence: Synthetic coding sequence
atggagtaccccgcccccgccaccgtgcaggccgccgacggcggcgccgccggcccctacagcagcagcgagctgctggagggccaggagcccgacggcgtgagattcgacagagagagagccagaagactgtgggaggccgtgagcggcgcccagcccgtgggcagagaggaggcccagttcttcccccacagcagaaccgtgatccccatcctggtgctgagcgagacctacagcctgtgccaccccgtggagcacatgatccagaagaaccagtgcctgttcaccaacacccagtgcaaggtgtgctgcgccctgctgatcagcgagagccagaagctggcccactaccagagcaagaagcacgccaacaaggtgaagagatacctggccatccacggcatggagaccctgaagggcgagaccaagaagctggacagcgaccagaagagcagcagaagcaaggacaagaaccagtgctgccccatctgcaacatgaccttcagcagccccgtggtggcccagagccactacctgggcaagacccacgccaagaacctgaagctgaagcagcagagcaccaaggtggaggccctgcaccagaacagagagatgatcgaccccgacaagttctgcagcctgtgccacgccaccttcaacgaccccgtgatggcccagcagcactacgtgggcaagaagcacagaaagcaggagaccaagctgaagctgatggccagatacggcagactggccgaccccgccgtgaccgacttccccgccggcaagggctacccctgcaagacctgcaagatcgtgctgaacagcatcgagcagtaccaggcccacgtgagcggcttcaagcacaagaaccagagccccaagaccgtggccagcagcctgggccagatccccatgcagagacagcccatccagaaggacagcaccaccctggaggactag

SEQ ID NO: 10400 - DNA, 885 bp, Artificial Sequence
  Description of Artificial Sequence: Synthetic coding sequence
atggagtaccccgcccccgccaccgtgcaggccgccgacggcggcgccgccggcccctacagcagcagcgagctgctggagggccaggagcccgacggcgtgagattcgacagagagagagccagaagactgtgggaggccgtgagcggcgcccagcccgtgggcagagaggaggtggagcacatgatccagaagaaccagtgcctgttcaccaacacccagtgcaaggtgtgctgcgccctgctgatcagcgagagccagaagctggcccactaccagagcaagaagcacgccaacaaggtgaagagatacctggccatccacggcatggagaccctgaagggcgagaccaagaagctggacagcgaccagaagagcagcagaagcaaggacaagaaccagtgctgccccatctgcaacatgaccttcagcagccccgtggtggcccagagccactacctgggcaagacccacgccaagaacctgaagctgaagcagcagagcaccaaggtggaggccctgcaccagaacagagagatgatcgaccccgacaagttctgcagcctgtgccacgccaccttcaacgaccccgtgatggcccagcagcactacgtgggcaagaagcacagaaagcaggagaccaagctgaagctgatggccagatacggcagactggccgaccccgccgtgaccgacttccccgccggcaagggctacccctgcaagacctgcaagatcgtgctgaacagcatcgagcagtaccaggcccacgtgagcggcttcaagcacaagaaccagagccccaagaccgtggccagcagcctgggccagatccccatgcagagacagcccatccagaaggacagcaccaccctggaggactag

SEQ ID NO: 10401 - DNA, 960 bp, Artificial Sequence; identical to SEQ ID NO: 10399
  Description of Artificial Sequence: Synthetic coding sequence

SEQ ID NO: 10402 - DNA, 789 bp, Artificial Sequence
  Description of Artificial Sequence: Synthetic coding sequence
atggagtaccccgcccccgccaccgtgcaggccgccgacggcggcgccgccggcccctacagcagcagcgagctgctggagggccaggagcccgacggcgtgagattcgacagagagagagccagaagactgtgggaggccgtgagcggcgcccagcccgtgggcagagaggaggtggagcacatgatccagaagaaccagtgcctgttcaccaacacccagtgcaaggtgtgctgcgccctgctgatcagcgagagccagaagctggcccactaccagagcagcagaagcaaggacaagaaccagtgctgccccatctgcaacatgaccttcagcagccccgtggtggcccagagccactacctgggcaagacccacgccaagaacctgaagctgaagcagcagagcaccaaggtggaggccctgcaccagaacagagagatgatcgaccccgacaagttctgcagcctgtgccacgccaccttcaacgaccccgtgatggcccagcagcactacgtgggcaagaagcacagaaagcaggagaccaagctgaagctgatggccagatacggcagactggccgaccccgccgtgaccgacttccccgccggcaagggctacccctgcaagacctgcaagatcgtgctgaacagcatcgagcagtaccaggcccacgtgagcggcttcaagcacaagaaccagagccccaagaccgtggccagcagcctgggccagatccccatgcagagacagcccatccagaaggacagcaccaccctggaggactag

SEQ ID NO: 10403 - DNA, 591 bp, Artificial Sequence
  Description of Artificial Sequence: Synthetic coding sequence
atggagtaccccgcccccgccaccgtgcaggccgccgacggcggcgccgccggcccctacagcagcagcgagctgctggagggccaggagcccgacggcgtgagattcgacagagagagagccagaagactgtgggaggccgtgagcggcgcccagcccgtgggcagagaggaggccctgagcaagagactgaccaaccccttcctggtggccagcaccctggccctgcaccagaacagagagatgatcgaccccgacaagttctgcagcctgtgccacgccaccttcaacgaccccgtgatggcccagcagcactacgtgggcaagaagcacagaaagcaggagaccaagctgaagctgatggccagatacggcagactggccgaccccgccgtgaccgacttccccgccggcaagggctacccctgcaagacctgcaagatcgtgctgaacagcatcgagcagtaccaggcccacgtgagcggcttcaagcacaagaaccagagccccaagaccgtggccagcagcctgggccagatccccatgcagagacagcccatccagaaggacagcaccaccctggaggactag

SEQ ID NO: 10404 - DNA, 933 bp, Artificial Sequence
  Description of Artificial Sequence: Synthetic coding sequence
atggagtaccccgcccccgccaccgtgcaggccgccgacggcggcgccgccggcccctacagcagcagcgagctgctggagggccaggagcccgacggcgtgagattcgacagagagagagccagaagactgtgggaggccgtgagcggcgcccagcccgtgggcagagaggaggtggagcacatgatccagaagaaccagtgcctgttcaccaacacccagtgcaaggtgtgctgcgccctgctgatcagcgagagccagaagctggcccactaccagagcaagaagcacgccaacaaggtgaagagatacctggccatccacggcatggagaccctgaagggcgagaccaagaagctggacagcgaccagaagagcagcagaagcaaggacaagaaccagtgctgccccatctgcaacatgaccttcagcagccccgtggtggcccagagccactacctgggcaagacccacgccaagaacctgaagctgaagcagcagagcaccaaggtggaggccctgagcaagagactgaccaaccccttcctggtggccagcaccctggccctgcaccagaacagagagatgatcgaccccgacaagttctgcagcctgtgccacgccaccttcaacgaccccgtgatggcccagcagcactacgtgggcaagaagcacagaaagcaggagaccaagctgaagctgatggccagatacggcagactggccgaccccgccgtgaccgacttccccgccggcaagggctacccctgcaagacctgcaagatcgtgctgaacagcatcgagcagtaccaggcccacgtgagcggcttcaagcacaagaaccagagccccaagaccgtggccagcagcctgggccagatccccatgcagagacagcccatccagaaggacagcaccaccctggaggactag

SEQ ID NO: 10405 - DNA, 357 bp, Artificial Sequence
  Description of Artificial Sequence: Synthetic coding sequence
atggagtaccccgcccccgccaccgtgcaggccgccgacggcggcgccgccggcccctacagcagcagcgagctgctggagggccaggagcccgacggcgtgagattcgacagagagagagccagaagactgtgggaggccgtgagcggcgcccagcccgtgggcagagaggaggccggcaagggctacccctgcaagacctgcaagatcgtgctgaacagcatcgagcagtaccaggcccacgtgagcggcttcaagcacaagaaccagagccccaagaccgtggccagcagcctgggccagatccccatgcagagacagcccatccagaaggacagcaccaccctggaggactag

SEQ ID NO: 10406 - DNA, 2520 bp, Artificial Sequence
  Description of Artificial Sequence: Synthetic coding sequence
atggccctgacccagggccaggtgaccttcagagacgtggccatcgagttcagccaggaggagtggacctgcctggaccccgcccagagaaccctgtacagagacgtgatgctggagaactacagaaacctggccagcctgggcatcagctgcttcgacctgagcatcatcagcatgctggagcagggcaaggagcccttcaccctggagagccaggtgcagatcgccggcaaccccgacggctgggagtggatcaaggccgtgatcaccgccctgagcagcgagttcgtgatgaaggacctgctgcacaagggcaagagcaacaccggcgaggtgttccagaccgtgatgctggagagacaggagagccaggacatcgagggctgcagcttcagagaggtgcagaagaacacccacggcctggagtaccagtgcagagacgccgagggcaactacaagggcgtgctgctgacccaggagggcaacctgacccacggcagagacgagcacgacaagagagacgccagaaacaagctgatcaagaaccagctgggcctgagcctgcagagccacctgcccgagctgcagctgttccagtacgagggcaagatctacgagtgcaaccaggtggagaagagcttcaacaacaacagcagcgtgagccccccccagcagatgccctacaacgtgaagacccacatcagcaagaagtacctgaaggacttcatcagcagcctgctgctgacccagggccagaaggccaacaactggggcagcccctacaagagcaacggctgcggcatggtgttcccccagaacagccacctggccagccaccagagaagccacaccaaggagaagccctacaagtgctacgagtgcggcaaggccttcagaaccagaagcaacctgaccacccaccaggtgatccacaccggcgagaagagatacaagtgcaacgagtgcggcaaggtgttcagcagaaacagccagctgagccagcaccagaagatccacaccggcgagaagccctacaagtgcaacgagtgcggcaaggtgttcacccagaacagccacctggtgagacacagaggcatccacaccggcgagaagccctacaagtgcaacgagtgcggcaaggccttcagagccagaagcagcctggccatccaccaggccacccacagcggcgagaagccctacaagtgcaacgagtgcggcaaggtgttcacccagaacagccacctgaccaaccactggagaatccacaccggcgagaagccctacaagtgcaacgagtgcggcaaggccttcggcgtgagaagcagcctggccatccacctggtgatccacaccggcgagaagccctacaagtgccacgagtgcggcaaggtgttcagaagaaacagccacctggccagacaccagctgatccacaccggcgagaagccctacaagtgcaacgagtgcggcaaggccttcagagcccacagcaacctgaccacccaccaggtgatccacaccggcgagaagccctacaagtgcaacgagtgcggcaaggtgttcacccagaacagccacctggccaaccaccagagaatccacaccggcgtgaagccctacatgtgcaacgagtgcggcaaggccttcagcgtgtacagcagcctgaccacccaccaggtgatccacaccggcgagaagccctacaagtgcaacgagtgcggcaaggtgttcacccagaacagccacctggccagacacagaggcatccacaccggcgagaagccctacaagtgcaacgagtgcggcaaggtgttcagacacaacagctacctgagcagacaccagagaatccacaccggcgagaagccctacaagtacaacgagtacggcaaggccttcagcgagcacagcaacctgaccacccaccaggtgatccacaccggcgagaagccctacaagtgcaacgagtgcggcaaggtgttcacccagaacagccacctggccagacacagaagagtgcacaccggcggcaagccctaccagtgcaacgagtgcggcaaggccttcagccagaccagcaagctggccagacaccagagagtgcacaccggcgagaagccctacgagtgcaaccagtgcggcaaggccttcagcgtgagaagcagcctgaccacccaccaggccatccacaccggcaagaagccctacaagtgcaacgagtgcggcaaggtgttcacccagaacagccacctggccagacacagaggcatccacaccggcgagaagccctacaagtgcaacgagtgcggcaaggccttcagccagaccagcaagctggccagacaccagagaatccacaccggcgagaagccctacgagtgcggcaagcccttcagcatctgcagcagcctgaccacccaccagaccatccacaccggcggcaagccctacaagtgcaacgtgtggaaggtgctgaagagcgagttcaagccctgcaagcccagccagaacagctag

SEQ ID NO: 10407 - DNA, 282 bp, Artificial Sequence
  Description of Artificial Sequence: Synthetic coding sequence
agcagaaacagccagctgagccagcaccagaagatccacaccggcgagaagccctacaagtgcaacgagtgcggcaaggtgttcacccagaacagccacctggtgagacacagaggcatccacaccggcgagaagccctacaagtgcaacgagtgcggcaagcccttcagcatctgcagcagcctgaccacccaccagaccatccacaccggcggcaagccctacaagtgcaacgtgtggaaggtgctgaagagcgagttcaagccctgcaagcccagctag

SEQ ID NO: 10408 - DNA, 2523 bp, Artificial Sequence
  Description of Artificial Sequence: Synthetic coding sequence
atggccctgacccagggccaggtgaccttcagagacgtggccatcgagttcagccaggaggagtggacctgcctggaccccgcccagagaaccctgtacagagacgtgatgctggagaactacagaaacctggccagcctggccggcatcagctgcttcgacctgagcatcatcagcatgctggagcagggcaaggagcccttcaccctggagagccaggtgcagatcgccggcaaccccgacggctgggagtggatcaaggccgtgatcaccgccctgagcagcgagttcgtgatgaaggacctgctgcacaagggcaagagcaacaccggcgaggtgttccagaccgtgatgctggagagacaggagagccaggacatcgagggctgcagcttcagagaggtgcagaagaacacccacggcctggagtaccagtgcagagacgccgagggcaactacaagggcgtgctgctgacccaggagggcaacctgacccacggcagagacgagcacgacaagagagacgccagaaacaagctgatcaagaaccagctgggcctgagcctgcagagccacctgcccgagctgcagctgttccagtacgagggcaagatctacgagtgcaaccaggtggagaagagcttcaacaacaacagcagcgtgagccccccccagcagatgccctacaacgtgaagacccacatcagcaagaagtacctgaaggacttcatcagcagcctgctgctgacccagggccagaaggccaacaactggggcagcccctacaagagcaacggctgcggcatggtgttcccccagaacagccacctggccagccaccagagaagccacaccaaggagaagccctacaagtgctacgagtgcggcaaggccttcagaaccagaagcaacctgaccacccaccaggtgatccacaccggcgagaagagatacaagtgcaacgagtgcggcaaggtgttcagcagaaacagccagctgagccagcaccagaagatccacaccggcgagaagccctacaagtgcaacgagtgcggcaaggtgttcacccagaacagccacctggtgagacacagaggcatccacaccggcgagaagccctacaagtgcaacgagtgcggcaaggccttcagagccagaagcagcctggccatccaccaggccacccacagcggcgagaagccctacaagtgcaacgagtgcggcaaggtgttcacccagaacagccacctgaccaaccactggagaatccacaccggcgagaagccctacaagtgcaacgagtgcggcaaggccttcggcgtgagaagcagcctggccatccacctggtgatccacaccggcgagaagccctacaagtgccacgagtgcggcaaggtgttcagaagaaacagccacctggccagacaccagctgatccacaccggcgagaagccctacaagtgcaacgagtgcggcaaggccttcagagcccacagcaacctgaccacccaccaggtgatccacaccggcgagaagccctacaagtgcaacgagtgcggcaaggtgttcacccagaacagccacctggccaaccaccagagaatccacaccggcgtgaagccctacatgtgcaacgagtgcggcaaggccttcagcgtgtacagcagcctgaccacccaccaggtgatccacaccggcgagaagccctacaagtgcaacgagtgcggcaaggtgttcacccagaacagccacctggccagacacagaggcatccacaccggcgagaagccctacaagtgcaacgagtgcggcaaggtgttcagacacaacagctacctgagcagacaccagagaatccacaccggcgagaagccctacaagtacaacgagtacggcaaggccttcagcgagcacagcaacctgaccacccaccaggtgatccacaccggcgagaagccctacaagtgcaacgagtgcggcaaggtgttcacccagaacagccacctggccagacacagaagagtgcacaccggcggcaagccctaccagtgcaacgagtgcggcaaggccttcagccagaccagcaagctggccagacaccagagagtgcacaccggcgagaagccctacgagtgcaaccagtgcggcaaggccttcagcgtgagaagcagcctgaccacccaccaggccatccacaccggcaagaagccctacaagtgcaacgagtgcggcaaggtgttcacccagaacagccacctggccagacacagaggcatccacaccggcgagaagccctacaagtgcaacgagtgcggcaaggccttcagccagaccagcaagctggccagacaccagagaatccacaccggcgagaagccctacgagtgcggcaagcccttcagcatctgcagcagcctgaccacccaccagaccatccacaccggcggcaagccctacaagtgcaacgtgtggaaggtgctgaagagcgagttcaagccctgcaagcccagccagaacagctag

SEQ ID NO: 10409 - DNA, 1599 bp, Artificial Sequence
  Description of Artificial Sequence: Synthetic coding sequence
atgatccaggcccaggagagcatcaccctggaggacgtggccgtggacttcacctgggaggagtggcagctgctgggcgccgcccagaaggacctgtacagagacgtgatgctggagaactacagcaacctggtggccgtgggctaccaggccagcaagcccgacgccctgttcaagctggagcagggcgagcagctgtggaccatcgaggacggcatccacagcggcgcctgcagcgacatctggaaggtggaccacgtgctggagagactgcagagcgagagcctggtgaacagaagaaagccctgccacgagcacgacgccttcgagaacatcgtgcactgcagcaagagccagttcctgctgggccagaaccacgacatcttcgacctgagaggcaagagcctgaagagcaacctgaccctggtgaaccagagcaagggctacgagatcaagaacagcgtggagttcaccggcaacggcgacagcttcctgcacgccaaccacgagagactgcacaccgccatcaagttccccgccagccagaagctgatcagcaccaagagccagttcatcagccccaagcaccagaagaccagaaagctggagaagcaccacgtgtgcagcgagtgcggcaaggccttcatcaagaagagctggctgaccgaccaccaggtgatgcacaccggcgagaagccccacagatgcagcctgtgcgagaaggccttcagcagaaagttcatgctgaccgagcaccagagaacccacaccggcgagaagccctacgagtgccccgagtgcggcaaggccttcctgaagaagagcagactgaacatccaccagaagacccacaccggcgagaagccctacatctgcagcgagtgcggcaagggcttcatccagaagggcaacctgatcgtgcaccagagaatccacaccggcgagaagccctacatctgcaacgagtgcggcaagggcttcatccagaagacctgcctgatcgcccaccagagattccacaccggcaagacccccttcgtgtgcagcgagtgcggcaagagctgcagccagaagagcggcctgatcaagcaccagagaatccacaccggcgagaagcccttcgagtgcagcgagtgcggcaaggccttcagcaccaagcagaagctgatcgtgcaccagagaacccacaccggcgagagaccctacggctgcaacgagtgcggcaaggccttcgcctacatgagctgcctggtgaagcacaagagaatccacaccagagagaagcaggaggccgccaaggtggagaacccccccgccgagagacacagcagcctgcacaccagcgacgtgatgcaggagaagaacagcgccaacggcgccaccacccaggtgcccagcgtggccccccagaccagcctgaacatcagcggcctgctggccaacagaaacgtggtgctggtgggccagcccgtggtgagatgcgccgccagcggcgacaacagaggcttcgcccaggacagaaacctggtgaacgccgtgaacgtggtggtgcccagcgtgatcaactacgtgctgttctacgtgaccgagaacccctag

SEQ ID NO: 10410 - DNA, 1818 bp, Artificial Sequence
  Description of Artificial Sequence: Synthetic coding sequence
atggccgccggccagagagaggccagaccccaggtgagcctgaccttcgaggacgtggccgtgctgttcaccagagacgagtggagaaagctggcccccagccagagaaacctgtacagagacgtgatgctggagaactacagaaacctggtgagcctgggcctgcccttcaccaagcccaaggtgatcagcctgctgcagcagggcgaggacccctgggaggtggagaaggacggcagcggcgtgagcagcctgggcagcaagagcagccacaagaccaccaagagcacccagacccaggacagcagcttccagggcctgatcctgaagagaagcaacagaaacgtgccctgggacctgaagctggagaagccctacatctacgagggcagactggagaagaagcaggacaagaagggcagcttccagatcgtgagcgccacccacaagaagatccccaccatcgagagaagccacaagaacaccgagctgagccagaacttcagccccaagagcgtgctgatcagacagcagatcctgcccagagagaagaccccccccaagtgcgagatccagggcaacagcctgaagcagaacagccagctgctgaaccagcccaagatcaccgccgacaagagatacaagtgcagcctgtgcgagaagaccttcatcaacaccagcagcctgagaaagcacgagaagaaccacagcggcgagaagctgttcaagtgcaaggagtgcagcaaggccttcagccagagcagcgccctgatccagcaccagatcacccacaccggcgagaagccctacatctgcaaggagtgcggcaaggccttcaccctgagcaccagcctgtacaagcacctgagaacccacaccgtggagaagagctacagatgcaaggagtgcggcaagagcttcagcagaagaagcggcctgttcatccaccagaagatccacgccgaggagaacccctgcaagtacaaccccggcagaaaggccagcagctgcagcaccagcctgagcggctgccagagaatccacagcagaaagaagagctacctgtgcaacgagtgcggcaacaccttcaagagcagcagcagcctgagataccaccagagaatccacaccggcgagaagcccttcaagtgcagcgagtgcggcagagccttcagccagagcgccagcctgatccagcacgagagaatccacaccggcgagaagccctacagatgcaacgagtgcggcaagggcttcaccagcatcagcagactgaacagacacagaatcatccacaccggcgagaagttctacaactgcaacgagtgcggcaaggccctgagcagccacagcaccctgatcatccacgagagaatccacaccggcgagaagccctgcaagtgcaaggtgtgcggcaaggccttcagacagagcagcgccctgatccagcaccagagaatgcacaccggcgagagaccctacaagtgcaacgagtgcggcaagaccttcagatgcaacagcagcctgagcaaccaccagagaatccacaccggcgagaagccctacagatgcgaggagtgcggcatcagcttcggccagagcagcgccctgatccagcacagaagaatccacaccggcgagaagcccttcaagtgcaacacctgcggcaagaccttcagacagagcagcagcagaatcgcccaccagagaatccacaccggcgagaagccctacgagtgcaacacctgcggcaagctgttcaaccacagaagcagcctgaccaaccactacaagatccacatcgaggaggacccctag

SEQ ID NO: 10411 - DNA, 408 bp, Artificial Sequence
  Description of Artificial Sequence: Synthetic coding sequence
atggccgccggccagagagaggccagaccccaggtgagcctgaccttcgaggacgtggccgtgctgttcaccagagacgagtggagaaagctggcccccagccagagaaacctgtacagagacgtgatgctggagaactacagaaacctggtgagcctgggcctgcccttcaccaagcccaaggtgatcagcctgctgcagcagggcgaggacccctgggaggtggagaaggacggcagcggcgtgagcagcctgggcagcaagagcagccacaagaccaccaagagcacccagacccaggacagcagcttccagggcctgatcctgaagagaagcaacagaaacgtgccctgggacctgaagctggagaagccctacatctacgagggcagactggagaagaagtag

SEQ ID NO: 10412 - DNA, 1839 bp, Artificial Sequence
  Description of Artificial Sequence: Synthetic coding sequence
atggccgccggccagagagaggccagaccccaggtgagcctgaccttcgaggacgtggccgtgctgttcacctgggacgagtggagaaagctggcccccagccagagaaacctgtacagagacgtgatgctggagaactacagaaacctggtgagcctgggcctgagcttcaccaagcccaaggtgatcagcctgctgcagcagggcgaggacccctgggaggtggagaaggacagcagcggcgtgagcagcctgggctgcaagagcacccccaagatgaccaagagcacccagacccaggacagcttccaggagcagatcagaaagagactgaagagagacgagccctggaacttcatcagcgagagaagctgcatctacgaggagaagctgaagaagcagcaggacaagaacgagaacctgcagatcatcagcgtggcccacaccaagatcctgaccgtggacagaagccacaagaacgtggagttcggccagaacttctacctgaagagcgtgttcatcaagcagcagagattcgccaaggagaagacccccagcaagtgcgagatccagagaaacagcttcaagcagaacagcaacctgctgaaccagagcaagatcaagaccgccgagaagagatacaagtgcagcacctgcgagaaggccttcatccacaacagcagcctgagaaagcaccagaagaaccacaccggcgagaagctgttcaagtgcaaggagtgcctgaaggccttcagccagagcagcgccctgatccagcaccagagaacccacaccggcgagaagccctacatctgcaaggagtgcggcaaggccttcagccacagcgccagcctgtgcaagcacctgagaacccacaccgtggagaagtgctacagatgcaaggagtgcggcaagagcttcagcagaagaagcggcctgttcatccaccagaagatccacgcccaggagaacccccacaagtacaaccccggcagaaaggccagcagctacagcaccagcctgagcggcagccagaagatccacctgagaaagaagagctacctgtgcaacgagtgcggcaacaccttcaagagcagcagcagcctgagataccaccagagaatccacaccggcgagaagcccttcaagtgcagcgagtgcggcagagccttcagccagagcgccagcctgatccagcacgagagaatccacaccggcgagaagccctacagatgcaacgagtgcggcaagggcttcaccagcatcagcagactgaacagacacagaatcatccacaccggcgagaagctgtacaactgcaacgagtgcggcaaggccctgagcagccacagcaccctgatcatccacgagagaatccacaccggcgagaagccctgcaagtgcaaggtgtgcggcaaggccttcagacagagcagcgccctgatccagcaccagagaatgcacaccggcgagagaccctacaagtgcaacgagtgcgacaagaccttcagatgcaacagcagcctgagcaaccaccagagaatccacaccggcgagaagccctacagatgcctggagtgcggcatgagcttcggccagagcgccgccctgatccagcaccagagaatccacaccggcgagaagcccttcaagtgcaacacctgcggcaagaccttcagacagagcagcagcctgatcgcccaccagagaatccacaccggcgagaagccctacgagtgcaacgcctgcggcaagctgttcagccagagaagcagcctgaccaaccactacaagatccacatcgaggaggacagcctgaaggccgacctgcacgtgtag

SEQ ID NO: 10413 - DNA, 405 bp, Artificial Sequence
  Description of Artificial Sequence: Synthetic coding sequence
atggccgccggccagagagaggccagaccccaggtgagcctgaccttcgaggacgtggccgtgctgttcacctgggacgagtggagaaagctggcccccagccagagaaacctgtacagagacgtgatgctggagaactacagaaacctggtgagcctgggcctgagcttcaccaagcccaaggtgatcagcctgctgcagcagggcgaggacccctgggaggtggagaaggacagcagcggcgtgagcagcctgggctgcaagagcacccccaagatgaccaagagcacccagacccaggacagcttccaggagcagatcagaaagagactgaagagagacgagccctggaacttcatcagcgagagaagctgcatctacgaggagaagctgaagaagcagtag

SEQ ID NO: 10414 - DNA, 1665 bp, Artificial Sequence
  Description of Artificial Sequence: Synthetic coding sequence
atggccgtggacctgctgagcgcccaggagcccgtgaccttcagagacgtggccgtgttcttcagccaggacgagtggctgcacctggacagcgcccagagagccctgtacagagaggtgatgctggagaactacagcagcctggtgagcctgggcatccccttcagcatgcccaagctgatccaccagctgcagcagggcgaggacccctgcatggtggagagagaggtgcccagcgacaccagactgggcttcaagacctggctggagaccgaggccctgccccacagacaggacatcttcatcgaggagaccagccagggcatggtgaagaaggagagcatcaaggacggccactgggacatcaacttcgaggaggccgtggagttcgagagcgagatcgaggaggagcaggagaagaagcccctgagacagatgatcgacagccacgagaagaccatcagcgaggacggcaaccacaccagcctggagctgggcaagagcctgttcaccaacaccgccctggtgacccagcagagcgtgcccatcgagagaatccccaacatgtactacaccttcggcaaggacttcaagcagaacttcgacctgatgaagtgcttccagatctaccccggcggcaagccccacatctgcaacgagtgcggcaagagcttcaagcagaacctgcacctgatcgagcaccagagaatccacaccggcgagaagccctacaagtgcaacgagtgcgagaagaccttcagccacagaagcagcctgctgagccaccagagaatccacaccggcgagaagccctacaagtgcaacgagtgcgagaaggccttcagcaacagcagcaccctgatcaagcacctgagagtgcacaccggcgagaagccctacagatgcagagagtgcggcaaggccttcagccagtgcagcaccctgaccgtgcaccagagaatccacaccggcgagaagctgtacaagtgcggcgagtgcgagaaggccttcaactgcagagccaagctgcacagacaccagagaatccacaccggcgagaagccctacaagtgcagcgagtgcggcaagggctacagccagttcaccagcctggccgagcaccagagattccacaccggcgagcagctgtacacctgcctggagtgcggcagaaccttcaccagaatcgtgaccctgatcgagcaccagagaatccacaccggccagaagccctaccagtgcaacgagtgcgagaaggccttcaaccagtacagcagcttcaacgagcacagaaagatccacaccggcgagaagctgtacacctgcgaggagtgcggcaaggccttcggctgcaagagcaacctgtacagacaccagagaatccacaccggcgagaagccctaccagtgcaaccagtgcggcaaggccttcagccagtacagcttcctgaccgagcacgagagaatccacaccggcgagaagctgtacaagtgcatggagtgcggcaaggcctacagctacagaagcaacctgtgcagacacaagaaggtgcacaccaaggagaagctgtacaagtggaaggagtacggcaagcccttcatctgcagcagcagcctgacccagtaccagagattcttcaagggcgacaaggcctacgaggtgtag

SEQ ID NO: 10415 - DNA, 1707 bp, Artificial Sequence
  Description of Artificial Sequence: Synthetic coding sequence
atgagaagaagcgtgctggtgagaaaccccggccacaagggcctgagacccgtgtacgaggagctggacagcgacagcgaggacctggaccccaaccccgaggacctggaccccgtgagcgaggaccccgagcccgaccccgaggacctgaacaccgtgcccgaggacgtggaccccagctacgaggacctggagcccgtgagcgaggacctggaccccgacgccgaggcccccggcagcgagccccaggaccccgaccccatgagcagcagcttcgacctggaccccgacgtgatcggccccgtgcccctgatcctggaccccaacagcgacaccctgagccccggcgaccccaaggtggaccccatcagcagcggcctgaccgccaccccccaggtgctggccaccagccccgccgtgctgcccgcccccgccagcccccccagacccttcagctgccccgactgcggcagagccttcagaagaagcagcggcctgagccagcacagaagaacccacagcggcgagaagccctacagatgccccgactgcggcaagagcttcagccacggcgccaccctggcccagcacagaggcatccacaccggcgccagaccctaccagtgcgccgcctgcggcaaggccttcggctggagaagcaccctgctgaagcacagaagcagccacagcggcgagaagccccaccactgccccgtgtgcggcaaggccttcggccacggcagcctgctggcccagcacctgagaacccacggcggccccagaccccacaagtgccccgtgtgcgccaagggcttcggccagggcagcgccctgctgaagcacctgagaacccacaccggcgagagaccctacccctgcccccagtgcggcaaggccttcggccagagcagcgccctgctgcagcaccagagaacccacaccgccgagagaccctacagatgcccccactgcggcaaggccttcggccagagcagcaacctgcagcaccacctgagaatccacaccggcgagagaccctacgcctgcccccactgcagcaaggccttcggccagagcagcgccctgctgcagcacctgcacgtgcacagcggcgagagaccctacagatgccagctgtgcggcaaggccttcggccaggccagcagcctgaccaagcacaagagagtgcacgagggcgccgccgccgccgccgccgccgccgccgccgccgccgccgccgccgccgccggcctgggcctgggccccggcctgagccccgccagcatgatgagacccggccaggtgagcctgctgggccccgacgccgtgagcgtgctgggcagcggcctgggcctgagccccggcaccagcagcggcagaaaccccgaccccggcagcggccccggcaccctgcccgaccccagcagcaagcccctgcccggcagcagaagcacccccagccccacccccgtggagagcagcgaccccaaggccggccacgacgccggccccgacctggtgcccagccccgacctggaccccgtgcccagccccgaccccgaccccgtgcccagccccgaccccaaccccgtgagctgccccgacccctgcagccccaccagaggcaccgtgagccccgccctgcccaccggcgagagccccgagtgggtgcaggagcagggcgccctgctgggccccgacggctag

SEQ ID NO: 10416 - DNA, 1707 bp, Artificial Sequence; identical to SEQ ID NO: 10415
  Description of Artificial Sequence: Synthetic coding sequence

SEQ ID NO: 10417 - DNA, 1707 bp, Artificial Sequence; identical to SEQ ID NO: 10415
  Description of Artificial Sequence: Synthetic coding sequence

SEQ ID NO: 10418 - DNA, 1263 bp, Artificial Sequence
  Description of Artificial Sequence: Synthetic coding sequence
atgagcagaagcagccccagcggcaagggccacagcagaatggccgagcccagattcaacaacccctacttctggccccccccccccaccatgcccagccagctggacaacctggtgctgatcaacaagatcaaggagcagctgatggccgagaagatcagacccccccacctgccccccaccagcgccagcagccagcagcccctgctggtgccccccgcccccgccgagagcagccaggccgtgatgagcctgcccaagctgcagcaggtgcccggcctgcacccccaggccgtgccccagcccgacgtggccctgcacgccagacccgccaccagcaccgtgaccggcctgggcctgagcaccagaacccccagcgtgagcaccagcgagagcagcgccggcgccggcaccggcaccggcaccagcacccccagcacccccaccaccaccagccagagcagactgatcgccagcagccccaccctgatcagcggcatcaccagcccccccctgctggacagcatcaagaccatccagggccacggcctgctgggcccccccaagagcgagagaggcagaaagaagatcaaggccgagaaccccggcggcccccccgtgctggtggtgccctaccccatcctggccagcggcgagaccgccaaggagggcaagacctacagatgcaaggtgtgccccctgaccttcttcaccaagagcgagatgcagatccacagcaagagccacaccgaggccaagccccacaagtgcccccactgcagcaagagcttcgccaacgccagctacctggcccagcacctgagaatccacctgggcgtgaagccctaccactgcagctactgcgacaagagcttcagacagctgagccacctgcagcagcacaccagaatccacaccggcgacagaccctacaagtgcccccaccccggctgcgagaaggccttcacccagctgagcaacctgcagagccaccagagacagcacaacaaggacaagccctacaagtgccccaactgctacagagcctacagcgacagcgccagcctgcagatccacctgagcgcccacgccatcaagcacgccaaggcctactgctgcagcatgtgcggcagagcctacaccagcgagacctacctgatgaagcacatgagcaagcacaccgtggtggagcacctggtgagccaccacagcccccagagaaccgagagccccggcatccccgtgagaatcagcctgatctag

SEQ ID NO: 10419 - DNA, 1263 bp, Artificial Sequence; identical to SEQ ID NO: 10418
  Description of Artificial Sequence: Synthetic coding sequence

SEQ ID NO: 10420 - DNA, 2235 bp, Artificial Sequence
  Description of Artificial Sequence: Synthetic coding sequence
atgcagaaggagatgaagatgatcaaggacgaggacgtgcacttcgacctggccgtgaagaagacccccagcttcccccactgcctgcagcccgtggccagcagaggcaaggccccccagagacaccccttccccgaggccctgagaggccccttcagccagttcagatacgagcccccccccggcgacctggacggcttccccggcgtgttcgagggcgccggcagcagaaagagaaagagcatgcccaccaagatgccctacaaccaccccgccgaggaggtgaccctggccctgcacagcgaggagaacaagaaccacggcctgcccaacctgcccctgctgttcccccagccccccagacccaagtacgacagccagatgatcgacctgtgcaacgtgggcttccagttctacagaagcctggagcacttcggcggcaagcccgtgaagcaggagcccatcaagcccagcgccgtgtggccccagcccacccccacccccttcctgcccaccccctacccctactaccccaaggtgcaccccggcctgatgttccccttcttcgtgcccagcagcagccccttccccttcagcagacacaccttcctgcccaagcagccccccgagcccctgctgcccagaaaggccgagccccaggagagcgaggagaccaagcagaaggtggagagagtggacgtgaacgtgcagatcgacgacagctactacgtggacgtgggcggcagccagaagagatggcagtgccccacctgcgagaagagctacaccagcaagtacaacctggtgacccacatcctgggccacagcggcatcaagccccacgcctgcacccactgcggcaagctgttcaagcagctgagccacctgcacacccacatgctgacccaccagggcaccagaccccacaagtgccaggtgtgccacaaggccttcacccagaccagccacctgaagagacacatgatgcagcacagcgaggtgaagccccacaactgcagagtgtgcggcagaggcttcgcctaccccagcgagctgaaggcccacgaggccaagcacgccagcggcagagagaacatctgcgtggagtgcggcctggacttccccaccctggcccagctgaagagacacctgaccacccacagaggccccatccagtacaactgcagcgagtgcgacaagaccttccagtaccccagccagctgcagaaccacatgatgaagcacaaggacatcagaccctacatctgcagcgagtgcggcatggagttcgtgcagccccaccacctgaagcagcacagcctgacccacaagggcgtgaaggagcacaagtgcggcatctgcggcagagagttcaccctgctggccaacatgaagagacacgtgctgatccacaccaacatcagagcctaccagtgccacctgtgctacaagagcttcgtgcagaagcagaccctgaaggcccacatgatcgtgcacagcgacgtgaagcccttcaagtgcaagctgtgcggcaaggagttcaacagaatgcacaacctgatgggccacatgcacctgcacagcgacagcaagcccttcaagtgcctgtactgccccagcaagttcaccctgaagggcaacctgaccagacacatgaaggtgaagcacggcgtgatggagagaggcctgcacagccagggcctgggcagaggcagaatcgccctggcccagaccgccggcgtgctgagaagcctggagcaggaggagcccttcgacctgagccagaagagaagagccaaggtgcccgtgttccagagcgacggcgagagcgcccagggcagccactgccacgaggaggaggaggaggacaactgctacgaggtggagccctacagccccggcctggccccccagagccagcagctgtgcacccccgaggacctgagcaccaagagcgagcacgcccccgaggtgctggaggaggcctgcaaggaggagaaggaggacgccagcaagggcgagtgggagaagagaagcaagggcgacctgggcgccgagggcggccaggagagagactgcgccggcagagacgagtgcctgagcctgagagccttccagagcaccagaagaggccccagcttcagcgactacctgtacttcaagcacagagacgagagcctgaaggagctgctggagagaaagatggagaagcaggccgtgctgctgggcatctag

SEQ ID NO: 10421 - DNA, 717 bp, Artificial Sequence
  Description of Artificial Sequence: Synthetic coding sequence
atgaagaacgtggccaacaccgtgaccatcagccacatcctgccccacatcaagatcatccacaccgaggagaagcccgacaagtgcgaggagtgcaacaaggtgttcaactggagcagcacccacaccaagtacaagagaatccacaccgaggacaagttctacaagtacgaggagtgcgacaagagcttcaagaacatcagcaccctgatcacccacaagatcatctacgtggtggagaagttctacaagtgcgaggagtgcggcaaggtgttcttcttcttcctgaagtggagcctgaccctgagccccaagctggagtgcaacggcgccatcagcgtgcactgcaacctgagactgctgggcagcagcgacagcctggccagcaccagccaggccgccggcatcgccggcgcctgccaccacgcccagctgatcttcgtgttcctggtggagaccggcttccaccacttcgaccaggccggcttcgagctgctgaccagcagcgacccccccgccctggccagccagagcgcccccaagtgctgggactacaagcacgagcccctgagccccgtggagtgcggcaaggtgttcaacaagctgagcaaccacaccggcgagaagctgtacaagcccaagagacacgacagcgccctggagaacaccctgaacttcagcaagcacaagagaaaccacagcgtgaagaagccctag

SEQ ID NO: 10422 - DNA, 1686 bp, Artificial Sequence
  Description of Artificial Sequence: Synthetic coding sequence
atgatcaccagccagggcagcgtgagcttcagagacgtgaccgtgggcttcacccaggaggagtggcagcacctggaccccgcccagagaaccctgtacagagacgtgatgctggagaactacagccacctggtgagcgtgggctactgcatccccaagcccgaggtgatcctgaagctggagaagggcgaggagccctggatcctggaggagaagttccccagccagagccacctggagctgatcaacaccagcagaaactacagcatcatgaagttcaacgagttcaacaagggcggcaagtgcttctgcgacgagaagcacgagatcatccacagcgaggaggagcccagcgagtacaacaagaacggcaacagcttctggctgaacgaggacctgatctggcaccagaagatcaagaactgggagcagagcttcgagtacaacgagtgcggcaaggccttccccgagaacagcctgttcctggtgcacaagagaggctacaccggccagaagacctgcaagtacaccgagcacggcaagacctgcgacatgagcttcttcatcacccaccagcagacccaccccagagagaaccactacggcaacgagtgcggcgagaacatcttcgaggagagcatcctgctggagcaccagagcgtgtaccccttcagccagaagctgaacctgacccccatccagagaacccacagcatcaacaacatcatcgagtacaacgagtgcggcaccttcttcagcgagaagctggtgctgcacctgcagcagagaacccacaccggcgagaagccctacgagtgccacgagtgcggcaagaccttcacccagaagagcgcccacaccagacaccagagaacccacaccggcggcaagccctacgagtgccacgagtgcggcaagaccttctacaagaacagcgacctgatcaagcaccagagaatccacaccggcgagagaccctacggctgccacgagtgcggcaagagcttcagcgagaagagcaccctgacccagcaccagagaacccacaccggcgagaagccctacgagtgccacgagtgcggcaagaccttcagcttcaagagcgtgctgaccgtgcaccagaagacccacaccggcgagaagccctacgagtgctacgcctgcggcaaggccttcctgagaaagagcgacctgatcaagcaccagagaatccacaccggcgagaagccctacgagtgcaacgagtgcggcaagagcttcagcgagaagagcaccctgaccaagcacctgagaacccacaccggcgagaagccctacgagtgcatccagtgcggcaagttcttctgctactacagcggcttcaccgagcacctgagaagacacaccggcgagaagcccttcggctgcaacgagtgcggcaagaccttcagacagaagagcgccctgatcgtgcaccagagaacccacatcagacagaagccctacggctgcaaccagtgcggcaagagcttctgcgtgaagagcaagctgatcgcccaccacagaacccacaccggcgagaagccctacgagtgcaacgtgtgcggcaagagcttctacgtgaagagcaagctgaccgtgcaccagagaatccacctgggcagaaaccccatcaacgtggtgaacgagggcaactacagcggctag

SEQ ID NO: 10423 - DNA, 1686 bp, Artificial Sequence; identical to SEQ ID NO: 10422
  Description of Artificial Sequence: Synthetic coding sequence

SEQ ID NO: 10424 - DNA, 1188 bp, Artificial Sequence
  Description of Artificial Sequence: Synthetic coding sequence
atgagaaacatcatgtacttcggcggcacctgccagagccccgccctgcccgccctggtgagaccccccgccccccccctgcagcccagcctggacatcaagcccttcctgcccttccccctggacaccgccgccgccgtgaacctgttccccaacttcaacgccatggaccccatccagaaggccgtgatcaaccacaccttcggcgtgcccctgccccacagaagaaagcagatcatcagctgcaacatctgccagctgagattcaacagcgacagccaggccgccgcccactacaagggcaccaagcacgccaagaagctgaaggccctggaggccatgaagaacaagcagaagagcgtgaccgccaaggacagcgccaagaccaccttcaccagcatcaccaccaacaccatcaacaccagcagcgacaagaccgacggcaccgccggcacccccgccatcagcaccaccaccaccgtggagatcagaaagagcagcgtgatgaccaccgagatcaccagcaaggtggagaagagccccaccaccgccaccggcaacagcagctgccccagcaccgagaccgaggaggagaaggccaagagactgctgtactgcagcctgtgcaaggtggccgtgaacagcgccagccagctggaggcccacaacagcggcaccaagcacaagaccatgctggaggccagaaacggcagcggcaccatcaaggccttccccagagccggcgtgaagggcaagggccccgtgaacaagggcaacaccggcctgcagaacaagaccttccactgcgagatctgcgacgtgcacgtgaacagcgagacccagctgaagcagcacatcagcagcagaagacacaaggacagagccgccggcaagccccccaagcccaagtacagcccctacaacaagctgcagaagaccgcccaccccctgggcgtgaagctggtgttcagcaaggagcccagcaagcccctggcccccagaatcctgcccaaccccctggccgccgccgccgccgccgccgccgtggccgtgagcagccccttcagcctgagaaccgcccccgccgccaccctgttccagaccagcgccctgccccccgccctgctgagacccgcccccggccccatcagaaccgcccacacccccgtgctgttcgccccctactag

SEQ ID NO: 10425 - DNA, 1077 bp, Artificial Sequence
  Description of Artificial Sequence: Synthetic coding sequence
atggagagcctgagaggcaacaccgcccagggccccaccaacgaggaggactacaagaacgagggccagctgagcagacagaccaagtgccccgcccagaagaagagcagcttcgagaacaccgtggtgagaaaggtgagcgtgaccctgaaggagatcttcaccggcgaggagggccccgagagcagcgagttcagcctgagccccaacctggacgcccagcagaagatccccaagggccacggcagccccatcagcagaaagaacagcaaggacaacagcgacctgatcaagcaccagagactgttcagccagagaaagccctgcaagtgcaacgagtgcgagaaggccttcagctaccagagcgacctgctggtgcacagcagaatccacggcggcgagaagcccttcgagtgcaacaagtgcggcaagagcttcagcagaagcacccacctgatcgagcaccagagaacccacaccggcgagaagccctacgagtgcaacgagtgcggcaaggccttcagcagaagcacccacctgagcctgcaccagagaatccacaccggcgagaagccctacgagtgcagcgagtgcggcaaggccttcagcagaagcaccaacctgagccagcaccagagaacccacacccaggagagaccctacaagtgcaacgagtgcggcaaggccttcggcgacagaagcaccatcatccagcaccagagaatccacaccggcgagaacccctacgagtgcagcaagtgcggcaaggccttcagctggatcagcagcctgaccgagcaccagagaacccacaccggcgagaacccctacgagtgcagcgagtgcggcaaggtgttcagcagaagcagcagcctgaccgagcaccagagaatccacagcggcgagaagccccacgagtgcagagtgtgcggcaagggcttcagcagaagcagcagcctgatcatccaccagagaacccacaccggcgagaagccctacaagtgcaacgactgcggcaaggccttctgccagagcagcaccctgatcagacaccagcacctgcacaccaaggagtag

SEQ ID NO: 10426 - DNA, 402 bp, Artificial Sequence
  Description of Artificial Sequence: Synthetic coding sequence
atggagagcctgagaggcaacaccgcccagggccccaccaacgaggaggactacaagaacgagggccagctgagcagacagaccaagtgccccgcccagaagaagagcagcttcgagaacaccgtggtgagaaaggtgagcgtgaccctgaaggagatcttcaccggcgaggagggccccgagagcagcgagttcagcctgagccccaacctggacgcccagcagaagatccccaagggccacggcagccccatcagcagaaagaacagcaaggacaacagcgacctgatcaagcaccagagactgttcagccagagaaagccctgcaagtgcaacgagtgcgagaaggccttcagctaccagagcgacctgctggtgcacagcagaatccacggcggctag

SEQ ID NO: 10427 - DNA, 1686 bp, Artificial Sequence
  Description of Artificial Sequence: Synthetic coding sequence
atgaacagcagcctgaccgcccagagaagaggcagcgacgccgagctgggcccctgggtgatggccgccagaagcaaggacgccgcccccagccagagagacggcctgctgcccgtgaaggtggaggaggacagccccggcagctgggagcccaactaccccgccgccagccccgaccccgagaccagcagactgcacttcagacagctgagataccaggaggtggccggccccgaggaggccctgagcagactgagagagctgtgcagaagatggctgagacccgagctgctgagcaaggagcagatcctggagctgctggtgctggagcagttcctgaccatcctgcccgaggagctgcaggcctgggtgagagagcactgccccgagagcggcgaggaggccgtggccgtggtgagagccctgcagagagccctggacggcaccagcagccagggcatggtgaccttcgaggacaccgccgtgagcctgacctgggaggagtgggagagactggaccccgccagaagagacttctgcagagagagcgcccagaaggacagcggcagcaccgtgccccccagcctggagagcagagtggagaacaaggagctgatccccatgcagcagatcctggaggaggccgagccccagggccagctgcaggaggccttccagggcaagagacccctgttcagcaagtgcggcagcacccacgaggacagagtggagaagcagagcggcgaccccctgcccctgaagctggagaacagccccgaggccgagggcctgaacagcatcagcgacgtgaacaagaacggcagcatcgagggcgaggacagcaagaacaacgagctgcagaacagcgccagatgcagcaacctggtgctgtgccagcacatccccaaggccgagagacccaccgacagcgaggagcacggcaacaagtgcaagcagagcttccacatggtgacctggcacgtgctgaagccccacaagagcgacagcggcgacagcttccaccacagcagcctgttcgagacccagagacagctgcacgaggagagaccctacaagtgcggcaactgcggcaagagcttcaagcagagaagcgacctgttcagacaccagagaatccacaccggcgagaagccctacggctgccaggagtgcggcaagagcttcagccagagcgccgccctgaccaagcaccagagaacccacaccggcgagaagccctacacctgcctgaagtgcggcgagagattcagacagaacagccacctgaacagacaccagagcacccacagcagagacaagcacttcaagtgcgaggagtgcggcgagacctgccacatcagcaacctgttcagacaccagagactgcacaagggcgagagaccctacaagtgcgaggagtgcgagaagagcttcaagcagagaagcgacctgttcaagcaccacagaatccacaccggcgagaagccctacggctgcagcgtgtgcggcaagagattcaaccagagcgccaccctgatcaagcaccagagaatccacaccggcgagaagccctacaagtgcctggagtgcggcgagagattcagacagagcacccacctgatcagacaccagagaatccaccagaacaaggtgctgagcgccggcagaggcggcagcagactgtag

SEQ ID NO: 10428 - DNA, 489 bp, Artificial Sequence
  Description of Artificial Sequence: Synthetic coding sequence
atgaacagcagcctgaccgcccagagaagaggcagcgacgccgagctgggcccctgggtgatggccgccagaagcaaggacgccgcccccagccagagagacggcctgctgcccgtgaaggtggaggaggacagccccggcagctgggagcccaactaccccgccgccagccccgaccccgagaccagcagactgcacttcagacagctgagataccaggaggtggccggccccgaggaggccctgagcagactgagagagctgtgcagaagatggctgagacccgagctgctgagcaaggagcagatcctggagctgctggtgctggagcagttcctgaccatcctgcccgaggagctgcaggcctgggtgagagagcactgccccgagagcggcgaggaggccgtggccgtggtgagagccctgcagagagccctggacggcaccagcagccaggtgtggaaggccgagtggagaaccaagagctag

SEQ ID NO: 10429 - DNA, 1416 bp, Artificial Sequence
  Description of Artificial Sequence: Synthetic coding sequence
atgaagggcaactacgagagcctgatcagcatggactacgccatcaaccagcccgacgtgctgagccagatccagcccgagggcgagcacaacaccgaggaccaggccggccccgaggagagcgagatccccaccgaccccagcgaggagcccggcatcagcaccagcgacatcctgagctggatcaagcaggaggaggagccccaggtgggcgccccccccgagagcaaggagagcgacgtgtacaagagcacctacgccgacgaggagctggtgatcaaggccgagggcctggccagaagcagcctgtgccccgaggtgcccgtgcccttcagcagcccccccgccgccgccaaggacgccttcagcgacgtggccttcaagagccagcagagcaccagcatgacccccttcggcagacccgccaccgacctgcccgaggccagcgagggccaggtgaccttcacccagctgggcagctaccccctgcccccccccgtgggcgagcaggtgttcagctgccaccactgcggcaagaacctgagccaggacatgctgctgacccaccagtgcagccacgccaccgagcaccccctgccctgcgcccagtgccccaagcacttcaccccccaggccgacctgagcagcaccagccaggaccacgccagcgagaccccccccacctgcccccactgcgccagaaccttcacccaccccagcagactgacctaccacctgagagtgcacaacagcaccgagagacccttcccctgccccgactgccccaagagattcgccgaccaggccagactgaccagccacagaagagcccacgccagcgagagacccttcagatgcgcccagtgcggcagaagcttcagcctgaagatcagcctgctgctgcaccagagaggccacgcccaggagagacccttcagctgcccccagtgcggcatcgacttcaacggccacagcgccctgatcagacaccagatgatccacaccggcgagagaccctacccctgcaccgactgcagcaagagcttcatgagaaaggagcacctgctgaaccacagaagactgcacaccggcgagagacccttcagctgcccccactgcggcaagagcttcatcagaaagcaccacctgatgaagcaccagagaatccacaccggcgagagaccctacccctgcagctactgcggcagaagcttcagatacaagcagaccctgaaggaccacctgagaagcggccacaacggcggctgcggcggcgacagcgaccccagcggccagccccccaacccccccggccccctgatcaccggcctggagaccagcggcctgggcgtgaacaccgagggcctggagaccaaccagtggtacggcgagggcagcggcggcggcgtgctgtag

SEQ ID NO: 10430 - DNA, 1416 bp, Artificial Sequence; identical to SEQ ID NO: 10429
  Description of Artificial Sequence: Synthetic coding sequence

SEQ ID NO: 10431 - DNA, 1416 bp, Artificial Sequence; identical to SEQ ID NO: 10429
  Description of Artificial Sequence: Synthetic coding sequence

SEQ ID NO: 10432 - DNA, 1929 bp, Artificial Sequence
  Description of Artificial Sequence: Synthetic coding sequence
atggccgaggccgcccccgcccccaccagcgagtgggacagcgagtgcctgaccagcctgcagcccctgcccctgcccaccccccccgccgccaacgaggcccacctgcagaccgccgccatcagcctgtggaccgtggtggccgccgtgcaggccatcgagagaaaggtggagatccacagcagaagactgctgcacctggagggcagaaccggcaccgccgagaagaagctggccagctgcgagaagaccgtgaccgagctgggcaaccagctggagggcaagtgggccgtgctgggcaccctgctgcaggagtacggcctgctgcagagaagactggagaacctggagaacctgctgagaaacagaaacttctggatcctgagactgccccccggcatcaagggcgacatccccaaggtgcccgtggccttcgacgacgtgagcatctacttcagcacccccgagtgggagaagctggaggagtggcagaaggagctgtacaagaacatcatgaagggcaactacgagagcctgatcagcatggactacgccatcaaccagcccgacgtgctgagccagatccagcccgagggcgagcacaacaccgaggaccaggccggccccgaggagagcgagatccccaccgaccccagcgaggagcccggcatcagcaccagcgacatcctgagctggatcaagcaggaggaggagccccaggtgggcgccccccccgagagcaaggagagcgacgtgtacaagagcacctacgccgacgaggagctggtgatcaaggccgagggcctggccagaagcagcctgtgccccgaggtgcccgtgcccttcagcagcccccccgccgccgccaaggacgccttcagcgacgtggccttcaagagccagcagagcaccagcatgacccccttcggcagacccgccaccgacctgcccgaggccagcgagggccaggtgaccttcacccagctgggcagctaccccctgcccccccccgtgggcgagcaggtgttcagctgccaccactgcggcaagaacctgagccaggacatgctgctgacccaccagtgcagccacgccaccgagcaccccctgccctgcgcccagtgccccaagcacttcaccccccaggccgacctgagcagcaccagccaggaccacgccagcgagaccccccccacctgcccccactgcgccagaaccttcacccaccccagcagactgacctaccacctgagagtgcacaacagcaccgagagacccttcccctgccccgactgccccaagagattcgccgaccaggccagactgaccagccacagaagagcccacgccagcgagagacccttcagatgcgcccagtgcggcagaagcttcagcctgaagatcagcctgctgctgcaccagagaggccacgcccaggagagacccttcagctgcccccagtgcggcatcgacttcaacggccacagcgccctgatcagacaccagatgatccacaccggcgagagaccctacccctgcaccgactgcagcaagagcttcatgagaaaggagcacctgctgaaccacagaagactgcacaccggcgagagacccttcagctgcccccactgcggcaagagcttcatcagaaagcaccacctgatgaagcaccagagaatccacaccggcgagagaccctacccctgcagctactgcggcagaagcttcagatacaagcagaccctgaaggaccacctgagaagcggccacaacggcggctgcggcggcgacagcgaccccagcggccagccccccaacccccccggccccctgatcaccggcctggagaccagcggcctgggcgtgaacaccgagggcctggagaccaaccagtggtacggcgagggcagcggcggcggcgtgctgtag

SEQ ID NO: 10433 - DNA, 1416 bp, Artificial Sequence; identical to SEQ ID NO: 10429
  Description of Artificial Sequence: Synthetic coding sequence

SEQ ID NO: 10434 - DNA, 1416 bp, Artificial Sequence; identical to SEQ ID NO: 10429
  Description of Artificial Sequence: Synthetic coding sequence

SEQ ID NO: 10435 - DNA, 1944 bp, Artificial Sequence
  Description of Artificial Sequence: Synthetic coding sequence
atgatcggcctgatccagggcagaagactggccgagcagaccagcgagtgggacagcgagtgcctgaccagcctgcagcccctgcccctgcccaccccccccgccgccaacgaggcccacctgcagaccgccgccatcagcctgtggaccgtggtggccgccgtgcaggccatcgagagaaaggtggagatccacagcagaagactgctgcacctggagggcagaaccggcaccgccgagaagaagctggccagctgcgagaagaccgtgaccgagctgggcaaccagctggagggcaagtgggccgtgctgggcaccctgctgcaggagtacggcctgctgcagagaagactggagaacctggagaacctgctgagaaacagaaacttctggatcctgagactgccccccggcatcaagggcgacatccccaaggtgcccgtggccttcgacgacgtgagcatctacttcagcacccccgagtgggagaagctggaggagtggcagaaggagctgtacaagaacatcatgaagggcaactacgagagcctgatcagcatggactacgccatcaaccagcccgacgtgctgagccagatccagcccgagggcgagcacaacaccgaggaccaggccggccccgaggagagcgagatccccaccgaccccagcgaggagcccggcatcagcaccagcgacatcctgagctggatcaagcaggaggaggagccccaggtgggcgccccccccgagagcaaggagagcgacgtgtacaagagcacctacgccgacgaggagctggtgatcaaggccgagggcctggccagaagcagcctgtgccccgaggtgcccgtgcccttcagcagcccccccgccgccgccaaggacgccttcagcgacgtggccttcaagagccagcagagcaccagcatgacccccttcggcagacccgccaccgacctgcccgaggccagcgagggccaggtgaccttcacccagctgggcagctaccccctgcccccccccgtgggcgagcaggtgttcagctgccaccactgcggcaagaacctgagccaggacatgctgctgacccaccagtgcagccacgccaccgagcaccccctgccctgcgcccagtgccccaagcacttcaccccccaggccgacctgagcagcaccagccaggaccacgccagcgagaccccccccacctgcccccactgcgccagaaccttcacccaccccagcagactgacctaccacctgagagtgcacaacagcaccgagagacccttcccctgccccgactgccccaagagattcgccgaccaggccagactgaccagccacagaagagcccacgccagcgagagacccttcagatgcgcccagtgcggcagaagcttcagcctgaagatcagcctgctgctgcaccagagaggccacgcccaggagagacccttcagctgcccccagtgcggcatcgacttcaacggccacagcgccctgatcagacaccagatgatccacaccggcgagagaccctacccctgcaccgactgcagcaagagcttcatgagaaaggagcacctgctgaaccacagaagactgcacaccggcgagagacccttcagctgcccccactgcggcaagagcttcatcagaaagcaccacctgatgaagcaccagagaatccacaccggcgagagaccctacccctgcagctactgcggcagaagcttcagatacaagcagaccctgaaggaccacctgagaagcggccacaacggcggctgcggcggcgacagcgaccccagcggccagccccccaacccccccggccccctgatcaccggcctggagaccagcggcctgggcgtgaacaccgagggcctggagaccaaccagtggtacggcgagggcagcggcggcggcgtgctgtag

SEQ ID NO: 10436 - DNA, 6747 bp, Artificial Sequence
  Description of Artificial Sequence: Synthetic coding sequence
atgatggacagcgagaacaagcccgagaacgacgaggacgagaagatcaacaaggaggcccaggacctgaccaagctgagcagccacaacgaggacggcggccccgtgagcgacgtgatcgccagcttccccgagaacagcatgggcaagagaggcttcagcgagagcagcaacagcgacagcgtggtgatcggcgaggacagaaacaagcacgccagcaagagaagaaagctggacgaggccgagcccctgaagagcggcaagcagggcatctgcagactggagaccagcgagagcagcgtgaccgagggcggcatcgccctggacgagaccggcaaggagaccttcctgagcgactgcaccgtgggcggcacctgcctgcccaacgccctgagccccagctgcaacttcagcaccatcgacgtggtgagcctgaagaccgacaccgagaagaccagcgcccaggagatggtgagcctggacctggagagagagagccccttcccccccaaggagatcagcgtgagctgcaccatcggcaacgtggacaccgtgctgaagtgcagcatctgcggccacctgttcagcagctgcagcgacctggagaagcacgccgagagccacatgcagcagcccaaggagcacacctgctgccactgcagccacaaggccgagagcagcagcgccctgcacatgcacatcaagcaggcccacggcccccagaaggtgttcagctgcgacctgtgcggcttccagtgcagcgaggagaacctgctgaacgcccactacctgggcaagacccacctgagaagacagaacctggccgccagaggcggcttcgtgcagatcctgaccaagcagcccttccccaagaagagcagaaccatggccaccaagaacgtgcacagcaagcccagaaccagcaagagcatcgccaagaacagcgacagcaagggcctgagaaacgtgggcagcaccttcaaggacttcagaggcagcatcagcaagcagagcggcagcagcagcgagctgctggtggagatgatgcccagcagaaacaccctgagccaggaggtggagatcgtggaggagcacgtgaccagcctgggcctggcccagaaccccgagaaccagagcagaaagctggacaccctggtgaccagcgagggcctgctggagaagctggagagcaccaagaacaccctgcaggccgcccacggcaacagcgtgaccagcagacccagacccgagagaaacatcctggtgctgggcaacagcttcagaagaagaagcagcaccttcaccctgaagggccaggccaagaagagattcaacctgctgggcatcaagagaggcaccagcgagacccagagaatgtacatgaagcacctgagaacccagatgaagacccacgacgccgagagcgtgctgaagcacctggaggcctgcagcagcgtgcagagagtgtgcgtgaccaccagcgagacccaggaggccgagcagggccagggcagcgccagaccccccgacagcggcctgcacagcctgaccgtgaagcccgccagcggcagccagaccctgtgcgcctgcaccgactgcggccaggtggccaccaacagaaccgacctggagatccacgtgaagagatgccacgccagagagatgaagttctactgcagaacctgcgacttcagcagcatgagcagaagagacctggacgagcacctgcacagcaaccagcaccagcagaccgccagcgtgctgagctgccagtgctgcagcttcatcagcctggacgagatcaacctgagagaccacatgaaggagaagcacaacatgcacttcctgtgcaccccctgcaacctgttcttcctgagcgagaaggacgtggaggagcacaaggccaccgagaagcacatcaacagcctggtgcagcccaagaccctgcagagcagcaacagcgacctggtgctgcagaccctgcccctgagcaccctggagagcgagaacgccaaggagagcatggacgacagcggcaaggccagccaggaggagcccctgaagagcagagtgagccacggcaacgaggtgagacacagcagcaagccccagttccagtgcaagaagtgcttctacaagaccagaagcagcaccgtgctgaccagacacatcaagctgagacacggccaggactaccacttcctgtgcaaggcctgcaacctgtacagcctgagcaaggagggcatggagaagcacatcaagagaagcaagcacctggagaacgccaagaagaacaacatcggcctgagcttcgaggagtgcatcgagagagtgtgcatcggcgccaacgacaagaaggaggagttcgacgtgagcggcaacggcagaatcgagggccacatcggcgtgcagctgcaggagcacagctacctggagaagggcatgctggccagcgaggagctgagccagagcggcggcagcaccaaggacgacgagctggccagcaccaccacccccaagagaggcagacccaagggcaacatcagcagaacctgcagccactgcggcctgctggccagcagcatcaccaacctgaccgtgcacatcagaagaaagcacagccaccagtacagctacctgtgcaaggtgtgcaagtactacaccgtgaccaagggcgacatggagagacactgcgccaccaagaagcacaagggcagagtggagatcgaggccagcggcaagcacagcagcgacatcatcgtgggccccgagggcggcagcctggaggccggcaagaagaacgccggcagcgccgtgaccatgagcgacgagcacgccaacaagcccgccgagagccccaccagcgtgctggagaagcccgacagaggcaacagcatcgaggccgaggtggagaacgtgttccacagcctggacggcgaggtgaacagccacctgctggacaagaaggagcagatcagcagcgagcccgaggacttcgcccagcccggcgacgtgtacagccagagagacgtgaccggcaccggcgagaacaagtgcctgcactgcgagttcagcgcccacagcagcgccagcctggagctgcacgtgaagagaaagcacaccaaggagttcgagttctactgcatggcctgcgactactacgccgtgaccagaagagagatgaccagacacgccgccaccgagaagcacaagatgaagagacagagctacctgaacagcgccaacgtggaggccggcagcgccgacatgagcaagaacatcatcatgcccgaggaggagcaccagcagaacagcgaggagttccagatcatcagcggccagcccagcgacaccctgaagagcagaaacgccgccgactgcagcatcctgaacgagaacaccaacctggacatgagcaaggtgctgtgcgccgccgacagcgtggaggtggagaccgaggaggagagcaacttcaacgaggaccacagcttctgcgagaccttccagcaggcccccgtgaaggacaaggtgagaaagcccgaggagatgatgagcctgaccatgagcagcaactacggcagccccagcagattccagaacgagaacagcggcagcagcgccctgaactgcgagaccgccaagaagaaccacgagatcagcaacgacgccggcgagctgagagtgcactgcgagggcgagggcggcaacgccggcgacggcggcggcgtggtgccccacagacacctgtgccccgtgaccctggacggcgagagaagcgccgagagccccgtgctggtggtgaccagaatcaccagagagcagggcaacctggagagcggcggccagaacagagtggccagaggccacggcctggaggacctgaagggcgtgcaggaggaccccgtgctgggcaacaaggagatcctgatgaacagccagcacgagaccgagttcatcctggaggaggacggccccgccagcgacagcaccgtggagagcagcgacgtgtacgagaccatcatcagcatcgacgacaagggccaggccatgtacagcttcggcagattcgacagcagcatcatcagaatcaagaaccccgaggacggcgagctgatcgaccagagcgaggagggcctgatcgccaccggcgtgagaatcagcgagctgcccctgaaggactgcgcccagggcgtgaagaagaagaagagcgagggcagcagcatcggcgagagcaccagaatcagatgcgacgactgcggcttcctggccgacggcctgagcggcctgaacgtgcacatcgccatgaagcaccccaccaaggagaagcacttccactgcctgctgtgcggcaagagcttctacaccgagagcaacctgcaccagcacctggccagcgccggccacatgagaaacgagcaggccagcgtggaggagctgcccgagggcggcgccaccttcaagtgcgtgaagtgcaccgagcccttcgacagcgagcagaacctgttcctgcacatcaagggccagcacgaggagctgctgagagaggtgaacaagtacatcgtggaggacaccgagcagatcaacagagagagagaggagaaccagggcaacgtgtgcaagtactgcggcaagatgtgcagaagcagcaacagcatggccttcctggcccacatcagaacccacaccggcagcaagcccttcaagtgcaagatctgccacttcgccaccgcccagctgggcgacgccagaaaccacgtgaagagacacctgggcatgagagagtacaagtgccacgtgtgcggcgtggccttcgtgatgaagaagcacctgaacacccacctgctgggcaagcacggcgtgggcacccccaaggagagaaagttcacctgccacctgtgcgacagaagcttcaccgagaagtgggccctgaacaaccacatgaagctgcacaccggcgagaagcccttcaagtgcacctggcccacctgccactacagcttcctgaccgccagcgccatgaaggaccactacagaacccacaccggcgagaagagcttcctgtgcgacctgtgcggcttcgccggcggcaccagacacgccctgaccaagcacagaagacagcacaccggcgagaagcccttcaagtgcgacgagtgcaacttcgccagcaccacccagagccacctgaccagacacaagagagtgcacaccggcgagaagccctacagatgcccctggtgcgactacagaagcaactgcgccgagaacatcagaaagcacatcctgcacaccggcaagcacgagggcgtgaagatgtacaactgccccaagtgcgactacggcaccaacgtgcccgtggagttcagaaaccacctgaaggagcagcaccccgacatcgagaaccccgacctggcctacctgcacgccggcatcgtgagcaagagctacgagtgcagactgaagggccagggcgccaccttcgtggagaccgacagccccttcaccgccgccgccctggccgaggagcccctggtgaaggagaagcccctgagaagcagcagaagacccgcccccccccccgagcaggtgcagcaggtgatcatcttccagggctacgacggcgagttcgccctggaccccagcgtggaggagaccgccgccgccaccctgcagaccctggccatggccggccaggtggccagagtggtgcacatcaccgaggacggccaggtgatcgccaccagccagagcggcgcccacgtgggcagcgtggtgcccggccccatcctgcccgagcagctggccgacggcgccacccaggtggtggtggtgggcggcagcatggagggccacggcatggacgagagcctgagccccggcggcgccgtgatccagcaggtgaccaagcaggagatcctgaacctgagcgaggccggcgtggccccccccgaggccagcagcgccctggacgccctgctgtgcgccgtgaccgagctgggcgaggtggagggcagagccggcctggaggagcagggcagacccggcgccaaggacgtgctgatccagctgcccggccaggaggtgagccacgtggccgccgaccccgaggcccccgagatccagatgttcccccaggcccaggagagccccgccgccgtggaggtgctgacccaggtggtgcaccccagcgccgccatggccagccaggagagagcccaggtggccttcaagaagatggtgcagggcgtgctgcagttcgccgtgtgcgacaccgccgccgccggccagctggtgaaggacggcgtgacccaggtggtggtgagcgaggagggcgccgtgcacatggtggccggcgagggcgcccagatcatcatgcaggaggcccagggcgagcacatggacctggtggagagcgacggcgagatcagccagatcatcgtgaccgaggagctggtgcaggccatggtgcaggagagcagcggcggcttcagcgagggcaccacccactacatcctgaccgagctgccccccggcgtgcaggacgagcccggcctgtacagccacaccgtgctggagaccgccgacagccaggagctgctgcaggccggcgccaccctgggcaccgaggccggcgcccccagcagagccgagcagctggccagcgtggtgatctacacccaggagggcagcagcgccgccgccgccatccagagccagagagagagcagcgagctgcaggaggcctag

SEQ ID NO: 10437 - DNA, 4983 bp, Artificial Sequence
  Description of Artificial Sequence: Synthetic coding sequence
atgatggacagcgagaacaagcccgagaacgacgaggacgagaagatcaacaaggaggcccaggacctgaccaagctgagcagccacaacgaggacggcggccccgtgagcgacgtgatcgccagcttccccgagaacagcatgggcaagagaggcttcagcgagagcagcaacagcgacagcgtggtgatcggcgaggacagaaacaagcacgccagcaagagaagaaagctggacgaggccgagcccctgaagagcggcaagcagggcatctgcagactggagaccagcgagagcagcgtgaccgagggcggcatcgccctggacgagaccggcaaggagaccttcctgagcgactgcaccgtgggcggcacctgcctgcccaacgccctgagccccagctgcaacttcagcaccatcgacgtggtgagcctgaagaccgacaccgagaagaccagcgcccaggagatggtgagcctggacctggagagagagagccccttcccccccaaggagatcagcgtgagctgcaccatcggcaacgtggacaccgtgctgaagtgcagcatctgcggccacctgttcagcagctgcagcgacctggagaagcacgccgagagccacatgcagcagcccaaggagcacacctgctgccactgcagccacaaggccgagagcagcagcgccctgcacatgcacatcaagcaggcccacggcccccagaaggtgttcagctgcgacctgtgcggcttccagtgcagcgaggagaacctgctgaacgcccactacctgggcaagacccacctgagaagacagaacctggccgccagaggcggcttcgtgcagatcctgaccaagcagcccttccccaagaagagcagaaccatggccaccaagaacgtgcacagcaagcccagaaccagcaagagcatcgccaagaacagcgacagcaagggcctgagaaacgtgggcagcaccttcaaggacttcagaggcagcatcagcaagcagagcggcagcagcagcgagctgctggtggagatgatgcccagcagaaacaccctgagccaggaggtggagatcgtggaggagcacgtgaccagcctgggcctggcccagaaccccgagaaccagagcagaaagctggacaccctggtgaccagcgagggcctgctggagaagctggagagcaccaagaacaccctgcaggccgcccacggcaacagcgtgaccagcagacccagacccgagagaaacatcctggtgctgggcaacagcttcagaagaagaagcagcaccttcaccctgaagggccaggccaagaagagattcaacctgctgggcatcaagagaggcaccagcgagacccagagaatgtacatgaagcacctgagaacccagatgaagacccacgacgccgagagcgtgctgaagcacctggaggcctgcagcagcgtgcagagagtgtgcgtgaccaccagcgagacccaggaggccgagcagggccagggcagcgccagaccccccgacagcggcctgcacagcctgaccgtgaagcccgccagcggcagccagaccctgtgcgcctgcaccgactgcggccaggtggccaccaacagaaccgacctggagatccacgtgaagagatgccacgccagagagatgaagttctactgcagaacctgcgacttcagcagcatgagcagaagagacctggacgagcacctgcacagcaaccagcaccagcagaccgccagcgtgctgagctgccagtgctgcagcttcatcagcctggacgagatcaacctgagagaccacatgaaggagaagcacaacatgcacttcctgtgcaccccctgcaacctgttcttcctgagcgagaaggacgtggaggagcacaaggccaccgagaagcacatcaacagcctggtgcagcccaagaccctgcagagcagcaacagcgacctggtgctgcagaccctgcccctgagcaccctggagagcgagaacgccaaggagagcatggacgacagcggcaaggccagccaggaggagcccctgaagagcagagtgagccacggcaacgaggtgagacacagcagcaagccccagttccagtgcaagaagtgcttctacaagaccagaagcagcaccgtgctgaccagacacatcaagctgagacacggccaggactaccacttcctgtgcaaggcctgcaacctgtacagcctgagcaaggagggcatggagaagcacatcaagagaagcaagcacctggagaacgccaagaagaacaacatcggcctgagcttcgaggagtgcatcgagagagtgtgcatcggcgccaacgacaagaaggaggagttcgacgtgagcggcaacggcagaatcgagggccacatcggcgtgcagctgcaggagcacagctacctggagaagggcatgctggccagcgaggagctgagccagagcggcggcagcaccaaggacgacgagctggccagcaccaccacccccaagagaggcagacccaagggcaacatcagcagaacctgcagccactgcggcctgctggccagcagcatcaccaacctgaccgtgcacatcagaagaaagcacagccaccagtacagctacctgtgcaaggtgtgcaagtactacaccgtgaccaagggcgacatggagagacactgcgccaccaagaagcacaagggcagagtggagatcgaggccagcggcaagcacagcagcgacatcatcgtgggccccgagggcggcagcctggaggccggcaagaagaacgccggcagcgccgtgaccatgagcgacgagcacgccaacaagcccgccgagagccccaccagcgtgctggagaagcccgacagaggcaacagcatcgaggccgaggtggagaacgtgttccacagcctggacggcgaggtgaacagccacctgctggacaagaaggagcagatcagcagcgagcccgaggacttcgcccagcccggcgacgtgtacagccagagagacgtgaccggcaccggcgagaacaagtgcctgcactgcgagttcagcgcccacagcagcgccagcctggagctgcacgtgaagagaaagcacaccaaggagttcgagttctactgcatggcctgcgactactacgccgtgaccagaagagagatgaccagacacgccgccaccgagaagcacaagatgaagagacagagctacctgaacagcgccaacgtggaggccggcagcgccgacatgagcaagaacatcatcatgcccgaggaggagcaccagcagaacagcgaggagttccagatcatcagcggccagcccagcgacaccctgaagagcagaaacgccgccgactgcagcatcctgaacgagaacaccaacctggacatgagcaaggtgctgtgcgccgccgacagcgtggaggtggagaccgaggaggagagcaacttcaacgaggaccacagcttctgcgagaccttccagcaggcccccgtgaaggacaaggtgagaaagcccgaggagatgatgagcctgaccatgagcagcaactacggcagccccagcagattccagaacgagaacagcggcagcagcgccctgaactgcgagaccgccaagaagaaccacgagatcagcaacgacgccggcgagctgagagtgcactgcgagggcgagggcggcaacgccggcgacggcggcggcgtggtgccccacagacacctgtgccccgtgaccctggacggcgagagaagcgccgagagccccgtgctggtggtgaccagaatcaccagagagcagggcaacctggagagcggcggccagaacagagtggccagaggccacggcctggaggacctgaagggcgtgcaggaggaccccgtgctgggcaacaaggagatcctgatgaacagccagcacgagaccgagttcatcctggaggaggacggccccgccagcgacagcaccgtggagagcagcgacgtgtacgagaccatcatcagcatcgacgacaagggccaggccatgtacagcttcggcagattcgacagcagcatcatcagaatcaagaaccccgaggacggcgagctgatcgaccagagcgaggagggcctgatcgccaccggcgtgagaatcagcgagctgcccctgaaggactgcgcccagggcgtgaagaagaagaagagcgagggcagcagcatcggcgagagcaccagaatcagatgcgacgactgcggcttcctggccgacggcctgagcggcctgaacgtgcacatcgccatgaagcaccccaccaaggagaagcacttccactgcctgctgtgcggcaagagcttctacaccgagagcaacctgcaccagcacctggccagcgccggccacatgagaaacgagcaggccagcgtggaggagctgcccgagggcggcgccaccttcaagtgcgtgaagtgcaccgagcccttcgacagcgagcagaacctgttcctgcacatcaagggccagcacgaggagctgctgagagaggtgaacaagtacatcgtggaggacaccgagcagatcaacagagagagagaggagaaccagggcaacgtgtgcaagtactgcggcaagatgtgcagaagcagcaacagcatggccttcctggcccacatcagaacccacaccggcagcaagcccttcaagtgcaagatctgccacttcgccaccgcccagctgggcgacgccagaaaccacgtgaagagacacctgggcatgagagagtacaagtgccacgtgtgcggcgtggccttcgtgatgaagaagcacctgaacacccacctgctgggcaagcacggcgtgggcacccccaaggagagagtgaaggtggcctacagaaagatcggcaccctgcccggcatccagaacaacagaaacgccagcagcgccagcgaggcccagagcctgtgcgagcacttcagctag

SEQ ID NO: 10438 - DNA, 5448 bp, Artificial Sequence
  Description of Artificial Sequence: Synthetic coding sequence
atgatggacagcgagaacaagcccgagaacgacgaggacgagaagatcaacaaggaggcccaggacctgaccaagctgagcagccacaacgaggacggcggccccgtgagcgacgtgatcgccagcttccccgagaacagcatgggcaagagaggcttcagcgagagcagcaacagcgacagcgtggtgatcggcgaggacagaaacaagcacgccagcaagagaagaaagctggacgaggccgagcccctgaagagcggcaagcagggcatctgcagactggagaccagcgagagcagcgtgaccgagggcggcatcgccctggacgagaccggcaaggagaccttcctgagcgactgcaccgtgggcggcacctgcctgcccaacgccctgagccccagctgcaacttcagcaccatcgacgtggtgagcctgaagaccgacaccgagaagaccagcgcccaggagatggtgagcctggacctggagagagagagccccttcccccccaaggagatcagcgtgagctgcaccatcggcaacgtggacaccgtgctgaagtgcagcatctgcggccacctgttcagcagctgcagcgacctggagaagcacgccgagagccacatgcagcagcccaaggagcacacctgctgccactgcagccacaaggccgagagcagcagcgccctgcacatgcacatcaagcaggcccacggcccccagaaggtgttcagctgcgacctgtgcggcttccagtgcagcgaggagaacctgctgaacgcccactacctgggcaagacccacctgagaagacagaacctggccgccagaggcggcttcgtgcagatcctgaccaagcagcccttccccaagaagagcagaaccatggccaccaagaacgtgcacagcaagcccagaaccagcaagagcatcgccaagaacagcgacagcaagggcctgagaaacgtgggcagcaccttcaaggacttcagaggcagcatcagcaagcagagcggcagcagcagcgagctgctggtggagatgatgcccagcagaaacaccctgagccaggaggtggagatcgtggaggagcacgtgaccagcctgggcctggcccagaaccccgagaaccagagcagaaagctggacaccctggtgaccagcgagggcctgctggagaagctggagagcaccaagaacaccctgcaggccgcccacggcaacagcgtgaccagcagacccagacccgagagaaacatcctggtgctgggcaacagcttcagaagaagaagcagcaccttcaccctgaagggccaggccaagaagagattcaacctgctgggcatcaagagaggcaccagcgagacccagagaatgtacatgaagcacctgagaacccagatgaagacccacgacgccgagagcgtgctgaagcacctggaggcctgcagcagcgtgcagagagtgtgcgtgaccaccagcgagacccaggaggccgagcagggccagggcagcgccagaccccccgacagcggcctgcacagcctgaccgtgaagcccgccagcggcagccagaccctgtgcgcctgcaccgactgcggccaggtggccaccaacagaaccgacctggagatccacgtgaagagatgccacgccagagagatgaagttctactgcagaacctgcgacttcagcagcatgagcagaagagacctggacgagcacctgcacagcaaccagcaccagcagaccgccagcgtgctgagctgccagtgctgcagcttcatcagcctggacgagatcaacctgagagaccacatgaaggagaagcacaacatgcacttcctgtgcaccccctgcaacctgttcttcctgagcgagaaggacgtggaggagcacaaggccaccgagaagcacatcaacagcctggtgcagcccaagaccctgcagagcagcaacagcgacctggtgctgcagaccctgcccctgagcaccctggagagcgagaacgccaaggagagcatggacgacagcggcaaggccagccaggaggagcccctgaagagcagagtgagccacggcaacgaggtgagacacagcagcaagccccagttccagtgcaagaagtgcttctacaagaccagaagcagcaccgtgctgaccagacacatcaagctgagacacggccaggactaccacttcctgtgcaaggcctgcaacctgtacagcctgagcaaggagggcatggagaagcacatcaagagaagcaagcacctggagaacgccaagaagaacaacatcggcctgagcttcgaggagtgcatcgagagagtgtgcatcggcgccaacgacaagaaggaggagttcgacgtgagcggcaacggcagaatcgagggccacatcggcgtgcagctgcaggagcacagctacctggagaagggcatgctggccagcgaggagctgagccagagcggcggcagcaccaaggacgacgagctggccagcaccaccacccccaagagaggcagacccaagggcaacatcagcagaacctgcagccactgcggcctgctggccagcagcatcaccaacctgaccgtgcacatcagaagaaagcacagccaccagtacagctacctgtgcaaggtgtgcaagtactacaccgtgaccaagggcgacatggagagacactgcgccaccaagaagcacaagggcagagtggagatcgaggccagcggcaagcacagcagcgacatcatcgtgggccccgagggcggcagcctggaggccggcaagaagaacgccggcagcgccgtgaccatgagcgacgagcacgccaacaagcccgccgagagccccaccagcgtgctggagaagcccgacagaggcaacagcatcgaggccgaggtggagaacgtgttccacagcctggacggcgaggtgaacagccacctgctggacaagaaggagcagatcagcagcgagcccgaggacttcgcccagcccggcgacgtgtacagccagagagacgtgaccggcaccggcgagaacaagtgcctgcactgcgagttcagcgcccacagcagcgccagcctggagctgcacgtgaagagaaagcacaccaaggagttcgagttctactgcatggcctgcgactactacgccgtgaccagaagagagatgaccagacacgccgccaccgagaagcacaagatgaagagacagagctacctgaacagcgccaacgtggaggccggcagcgccgacatgagcaagaacatcatcatgcccgaggaggagcaccagcagaacagcgaggagttccagatcatcagcggccagcccagcgacaccctgaagagcagaaacgccgccgactgcagcatcctgaacgagaacaccaacctggacatgagcaaggtgctgtgcgccgccgacagcgtggaggtggagaccgaggaggagagcaacttcaacgaggaccacagcttctgcgagaccttccagcaggcccccgtgaaggacaaggtgagaaagcccgaggagatgatgagcctgaccatgagcagcaactacggcagccccagcagattccagaacgagaacagcggcagcagcgccctgaactgcgagaccgccaagaagaaccacgagatcagcaacgacgccggcgagctgagagtgcactgcgagggcgagggcggcaacgccggcgacggcggcggcgtggtgccccacagacacctgtgccccgtgaccctggacggcgagagaagcgccgagagccccgtgctggtggtgaccagaatcaccagagagcagggcaacctggagagcggcggccagaacagagtggccagaggccacggcctggaggacctgaagggcgtgcaggaggaccccgtgctgggcaacaaggagatcctgatgaacagccagcacgagaccgagttcatcctggaggaggacggccccgccagcgacagcaccgtggagagcagcgacgtgtacgagaccatcatcagcatcgacgacaagggccaggccatgtacagcttcggcagattcgacagcagcatcatcagaatcaagaaccccgaggacggcgagctgatcgaccagagcgaggagggcctgatcgccaccggcgtgagaatcagcgagctgcccctgaaggactgcgcccagggcgtgaagaagaagaagagcgagggcagcagcatcggcgagagcaccagaatcagatgcgacgactgcggcttcctggccgacggcctgagcggcctgaacgtgcacatcgccatgaagcaccccaccaaggagaagcacttccactgcctgctgtgcggcaagagcttctacaccgagagcaacctgcaccagcacctggccagcgccggccacatgagaaacgagcaggccagcgtggaggagctgcccgagggcggcgccaccttcaagtgcgtgaagtgcaccgagcccttcgacagcgagcagaacctgttcctgcacatcaagggccagcacgaggagctgctgagagaggtgaacaagtacatcgtggaggacaccgagcagatcaacagagagagagaggagaaccagggcaacgtgtgcaagtactgcggcaagatgtgcagaagcagcaacagcatggccttcctggcccacatcagaacccacaccggcagcaagcccttcaagtgcaagatctgccacttcgccaccgcccagctgggcgacgccagaaaccacgtgaagagacacctgggcatgagagagtacaagtgccacgtgtgcggcgtggccttcgtgatgaagaagcacctgaacacccacctgctgggcaagcacggcgtgggcacccccaaggagagaaagttcacctgccacctgtgcgacagaagcttcaccgagaagtgggccctgaacaaccacatgaagctgcacaccggcgagaagcccttcaagtgcacctggcccacctgccactacagcttcctgaccgccagcgccatgaaggaccactacagaacccacaccggcgagaagagcttcctgtgcgacctgtgcggcttcgccggcggcaccagacacgccctgaccaagcacagaagacagcacaccggcgagaagcccttcaagtgcgacgagtgcaacttcgccagcaccacccagagccacctgaccagacacaagagagtgcacaccggcgagaagccctacagatgcccctggtgcgactacagaagcaactgcgccgagaacatcagaaagcacatcctgcacaccggcaagcacgagggcgtgaagatgtacaactgccccaagtgcgactacggcaccaacgtgcccgtggagttcagaaaccacctgaaggagcagcaccccgacatcgagaaccccgacctggcctacctgcacgccggcaagggccagaagctgtag

SEQ ID NO: 10439 - DNA, 4983 bp, Artificial Sequence; identical to SEQ ID NO: 10437
  Description of Artificial Sequence: Synthetic coding sequence

SEQ ID NO: 10440 - DNA, 2163 bp, Artificial Sequence
  Description of Artificial Sequence: Synthetic coding sequence
atggaggaggccgaggagctgctgctggagggcaagaaggccctgcagctggccagagagcccagactgggcctggacctgggctggaaccccagcggcgagggctgcacccagggcctgaaggacgtgccccccgagcccaccagagacatcctggccctgaagagcctgcccagaggcctggccctgggccccagcctggccaaggagcagagactgggcgtgtggtgcgtgggcgaccccctgcagcccggcctgctgtggggccccctggaggaggagagcgccagcaaggagaagggcgagggcgtgaagcccagacaggaggagaacctgagcctgggcccctggggcgacgtgtgcgcctgcgagcagagcagcggctggaccagcctggtgcagagaggcagactggagagcgagggcaacgtggcccccgtgagaatcagcgagagactgcacctgcaggtgtaccagctggtgctgcccggcagcgagctgctgctgtggccccagcccagcagcgagggccccagcctgacccagcccggcctggacaaggaggccgccgtggccgtggtgaccgaggtggagagcgccgtgcagcaggaggtggccagccccggcgaggacgccgccgagccctgcatcgaccccggcagccagagccccagcggcatccaggccgagaacatggtgagccccggcctgaagttccccacccaggacagaatcagcaaggacagccagcccctgggccccctgctgcaggacggcgacgtggacgaggagtgccccgcccaggcccagatgccccccgagctgcagagcaacagcgccacccagcaggaccccgacggcagcggcgccagcttcagcagcagcgccagaggcacccagccccacggctacctggccaagaagctgcacagccccagcgaccagtgcccccccagagccaagacccccgagcccggcgcccagcagagcggcttccccaccctgagcagaagcccccccggccccgccggcagcagccccaagcagggcagaagatacagatgcggcgagtgcggcaaggccttcctgcagctgtgccacctgaagaagcacgccttcgtgcacaccggccacaagcccttcctgtgcaccgagtgcggcaagagctacagcagcgaggagagcttcaaggcccacatgctgggccacagaggcgtgagacccttcccctgcccccagtgcgacaaggcctacggcacccagagagacctgaaggagcaccaggtggtgcacagcggcgccagacccttcgcctgcgaccagtgcggcaaggccttcgccagaagacccagcctgagactgcacagaaagacccaccaggtgcccgccgcccccgccccctgcccctgccccgtgtgcggcagacccctggccaaccagggcagcctgagaaaccacatgagactgcacaccggcgagaagcccttcctgtgcccccactgcggcagagccttcagacagagaggcaacctgagaggccacctgagactgcacaccggcgagagaccctacagatgcccccactgcgccgacgccttcccccagctgcccgagctgagaagacacctgatcagccacaccggcgaggcccacctgtgccccgtgtgcggcaaggccctgagagacccccacaccctgagagcccacgagagactgcacagcggcgagagacccttcccctgcccccagtgcggcagagcctacaccctggccaccaagctgagaagacacctgaagagccacctggaggacaagccctacagatgccccacctgcggcatgggctacaccctgccccagagcctgagaagacaccagctgagccacagacccgaggccccctgcagcccccccagcgtgcccagcgccgccagcgagcccaccgtggtgctgctgcaggccgagccccagctgctggacacccacagagaggaggaggtgagccccgccagagacgtggtggaggtgaccatcagcgagagccaggagaagtgcttcgtggtgcccgaggagcccgacgccgcccccagcctggtgctgatccacaaggacatgggcctgggcgcctgggccgaggtggtggaggtggagatgggcacctag

SEQ ID NO: 10441 - DNA, 597 bp, Artificial Sequence
  Description of Artificial Sequence: Synthetic coding sequence
atggagaagcccgccggcagaaagaagaagacccccacccccagagaggaggccgacgtgcagaagagcgccctgagagaggagaaggtgagcggcgacagaaagccccccgagagacccaccgtgcccagaaagcccagaaccgagccctgcctgagccccgaggacgaggagcacgtgttcgacgccttcgacgccagcttcaaggacgacttcgagggcgtgcccgtgttcatccccttccagagaaagaagccctacgagtgcagcgagtgcggcagaatcttcaagcacaagaccgaccacatcagacaccagagagtgcacaccggcgagaagcccttcaagtgcgcccagtgcggcaaggccttcagacacagcagcgacgtgaccaagcaccagagaacccacaccggcgagaagcccttcaagtgcggcgagtgcggcaaggccttcaactgcggcagcaacctgctgaagcaccagaagacccacaccggcgagaagccctacgagtgcacccactgcggcaaggccttcgcctacagcagctgcctgatcagacaccagaagagacaccccagaaagaagccctag

SEQ ID NO: 10442 - DNA, 597 bp, Artificial Sequence; identical to SEQ ID NO: 10441
  Description of Artificial Sequence: Synthetic coding sequence

SEQ ID NO: 10443 - DNA, 597 bp, Artificial Sequence; identical to SEQ ID NO: 10441
  Description of Artificial Sequence: Synthetic coding sequence

SEQ ID NO: 10444 - DNA, 1296 bp, Artificial Sequence
  Description of Artificial Sequence: Synthetic coding sequence
atgctgagcgacgagctggagagcaagcccgagctgctggtgcagttcgtgcagaacaccagcatccccctgggccagggcctggtggagagcgaggccaaggacatcacctgcctgagcctgctgcccgtgaccgaggccagcgagtgcagcagactgatgctgcccgacgacaccaccaaccacagcaacagcagcaaggaggtgcccagcagcgccgtgctgagaagcctgagagtgaacgtgggccccgacggcgaggagaccagagcccagaccgtgcagaagagccccgagttcctgagcaccagcgagagcagcagcctgctgcaggacctgcagcccagcgacagcaccagcttcatcctgctgaacctgaccagagccggcctgggcagcagcgccgagcacctggtgttcgtgcaggacgaggccgaggacagcggcaacgacttcctgagcagcgagagcaccgacagcagcatcccctggttcctgagagtgcaggagctggcccacgacagcctgatcgccgccaccagagcccagctggccaagaacgccaagaccagcagcaacggcgagaacgtgcacctgggcagcggcgacggccagagcaaggacagcggccccctgccccaggtggagaagaagctgaagtgcaccgtggagggctgcgacagaaccttcgtgtggcccgcccacttcaagtaccacctgaagacccacagaaacgacagaagcttcatctgccccgccgagggctgcggcaagagcttctacgtgctgcagagactgaaggtgcacatgagaacccacaacggcgagaagcccttcatgtgccacgagagcggctgcggcaagcagttcaccaccgccggcaacctgaagaaccacagaagaatccacaccggcgagaagcccttcctgtgcgaggcccagggctgcggcagaagcttcgccgagtacagcagcctgagaaagcacctggtggtgcacagcggcgagaagccccaccagtgccaggtgtgcggcaagaccttcagccagagcggcagcagaaacgtgcacatgagaaagcaccacctgcagctgggcgccgccggcagccaggagcaggagcagaccgaggtgctggccgagggcagccccagaagcctgagcagcgtgcccgacgtgacccaccacctggtgaccatgcagagcggcagacagagctacgaggtgagcgtgctgaccgccgtgaacccccaggagctgctgaaccagggcgacctgaccgagagaagaacctag

SEQ ID NO: 10445 - DNA, 1278 bp, Artificial Sequence
  Description of Artificial Sequence: Synthetic coding sequence
atgctgcccgacgacaccaccaaccacagcaacagcagcaaggaggtgcccagcagcgccgtgctgagaagcctgagagtgaacgtgggccccgacggcgaggagaccagagcccagaccgtgcagaagagccccgagttcctgagcaccagcgagagcagcagcctgctgcaggacctgcagcccagcgacagcaccagcttcatcctgctgaacctgaccagagccggcctgggcagcagcgccgagcacctggtgttcgtgcaggacgaggccgaggacagcggcaacgacttcctgagcagcgagagcaccgacagcagcatcccctggttcctgagagtgcaggagctggcccacgacagcctgatcgccgccaccagagcccagctggccaagaacgccaagaccagcagcaacggcgagaacgtgcacctgggcagcggcgacggccagagcaaggacagcggccccctgccccaggtggagaagaagctgaagtgcaccgtggagggctgcgacagaaccttcgtgtggcccgcccacttcaagtaccacctgaagacccacagaaacgacagaagcttcatctgccccgccgagggctgcggcaagagcttctacgtgctgcagagactgaaggtgcacatgagaacccacaacggcgagaagcccttcatgtgccacgagagcggctgcggcaagcagttcaccaccgccggcaacctgaagaaccacagaagaatccacaccggcgagaagcccttcctgtgcgaggcccagggctgcggcagaagcttcgccgagtacagcagcctgagaaagcacctggtggtgcacagcggcgagaagccccaccagtgccaggtgtgcggcaagaccttcagccagagcggcagcagaaacgtgcacatgagaaagcaccacctgcagctgggcgccgccggcagccaggagcaggagcagaccgccgagcccctgatgggcagcagcctgctggaggaggccagcgtgcccagcaagaacctggtgagcatgaacagccagcccagcctgggcggcgagagcctgaacctgcccaacaccaacagcatcctgggcgtggacgacgaggtgctggccgagggcagccccagaagcctgagcagcgtgcccgacgtgacccaccacctggtgaccatgcagagcggcagacagagctacgaggtgagcgtgctgaccgccgtgaacccccaggagctgctgaaccagggcgacctgaccgagagaagaacctag

SEQ ID NO: 10446 - DNA, 1551 bp, Artificial Sequence
  Description of Artificial Sequence: Synthetic coding sequence
atgctgagcgacgagctggagagcaagcccgagctgctggtgcagttcgtgcagaacaccagcatccccctgggccagggcctggtggagagcgaggccaaggacatcacctgcctgagcctgctgcccgtgaccgaggccagcgagtgcagcagactgatgctgcccgagcccgtgccctggagagaggaggacggcaagagcggctgcagcgacctgaacgacaccaccaaccacagcaacagcagcaaggaggtgcccagcagcgccgtgctgagaagcctgagagtgaacgtgggccccgacggcgaggagaccagagcccagaccgtgcagaagagccccgagttcctgagcaccagcgagagcagcagcctgctgcaggacctgcagcccagcgacagcaccagcttcatcctgctgaacctgaccagagccggcctgggcagcagcgccgagcacctggtgttcgtgcaggacgaggccgaggacagcggcaacgacttcctgagcagcgagagcaccgacagcagcatcccctggttcctgagagtgcaggagctggcccacgacagcctgatcgccgccaccagagcccagctggccaagaacgccaagaccagcagcaacggcgagaacgtgcacctgggcagcggcgacggccagagcaaggacagcggccccctgccccaggtggagaagaagctgaagtgcaccgtggagggctgcgacagaaccttcgtgtggcccgcccacttcaagtaccacctgaagacccacagaaacgacagaagcttcatctgccccgccgagggctgcggcaagagcttctacgtgctgcagagactgaaggtgcacatgagaacccacaacggcgagaagcccttcatgtgccacgagagcggctgcggcaagcagttcaccaccgccggcaacctgaagaaccacagaagaatccacaccggcgagaagcccttcctgtgcgaggcccagggctgcggcagaagcttcgccgagtacagcagcctgagaaagcacctggtggtgcacagcggcgagaagccccaccagtgccaggtgtgcggcaagaccttcagccagagcggcagcagaaacgtgcacatgagaaagcaccacctgcagctgggcgccgccggcagccaggagcaggagcagaccgccgagcccctgatgggcagcagcctgctggaggaggccagcgtgcccagcaagaacctggtgagcatgaacagccagcccagcctgggcggcgagagcctgaacctgcccaacaccaacagcatcctgggcgtggacgacgaggtgctggccgagggcagccccagaagcctgagcagcgtgcccgacgtgacccaccacctggtgaccatgcagagcggcagacagagctacgaggtgagcgtgctgaccgccgtgaacccccaggagagcctggcccccctgcccagactggagtgcagcggcgccttcagcgcccactgcaacctgtgcctgcccggcagcagcgacagccccgccagcgccagctag

SEQ ID NO: 10447 - DNA, 1404 bp, Artificial Sequence
  Description of Artificial Sequence: Synthetic coding sequence
atgctgagcgacgagctggagagcaagcccgagctgctggtgcagttcgtgcagaacaccagcatccccctgggccagggcctggtggagagcgaggccaaggacatcacctgcctgagcctgctgcccgtgaccgaggccagcgagtgcagcagactgatgctgcccgacgacaccaccaaccacagcaacagcagcaaggaggtgcccagcagcgccgtgctgagaagcctgagagtgaacgtgggccccgacggcgaggagttcctgagcaccagcgagagcagcagcctgctgcaggacctgcagcccagcgacagcaccagcttcatcctgctgaacctgaccagagccggcctgggcagcagcgccgagcacctggtgttcgtgcaggacgaggccgaggacagcggcaacgacttcctgagcagcgagagcaccgacagcagcatcccctggttcctgagagtgcaggagctggcccacgacagcctgatcgccgccaccagagcccagctggccaagaacgccaagaccagcagcaacggcgagaacgtgcacctgggcagcggcgacggccagagcaaggacagcggccccctgccccaggtggagaagaagctgaagtgcaccgtggagggctgcgacagaaccttcgtgtggcccgcccacttcaagtaccacctgaagacccacagaaacgacagaagcttcatctgccccgccgagggctgcggcaagagcttctacgtgctgcagagactgaaggtgcacatgagaacccacaacggcgagaagcccttcatgtgccacgagagcggctgcggcaagcagttcaccaccgccggcaacctgaagaaccacagaagaatccacaccggcgagaagcccttcctgtgcgaggcccagggctgcggcagaagcttcgccgagtacagcagcctgagaaagcacctggtggtgcacagcggcgagaagccccaccagtgccaggtgtgcggcaagaccttcagccagagcggcagcagaaacgtgcacatgagaaagcaccacctgcagctgggcgccgccggcagccaggagcaggagcagaccgccgagcccctgatgggcagcagcctgctggaggaggccagcgtgcccagcaagaacctggtgagcatgaacagccagcccagcctgggcggcgagagcctgaacctgcccaacaccaacagcatcctgggcgtggacgacgaggtgctggccgagggcagccccagaagcctgagcagcgtgcccgacgtgacccaccacctggtgaccatgcagagcggcagacagagctacgaggtgagcgtgctgaccgccgtgaacccccaggagctgctgaaccagggcgacctgaccgagagaagaacctag

SEQ ID NO: 10448 - DNA, 1218 bp, Artificial Sequence
  Description of Artificial Sequence: Synthetic coding sequence
atgctgagcgacgagctggagagcaagcccgagctgctggtgcagttcgtgcagaacaccagcatccccctgggccagggcctggtggagagcgaggccaaggacatcacctgcctgagcctgctgcccgtgaccgaggccagcgagtgcagcagactgatgctgcccggcctgggcagcagcgccgagcacctggtgttcgtgcaggacgaggccgaggacagcggcaacgacttcctgagcagcgagagcaccgacagcagcatcccctggttcctgagagtgcaggagctggcccacgacagcctgatcgccgccaccagagcccagctggccaagaacgccaagaccagcagcaacggcgagaacgtgcacctgggcagcggcgacggccagagcaaggacagcggccccctgccccaggtggagaagaagctgaagtgcaccgtggagggctgcgacagaaccttcgtgtggcccgcccacttcaagtaccacctgaagacccacagaaacgacagaagcttcatctgccccgccgagggctgcggcaagagcttctacgtgctgcagagactgaaggtgcacatgagaacccacaacggcgagaagcccttcatgtgccacgagagcggctgcggcaagcagttcaccaccgccggcaacctgaagaaccacagaagaatccacaccggcgagaagcccttcctgtgcgaggcccagggctgcggcagaagcttcgccgagtacagcagcctgagaaagcacctggtggtgcacagcggcgagaagccccaccagtgccaggtgtgcggcaagaccttcagccagagcggcagcagaaacgtgcacatgagaaagcaccacctgcagctgggcgccgccggcagccaggagcaggagcagaccgccgagcccctgatgggcagcagcctgctggaggaggccagcgtgcccagcaagaacctggtgagcatgaacagccagcccagcctgggcggcgagagcctgaacctgcccaacaccaacagcatcctgggcgtggacgacgaggtgctggccgagggcagccccagaagcctgagcagcgtgcccgacgtgacccaccacctggtgaccatgcagagcggcagacagagctacgaggtgagcgtgctgaccgccgtgaacccccaggagctgctgaaccagggcgacctgaccgagagaagaacctag

SEQ ID NO: 10449 - DNA, 213 bp, Artificial Sequence
  Description of Artificial Sequence: Synthetic coding sequence
atgctgagcgacgagctggagagcaagcccgagctgctggtgcagttcgtgcagaacaccagcatccccctgggccagggcctggtggagagcgaggccaaggacatcacctgcctgagcctgctgcccgtgaccgaggccagcgagtgcagcagactgatgctgcccgacgacaccaccaaccacagcaacagcagcaaggaggtgccctag

SEQ ID NO: 10450 - DNA, 1437 bp, Artificial Sequence
  Description of Artificial Sequence: Synthetic coding sequence
atgctgagcgacgagctggagagcaagcccgagctgctggtgcagttcgtgcagaacaccagcatccccctgggccagggcctggtggagagcgaggccaaggacatcacctgcctgagcctgctgcccgtgaccgaggccagcgagtgcagcagactgatgctgcccgacgacaccaccaaccacagcaacagcagcaaggaggtgcccagcagcgccgtgctgagaagcctgagagtgaacgtgggccccgacggcgaggagaccagagcccagaccgtgcagaagagccccgagttcctgagcaccagcgagagcagcagcctgctgcaggacctgcagcccagcgacagcaccagcttcatcctgctgaacctgaccagagccggcctgggcagcagcgccgagcacctggtgttcgtgcaggacgaggccgaggacagcggcaacgacttcctgagcagcgagagcaccgacagcagcatcccctggttcctgagagtgcaggagctggcccacgacagcctgatcgccgccaccagagcccagctggccaagaacgccaagaccagcagcaacggcgagaacgtgcacctgggcagcggcgacggccagagcaaggacagcggccccctgccccaggtggagaagaagctgaagtgcaccgtggagggctgcgacagaaccttcgtgtggcccgcccacttcaagtaccacctgaagacccacagaaacgacagaagcttcatctgccccgccgagggctgcggcaagagcttctacgtgctgcagagactgaaggtgcacatgagaacccacaacggcgagaagcccttcatgtgccacgagagcggctgcggcaagcagttcaccaccgccggcaacctgaagaaccacagaagaatccacaccggcgagaagcccttcctgtgcgaggcccagggctgcggcagaagcttcgccgagtacagcagcctgagaaagcacctggtggtgcacagcggcgagaagccccaccagtgccaggtgtgcggcaagaccttcagccagagcggcagcagaaacgtgcacatgagaaagcaccacctgcagctgggcgccgccggcagccaggagcaggagcagaccgccgagcccctgatgggcagcagcctgctggaggaggccagcgtgcccagcaagaacctggtgagcatgaacagccagcccagcctgggcggcgagagcctgaacctgcccaacaccaacagcatcctgggcgtggacgacgaggtgctggccgagggcagccccagaagcctgagcagcgtgcccgacgtgacccaccacctggtgaccatgcagagcggcagacagagctacgaggtgagcgtgctgaccgccgtgaacccccaggagctgctgaaccagggcgacctgaccgagagaagaacctag

SEQ ID NO: 10451 - DNA, 225 bp, Artificial Sequence
  Description of Artificial Sequence: Synthetic coding sequence
atgctgagcgacgagctggagagcaagcccgagctgctggtgcagttcgtgcagaacaccagcatccccctgggccagggcctggtggagagcgaggccaaggacatcacctgcctgagcctgctgcccgtgaccgaggccagcgagtgcagcagactgatgctgcccgacgacaccaccaaccacagcaacagcagcaaggaggtgcccagcagcgccgtgtag

SEQ ID NO: 10452 - DNA, 381 bp, Artificial Sequence
  Description of Artificial Sequence: Synthetic coding sequence
atgctgagcgacgagctggagagcaagcccgagctgctggtgcagttcgtgcagaacaccagcatccccctgggccagggcctggtggagagcgaggccaaggacatcacctgcctgagcctgctgcccgtgaccgaggccagcgagtgcagcagactgatgctgcccgacgacaccaccaaccacagcaacagcagcaaggaggtgcccagcagcgccgtgctgagaagcctgagagtgaacgtgggccccgacggcgaggagaccagagcccagaccgtgcagaagagccccgagttcctgagcaccagcgagagcagcagcctgctgcaggacctgcagcccagcgacagcaccagcttcatcctgctgaacctgtag

SEQ ID NO: 10453 - DNA, 819 bp, Artificial Sequence
  Description of Artificial Sequence: Synthetic coding sequence
atgctgagcgacgagctggagagcaagcccgagctgctggtgcagttcgtgcagaacaccagcatccccctgggccagggcctggtggagagcgaggccaaggacatcacctgcctgagcctgctgcccgtgaccgaggccagcgagtgcagcagactgatgctgcccgacgacaccaccaaccacagcaacagcagcaaggaggtgcccagcagcgccgtgctgagaagcctgagagtgaacgtgggccccgacggcgaggagaccagagcccagaccgtgcagaagagccccgagttcctgagcaccagcgagagcagcagcctgctgcaggacctgcagcccagcgacagcaccagcttcatcctgctgaacctgaccagagccggcctgggcagcagcgccgagcacctggtgttcgtgcaggacgaggccgaggacagcggcaacgacttcctgagcagcgagagcaccgacagcagcatcccctggttcctgagagtgcaggagctggcccacgacagcctgatcgccgccaccagagcccagctggccaagaacgccaagaccagcagcaacggcgagaacgtgcacctgggcagcggcgacggccagagcaaggacagcggccccctgccccaggtggagaagaagctgaagtgcaccgtggagggctgcgacagaaccttcgtgtggcccgcccacttcaagtaccacctgaagacccacagaagactgtgggagaagctgctgtgcgccgccgaggccgagggcgcccacgaggacccccagtggagagaggccctgtacgtgccctag

SEQ ID NO: 10454 - DNA, 939 bp, Artificial Sequence
  Description of Artificial Sequence: Synthetic coding sequence
atggaggagaagcccagcggccccatccccgacatgctggccaccgccgagcccagcagcagcgagaccgacaaggaggtgctgagccccgccgtgcccgccgccgcccccagcagcagcatgagcgaggagcccggccccgagcaggccgccaccccccccgtgtgggagagaggcggcgccggcggcatgcagcagggcagcagccccgcccccgacagctgccagcccggccccggccccagccccggcctgaccagcatcgtgagcggcaccagcgaggacctgagaccccccagaagaagacccccccccggcaagcagatcccctgcagcagccccggctgctgcctgagcttccccagcgtgagagacctggcccagcacctgagaacccactgcccccccacccagagcctggagggcaagctgttcagatgcagcgccctgagctgcaccgagaccttccccagcatgcaggagctggtggcccacagcaagctgcactacaagcccaacagatacttcaagtgcgagaactgcctgctgagattcagaacccacagaagcctgttcaagcacctgcacgtgtgcgccgagcacgcccagagccccgcccccccccccccccccgccctggacagagagccccccgcccccgagagaccccccgaggtggaccccgccagcgcccccggcctgcccttccccctgctggagcccttcaccacccccgcccccgcccccaccggccccttcctgccctacctgaaccccgcccccttcggcctgagcccccccagactgagacccttcctggccgccgcccccggcccccccgccagcagcgccgccgtgtggaagaagagccagggcgccggcagcagccccagaagaccccagggcggcagcgacgcccccagcggcgcctgcagatag

SEQ ID NO: 10455 - DNA, 1173 bp, Artificial Sequence
  Description of Artificial Sequence: Synthetic coding sequence
atggaggagaagcccagcggccccatccccgacatgctggccaccgccgagcccagcagcagcgagaccgacaaggaggtgctgagccccgccgtgcccgccgccgcccccagcagcagcatgagcgaggagcccggccccgagcaggccgccaccccccccgtgtgggagagaggcggcgccggcggcatgcagcagggcagcagccccgcccccgacagctgccagcccggccccggccccagccccggcctgaccagcatcgtgagcggcaccagcgaggacctgagaccccccagaagaagacccccccccggcaagcagatcccctgcagcagccccggctgctgcctgagcttccccagcgtgagagacctggcccagcacctgagaacccactgcccccccacccagagcctggagggcaagctgttcagatgcagcgccctgagctgcaccgagaccttccccagcatgcaggagctggtggcccacagcaagctgcactacaagcccaacagatacttcaagtgcgagaactgcctgctgagattcagaacccacagaagcctgttcaagcacctgcacgtgtgcgccgagcacgcccagagccccgcccccccccccccccccgccctggacagagagccccccgcccccgagagaccccccgaggtggaccccgccagcgcccccggcctgcccttccccctgctggagcccttcaccacccccgcccccgcccccaccggccccttcctgccctacctgaaccccgcccccttcggcctgagcccccccagactgagacccttcctggccgccgcccccggcccccccgccagcagcgccgccgtgtggaagaagagccagggcgccggcagcagccccagaagaccccagggcggcagcgacgcccccagcggccacgccgcccccagcagaatcgtgtgggagcacaccagaggcagatacagctgcatgcagtgcgccttcagcaccgccagcagacccgccatgaccctgcacctggaggaccacagacccggcgcccccgccgcccccgccgccggcccccccagacccgacgcccccgccgaccccgcccccctggcccccaaggtgagccccctgctgagcgagggcgagctgcccgtgttcagccagctgtag

SEQ ID NO: 10456 - DNA, 1785 bp, Artificial Sequence
  Description of Artificial Sequence: Synthetic coding sequence
atggccgccgccgtgctgagagacagcaccagcgtgcccgtgaccgccgaggccaagctgatgggcttcacccagggctgcgtgaccttcgaggacgtggccatctacttcagccaggaggagtggggcctgctggacgaggcccagagactgctgtacagagacgtgatgctggagaacttcgccctgatcaccgccctggtgtgctggcacggcatggaggacgaggagacccccgagcagagcgtgagcgtggagggcgtgccccaggtgagaacccccgaggccagccccagcacccagaagatccagagctgcgacatgtgcgtgcccttcctgaccgacatcctgcacctgaccgacctgcccggccaggagctgtacctgaccggcgcctgcgccgtgttccaccaggaccagaagcaccacagcgccgagaagcccctggagagcgacatggacaaggccagcttcgtgcagtgctgcctgttccacgagagcggcatgcccttcaccagcagcgaggtgggcaaggacttcctggcccccctgggcatcctgcagccccaggccatcgccaactacgagaagcccaacaagatcagcaagtgcgaggaggccttccacgtgggcatcagccactacaagtggagccagtgcagaagagagagcagccacaagcacaccttcttccaccccagagtgtgcaccggcaagagactgtacgagagcagcaagtgcggcaaggcctgctgctgcgagtgcagcctggtgcagctgcagagagtgcaccccggcgagagaccctacgagtgcagcgagtgcggcaagagcttcagccagaccagccacctgaacgaccacagaagaatccacaccggcgagagaccctacgtgtgcggccagtgcggcaagagcttcagccagagagccaccctgatcaagcaccacagagtgcacaccggcgagagaccctacgagtgcggcgagtgcggcaagagcttcagccagagcagcaacctgatcgagcactgcagaatccacaccggcgagagaccctacgagtgcgacgagtgcggcaaggccttcggcagcaagagcaccctggtgagacaccagagaacccacaccggcgagaagccctacgagtgcggcgagtgcggcaagctgttcagacagagcttcagcctggtggtgcaccagagaatccacaccaccgccagaccctacgagtgcggccagtgcggcaagagcttcagcctgaagtgcggcctgatccagcaccagctgatccacagcggcgccagacccttcgagtgcgacgagtgcggcaagagcttcagccagagaaccaccctgaacaagcaccacaaggtgcacaccgccgagagaccctacgtgtgcggcgagtgcggcaaggccttcatgttcaagagcaagctggtgagacaccagagaacccacaccggcgagagacccttcgagtgcagcgagtgcggcaagttcttcagacagagctacaccctggtggagcaccagaagatccacaccggcctgagaccctacgactgcggccagtgcggcaagagcttcatccagaagagcagcctgatccagcaccaggtggtgcacaccggcgagagaccctacgagtgcggcaagtgcggcaagagcttcacccagcacagcggcctgatcctgcacagaaagagccacaccgtggagagacccagagacagcagcaagtgcggcaagccctacagccccagaagcaacatcgtgtag

SEQ ID NO: 10457 - DNA, 1434 bp, Artificial Sequence
  Description of Artificial Sequence: Synthetic coding sequence
atggccgccgccgtgctgagagacagcaccagcggctgcgtgaccttcgaggacgtggccatctacttcagccaggaggagtggggcctgctggacgaggcccagagactgctgtacagagacgtgatgctggagaacttcgccctgatcaccgccctggtgtgctggcacggcatggaggacgaggagacccccgagcagagcgtgagcgtggagggcgtgccccaggtgagaacccccgaggccagccccagcacccagaagatccagagctgcgacatgtgcgtgcccttcctgaccgacatcctgcacctgaccgacctgcccggccaggagctgtacctgaccggcgcctgcgccgtgttccaccaggaccagaagcaccacagcgccgagaagcccctggagagcgacatggacaaggccagcttcgtgcagtgctgcctgttccacgagagcggcatgcccttcaccagcagcgaggtgggcaaggacttcctggcccccctgggcatcctgcagccccaggccatcgccaactacgagaagcccaacaagatcagcaagtgcgaggaggccttccacgtgggcatcagccactacaagtggagccagtgcagaagagagagcagccacaagcacaccttcttccaccccagagtgtgcaccggcaagagactgtacgagagcagcaagtgcggcaaggcctgctgctgcgagtgcagcctggtgcagctgcagagagtgcaccccggcgagagaccctacgagtgcagcgagtgcggcaagagcttcagccagaccagccacctgaacgaccacagaagaatccacaccggcgagagaccctactacgagtgcggcgagtgcggcaagagcttcagccagagcagcaacctgatcgagcactgcagaatccacaccggcgagagaccctacgagtgcgacgagtgcggcaaggccttcggcagcaagagcaccctggtgagacaccagagaacccacaccggcgagaagccctacgagtgcggcgagtgcggcaagctgttcagacagagcttcagcctggtggtgcaccagagaatccacaccaccgccagaccctacgagtgcggccagtgcggcaagagcttcagcctgaagagcaagctggtgagacaccagagaacccacaccggcgagagacccttcgagtgcagcgagtgcggcaagttcttcagacagagctacaccctggtggagcaccagaagatccacaccggcctgagaccctacgactgcggccagtgcggcaagagcttcatccagaagagcagcctgatccagcaccaggtggtgcacaccggcgagagaccctacgagtgcggcaagtgcggcaagagcttcacccagcacagcggcctgatcctgcacagaaagagccacaccgtgtag

SEQ ID NO: 10458 - DNA, 1419 bp, Artificial Sequence
  Description of Artificial Sequence: Synthetic coding sequence
atgggcttcacccagggctgcgtgaccttcgaggacgtggccatctacttcagccaggaggagtggggcctgctggacgaggcccagagactgctgtacagagacgtgatgctggagaacttcgccctgatcaccgccctggtgtgctggcacggcatggaggacgaggagacccccgagcagagcgtgagcgtggagggcgtgccccaggtgagaacccccgaggccagccccagcacccagaagatccagagctgcgacatgtgcgtgcccttcctgaccgacatcctgcacctgaccgacctgcccggccaggagctgtacctgaccggcgcctgcgccgtgttccaccaggaccagaagcaccacagcgccgagaagcccctggagagcgacatggacaaggccagcttcgtgcagtgctgcctgttccacgagagcggcatgcccttcaccagcagcgaggtgggcaaggacttcctggcccccctgggcatcctgcagccccaggccatcgccaactacgagaagcccaacaagatcagcaagtgcgaggaggccttccacgtgggcatcagccactacaagtggagccagtgcagaagagagagcagccacaagcacaccttcttccaccccagagtgtgcaccggcaagagactgtacgagagcagcaagtgcggcaaggcctgctgctgcgagtgcagcctggtgcagctgcagagagtgcaccccggcgagagaccctacgagtgcagcgagtgcggcaagagcttcagccagaccagccacctgaacgaccacagaagaatccacaccggcgagagaccctacccctacgagtgcggcgagtgcggcaagctgttcagacagagcttcagcctggtggtgcaccagagaatccacaccaccgccagaccctacgagtgcggccagtgcggcaagagcttcagcctgaagtgcggcctgatccagcaccagctgatccacagcggcgccagacccttcgagtgcgacgagtgcggcaagagcttcagccagagaaccaccctgaacaagcaccacaaggtgcacaccgccgagagaccctacgtgtgcggcgagtgcggcaaggccttcatgttcaagagcaagctggtgagacaccagagaacccacaccggcgagagacccttcgagtgcagcgagtgcggcaagttcttcagacagagctacaccctggtggagcaccagaagatccacaccggcctgagaccctacgactgcggccagtgcggcaagagcttcatccagaagagcagcctgatccagcaccaggtggtgcacaccggcgagagaccctacgagtgcggcaagtgcggcaagagcttcacccagcacagcggcctgatcctgcacagaaagagccacaccgtgtag

SEQ ID NO: 10459 - DNA, 1728 bp, Artificial Sequence
  Description of Artificial Sequence: Synthetic coding sequence
atggccgccgccgcccccagaagacccacccagcagggcaccgtgaccttcgaggacgtggccgtgaacttcagccaggaggagtggtgcctgctgagcgaggcccagagatgcctgtacagagacgtgatgctggagaacctggccctgatcagcagcctgggctgctggtgcggcagcaaggacgaggaggccccctgcaagcagagaatcagcgtgcagagagagagccagagcagaacccccagagccggcgtgagccccaagaaggcccacccctgcgagatgtgcggcctgatcctggaggacgtgttccacttcgccgaccaccaggagacccaccacaagcagaagctgaacagaagcggcgcctgcggcaagaacctggacgacaccgcctacctgcaccagcaccagaagcagcacatcggcgagaagttctacagaaagagcgtgagagaggccagcttcgtgaagaagagaaagctgagagtgagccaggagcccttcgtgttcagagagttcggcaaggacgtgctgcccagcagcggcctgtgccaggaggccgccgccgtggagaagaccgacagcgagaccatgcacggcccccccttccaggagggcaagaccaactacagctgcggcaagagaaccaaggccttcagcaccaagcacagcgtgatcccccaccagaagctgttcaccagagacggctgctacgtgtgcagcgactgcggcaagagcttcagcagatacgtgagcttcagcaaccaccagagagaccacaccgccaagggcccctacgactgcggcgagtgcggcaagagctacagcagaaagagcagcctgatccagcaccagagagtgcacaccggcaagaccgcctacccctgcgaggagtgcggcaagagcttcagccagaagggcagcctgatcagccaccagagagtgcacaccggcgagagaccctacgagtgcagagagtacggcaagagcttcggccagaagggcaacctgatccagcaccagcagggccacaccggcgagagagcctaccactgcggcgagtgcggcaagagcttcagacagaagttctgcttcatcaaccaccagagagtgcacaccggcgagagaccctacaagtgcggcgagtgcggcaagagcttcggccagaagggcaacctggtgcagcaccagagaggccacaccggcgagagaccctacgagtgcaaggagtgcggcaagagcttcagatacagaagccacctgaccgagcaccagagactgcacaccggcgagagaccctacaactgcagagagtgcggcaagctgttcaacagaaagtaccacctgctggtgcacgagagagtgcacaccggcgagagaccctacgcctgcgaggtgtgcggcaagctgttcggcaacaagaactgcgtgaccatccaccagagaatccacaccggcgagagaccctacgagtgcaacgagtgcggcaagagcttcctgagcagcagcgccctgcacgtgcacaagagagtgcacagcggccagaagccctacaagtgcagcgagtgcggcaagagcttcgccgagtgcagcagcctgatcaagcacagaagaatccacaccggcgagagaccctacgagtgcaccaagtgcggcaagaccttccagagaagcagcaccctgctgcaccaccagagcagccacagaagaaaggccctgtag

SEQ ID NO: 10460 - DNA, 1131 bp, Artificial Sequence
  Description of Artificial Sequence: Synthetic coding sequence
atgcacggcccccccttccaggagggcaagaccaactacagctgcggcaagagaaccaaggccttcagcaccaagcacagcgtgatcccccaccagaagctgttcaccagagacggctgctacgtgtgcagcgactgcggcaagagcttcagcagatacgtgagcttcagcaaccaccagagagaccacaccgccaagggcccctacgactgcggcgagtgcggcaagagctacagcagaaagagcagcctgatccagcaccagagagtgcacaccggcaagaccgcctacccctgcgaggagtgcggcaagagcttcagccagaagggcagcctgatcagccaccagagagtgcacaccggcgagagaccctacgagtgcagagagtacggcaagagcttcggccagaagggcaacctgatccagcaccagcagggccacaccggcgagagagcctaccactgcggcgagtgcggcaagagcttcagacagaagttctgcttcatcaaccaccagagagtgcacaccggcgagagaccctacaagtgcggcgagtgcggcaagagcttcggccagaagggcaacctggtgcagcaccagagaggccacaccggcgagagaccctacgagtgcaaggagtgcggcaagagcttcagatacagaagccacctgaccgagcaccagagactgcacaccggcgagagaccctacaactgcagagagtgcggcaagctgttcaacagaaagtaccacctgctggtgcacgagagagtgcacaccggcgagagaccctacgcctgcgaggtgtgcggcaagctgttcggcaacaagaactgcgtgaccatccaccagagaatccacaccggcgagagaccctacgagtgcaacgagtgcggcaagagcttcctgagcagcagcgccctgcacgtgcacaagagagtgcacagcggccagaagccctacaagtgcagcgagtgcggcaagagcttcgccgagtgcagcagcctgatcaagcacagaagaatccacaccggcgagagaccctacgagtgcaccaagtgcggcaagaccttccagagaagcagcaccctgctgcaccaccagagcagccacagaagaaaggccctgtag

SEQ ID NO: 10461 - DNA, 2031 bp, Artificial Sequence
  Description of Artificial Sequence: Synthetic coding sequence
atgcagggcaccgtggccttcgaggacgtggccgtgaacttcagccaggaggagtggagcctgctgagcgaggtgcagagatgcctgtaccacgacgtgatgctggagaactgggtgctgatcagcagcctgggctgctggtgcggcagcgaggacgaggaggcccccagcaagaagagcatcagcatccagagagtgagccaggtgagcacccccggcgccggcgtgagccccaagaaggcccacagctgcgagatgtgcggcgccatcctgggcgacatcctgcacctggccgaccaccagggcacccaccacaagcagaagctgcacagatgcgaggcctggggcaacaagctgtacgacagcagcaacagaccccaccagaaccagtacctgggcgagaagccctacagaagcagcgtggaggaggccctgttcgtgaagagatgcaagttccacgtgagcgaggagagcagcatcttcatccagagcggcaaggacttcctgcccagcagcggcctgctgctgcaggaggccacccacaccggcgagaagagcaacagcaagcccgagtgcgagagccccttccagtggggcgacacccactacagctgcggcgagtgcatgaagcacagcagcaccaagcacgtgttcgtgcagcagcagagactgcccagcagagaggagtgctactgctgggagtgcggcaagagcttcagcaagtacgacagcgtgagcaaccaccagagagtgcacaccggcaagagaccctacgagtgcggcgagtgcggcaagagcttcagccacaagggcagcctggtgcagcaccagagagtgcacaccggcaagagaccctacgagtgcggcgagtgcggcaagagcttcagccacaagggcagcctggtgcagcaccagagagtgcacaccggcgagagaccctacgagtgcggcgagtgcggcaagagcttcagccagaacggcaccctgatcaagcaccagagagtgcacaccggcgagagaccctacgagtgcgaggagtgcggcaagtgcttcacccagaagggcaacctgatccagcaccagagaggccacaccagcgagagaccctacgagtgcgaggagtgcggcaagtgcttcagccagaagggcaccctgaccgagcaccacagagtgcacaccagagagagaccctacgagtgcggcgagtgcggcaagagcttcagcagaaagggccacctgagaaaccaccagagaggccacaccggcgagagaccctacgagtgcggcgagtgcggcaagagcttcagcagaaagggcaacctgatccagcaccagagaagccacaccggcgagagaccctacgagtgcagagagtgcagaaagctgttcagaggcaagagccacctgatcgagcaccagagagtgcacaccggcgagagaccctacgagtgcaacgagtgcggcaagagcttccaggacagcagcggcttcagagtgcaccagagagtgcacaccggcgagaagcccttcgagtgcagcgagtgcggcaagagcttcccccagagctgcagcctgctgagacacagaagagtgcacaccggcgagagaccctacgagtgcggcgagtgcggcaagagcttccaccagagcagcagcctgctgagacaccagaagacccacaccgccgagagaccctacgagtgcagagagtgcggcaagttcttcagcagcctgctggagcacagaagagtgcacaccggcgagagaccctacgagtgcagagagtgcggcaagaccttcaccagaagaagcgcccacttcaagcaccagagactgcacaccagaggcaagccctacgagtgcagcgagtgcggcaagagcttcgccgagaccttcagcctgaccgagcacagaagagtgcacaccggcgagagaccctacgagtgcagcgagtgcggcaagagcttccacagaagcagcagcctgctgagacaccagagagtgcacaccgagagaagcccctacaagtag

SEQ ID NO: 10462 - DNA, 2094 bp, Artificial Sequence
  Description of Artificial Sequence: Synthetic coding sequence
atgcaggagggcctgcacagaatgacctgggactgcatcgccatcggcagccacgagaacagcgtgcagggcaccgtggccttcgaggacgtggccgtgaacttcagccaggaggagtggagcctgctgagcgaggtgcagagatgcctgtaccacgacgtgatgctggagaactgggtgctgatcagcagcctgggctgctggtgcggcagcgaggacgaggaggcccccagcaagaagagcatcagcatccagagagtgagccaggtgagcacccccggcgccggcgtgagccccaagaaggcccacagctgcgagatgtgcggcgccatcctgggcgacatcctgcacctggccgaccaccagggcacccaccacaagcagaagctgcacagatgcgaggcctggggcaacaagctgtacgacagcagcaacagaccccaccagaaccagtacctgggcgagaagccctacagaagcagcgtggaggaggccctgttcgtgaagagatgcaagttccacgtgagcgaggagagcagcatcttcatccagagcggcaaggacttcctgcccagcagcggcctgctgctgcaggaggccacccacaccggcgagaagagcaacagcaagcccgagtgcgagagccccttccagtggggcgacacccactacagctgcggcgagtgcatgaagcacagcagcaccaagcacgtgttcgtgcagcagcagagactgcccagcagagaggagtgctactgctgggagtgcggcaagagcttcagcaagtacgacagcgtgagcaaccaccagagagtgcacaccggcaagagaccctacgagtgcggcgagtgcggcaagagcttcagccacaagggcagcctggtgcagcaccagagagtgcacaccggcaagagaccctacgagtgcggcgagtgcggcaagagcttcagccacaagggcagcctggtgcagcaccagagagtgcacaccggcgagagaccctacgagtgcggcgagtgcggcaagagcttcagccagaacggcaccctgatcaagcaccagagagtgcacaccggcgagagaccctacgagtgcgaggagtgcggcaagtgcttcacccagaagggcaacctgatccagcaccagagaggccacaccagcgagagaccctacgagtgcgaggagtgcggcaagtgcttcagccagaagggcaccctgaccgagcaccacagagtgcacaccagagagagaccctacgagtgcggcgagtgcggcaagagcttcagcagaaagggccacctgagaaaccaccagagaggccacaccggcgagagaccctacgagtgcggcgagtgcggcaagagcttcagcagaaagggcaacctgatccagcaccagagaagccacaccggcgagagaccctacgagtgcagagagtgcagaaagctgttcagaggcaagagccacctgatcgagcaccagagagtgcacaccggcgagagaccctacgagtgcaacgagtgcggcaagagcttccaggacagcagcggcttcagagtgcaccagagagtgcacaccggcgagaagcccttcgagtgcagcgagtgcggcaagagcttcccccagagctgcagcctgctgagacacagaagagtgcacaccggcgagagaccctacgagtgcggcgagtgcggcaagagcttccaccagagcagcagcctgctgagacaccagaagacccacaccgccgagagaccctacgagtgcagagagtgcggcaagttcttcagcagcctgctggagcacagaagagtgcacaccggcgagagaccctacgagtgcagagagtgcggcaagaccttcaccagaagaagcgcccacttcaagcaccagagactgcacaccagaggcaagccctacgagtgcagcgagtgcggcaagagcttcgccgagaccttcagcctgaccgagcacagaagagtgcacaccggcgagagaccctacgagtgcagcgagtgcggcaagagcttccacagaagcagcagcctgctgagacaccagagagtgcacaccgagagaagcccctacaagtag

SEQ ID NO: 10463 - DNA, 1929 bp, Artificial Sequence
  Description of Artificial Sequence: Synthetic coding sequence
atggccgccgccgccctgagactgcccgcccaggtggtgggcgtggaccagaagatgagaagacacctgctgagaagagccttcctgtacaaggagtgcctgagaagcgccctgctgggccaggtgagccccaagaaggcccacagctgcgagatgtgcggcgccatcctgggcgacatcctgcacctggccgaccaccagggcacccaccacaagcagaagctgcacagatgcgaggcctggggcaacaagctgtacgacagcagcaacagaccccaccagaaccagtacctgggcgagaagccctacagaagcagcgtggaggaggccctgttcgtgaagagatgcaagttccacgtgagcgaggagagcagcatcttcatccagagcggcaaggacttcctgcccagcagcggcctgctgctgcaggaggccacccacaccggcgagaagagcaacagcaagcccgagtgcgagagccccttccagtggggcgacacccactacagctgcggcgagtgcatgaagcacagcagcaccaagcacgtgttcgtgcagcagcagagactgcccagcagagaggagtgctactgctgggagtgcggcaagagcttcagcaagtacgacagcgtgagcaaccaccagagagtgcacaccggcaagagaccctacgagtgcggcgagtgcggcaagagcttcagccacaagggcagcctggtgcagcaccagagagtgcacaccggcaagagaccctacgagtgcggcgagtgcggcaagagcttcagccacaagggcagcctggtgcagcaccagagagtgcacaccggcgagagaccctacgagtgcggcgagtgcggcaagagcttcagccagaacggcaccctgatcaagcaccagagagtgcacaccggcgagagaccctacgagtgcgaggagtgcggcaagtgcttcacccagaagggcaacctgatccagcaccagagaggccacaccagcgagagaccctacgagtgcgaggagtgcggcaagtgcttcagccagaagggcaccctgaccgagcaccacagagtgcacaccagagagagaccctacgagtgcggcgagtgcggcaagagcttcagcagaaagggccacctgagaaaccaccagagaggccacaccggcgagagaccctacgagtgcggcgagtgcggcaagagcttcagcagaaagggcaacctgatccagcaccagagaagccacaccggcgagagaccctacgagtgcagagagtgcagaaagctgttcagaggcaagagccacctgatcgagcaccagagagtgcacaccggcgagagaccctacgagtgcaacgagtgcggcaagagcttccaggacagcagcggcttcagagtgcaccagagagtgcacaccggcgagaagcccttcgagtgcagcgagtgcggcaagagcttcccccagagctgcagcctgctgagacacagaagagtgcacaccggcgagagaccctacgagtgcggcgagtgcggcaagagcttccaccagagcagcagcctgctgagacaccagaagacccacaccgccgagagaccctacgagtgcagagagtgcggcaagttcttcagcagcctgctggagcacagaagagtgcacaccggcgagagaccctacgagtgcagagagtgcggcaagaccttcaccagaagaagcgcccacttcaagcaccagagactgcacaccagaggcaagccctacgagtgcagcgagtgcggcaagagcttcgccgagaccttcagcctgaccgagcacagaagagtgcacaccggcgagagaccctacgagtgcagcgagtgcggcaagagcttccacagaagcagcagcctgctgagacaccagagagtgcacaccgagagaagcccctacaagtag

SEQ ID NO: 10464 - DNA, 1083 bp, Artificial Sequence
  Description of Artificial Sequence: Synthetic coding sequence
atgcccgagctggtggtgaccgccctgctggcccccagcagactgagcctgaagctgctgagagccttcatgtggagcctggtgttcagcgtggccctggtggccgccgccgtgtacggctgcatcgccctgacccacgtgctgtgcagacccagaagaggctgctgcggcagaagaagaagcgccagccccgcctgcctgagcgaccccagcctgggcgagcacggcttcctgaacctgaagagcagcggcctgagactgcactacgtgagcgccggcagaggcaacggccccctgatgctgttcctgcacggcttccccgagaactggttcagctggagataccagctgagagagttccagagcagattccacgtggtggccgtggacctgagaggctacggccccagcgacgcccccagagacgtggactgctacaccatcgacctgctgctggtggacatcaaggacgtgatcctgggcctgggctacagcaagtgcatcctggtggcccacgactggggcgccctgctggcctggcacttcagcatctactaccccagcctggtggagagaatggtggtggtgagcggcgcccccatgagcgtgtaccaggactacagcctgcaccacatcagccagttcttcagaagccactacatgttcctgttccagctgccctggctgcccgagaagctgctgagcatgagcgacttccagatcctgaagaccaccctgacccacagaaagaccggcatcccctgcctgacccccagcgagctggaggccttcctgtacaacttcagccagcccggcggcctgaccggccccctgaactactacagaaacctgttcagaaacttccccctggagccccaggagctgaccacccccaccctgctgctgtggggcgagaaggacacctacctggagctgggcctggtggaggccatcggcagcagattcgtgcccggcagactggaggcccacatcctgcccggcatcggccactggatcccccagagcaacccccaggagatgcaccagtacatgtgggccttcctgcaggacctgctggactag

SEQ ID NO: 10465 - DNA, 1290 bp, Artificial Sequence
  Description of Artificial Sequence: Synthetic coding sequence
gaccccgtgcagggctacgtgaccttcgaggacgtggccgtgtacttcagccaggaggagtggagactgctggacgacgcccagagactgctgtacagaaacgtgatgctggagaacttcaccctgctggccagcctgggcaagcaccccgagctgggcagcgccttcccccccttccccagagagagaagcctggccgtgagcctgatggacctgatccccggcggcctgagcgtgcagctgagccaccagtgcgactgctgcctgaccgtgctgttcctggtgctgcacgtgagccccagccaccagcagaaccccagcgccgtggccttcaccgagtgcgtggtggtgggcatggagagactgctgagcagcaacatccagcagcaccagaagcagcactgcggcgagaagcccctgaagagacaggagggcagagtgcccgtgctgagaagctgcaaggtgcacctgagcgagaagagcctgcagagcagagaggtgggcaaggccctgctgatcagcagcggcgtgctgaagcaccaggtgacccacaccggcgagaagagccacagaagcagcaagagcagagaggccttccacgccggcaagagacactacaagtgcagcgagtgcggcaaggccttcggccagaagtacctgctggtgcagcaccagagactgcacaccggcgagagaccctacggctgcagcaactgcggcaagagcttcagcagaaacgcccacctgatcgagcaccagagagtgcacaccggcgagaagcccttcacctgcagcgagtgcggcaaggccttcagacacaacagcaccctggtgcagcaccacaagatccacaccggcgtgagaccctacgagtgcagcgagtgcggcaagctgttcagcttcaacagcagcctgatgaagcaccagagaatccacaccggcgagagaccctacaagtgcagcgagtgcggcaagttctacagccacaagagcaacctgatcaagcactggagagtgcacaccggcgagagaccctacaagtgcagcgactgcggcaagttcttcacccagtgcagcagcctgatgcagcaccagaaggtgcacaccggcgagaagcccttcaagtgcaacgagtgcggcagattcttcagagagaacagcaccctggtgagacaccagagagtgcacaccggcgccaagccctacgagtgcagagagtgcggcaagttcttcagccagagcagcaccctgatgcagcacagaaaggtgcacatcggcgagaagccctag

SEQ ID NO: 10466 - DNA, 1437 bp, Artificial Sequence
  Description of Artificial Sequence: Synthetic coding sequence
atggccgccgccgccctgagagaccccgcccaggtgcccgtggccgccgacctgctgaccgaccacgaggagcagggctacgtgaccttcgaggacgtggccgtgtacttcagccaggaggagtggagactgctggacgacgcccagagactgctgtacagaaacgtgatgctggagaacttcaccctgctggccagcctgggctgctggcacggcgccgaggccgaggaggcccccgagcagatcgccagcgtgggcctgctgagcagcaacatccagcagcaccagaagcagcactgcggcgagaagcccctgaagagacaggagggcagagtgcccgtgctgagaagctgcaaggtgcacctgagcgagaagagcctgcagagcagagaggtgggcaaggccctgctgatcagcagcggcgtgctgaagcaccaggtgacccacaccggcgagaagagccacagaagcagcaagagcagagaggccttccacgccggcaagagacactacaagtgcagcgagtgcggcaaggccttcggccagaagtacctgctggtgcagcaccagagactgcacgccggcaagaagacctacgagtgcagcgagtgcggcaagctgttcagagacatgagcaacctgttcatccaccagatcgtgcacaccggcgagagaccctacggctgcagcaactgcggcaagagcttcagcagaaacgcccacctgatcgagcaccagagagtgcacaccggcgagaagcccttcacctgcagcgagtgcggcaaggccttcagacacaacagcaccctggtgcagcaccacaagatccacaccggcgtgagaccctacgagtgcagcgagtgcggcaagctgttcagcttcaacagcagcctgatgaagcaccagagaatccacaccggcgagagaccctacaagtgcagcgagtgcggcaagttctacagccacaagagcaacctgatcaagcactggagagtgcacaccggcgagagaccctacaagtgcagcgactgcggcaagttcttcacccagtgcagcagcctgatgcagcaccagaaggtgcacaccggcgagaagcccttcaagtgcaacgagtgcggcagattcttcagagagaacagcaccctggtgagacaccagagagtgcacaccggcgccaagccctacgagtgcagagagtgcggcaagttcttcagccagagcagcaccctgatgcagcacagaaaggtgcacatcggcgagaagcccttcaagtgcaacgagtgcggcagactgttcagagagaacagcagcctggtgaagcaccagagagtgcacaccggcgccaagccctacgagtgcagagagtgcggcaagttcttcagacacaacagcagcctgttcaagcacagaagaatccacaccggcgagatgcagtag

SEQ ID NO: 10467 - DNA, 1329 bp, Artificial Sequence
  Description of Artificial Sequence: Synthetic coding sequence
atggccgccgccgccctgagagaccccgcccagcagggctacgtgaccttcgaggacgtggccgtgtacttcagccaggaggagtggagactgctggacgacgcccagagactgctgtacagaaacgtgatgctggagaacttcaccctgctggccagcctgggcctggccagcagcaagacccacgagatcacccagctggagagctgggaggagcccttcatgcccgcctgggaggtggtgaccagcgccatccccagaggctgctggcacggcgccgaggccgaggaggcccccgagcagatcgccagcgtgggcctgctgagcagcaacatccagcagcaccagaagcagcactgcggcgagaagcccctgaagagacaggagggcagagtgcccgtgctgagaagctgcaaggtgcacctgagcgagaagagcctgcagagcagagaggtgggcaaggccctgctgatcagcagcggcgtgctgaagcaccaggtgacccacaccggcgagaagagccacagaagcagcaagagcagagaggccttccacgccggcaagagacactacaagtgcagcgagtgcggcaaggccttcggccagaagtacctgctggtgcagcaccagagactgcacgccggcaagaagacctacgagtgcagcgagtgcggcaagctgttcagagacatgagcaacctgttcatccaccagatcgtgcacaccggcgagagaccctacggctgcagcaactgcggcaagagcttcagcagaaacgcccacctgatcgagcaccagagagtgcacaccggcgagaagcccttcacctgcagcgagtgcggcaaggccttcagacacaacagcaccctggtgcagcaccacaagatccacaccggcgtgagaccctacgagtgcagcgagtgcggcaagctgttcagcttcaacagcagcctgatgaagcaccagagaatccacaccggcgagagaccctacaagtgcagcgagtgcggcaagttctacagccacaagagcaacctgatcaagcactggagagtgcacaccggcgagagaccctacaagtgcagcgactgcggcaagttcttcacccagtgcagcagcctgatgcagcaccagaaggtgcacaccggcgagaagcccttcaagtgcaacgagtgcggcagattcttcagagagaacagcagcctggtgaagcaccagagagtgcacaccggcgccaagccctacgagtgcagagagtgcggcaagttcttcagacacaacagcagcctgttcaagcacagaagaatccacaccggcgagatgcagtag

SEQ ID NO: 10468 - DNA, 1395 bp, Artificial Sequence
  Description of Artificial Sequence: Synthetic coding sequence
atggccgccgccgccctgagagaccccgcccagggctacgtgaccttcgaggacgtggccgtgtacttcagccaggaggagtggagactgctggacgacgcccagagactgctgtacagaaacgtgatgctggagaacttcaccctgctggccagcctgggctgctggcacggcgccgaggccgaggaggcccccgagcagatcgccagcgtgggcctgctgagcagcaacatccagcagcaccagaagcagcactgcggcgagaagcccctgaagagacaggagggcagagtgcccgtgctgagaagctgcaaggtgcacctgagcgagaagagcctgcagagcagagaggtgggcaaggccctgctgatcagcagcggcgtgctgaagcaccaggtgacccacaccggcgagaagagccacagaagcagcaagagcagagaggccttccacgccggcaagagacactacaagtgcagcgagtgcggcaaggccttcggccagaagtacctgctggtgcagcaccagagactgcacgccggcaagaagacctacgagtgcagcgagtgcggcaagctgttcagagacatgagcaacctgttcatccaccagatcgtgcacaccggcgagagaccctacggctgcagcaactgcggcaagagcttcagcagaaacgcccacctgatcgagcaccagagagtgcacaccggcgagaagcccttcacctgcagcgagtgcggcaaggccttcagacacaacagcaccctggtgcagcaccacaagatccacaccggcgtgagaccctacgagtgcagcgagtgcggcaagctgttcagcttcaacagcagcctgatgaagcaccagagaatccacaccggcgagagaccctacaagtgcagcgagtgcggcaagttctacagccacaagagcaacctgatcaagcactggagagtgcacaccggcgagagaccctacaagtgcagcgactgcggcaagttcttcacccagtgcagcagcctgatgcagcaccagaaggtgcacaccggcgagaagcccttcaagtgcaacgagtgcggcagattcttcagagagaacagcaccctggtgagacaccagagagtgcacaccggcgccaagccctacgagtgcagagagtgcggcaagttcttcagccagagcagcaccctgatgcagcacagaaaggtgcacatcggcgagaagcccttcaagtgcaacgagtgcggcagactgttcagagagaacagcagcctggtgaagcaccagagagtgcacaccggcgccaagccctacgagtgcagagagtgcggcaagttcttcagacacaacagcagcctgttcaagcacagaagaatccacaccggcgagatgcagtag

SEQ ID NO: 10469 - DNA, 1536 bp, Artificial Sequence
  Description of Artificial Sequence: Synthetic coding sequence
atggccgccgccgccctgagagaccccgcccaggtgcccgtggccgccgacctgctgaccgaccacgaggagcagggctacgtgaccttcgaggacgtggccgtgtacttcagccaggaggagtggagactgctggacgacgcccagagactgctgtacagaaacgtgatgctggagaacttcaccctgctggccagcctgggcctggccagcagcaagacccacgagatcacccagctggagagctgggaggagcccttcatgcccgcctgggaggtggtgaccagcgccatccccagaggctgctggcacggcgccgaggccgaggaggcccccgagcagatcgccagcgtgggcctgctgagcagcaacatccagcagcaccagaagcagcactgcggcgagaagcccctgaagagacaggagggcagagtgcccgtgctgagaagctgcaaggtgcacctgagcgagaagagcctgcagagcagagaggtgggcaaggccctgctgatcagcagcggcgtgctgaagcaccaggtgacccacaccggcgagaagagccacagaagcagcaagagcagagaggccttccacgccggcaagagacactacaagtgcagcgagtgcggcaaggccttcggccagaagtacctgctggtgcagcaccagagactgcacgccggcaagaagacctacgagtgcagcgagtgcggcaagctgttcagagacatgagcaacctgttcatccaccagatcgtgcacaccggcgagagaccctacggctgcagcaactgcggcaagagcttcagcagaaacgcccacctgatcgagcaccagagagtgcacaccggcgagaagcccttcacctgcagcgagtgcggcaaggccttcagacacaacagcaccctggtgcagcaccacaagatccacaccggcgtgagaccctacgagtgcagcgagtgcggcaagctgttcagcttcaacagcagcctgatgaagcaccagagaatccacaccggcgagagaccctacaagtgcagcgagtgcggcaagttctacagccacaagagcaacctgatcaagcactggagagtgcacaccggcgagagaccctacaagtgcagcgactgcggcaagttcttcacccagtgcagcagcctgatgcagcaccagaaggtgcacaccggcgagaagcccttcaagtgcaacgagtgcggcagattcttcagagagaacagcaccctggtgagacaccagagagtgcacaccggcgccaagccctacgagtgcagagagtgcggcaagttcttcagccagagcagcaccctgatgcagcacagaaaggtgcacatcggcgagaagcccttcaagtgcaacgagtgcggcagactgttcagagagaacagcagcctggtgaagcaccagagagtgcacaccggcgccaagccctacgagtgcagagagtgcggcaagttcttcagacacaacagcagcctgttcaagcacagaagaatccacaccggcgagatgcagtag

SEQ ID NO: 10470 - DNA, 1497 bp, Artificial Sequence
  Description of Artificial Sequence: Synthetic coding sequence
atggccgccgccgccctgagagaccccgcccagcagggctacgtgaccttcgaggacgtggccgtgtacttcagccaggaggagtggagactgctggacgacgcccagagactgctgtacagaaacgtgatgctggagaacttcaccctgctggccagcctgggcctggccagcagcaagacccacgagatcacccagctggagagctgggaggagcccttcatgcccgcctgggaggtggtgaccagcgccatccccagaggctgctggcacggcgccgaggccgaggaggcccccgagcagatcgccagcgtgggcctgctgagcagcaacatccagcagcaccagaagcagcactgcggcgagaagcccctgaagagacaggagggcagagtgcccgtgctgagaagctgcaaggtgcacctgagcgagaagagcctgcagagcagagaggtgggcaaggccctgctgatcagcagcggcgtgctgaagcaccaggtgacccacaccggcgagaagagccacagaagcagcaagagcagagaggccttccacgccggcaagagacactacaagtgcagcgagtgcggcaaggccttcggccagaagtacctgctggtgcagcaccagagactgcacgccggcaagaagacctacgagtgcagcgagtgcggcaagctgttcagagacatgagcaacctgttcatccaccagatcgtgcacaccggcgagagaccctacggctgcagcaactgcggcaagagcttcagcagaaacgcccacctgatcgagcaccagagagtgcacaccggcgagaagcccttcacctgcagcgagtgcggcaaggccttcagacacaacagcaccctggtgcagcaccacaagatccacaccggcgtgagaccctacgagtgcagcgagtgcggcaagctgttcagcttcaacagcagcctgatgaagcaccagagaatccacaccggcgagagaccctacaagtgcagcgagtgcggcaagttctacagccacaagagcaacctgatcaagcactggagagtgcacaccggcgagagaccctacaagtgcagcgactgcggcaagttcttcacccagtgcagcagcctgatgcagcaccagaaggtgcacaccggcgagaagcccttcaagtgcaacgagtgcggcagattcttcagagagaacagcaccctggtgagacaccagagagtgcacaccggcgccaagccctacgagtgcagagagtgcggcaagttcttcagccagagcagcaccctgatgcagcacagaaaggtgcacatcggcgagaagcccttcaagtgcaacgagtgcggcagactgttcagagagaacagcagcctggtgaagcaccagagagtgcacaccggcgccaagccctacgagtgcagagagtgcggcaagttcttcagacacaacagcagcctgttcaagcacagaagaatccacaccggcgagatgcagtag

SEQ ID NO: 10471 - DNA, 477 bp, Artificial Sequence
  Description of Artificial Sequence: Synthetic coding sequence
atggccgccgccgccctgagagaccccgcccaggtgcccgtggccgccgacctgctgaccgaccacgaggagggctacgtgaccttcgaggacgtggccgtgtacttcagccaggaggagtggagactgctggacgacgcccagagactgctgtacagaaacgtgatgctggagaacttcaccctgctggccagcctgggctgctggcacggcgccgaggccgaggaggcccccgagcagatcgccagcgtgggcctgctggaggtgctggccaagcagggcggctgcagcggcaagaagacctacgagtgcagcgagtgcggcaagctgttcagagacatgagcaacctgttcatccaccagatcgtgcacaccggcgagagaccctacggctgcagcaactgcggcaagagcttcagcagaaacgcccacctgatcgagcaccagagagtgcacaccggcgagaagcccttctag

SEQ ID NO: 10472 - DNA, 1494 bp, Artificial Sequence
  Description of Artificial Sequence: Synthetic coding sequence
atggccgccgccgccctgagagaccccgcccagggctacgtgaccttcgaggacgtggccgtgtacttcagccaggaggagtggagactgctggacgacgcccagagactgctgtacagaaacgtgatgctggagaacttcaccctgctggccagcctgggcctggccagcagcaagacccacgagatcacccagctggagagctgggaggagcccttcatgcccgcctgggaggtggtgaccagcgccatccccagaggctgctggcacggcgccgaggccgaggaggcccccgagcagatcgccagcgtgggcctgctgagcagcaacatccagcagcaccagaagcagcactgcggcgagaagcccctgaagagacaggagggcagagtgcccgtgctgagaagctgcaaggtgcacctgagcgagaagagcctgcagagcagagaggtgggcaaggccctgctgatcagcagcggcgtgctgaagcaccaggtgacccacaccggcgagaagagccacagaagcagcaagagcagagaggccttccacgccggcaagagacactacaagtgcagcgagtgcggcaaggccttcggccagaagtacctgctggtgcagcaccagagactgcacgccggcaagaagacctacgagtgcagcgagtgcggcaagctgttcagagacatgagcaacctgttcatccaccagatcgtgcacaccggcgagagaccctacggctgcagcaactgcggcaagagcttcagcagaaacgcccacctgatcgagcaccagagagtgcacaccggcgagaagcccttcacctgcagcgagtgcggcaaggccttcagacacaacagcaccctggtgcagcaccacaagatccacaccggcgtgagaccctacgagtgcagcgagtgcggcaagctgttcagcttcaacagcagcctgatgaagcaccagagaatccacaccggcgagagaccctacaagtgcagcgagtgcggcaagttctacagccacaagagcaacctgatcaagcactggagagtgcacaccggcgagagaccctacaagtgcagcgactgcggcaagttcttcacccagtgcagcagcctgatgcagcaccagaaggtgcacaccggcgagaagcccttcaagtgcaacgagtgcggcagattcttcagagagaacagcaccctggtgagacaccagagagtgcacaccggcgccaagccctacgagtgcagagagtgcggcaagttcttcagccagagcagcaccctgatgcagcacagaaaggtgcacatcggcgagaagcccttcaagtgcaacgagtgcggcagactgttcagagagaacagcagcctggtgaagcaccagagagtgcacaccggcgccaagccctacgagtgcagagagtgcggcaagttcttcagacacaacagcagcctgttcaagcacagaagaatccacaccggcgagatgcagtag

SEQ ID NO: 10473 - DNA, 1335 bp, Artificial Sequence
  Description of Artificial Sequence: Synthetic coding sequence
atggccgccgccgccctgagagaccccgcccaggtgcccgtggccgccgacctgctgaccgaccacgaggagcagggctacgtgaccttcgaggacgtggccgtgtacttcagccaggaggagtggagactgctggacgacgcccagagactgctgtacagaaacgtgatgctggagaacttcaccctgctggccagcctgggcctggccagcagcaagacccacgagatcacccagctggagagctgggaggagcccttcatgcccgcctgggaggtggtgaccagcgccatccccagaggctgctggcacggcgccgaggccgaggaggcccccgagcagatcgccagcgtgggcctgctgagcagcaacatccagcagcaccagaagcagcactgcggcgagaagcccctgaagagacaggagggcagagtgcccgtgctgagaagctgcaaggtgcacctgagcgagaagagcctgcagagcagagaggtgggcaaggccctgctgatcagcagcggcgtgctgaagcaccaggtgacccacaccggcgagaagagccacagaagcagcaagagcagagaggccttccacgccggcaagagacactacaagtgcagcgagtgcggcaaggccttcggccagaagtacctgctggtgcagcaccagagactgcacgccggcaagaagacctacgagtgcagcgagtgcggcaagctgttcagagacatgagcaacctgttcatccaccagatcgtgcacaccggcgagagaccctacggctgcagcaactgcggcaagagcttcagcagaaacgcccacctgatcgagcaccagagagtgcacaccggcgagaagcccttcacctgcagcgagtgcggcaaggccttcagacacaacagcaccctggtgcagcaccacaagatccacaccggcgtgagaccctacgagtgcagcgagtgcggcaagctgttcagcttcaacagcagcctgatgaagcaccagagaatccacaccggcgagagaccctacaagtgcagcgagtgcggcaagttctacagccacaagagcaacctgatcaagcactggagagtgcacaccggcgagagaccctacaagtgcagcgactgcggcaagttcttcacccagtgcagcagcctgatgcagcaccagaaggtgcacaccggcgagaagcccttcaagtgcaacgagtgcggcagattcttcagagagaacagcaccctggtgagacaccagagagtgcacaccggcgccaagccctacgagtgcagagagtgcggcaagttcttcagccagagcagcaccctgatgtag

SEQ ID NO: 10474 - DNA, 366 bp, Artificial Sequence
  Description of Artificial Sequence: Synthetic coding sequence
atggccgccgccgccctgagagaccccgcccagcagggctacgtgaccttcgaggacgtggccgtgtacttcagccaggaggagtggagactgctggacgacgcccagagactgctgtacagaaacgtgatgctggagaacttcaccctgctggccagcctgggctgctggcacggcgccgaggccgaggaggcccccgagcagatcgccagcgtgggcctgctgagcagcaacatccagcagcaccagaagcagcactgcggcgagaagcccctgaagagacaggagggcagagtgcccgtgctgagaagctgcaaggtgcacctgagcgagaagagcctgcagagcagagaggtgggcaagtag

SEQ ID NO: 10475 - DNA, 408 bp, Artificial Sequence
  Description of Artificial Sequence: Synthetic coding sequence
atggccgccgccgccctgagagaccccgcccagcagggctacgtgaccttcgaggacgtggccgtgtacttcagccaggaggagtggagactgctggacgacgcccagagactgctgtacagaaacgtgatgctggagaacttcaccctgctggccagcctgggcctggccagcagcaagacccacgagatcacccagctggagagctgggaggagcccttcatgcccgcctgggaggtggtgaccagcgccatccccagaggctgctggcacggcgccgaggccgaggaggcccccgagcagatcgccagcgtgggcctgctgagcagcaacatccagcagcaccagaagcagcactgcggcgagaagcccctgaagagacaggagggcagagtgcccgtgctgtag

SEQ ID NO: 10476 - DNA, 1611 bp, Artificial Sequence
  Description of Artificial Sequence: Synthetic coding sequence
atggccagaaagctggtgatgttcagagacgtggccatcgacttcagccaggaggagtgggagtgcctggacagcgcccagagagacctgtacagagacgtgatgctggagaactacagcaacctggtgagcctggacctgcccagcagatgcgccagcaaggacctgagccccgagaagaacacctacgagaccgagctgagccagtgggagatgagcgacagactggagaactgcgacctggaggagagcaacagcagagactacctggaggccaagggcaagatggagaagcagcaggagaaccagaaggagtacttcagacagggcatgatcatctacgacaagatgagcatcttcaaccagcacacctacctgagccagcacagcagatgccacagcaccgagaagccctacaagtgcaaggagtgcggcaaggccttcagaagagccagccacctgacccagcaccagagcatccacaccggcgagaagccctacgagtgcaagcagtgcggcaaggccttcagcagagacagccagctgagcctgcaccagagactgcacaccggcgagaagccctacgcctgcaaggagtgcggcaaggccttcacccagagcagccagctgatcctgcaccacagaatccacaccggcgagaagccctacaagtgcgaggagtgcggcaaggccttcatcagaagcagccagctgaccagacaccagaaggtgcacaccggcgagaagccctacgagtgcaaggagtgcggcaaggccttcacccagaacagccagctgaccctgcaccagagactgcacaccggcgagaagctgtacgagtgcaaggagtgcagaaaggtgttcacccagctgagccagctgatcctgcacaagagaatccacaccggcgagaagccctacgagtgcaaggagtgcggcaaggccttcatctgcggcagccagctgagccagcaccagaagatccacaacggcgagaagccctacgagtgcaaggagtgcggcagagccttcatcagaggcagcctgctgatgcagcaccagagaatccacaccggcgagaagccctacaagtgcgaggagtgcggcaaggccttcatcagaggcagccagctgacccagcaccagagaatccacaccaacgagaagccctacgagtgcaaggagtgcggcaagatgttcagccacggcagccagctgacccagcaccagagaatccacaccggcgagaagccctaccagtgcaaggagtgcggcaaggccttcaacagaggcagcctgctgaccagacaccagagaatccacaccggcgagaagccctacgagtgcaaggagtgcggcaagaccttcagcagaggcagcgagctgacccagcacgagagaatccacaccgccttcctggccggccagcaggacagaagcgacatctacatgagcagaagattcaccaagagcatcttccccgtgttcttcagcgtgcccaccatgtggaccagcaagctggagctgagatacagccacggcgacttcgagaacggcatctgggtgctgtggatcatggagcagaagtacagaagaagcctgcagccctag

SEQ ID NO: 10477 - DNA, 2067 bp, Artificial Sequence
  Description of Artificial Sequence: Synthetic coding sequence
atggccagaaagctggtgatgttcagagacgtggccatcgacttcagccaggaggagtgggagtgcctggacagcgcccagagagacctgtacagagacgtgatgctggagaactacagcaacctggtgagcctggacctgcccagcagatgcgccagcaaggacctgagccccgagaagaacacctacgagaccgagctgagccagtgggagatgagcgacagactggagaactgcgacctggaggagagcaacagcagagactacctggaggccaagggcaagatggagaagcagcaggagaaccagaaggagtacttcagacagggcatgatcatctacgacaagatgagcatcttcaaccagcacacctacctgagccagcacagcagatgccacagcaccgagaagccctacaagtgcaaggagtgcggcaaggccttcagaagagccagccacctgacccagcaccagagcatccacaccggcgagaagccctacgagtgcaagcagtgcggcaaggccttcagcagagacagccagctgagcctgcaccagagactgcacaccggcgagaagccctacgcctgcaaggagtgcggcaaggccttcacccagagcagccagctgatcctgcaccacagaatccacaccggcgagaagccctacaagtgcgaggagtgcggcaaggccttcatcagaagcagccagctgaccagacaccagaaggtgcacaccggcgagaagccctacgagtgcaaggagtgcggcaaggccttcacccagaacagccagctgaccctgcaccagagactgcacaccggcgagaagctgtacgagtgcaaggagtgcagaaaggtgttcacccagctgagccagctgatcctgcacaagagaatccacaccggcgagaagccctacgagtgcaaggagtgcggcaaggccttcatctgcggcagccagctgagccagcaccagaagatccacaacggcgagaagccctacgagtgcaaggagtgcggcagagccttcatcagaggcagcctgctgatgcagcaccagagaatccacaccggcgagaagccctacaagtgcgaggagtgcggcaaggccttcatcagaggcagccagctgacccagcaccagagaatccacaccaacgagaagccctacgagtgcaaggagtgcggcaagatgttcagccacggcagccagctgacccagcaccagagaatccacaccggcgagaagccctaccagtgcaaggagtgcggcaaggccttcaacagaggcagcctgctgaccagacaccagagaatccacaccggcgagaagccctacgagtgcaaggagtgcggcaagaccttcagcagaggcagcgagctgacccagcacgagagaatccacaccggcgagaagccctacgagtgcaaggagtgcggcaagagcttcatcagaggcagccagctgacccagcaccagagaatccacaccggcgagaagccctacgagtgcaaggagtgcagaatggccttcacccagagcagccacctgagccagcaccagagactgcacaccggcgagaagccctacgtgtgcaacgagtgcggcaaggccttcgccagaggcctgctgctgatccagcaccagagaatccacaccggcgagaagccctaccagtgcaaggagtgcggcaaggccttcatcagaggcagccagctgacccagcaccagagaatccacaccggcgagaagccctacgagtgcaaggagtgcggcaaggccttcagccacggcagccagctgaccctgcaccagagaatccacaccggcgagaagccctacgagtgcagagagtgcagaaaggccttcacccagagcagccacctgagcagacaccagagaatccacaccggcgagaagccctaccagtgcaaggagtgcggcaaggccttcaccagaggcagccagctgacccagcaccagagaatccacatcagcgagaagagcttcgagtacaaggagtgcggcatcgacttcagccacggcagccaggtgtacatgtag

SEQ ID NO: 10478 - DNA, 1665 bp, Artificial Sequence
  Description of Artificial Sequence: Synthetic coding sequence
atggccgccgccgacctgagccacggccactacctgagcggcgaccccgtgtgcctgcacgaggagaagacccccgccggcagaatcgtggccgactgcctgaccgactgctaccaggacagcgtgaccttcgacgacgtggccgtggacttcacccaggaggagtggaccctgctggacagcacccagagaagcctgtacagcgacgtgatgctggagaactacaagaacctggccaccgtgggcggccagatcatcaagcccagcctgatcagctggctggagcaggaggagagcagaaccgtgcagggcggcgtgctgcagggctgggagatgagactggagacccagtggagcatcctgcagcaggacttcctgagaggccagaccagcatcggcatccagctggagggcaagcacaacggcagagagctgtgcgactgcgagcagtgcggcgaggtgttcagcgagcacagctgcctgaagacccacgtgagaacccagagcaccggcaacacccacgactgcaaccagtacggcaaggacttcctgaccctgtgcgagaagaccagcaccggcgagaagctgagcgagttcaaccagagcgagaagatcttcagcctgacccccaacatcgtgtaccagagaaccagcacccaggagaagagcttcgagtgcagccactgcggcaagagcttcatcaacgagagctacctgcaggcccacatgagaacccacaacggcgagaagctgtacgagtggagaaactacggccccggcttcatcgacagcaccagcctgagcgtgctgatcgagaccctgaacgccaagaagccctacaagtgcaaggagtgcggcaagggctacagataccccgcctacctgagcatccacatgagaacccacaccggcgagaagccctacgagtgcaaggagtgcggcaaggccttcaactacagcaacagcttccagatccacggcagaacccacaccggcgagaagccctacgtgtgcaaggagtgcggcaaggccttcacccagtacagcggcctgagcatgcacgtgagaagccacagcggcgacaagccctacgagtgcaaggagtgcggcaagagcttcctgaccagcagcagactgatccagcacatcagaacccacaccggcgagaagcccttcgtgtgcgtggagtgcggcaaggccttcgccgtgagcagcaacctgagcggccacctgagaacccacaccgaggagaaggcctgcgagtgcaagatctgcggcaaggtgttcggctaccccagctgcctgaacaaccacatgagaacccacagcgcccagaagccctacacctgcaaggagtgcggcaaggccttcaactacagcacccacctgaagatccacatgagaatccacaccggcgagaagccctacgagtgcaagcagtgcggcaaggccttcagccacagcagcagcttccagatccacgagagaacccacaccggcgagaagccctacgagtgcaaggagtgcggcaaggccttcacctgcagcagcagcttcagaatccacgagaagacccacaccgaggagaagccctacaagtgccagcagtgcggcaaggcctacagccaccccagaagcctgagaagacacgagcagatccactag

SEQ ID NO: 10479 - DNA, 1665 bp, Artificial Sequence; identical to SEQ ID NO: 10478
  Description of Artificial Sequence: Synthetic coding sequence

SEQ ID NO: 10480 - DNA, 1626 bp, Artificial Sequence
  Description of Artificial Sequence: Synthetic coding sequence
agcgacggcgacatcaacgagagaagagtgctgaccagaagccacctggccggctggcagctgctgatctgccccatggacagcgtgaccttcgacgacgtggccgtggacttcacccaggaggagtggaccctgctggacagcacccagagaagcctgtacagcgacgtgatgctggagaactacaagaacctggccaccgtgggcggccagatcatcaagcccagcctgatcagctggctggagcaggaggagagcagaaccgtgcagggcggcgtgctgcagggctgggagatgagactggagacccagtggagcatcctgcagcaggacttcctgagaggccagaccagcatcggcatccagctggagggcaagcacaacggcagagagctgtgcgactgcgagcagtgcggcgaggtgttcagcgagcacagctgcctgaagacccacgtgagaacccagagcaccggcaacacccacgactgcaaccagtacggcaaggacttcctgaccctgtgcgagaagaccagcaccggcgagaagctgagcgagttcaaccagagcgagaagatcttcagcctgacccccaacatcgtgtaccagagaaccagcacccaggagaagagcttcgagtgcagccactgcggcaagagcttcatcaacgagagctacctgcaggcccacatgagaacccacaacggcgagaagctgtacgagtggagaaactacggccccggcttcatcgacagcaccagcctgagcgtgctgatcgagaccctgaacgccaagaagccctacaagtgcaaggagtgcggcaagggctacagataccccgcctacctgagcatccacatgagaacccacaccggcgagaagccctacgagtgcaaggagtgcggcaaggccttcaactacagcaacagcttccagatccacggcagaacccacaccggcgagaagccctacgtgtgcaaggagtgcggcaaggccttcacccagtacagcggcctgagcatgcacgtgagaagccacagcggcgacaagccctacgagtgcaaggagtgcggcaagagcttcctgaccagcagcagactgatccagcacatcagaacccacaccggcgagaagcccttcgtgtgcgtggagtgcggcaaggccttcgccgtgagcagcaacctgagcggccacctgagaacccacaccgaggagaaggcctgcgagtgcaagatctgcggcaaggtgttcggctaccccagctgcctgaacaaccacatgagaacccacagcgcccagaagccctacacctgcaaggagtgcggcaaggccttcaactacagcacccacctgaagatccacatgagaatccacaccggcgagaagccctacgagtgcaagcagtgcggcaaggccttcagccacagcagcagcttccagatccacgagagaacccacaccggcgagaagccctacgagtgcaaggagtgcggcaaggccttcacctgcagcagcagcttcagaatccacgagaagacccacaccgaggagaagccctacaagtgccagcagtgcggcaaggcctacagccaccccagaagcctgagaagacacgagcagatccactag

SEQ ID NO: 10481 - DNA, 2025 bp, Artificial Sequence
  Description of Artificial Sequence: Synthetic coding sequence
atgggccccctgaccttcaccgacgtggccatcgagttcagcctggaggagtggcagtgcctggacaccgcccagcagaacctgtacagaaacgtgatgctggagaactacagaaacctggtgttcctgggcatcgccgtgagcaagcccgacctgatcacctgcctggagaaggagaaggagccctgcaagatgaagagacacgagatggtggacgagccccccgtggtgtgcagccacttcgccgaggacttctggcccgagcaggacatcaaggacagcttccagaaggtgaccctgagaagatacgacaagagaggccacgagaacctgcagctgagaaagggctacaagaccgtgggcgactgcaagctgtacaagggcggctacaacggcctgaaccagtgcctgaccctgacccagagcaagatgtaccactgcgacatctacgtgaaggtgttctacgccttcagcaacgccgacagatacaagaccagacacaccggcaagaagcccttccagtgcaagaagtgcggcaagagcttctgcatgctgagccagctgacccagcacaagaagatccacatcagagagaacacctacagatgcaaggagttcggcaacgccttcaaccagagcagcgccctgaccaaccacaagagaatctacgtgggcgagaagcactacagatgcgaggagtgcggcaaggccttcaaccactacagcaccctgaccaaccacaagagaatccacaccggcgagaagccctacaagtgcaaggagtgcggcaaggccttcagcagatacagcaccctgaccacccacaagagaatccacagcggcgagaagccctacaagtgcgacgagtgcggcaagaccttcagcatcagcagcaccttcaccaagcacaagatcatccacaccgaggagaagccctacaagtgcaaggagtgcggcaaggccttcaacagaagcagcaccctgaccagccacaagagaatccacaccggcgagaagccctacaagtgcgaggagtgcggcaaggccttcaactggagcagcaccctgaccaagcacaaggtgatccacaccggcgagaagccctacaagtgcgaggagtgcggcaaggccttcaaccagagcagcagactgaccagacacaagaagatccacaccggcgaggagccctacaagttcgagaagtgcggcagagtgttcacctgcagcagcaccctgacccaggacaagaagatccacaccggcgagaagccctacaactgcgaggagtgcggcaaggtgttcacctacagcagcaccctgaccagacacaagagaatccacaccgaggagaagccctacaagtgcaacgagtgcggcaaggccttcaacagaagcagccacctgaccagccacagaagaatccacaccggcgagaagccctacaagtgcgaggagtgcggcaaggccttcaagcagagcagcaacctgaacagccacaagaagatccacagcggcgagaagccctacaagtgcgaggagtgcggcaaggccttcatcctgagcagcagactgacccagcacaagaagatccacaccggcgagaagccctacaagtgcgaggagtgcggcaaggccttcaacagaagcagcagactgacccagcacaagaagatccacaccggcgagaagccctacaagtgcaagcagtgcgacaaggccttcacccacagcagcaacctgagcagccacaagaagatccacagcggcgagaagccctacaagtgcgaggagtgcggcaaggccttcaacagaagcagcagactgacccagcacaagaagatccacaccagagagaagccctacaagtgcgaggagtgcgccaaggccttcaccagaagcagcagactgacccagcacaagaagatccacagaatgggcgtggtggcccacgcctgcaaccccagcaccctgggcggcagaggcggcagaatcaccagaagcggcgacagagacagacccggctag

SEQ ID NO: 10482 - DNA, 1731 bp, Artificial Sequence
  Description of Artificial Sequence: Synthetic coding sequence
atggacgacctgaagtacggcgtgtaccccctgaaggaggccagcggctgccccggcgccgagagaaacctgctggtgtacagctacttcgagaaggagaccctgaccttcagagacgtggccatcgagttcagcctggaggagtgggagtgcctgaaccccgcccagcagaacctgtacatgaacgtgatgctggagaactacaagaacctggtgttcctgggcgtggccgtgagcaagcaggaccccgtgacctgcctggagcaggagaaggagccctggaacatgaagagacacgagatggtggacgagccccccgccatgtgcagctacttcaccaaggacctgtggcccgagcaggacatcaaggacagcttccagcaggtgatcctgagaagatacggcaagtgcgagcacgagaacctgcagctgagaaagggcagcgccagcgtggacgagtacaaggtgcacaaggagggctacaacgagctgaaccagtgcctgaccaccacccagagcaagatcttcccctgcgacaagtacgtgaaggtgttccacaagttcctgaacgccaacagacacaagaccagacacaccggcaagaagcccttcaagtgcaagaagtgcggcaagagcttctgcatgctgctgcacctgagccagcacaagagaatccacatcagagagaacagctaccagtgcgaggagtgcggcaaggccttcaagtggttcagcaccctgaccagacacaagagaatccacaccggcgagaagcccttcaagtgcgaggagtgcggcaaggccttcaagcagagcagcaccctgaccacccacaagatcatccacaccggcgagaagccctacagatgcgaggagtgcggcaaggccttcaacagaagcagccacctgaccacccacaagatcatccacaccggcgagaagccctacaagtgcgaggagtgcggcaaggccttcaaccagagcagcaccctgagcacccacaagttcatccacgccggcgagaagccctacaagtgcgaggagtgcgacaaggccttcaacagattcagctacctgaccaagcacaagatcatccacaccggcgagaagagctacaagtgcgaggagtgcggcaagggcttcaactggagcagcaccctgaccaagcacaagagaatccacaccggcgagaagccctacaagtgcgaggtgtgcggcaaggccttcaacgagagcagcaacctgaccacccacaagatgatccacaccggcgagaagccctacaagtgcgaggagtgcggcaaggccttcaacagaagcccccagctgaccgcccacaagatcatccacaccggcgagaagccctacaagtgcgaggagtgcggcaaggccttcagccagagcagcatcctgaccacccacaagagaatccacaccggcgagaagccctacaagtgcgaggagtgcggcaaggccttcaacagaagcagcaacctgaccaagcacaagatcatccacaccggcgagaagagctacaagtgcgaggagtgcggcaaggccttcaaccagagcagcaccctgaccaagcacagaaagatccacaccagacagaagccctacaactgcgaggagtgcgacaacaccttcaaccagagcagcaacctgatcaagcagaacaacagctactggagagagaccctgcagatgagcagaatgtgggagagcctgtag

SEQ ID NO: 10483 - DNA, 1563 bp, Artificial Sequence
  Description of Artificial Sequence: Synthetic coding sequence
atgccccagctgagcctgagcagcctgggcctgtggcccatggccgccagcccctggctgctgctgctgctggtgggcgccagctggctgctggccagaatcctggcctggacctacaccttctacgacaactgctgcagactgagatgcttcccccagccccccaagagaaactggttcctgggccacctgggcctgatccacagcagcgaggagggcctgctgtacacccagagcctggcctgcaccttcggcgacatgtgctgctggtgggtgggcccctggcacgccatcgtgagaatcttccaccccacctacatcaagcccgtgctgttcgcccccgccgccatcgtgcccaaggacaaggtgttctacagcttcctgaagccctggctgggcgacggcctgctgctgagcgccggcgagaagtggagcagacacagaagaatgctgacccccgccttccacttcaacatcctgaagccctacatgaagatcttcaacgagagcgtgaacatcatgcacgccaagtggcagctgctggccagcgagggcagcgccagactggacatgttcgagcacatcagcctgatgaccctggacagcctgcagaagtgcgtgttcagcttcgacagccactgccaggagaagcccagcgagtacatcgccgccatcctggagctgagcgccctggtgaccaagagacaccagcagatcctgctgtacatcgacttcctgtactacctgacccccgacggccagagattcagaagagcctgcagactggtgcacgacttcaccgacgccgtgatccaggagagaagaagaaccctgcccagccagggcgtggacgacttcctgcaggccaaggccaagagcaagaccctggacttcatcgacgtgctgctgctgagcaaggacgaggacggcaagaagctgagcgacgaggacatcagagccgaggccgacaccttcatgttcgagggccacgacaccaccgccagcggcctgagctgggtgctgtaccacctggccaagcaccccgagtaccaggagagatgcagacaggaggtgcaggagctgctgaaggacagagagcccaaggagatcgagtgggacgacctggcccagctgcccttcctgaccatgtgcatcaaggagagcctgagactgcacccccccgtgcccgccgtgagcagatgctgcacccaggacatcgtgctgcccgacggcagagtgatccccaagggcatcatctgcctgatcagcgtgttcggcacccaccacaaccccgccgtgtggcccgaccccgaggtgtacgaccccttcagattcgaccccaagaacatcaaggagagaagccccctggccttcatccccttcagcgccggccccagaaactgcatcggccaggccttcgccatggccgagatgaaggtggtgctgggcctgaccctgctgagattcagagtgctgcccgaccacaccgagcccagaagaaagcccgagctggtgctgagagccgagggcggcctgtggctgagagtggagcccctgagctag

SEQ ID NO: 10484 - DNA, 2022 bp, Artificial Sequence
  Description of Artificial Sequence: Synthetic coding sequence
atgatgttccaggacagcgtggccttcgaggacgtggccgtgaccttcacccaggaggagtgggccctgctggaccccagccagaagaacctgtgcagagacgtgatgcaggagaccttcagaaacctggccagcatcggcaagaagtggaagccccagaacatctacgtggagtacgagaacctgagaagaaacctgagaatcgtgggcgagagactgttcgagagcaaggagggccaccagcacggcgagatcctgacccaggtgcccgacgacatgctgaagaagaccaccaccggcgtgaagagctgcgagagcagcgtgtacggcgaggtgggcagcgcccacagcagcctgaacagacacatcagagacgacaccggccacaaggcctacgagtaccaggagtacggccagaagccctacaagtgcaagtactgcaagaagcccttcaactgcctgagcagcgtgcagacccacgagagagcccacagcggcagaaagctgtacgtgtgcgaggagtgcggcaagaccttcatcagccacagcaacctgcagagacacagaatcatgcacagaggcgacggcccctacaagtgcaagttctgcggcaaggccctgatgttcctgagcctgtacctgatccacaagagaacccacaccggcgagaagccctaccagtgcaagcagtgcggcaaggccttcagccacagcagcagcctgagaatccacgagagaacccacaccggcgagaagccctacaagtgcaacgagtgcggcaaggccttccacagcagcacctgcctgcacgcccacaagagaacccacaccggcgagaagccctacgagtgcaagcagtgcggcaaggccttcagcagcagccacagcttccagatccacgagagaacccacaccggcgagaagccctacgagtgcaaggagtgcggcaaggccttcaagtgccccagcagcgtgagaagacacgagagaacccacagcagaaagaagccctacgagtgcaagcactgcggcaaggtgctgagctacctgaccagcttccagaaccacctgggcatgcacaccggcgagatcagccacaagtgcaagatctgcggcaaggccttctacagccccagcagcctgcagacccacgagaagacccacaccggcgagaagccctacaagtgcaaccagtgcggcaaggccttcaacagcagcagcagcttcagataccacgagagaacccacaccggcgagaagccctacgagtgcaagcagtgcggcaaggccttcagaagcgccagcctgctgcagacccacggcagaacccacaccggcgagaagccctacgcctgcaaggagtgcggcaagcccttcagcaacttcagcttcttccagatccacgagagaatgcacagagaggagaagccctacgagtgcaagggctacggcaagaccttcagcctgcccagcctgttccacagacacgagagaacccacaccggcggcaagacctacgagtgcaagcagtgcggcagaagcttcaactgcagcagcagcttcagataccacggcagaacccacaccggcgagaagccctacgagtgcaagcagtgcggcaaggccttcagaagcgccagccagctgcagatccacggcagaacccacaccggcgagaagccctacgagtgcaagcagtgcggcaaggccttcggcagcgccagccacctgcagatgcacggcagaacccacaccggcgagaagccctacgagtgcaagcagtgcggcaagagcttcggctgcgccagcagactgcagatgcacggcagaacccacaccggcgagaagccctacaagtgcaagcagtgcggcaaggccttcggctgccccagcaacctgagaagacacggcagaacccacaccggcgagaagccctacaagtgcaaccagtgcggcaaggtgttcagatgcagcagccagctgcaggtgcacggcagagcccactgcatcgacaccccctag

SEQ ID NO: 10485 - DNA, 1917 bp, Artificial Sequence
  Description of Artificial Sequence: Synthetic coding sequence
atgcaggagaccttcagaaacctggccagcatcggcaagaagtggaagccccagaacatctacgtggagtacgagaacctgagaagaaacctgagaatcgtgggcgagagactgttcgagagcaaggagggccaccagcacggcgagatcctgacccaggtgcccgacgacatgctgaagaagaccaccaccggcgtgaagagctgcgagagcagcgtgtacggcgaggtgggcagcgcccacagcagcctgaacagacacatcagagacgacaccggccacaaggcctacgagtaccaggagtacggccagaagccctacaagtgcaagtactgcaagaagcccttcaactgcctgagcagcgtgcagacccacgagagagcccacagcggcagaaagctgtacgtgtgcgaggagtgcggcaagaccttcatcagccacagcaacctgcagagacacagaatcatgcacagaggcgacggcccctacaagtgcaagttctgcggcaaggccctgatgttcctgagcctgtacctgatccacaagagaacccacaccggcgagaagccctaccagtgcaagcagtgcggcaaggccttcagccacagcagcagcctgagaatccacgagagaacccacaccggcgagaagccctacaagtgcaacgagtgcggcaaggccttccacagcagcacctgcctgcacgcccacaagagaacccacaccggcgagaagccctacgagtgcaagcagtgcggcaaggccttcagcagcagccacagcttccagatccacgagagaacccacaccggcgagaagccctacgagtgcaaggagtgcggcaaggccttcaagtgccccagcagcgtgagaagacacgagagaacccacagcagaaagaagccctacgagtgcaagcactgcggcaaggtgctgagctacctgaccagcttccagaaccacctgggcatgcacaccggcgagatcagccacaagtgcaagatctgcggcaaggccttctacagccccagcagcctgcagacccacgagaagacccacaccggcgagaagccctacaagtgcaaccagtgcggcaaggccttcaacagcagcagcagcttcagataccacgagagaacccacaccggcgagaagccctacgagtgcaagcagtgcggcaaggccttcagaagcgccagcctgctgcagacccacggcagaacccacaccggcgagaagccctacgcctgcaaggagtgcggcaagcccttcagcaacttcagcttcttccagatccacgagagaatgcacagagaggagaagccctacgagtgcaagggctacggcaagaccttcagcctgcccagcctgttccacagacacgagagaacccacaccggcggcaagacctacgagtgcaagcagtgcggcagaagcttcaactgcagcagcagcttcagataccacggcagaacccacaccggcgagaagccctacgagtgcaagcagtgcggcaaggccttcagaagcgccagccagctgcagatccacggcagaacccacaccggcgagaagccctacgagtgcaagcagtgcggcaaggccttcggcagcgccagccacctgcagatgcacggcagaacccacaccggcgagaagccctacgagtgcaagcagtgcggcaagagcttcggctgcgccagcagactgcagatgcacggcagaacccacaccggcgagaagccctacaagtgcaagcagtgcggcaaggccttcggctgccccagcaacctgagaagacacggcagaacccacaccggcgagaagccctacaagtgcaaccagtgcggcaaggtgttcagatgcagcagccagctgcaggtgcacggcagagcccactgcatcgacaccccctag

SEQ ID NO: 10486 - DNA, 159 bp, Artificial Sequence
  Description of Artificial Sequence: Synthetic coding sequence
atgcaggagaccttcagaaacctggccagcatcggcaagaagtggaagccccagaacatctacgtggagtacgagaacctgagaagaaacctgagaatcgtgggcgagagactgttcgagagcaaggagggccaccagcacggcgagatcctgacctag

SEQ ID NO: 10487 - DNA, 360 bp, Artificial Sequence
  Description of Artificial Sequence: Synthetic coding sequence
atgcaggagaccttcagaaacctggccagcatcggcaagaagtggaagccccagaacatctacgtggagtacgagaacctgagaagaaacctgagaatcgtgggcgagagactgttcgagagcaaggagggccaccagcacggcgagatcctgacccaggtgcccgacgacatgctgaagaagaccaccaccggcgtgaagagctgcgagagcagcgtgtacggcgaggtgggcagcgcccacagcagcctgaacagacacatcagagacgacaccggccacaaggcctacgagtaccaggagtacggccagaagccctacaagtgcaagtactgcaagaagcccttcaactgcctgtag

SEQ ID NO: 10488 - DNA, 1458 bp, Artificial Sequence
  Description of Artificial Sequence: Synthetic coding sequence
atgagagacaacagagccgtgagcctgtgccagcaggagtggatgtgccccggccccgcccagagagccctgtacagaggcgccacccagagaaaggacagccacgtgagcctggccaccggcgtgccctggggctacgaggagaccaagaccctgctggccatcctgagcagcagccagttctacggcaagctgcagacctgccagcagaacagccagatctacagagccatggccgagggcctgtgggagcagggcttcctgagaacccccgagcagtgcagaaccaagttcaagagcctgcagctgagctacagaaaggtgagaagaggcagagtgcccgagccctgcatcttctacgaggagatgaacgccctgagcggcagctgggccagcgccccccccatggccagcgacgccgtgcccggccaggagggcagcgacatcgaggccggcgagctgaaccaccagaacggcgagcccaccgaggtggaggacggcaccgtggacggcgccgacagagacgagaaggacttcagaaaccccggccaggaggtgagaaagctggacctgcccgtgctgttccccaacagactgggcttcgagttcaagaacgagatcaagaaggagaacctgaagtgggacgacagcgaggaggtggagatcaacaaggccctgcagagaaagagcagaggcgtgtactggcacagcgagctgcagaagggcctggagagcgagcccaccagcagaagacagtgcagaaacagccccggcgagagcgaggagaagacccccagccaggagaagatgagccaccagagcttctgcgccagagacaaggcctgcacccacatcctgtgcggcaagaactgcagccagagcgtgcacagcccccacaagcccgccctgaagctggagaaggtgagccagtgccccgagtgcggcaagaccttcagcagaagcagctacctggtgagacaccagagaatccacaccggcgagaagccccacaagtgcagcgagtgcggcaagggcttcagcgagagaagcaacctgaccgcccacctgagaacccacaccggcgagagaccctaccagtgcggccagtgcggcaagagcttcaaccagagcagcagcctgatcgtgcaccagagaacccacaccggcgagaagccctaccagtgcatcgtgtgcggcaagagattcaacaacagcagccagttcagcgcccacagaagaatccacaccggcgagagcccctacaagtgcgccgtgtgcggcaagatcttcaacaacagcagccacttcagcgcccacagaaagacccacaccggcgagaagccctacagatgcagccactgcgagagaggcttcaccaagaacagcgccctgaccagacaccagaccgtgcacatgaaggccgtgctgagcagccaggagggcagagacgccctgtag

SEQ ID NO: 10489 - DNA, 2094 bp, Artificial Sequence
  Description of Artificial Sequence: Synthetic coding sequence
atgatggccgccgtgaagagcaccgaggcccaccccagcagcaacaaggaccccacccagggccagaagagcgccctgcagggcaacagccccgacagcgaggccagcagacagagattcagacagttctgctaccaggaggtgaccggcccccacgaggccttcagcaagctgtgggagctgtgctgccagtggctgagacccaagacccacagcaaggaggagatcctggagctgctggtgctggagcagttcctgaccatcctgcccgaggagatccagacctgggtgagagagcagcaccccgagaacggcgaggaggccgtggccctggtggaggacgtgcagagagcccccggccagcaggtgctggacagcgagaaggacctgaaggtgctgatgaaggagatggcccccctgggcgccaccagagagagcctgagaagccagtggaagcaggaggtgcagcccgaggagcccaccttcaagggcagccagagcagccaccagagacccggcgagcagagcgaggcctggctggccccccaggcccccagaaacctgccccagaacaccggcctgcacgaccaggagaccggcgccgtggtgtggaccgccggcagccagggccccgccatgagagacaacagagccgtgagcctgtgccagcaggagtggatgtgccccggccccgcccagagagccctgtacagaggcgccacccagagaaaggacagccacgtgagcctggccaccggcgtgccctggggctacgaggagaccaagaccctgctggccatcctgagcagcagccagttctacggcaagctgcagacctgccagcagaacagccagatctacagagccatggccgagggcctgtgggagcagggcttcctgagaacccccgagcagtgcagaaccaagttcaagagcctgcagctgagctacagaaaggtgagaagaggcagagtgcccgagccctgcatcttctacgaggagatgaacgccctgagcggcagctgggccagcgccccccccatggccagcgacgccgtgcccggccaggagggcagcgacatcgaggccggcgagctgaaccaccagaacggcgagcccaccgaggtggaggacggcaccgtggacggcgccgacagagacgagaaggacttcagaaaccccggccaggaggtgagaaagctggacctgcccgtgctgttccccaacagactgggcttcgagttcaagaacgagatcaagaaggagaacctgaagtgggacgacagcgaggaggtggagatcaacaaggccctgcagagaaagagcagaggcgtgtactggcacagcgagctgcagaagggcctggagagcgagcccaccagcagaagacagtgcagaaacagccccggcgagagcgaggagaagacccccagccaggagaagatgagccaccagagcttctgcgccagagacaaggcctgcacccacatcctgtgcggcaagaactgcagccagagcgtgcacagcccccacaagcccgccctgaagctggagaaggtgagccagtgccccgagtgcggcaagaccttcagcagaagcagctacctggtgagacaccagagaatccacaccggcgagaagccccacaagtgcagcgagtgcggcaagggcttcagcgagagaagcaacctgaccgcccacctgagaacccacaccggcgagagaccctaccagtgcggccagtgcggcaagagcttcaaccagagcagcagcctgatcgtgcaccagagaacccacaccggcgagaagccctaccagtgcatcgtgtgcggcaagagattcaacaacagcagccagttcagcgcccacagaagaatccacaccggcgagagcccctacaagtgcgccgtgtgcggcaagatcttcaacaacagcagccacttcagcgcccacagaaagacccacaccggcgagaagccctacagatgcagccactgcgagagaggcttcaccaagaacagcgccctgaccagacaccagaccgtgcacatgaaggccgtgctgagcagccaggagggcagagacgccctgtag

SEQ ID NO: 10490 - DNA, 2094 bp, Artificial Sequence; identical to SEQ ID NO: 10489
  Description of Artificial Sequence: Synthetic coding sequence

SEQ ID NO: 10491 - DNA, 771 bp, Artificial Sequence
  Description of Artificial Sequence: Synthetic coding sequence
atggccgccgtgaagagcaccgaggcccaccccagcagcaacaaggaccccacccagggccagaagagcgccctgcagggcaacagccccgacagcgaggccagcagacagagattcagacagttctgctaccaggaggtgaccggcccccacgaggccttcagcaagctgtgggagctgtgctgccagtggctgagacccaagacccacagcaaggaggagatcctggagctgctggtgctggagcagttcctgaccatcctgcccgaggagatccagacctgggtgagagagcagcaccccgagaacggcgaggaggccgtggccctggtggaggacgtgcagagagcccccggccagcaggtgctggacagcgagaaggacctgaaggtgctgatgaaggagatggcccccctgggcgccaccagagagagcctgagaagccagtggaagcaggaggtgcagcccgaggagcccaccttcaagggcagccagagcagccaccagagacccggcgagcagagcgaggcctggctggccccccaggcccccagaaacctgccccagaacaccggcctgcacgaccaggagaccggcgccgtggtgtggaccgccggcagccagggccccgccatgagagacaacagagccgtgagcctgtgccagcaggagtggatgtgccccggccccgcccagagagccctgtacagaggcgccacccagagaaaggacagccacgtgagcctggccaccggcgccctgggcctgtag

SEQ ID NO: 10492 - DNA, 648 bp, Artificial Sequence
  Description of Artificial Sequence: Synthetic coding sequence
atgagagacaacagagccgtgagcctgtgccagcaggagtggatgtgccccggccccgcccagagagccctgtacagaggcgccacccagagaaaggacagccacgtgagcctggccaccggcgtgccctggggctacgaggagaccaagaccctgctggccatcctgagcagcagccagttctacggcaagctgcagacctgccagcagaacagccagatctacagagccatggccgagggcctgtgggagcagggcttcctgagaacccccgagcagtgcagaaccaagttcaagagcctgcagctgagctacagaaaggtgagaagaggcagagtgcccgagccctgcatcttctacgaggagatgaacgccctgagcggcagctgggccagcgccccccccatggccagcgacgccgtgcccggccaggagggcagcgacatcgaggccggcgagctgaaccaccagaacggcgagcccaccgaggtggaggacggcaccgtggacggcgccgacagagacgagaaggacttcagaaaccccggccaggaggtgagaaagctggacctgcccgtgctgttccccaacagactgggcaagacccccctggccctgatggtgaagggctggcagagccccctgtag

SEQ ID NO: 10493 - DNA, 1227 bp, Artificial Sequence
  Description of Artificial Sequence: Synthetic coding sequence
atggccgagggcctgtgggagcagggcttcctgagaacccccgagcagtgcagaaccaagttcaagagcctgcagctgagctacagaaaggtgagaagaggcagagtgcccgagccctgcatcttctacgaggagatgaacgccctgagcggcagctgggccagcgccccccccatggccagcgacgccgtgcccggccaggagggcagcgacatcgaggccggcgagctgaaccaccagaacggcgagcccaccgaggtggaggacggcaccgtggacggcgccgacagagacgagaaggacttcagaaaccccggccaggaggtgagaaagctggacctgcccgtgctgttccccaacagactgggcttcgagttcaagaacgagatcaagaaggagaacctgaagtgggacgacagcgaggaggtggagatcaacaaggccctgcagagaaagagcagaggcgtgtactggcacagcgagctgcagaagggcctggagagcgagcccaccagcagaagacagtgcagaaacagccccggcgagagcgaggagaagacccccagccaggagaagatgagccaccagagcttctgcgccagagacaaggcctgcacccacatcctgtgcggcaagaactgcagccagagcgtgcacagcccccacaagcccgccctgaagctggagaaggtgagccagtgccccgagtgcggcaagaccttcagcagaagcagctacctggtgagacaccagagaatccacaccggcgagaagccccacaagtgcagcgagtgcggcaagggcttcagcgagagaagcaacctgaccgcccacctgagaacccacaccggcgagagaccctaccagtgcggccagtgcggcaagagcttcaaccagagcagcagcctgatcgtgcaccagagaacccacaccggcgagaagccctaccagtgcatcgtgtgcggcaagagattcaacaacagcagccagttcagcgcccacagaagaatccacaccggcgagagcccctacaagtgcgccgtgtgcggcaagatcttcaacaacagcagccacttcagcgcccacagaaagacccacaccggcgagaagccctacagatgcagccactgcgagagaggcttcaccaagaacagcgccctgaccagacaccagaccgtgcacatgaaggccgtgctgagcagccaggagggcagagacgccctgtag

SEQ ID NO: 10494 - DNA, 2457 bp, Artificial Sequence
  Description of Artificial Sequence: Synthetic coding sequence
atggacagcgagagcaacatccccagcggcaccatccagagcagaaagggcctgcagaacaagagccagttcagaaccatcgcccccaagatcgtgcccaaggtgctgaccagcagaatgctgccctgccacagccccagcagaagcgaccaggtgaacctgggccccagcatcaacagcaagctgctgggcatgagcacccagaactacgccctgatgcaggtggccggccaggagggcaccttcagcctggtggccctgccccacgtggccagcgcccagcccatccagaagcccagaatgagcctgcccgagaacctgaagctgcccatccccagataccagccccccagaaacagcaaggccagcagaaagaagcccatcctgatcttccccaagagcggctgcagcaaggcccccgcccagacccagatgtgcccccagatgagccccagccccccccaccaccccgagctgctgtacaagcccagccccttcgaggaggtgcccagcctggagcaggcccccgccagcatcagcaccgccgccctgaccaacggcagcgaccacggcgacctgagaccccccgtgaccaacacccacggcagcctgaacccccccgccacccccgccagcagcacccccgaggagcccgccaagcaggacctgaccgccctgagcggcaaggcccacttcgtgagcaagatcaccagcagcaagcccagcgccgtggccagcgagaagttcaaggagcaggtggacctggccaagaccatgaccaacctgagccccaccatcctgggcaacgccgtgcagctgatcagcagcgtgcccaagggcaagctgcccatccccccctacagcagaatgaagaccatggaggtgtacaagatcaagagcgacgccaacatcgccggcttcagcctgcccggccccaaggccgactgcgacaagatccccagcaccaccgagggcttcaacgccgccaccaaggtggccagcagactgcccgtgccccaggtgagccagcagagcgcctgcgagagcgccttctgcccccccaccaagctggacctgaaccacaagaccaagctgaacagcggcgccgccaagagaaagggcagaaagagaaaggtgcccgacgagatcctggccttccagggcaagagaagaaagtacatcatcaacaagtgcagagacggcaaggagagagtgaagaacgacccccaggagttcagagaccagaagctgggcaccctgaagaagtacagaagcatcatgcccaagcccatcatggtgatccccaccctggccagcctggccagccccaccaccctgcagagccagatgctgggcggcctgggccaggacgtgctgctgaacaacagcctgacccccaagtacctgggctgcaagcaggacaacagcagcagccccaagcccagcagcgtgttcagaaacggcttcagcggcatcaagaagccctggcacagatgccacgtgtgcaaccaccacttccagttcaagcagcacctgagagaccacatgaacacccacaccaacagaagaccctacagctgcagaatctgcagaaagagctacgtgagacccggcagcctgagcacccacatgaagctgcaccacggcgagaacagactgaagaagctgatgtgctgcgagttctgcgccaaggtgttcggccacatcagagtgtacttcggccacctgaaggaggtgcacagagtggtgatcagcaccgagcccgcccccagcgagctgcagcccggcgacatccccaagaacagagacatgagcgtgagaggcatggagggcagcctggagagagagaacaagagcaacctggaggaggacttcctgctgaaccaggccgacgaggtgaagctgcagatcaagtgcggcagatgccagatcaccgcccagagcttcgccgagatcaagttccacctgctggacgtgcacggcgaggagatcgagggcagactgcaggagggcaccttccccggcagcaagggcacccaggaggagctggtgcagcacgccagccccgactggaagagacaccccgagagaggcaagcccgagaaggtgcacagcagcagcgaggagagccacgcctgccccagactgaagagacagctgcacctgcaccagaacggcgtggagatgctgatggagaacgagggcccccagagcggcaccaacaagcccagagagacctgccagggccccgagtgccccggcctgcacaccttcctgctgtggagccacagcggcttcaactgcctgctgtgcgccgagatgctgggcagaaaggaggacctgctgcaccactggaagcaccagcacaactgcgaggaccccagcaagctgtgggccatcctgaacaccgtgagcaaccagggcgtgatcgagctgagcagcgaggccgagaagtag

SEQ ID NO: 10495 - DNA, 2487 bp, Artificial Sequence
  Description of Artificial Sequence: Synthetic coding sequence
atgcagaacagcgtgagcgtgccccccaaggacgagggcgagagcaacatccccagcggcaccatccagagcagaaagggcctgcagaacaagagccagttcagaaccatcgcccccaagatcgtgcccaaggtgctgaccagcagaatgctgccctgccacagccccagcagaagcgaccaggtgaacctgggccccagcatcaacagcaagctgctgggcatgagcacccagaactacgccctgatgcaggtggccggccaggagggcaccttcagcctggtggccctgccccacgtggccagcgcccagcccatccagaagcccagaatgagcctgcccgagaacctgaagctgcccatccccagataccagccccccagaaacagcaaggccagcagaaagaagcccatcctgatcttccccaagagcggctgcagcaaggcccccgcccagacccagatgtgcccccagatgagccccagccccccccaccaccccgagctgctgtacaagcccagccccttcgaggaggtgcccagcctggagcaggcccccgccagcatcagcaccgccgccctgaccaacggcagcgaccacggcgacctgagaccccccgtgaccaacacccacggcagcctgaacccccccgccacccccgccagcagcacccccgaggagcccgccaagcaggacctgaccgccctgagcggcaaggcccacttcgtgagcaagatcaccagcagcaagcccagcgccgtggccagcgagaagttcaaggagcaggtggacctggccaagaccatgaccaacctgagccccaccatcctgggcaacgccgtgcagctgatcagcagcgtgcccaagggcaagctgcccatccccccctacagcagaatgaagaccatggaggtgtacaagatcaagagcgacgccaacatcgccggcttcagcctgcccggccccaaggccgactgcgacaagatccccagcaccaccgagggcttcaacgccgccaccaaggtggccagcagactgcccgtgccccaggtgagccagcagagcgcctgcgagagcgccttctgcccccccaccaagctggacctgaaccacaagaccaagctgaacagcggcgccgccaagagaaagggcagaaagagaaaggtgcccgacgagatcctggccttccagggcaagagaagaaagtacatcatcaacaagtgcagagacggcaaggagagagtgaagaacgacccccaggagttcagagaccagaagctgggcaccctgaagaagtacagaagcatcatgcccaagcccatcatggtgatccccaccctggccagcctggccagccccaccaccctgcagagccagatgctgggcggcctgggccaggacgtgctgctgaacaacagcctgacccccaagtacctgggctgcaagcaggacaacagcagcagccccaagcccagcagcgtgttcagaaacggcttcagcggcatcaagaagccctggcacagatgccacgtgtgcaaccaccacttccagttcaagcagcacctgagagaccacatgaacacccacaccaacagaagaccctacagctgcagaatctgcagaaagagctacgtgagacccggcagcctgagcacccacatgaagctgcaccacggcgagaacagactgaagaagctgatgtgctgcgagttctgcgccaaggtgttcggccacatcagagtgtacttcggccacctgaaggaggtgcacagagtggtgatcagcaccgagcccgcccccagcgagctgcagcccggcgacatccccaagaacagagacatgagcgtgagaggcatggagggcagcctggagagagagaacaagagcaacctggaggaggacttcctgctgaaccaggccgacgaggtgaagctgcagatcaagtgcggcagatgccagatcaccgcccagagcttcgccgagatcaagttccacctgctggacgtgcacggcgaggagatcgagggcagactgcaggagggcaccttccccggcagcaagggcacccaggaggagctggtgcagcacgccagccccgactggaagagacaccccgagagaggcaagcccgagaaggtgcacagcagcagcgaggagagccacgcctgccccagactgaagagacagctgcacctgcaccagaacggcgtggagatgctgatggagaacgagggcccccagagcggcaccaacaagcccagagagacctgccagggccccgagtgccccggcctgcacaccttcctgctgtggagccacagcggcttcaactgcctgctgtgcgccgagatgctgggcagaaaggaggacctgctgcaccactggaagcaccagcacaactgcgaggaccccagcaagctgtgggccatcctgaacaccgtgagcaaccagggcgtgatcgagctgagcagcgaggccgagaagtag

SEQ ID NO: 10496 - DNA, 1179 bp, Artificial Sequence
  Description of Artificial Sequence: Synthetic coding sequence
atgcccaagcccatcatggtgatccccaccctggccagcctggccagccccaccaccctgcagagccagatgctgggcggcctgggccaggacgtgctgctgaacaacagcctgacccccaagtacctgggctgcaagcaggacaacagcagcagccccaagcccagcagcgtgttcagaaacggcttcagcggcatcaagaagccctggcacagatgccacgtgtgcaaccaccacttccagttcaagcagcacctgagagaccacatgaacacccacaccaacagaagaccctacagctgcagaatctgcagaaagagctacgtgagacccggcagcctgagcacccacatgaagctgcaccacggcgagaacagactgaagaagctgatgtgctgcgagttctgcgccaaggtgttcggccacatcagagtgtacttcggccacctgaaggaggtgcacagagtggtgatcagcaccgagcccgcccccagcgagctgcagcccggcgacatccccaagaacagagacatgagcgtgagaggcatggagggcagcctggagagagagaacaagagcaacctggaggaggacttcctgctgaaccaggccgacgaggtgaagctgcagatcaagtgcggcagatgccagatcaccgcccagagcttcgccgagatcaagttccacctgctggacgtgcacggcgaggagatcgagggcagactgcaggagggcaccttccccggcagcaagggcacccaggaggagctggtgcagcacgccagccccgactggaagagacaccccgagagaggcaagcccgagaaggtgcacagcagcagcgaggagagccacgcctgccccagactgaagagacagctgcacctgcaccagaacggcgtggagatgctgatggagaacgagggcccccagagcggcaccaacaagcccagagagacctgccagggccccgagtgccccggcctgcacaccttcctgctgtggagccacagcggcttcaactgcctgctgtgcgccgagatgctgggcagaaaggaggacctgctgcaccactggaagcaccagcacaactgcgaggaccccagcaagctgtgggccatcctgaacaccgtgagcaaccagggcgtgatcgagctgagcagcgaggccgagaagtag

SEQ ID NO: 10497 - DNA, 2487 bp, Artificial Sequence; identical to SEQ ID NO: 10495
  Description of Artificial Sequence: Synthetic coding sequence

SEQ ID NO: 10498 - DNA, 1644 bp, Artificial Sequence
  Description of Artificial Sequence: Synthetic coding sequence
atgcagaacagcgtgagcgtgccccccaaggacgagggcgagagcaacatccccagcggcaccatccagagcagaaagggcctgcagaacaagagccagttcagaaccatcgcccccaagatcgtgcccaaggtgctgaccagcagaatgctgccctgccacagccccagcagaagcgaccaggacctgagacccaccgtgatcagatacccccccccccagaaggccctgatgcagccccccagatggcaggccggctacctgttccacaagaccaagctgaacagcggcgccgccaagagaaagggcagaaagagaaaggtgcccgacgagatcctggccttccagggcaagagaagaaagtacatcatcaacaagtgcagagacggcaaggagagagtgaagaacgacccccaggagttcagagaccagaagctgggcaccctgaagaagtacagaagcatcatgcccaagcccatcatggtgatccccaccctggccagcctggccagccccaccaccctgcagagccagatgctgggcggcctgggccaggacgtgctgctgaacaacagcctgacccccaagtacctgggctgcaagcaggacaacagcagcagccccaagcccagcagcgtgttcagaaacggcttcagcggcatcaagaagccctggcacagatgccacgtgtgcaaccaccacttccagttcaagcagcacctgagagaccacatgaacacccacaccaacagaagaccctacagctgcagaatctgcagaaagagctacgtgagacccggcagcctgagcacccacatgaagctgcaccacggcgagaacagactgaagaagctgatgtgctgcgagttctgcgccaaggtgttcggccacatcagagtgtacttcggccacctgaaggaggtgcacagagtggtgatcagcaccgagcccgcccccagcgagctgcagcccggcgacatccccaagaacagagacatgagcgtgagaggcatggagggcagcctggagagagagaacaagagcaacctggaggaggacttcctgctgaaccaggccgacgaggtgaagctgcagatcaagtgcggcagatgccagatcaccgcccagagcttcgccgagatcaagttccacctgctggacgtgcacggcgaggagatcgagggcagactgcaggagggcaccttccccggcagcaagggcacccaggaggagctggtgcagcacgccagccccgactggaagagacaccccgagagaggcaagcccgagaaggtgcacagcagcagcgaggagagccacgcctgccccagactgaagagacagctgcacctgcaccagaacggcgtggagatgctgatggagaacgagggcccccagagcggcaccaacaagcccagagagacctgccagggccccgagtgccccggcctgcacaccttcctgctgtggagccacagcggcttcaactgcctgctgtgcgccgagatgctgggcagaaaggaggacctgctgcaccactggaagcaccagcacaactgcgaggaccccagcaagctgtgggccatcctgaacaccgtgagcaaccagggcgtgatcgagctgagcagcgaggccgagaagtag

SEQ ID NO: 10499 - DNA, 2487 bp, Artificial Sequence; identical to SEQ ID NO: 10495
  Description of Artificial Sequence: Synthetic coding sequence

SEQ ID NO: 10500 - DNA, 2487 bp, Artificial Sequence; identical to SEQ ID NO: 10495
  Description of Artificial Sequence: Synthetic coding sequence

SEQ ID NO: 10501 - DNA, 2457 bp, Artificial Sequence; identical to SEQ ID NO: 10494
  Description of Artificial Sequence: Synthetic coding sequence

SEQ ID NO: 10502 - DNA, 2457 bp, Artificial Sequence; identical to SEQ ID NO: 10494
  Description of Artificial Sequence: Synthetic coding sequence

SEQ ID NO: 10503 - DNA, 2340 bp, Artificial Sequence
  Description of Artificial Sequence: Synthetic coding sequence
atgctgccctgccacagccccagcagaagcgaccaggtgaacctgggccccagcatcaacagcaagctgctgggcatgagcacccagaactacgccctgatgcaggtggccggccaggagggcaccttcagcctggtggccctgccccacgtggccagcgcccagcccatccagaagcccagaatgagcctgcccgagaacctgaagctgcccatccccagataccagccccccagaaacagcaaggccagcagaaagaagcccatcctgatcttccccaagagcggctgcagcaaggcccccgcccagacccagatgtgcccccagatgagccccagccccccccaccaccccgagctgctgtacaagcccagccccttcgaggaggtgcccagcctggagcaggcccccgccagcatcagcaccgccgccctgaccaacggcagcgaccacggcgacctgagaccccccgtgaccaacacccacggcagcctgaacccccccgccacccccgccagcagcacccccgaggagcccgccaagcaggacctgaccgccctgagcggcaaggcccacttcgtgagcaagatcaccagcagcaagcccagcgccgtggccagcgagaagttcaaggagcaggtggacctggccaagaccatgaccaacctgagccccaccatcctgggcaacgccgtgcagctgatcagcagcgtgcccaagggcaagctgcccatccccccctacagcagaatgaagaccatggaggtgtacaagatcaagagcgacgccaacatcgccggcttcagcctgcccggccccaaggccgactgcgacaagatccccagcaccaccgagggcttcaacgccgccaccaaggtggccagcagactgcccgtgccccaggtgagccagcagagcgcctgcgagagcgccttctgcccccccaccaagctggacctgaaccacaagaccaagctgaacagcggcgccgccaagagaaagggcagaaagagaaaggtgcccgacgagatcctggccttccagggcaagagaagaaagtacatcatcaacaagtgcagagacggcaaggagagagtgaagaacgacccccaggagttcagagaccagaagctgggcaccctgaagaagtacagaagcatcatgcccaagcccatcatggtgatccccaccctggccagcctggccagccccaccaccctgcagagccagatgctgggcggcctgggccaggacgtgctgctgaacaacagcctgacccccaagtacctgggctgcaagcaggacaacagcagcagccccaagcccagcagcgtgttcagaaacggcttcagcggcatcaagaagccctggcacagatgccacgtgtgcaaccaccacttccagttcaagcagcacctgagagaccacatgaacacccacaccaacagaagaccctacagctgcagaatctgcagaaagagctacgtgagacccggcagcctgagcacccacatgaagctgcaccacggcgagaacagactgaagaagctgatgtgctgcgagttctgcgccaaggtgttcggccacatcagagtgtacttcggccacctgaaggaggtgcacagagtggtgatcagcaccgagcccgcccccagcgagctgcagcccggcgacatccccaagaacagagacatgagcgtgagaggcatggagggcagcctggagagagagaacaagagcaacctggaggaggacttcctgctgaaccaggccgacgaggtgaagctgcagatcaagtgcggcagatgccagatcaccgcccagagcttcgccgagatcaagttccacctgctggacgtgcacggcgaggagatcgagggcagactgcaggagggcaccttccccggcagcaagggcacccaggaggagctggtgcagcacgccagccccgactggaagagacaccccgagagaggcaagcccgagaaggtgcacagcagcagcgaggagagccacgcctgccccagactgaagagacagctgcacctgcaccagaacggcgtggagatgctgatggagaacgagggcccccagagcggcaccaacaagcccagagagacctgccagggccccgagtgccccggcctgcacaccttcctgctgtggagccacagcggcttcaactgcctgctgtgcgccgagatgctgggcagaaaggaggacctgctgcaccactggaagcaccagcacaactgcgaggaccccagcaagctgtgggccatcctgaacaccgtgagcaaccagggcgtgatcgagctgagcagcgaggccgagaagtag

SEQ ID NO: 10504 - DNA, 1500 bp, Artificial Sequence
  Description of Artificial Sequence: Synthetic coding sequence
atgctgagcctgagccccatcctgctgtacacctgcgagatgttccaggaccccgtggccttcaaggacgtggccgtgaacttcacccaggaggagtgggccctgctggacatcagccagaagaacctgtacagagaggtgatgctggagaccttctggaacctgaccagcatcggcaagaagtggaaggaccagaacatcgagtacgagtaccagaaccccagaagaaacttcagaagcgtgaccgaggagaaggtgaacgagatcaaggaggacagccactgcggcgagaccttcacccccgtgcccgacgacagactgaacttccagaagaagaaggccagccccgaggtgaagagctgcgacagcttcgtgtgcgaggtgggcctgggcaacagcagcagcaacatgaacatcagaggcgacaccggccacaaggcctgcgagtgccaggagtacggccccaagccctggaagagccagcagcccaagaaggccttcagataccaccccagcctgagaacccaggagagagaccacaccggcaagaagccctacgcctgcaaggagtgcggcaagaacatcatctaccacagcagcatccagagacacatggtggtgcacagcggcgacggcccctacaagtgcaagttctgcggcaaggccttccactgcctgagcctgtacctgatccacgagagaacccacaccggcgagaagccctacgagtgcaagcagtgcggcaagagcttcagctacagcgccacccacagaatccacgagagaacccacatcggcgagaagccctacgagtgccaggagtgcggcaaggccttccacagccccagaagctgccacagacacgagagaagccacatgggcgagaaggcctaccagtgcaaggagtgcggcaaggccttcatgtgccccagatacgtgagaagacacgagagaacccacagcagaaagaagctgtacgagtgcaagcagtgcggcaaggccctgagcagcctgaccagcttccagacccacatcagaatgcacagcggcgagagaccctacgagtgcaagacctgcggcaagggcttctacagcgccaagagcttccagagacacgagaagacccacagcggcgagaagccctacaagtgcaagcagtgcggcaaggccttcaccagaagcggcagcttcagataccacgagagaacccacaccggcgagaagccctacgagtgcaagcagtgcggcaaggccttcagaagcgcccccaacctgcagctgcacggcagaacccacaccggcgagaagccctaccagtgcaaggagtgcggcaaggccttcagaagcgccagccagctgagaatccacagaagaatccacaccggcgagaagccctacgagtgcaagaagtgcggcaaggccttcagatacgtgcagaacttcagattccacgagagaacccagacccacaagaacgccctgtggagaaagaccctgtag

SEQ ID NO: 10505 - DNA, 1788 bp, Artificial Sequence
  Description of Artificial Sequence: Synthetic coding sequence
atggaccccgtggccttcaaggacgtggccgtgaacttcacccaggaggagtgggccctgctggacatcagccagagaaagctgtacagagaggtgatgctggagaccttcagaaacctgaccagcctgggcaagagatggaaggaccagaacatcgagtacgagcaccagaaccccagaagaaacttcagaagcctgatcgaggagaaggtgaacgagatcaaggacgacagccactgcggcgagaccttcacccccgtgcccgacgacagactgaacttccaggagaagaaggccagccccgaggtgaagagctgcgagagcttcgtgtgcggcgaggtgggcctgggcaacagcagcttcaacatgaacatcagaggcgacatcggccacaaggcctacgagtaccaggagtacggccccaagccctgcaagtgccagcagcccaagaaggccttcagatacagacccagcttcagaacccaggagagagaccacaccggcgagaagcccaacgcctgcaaggtgtgcggcaagaccttcatcagccacagcagcgtgagaagacacatggtgatgcacagcggcgacggcccctacaagtgcaagttctgcggcaaggccttccactgcctgagactgtacctgatccacgagagaatccacaccggcgagaagccctgcgagtgcaagcagtgcggcaagagcttcagctacagcgccacccacagaatccacaagagaacccacaccggcgagaagccctacgagtaccaggagtgcggcaaggccttccacagccccagaagctacagaagacacgagagaatccacatgggcgagaaggcctaccagtgcaaggagtgcggcaaggccttcacctgccccagatacgtgagaatccacgagagaacccacagcagaaagaacctgtacgagtgcaagcagtgcggcaaggccctgagcagcctgaccagcttccagacccacgtgagactgcacagcggcgagagaccctacgagtgcaagatctgcggcaaggacttctgcagcgtgaacagcttccagagacacgagaagatccacagcggcgagaagccctacaagtgcaagcagtgcggcaaggccttcccccacagcagcagcctgagataccacgagagaacccacaccggcgagaagccctacgagtgcaagcagtgcggcaaggccttcagaagcgccagccacctgagagtgcacggcagaacccacaccggcgagaagccctacgagtgcaaggagtgcggcaaggccttcagatacgtgaacaacctgcagagccacgagagaacccagacccacatcagaatccacagcggcgagagaagatacaagtgcaagatctgcggcaagggcttctactgccccaagagcttccagagacacgagaagacccacaccggcgagaagctgtacgagtgcaagcagagaagcgtggtgcccagcgtggtgcccgtgcccttcgacatcatgaagggcctgaccctggagagaagccccatcaacgccagcaacgtgggcaagcccagcgagctgtgccagagcttcgagtgcatggtgggcctgaccctgaagagaaaccccatgagcgtgagcaacgacggcaagcccagcgacctgccccacaccttcgagtacgtggtgggccacaccatggagagaagccccatgcacgtgagaaacgtgggcaaccccagcgacctgcccagaaccttcgagttcatgaagggccacaagcacacctag

SEQ ID NO: 10506 - DNA, 2082 bp, Artificial Sequence
  Description of Artificial Sequence: Synthetic coding sequence
atggacagcgtggccttcgaggacgtggccatcaacttcacctgcgaggagtgggccctgctgggccccagccagaagagcctgtacagagacgtgatgcaggagaccatcagaaacctggactgcatcggcatgatctggcagaaccacgacatcgaggaggaccagtacaaggacctgagaagaaacctgagatgccacatggtggagagagcctgcgagatcaaggacaacagccagtgcggcggccccttcacccagacccaggacagcatcgtgaacgagaagatccccggcgtggacccctgggagagcagcgagtgcaccgacgtgctgatgggcagaagcagcctgaactgctacgtgagagtggacagcgagcacaagccctgcgagtaccaggagtacggcgagaagccctacacccacacccagtgcggcaccgccttcagctaccagccctgcttccagatccacgagagaccccagcacggcaagaagctgtacgactgcaaggagtgcgccagcttcagcagcctggagaacctgcagagacacatggccgcccaccacggcgacggccccagaatctgcaagctgtgcggcaacgccttcatctggcccagcctgttccacatgctgagaagaacccacaccgaggagaagccctacgagtacgagcagtgcagcaccgccttccccgcctacagcagcaccctgagacacgagagaacccacagcggcgagaagccctaccagtgcaagcagtgcggcaaggccttcagctgcagctgctacacccagctgtacgagagaacccacaccggcgagcagagctacgagtgcaagcagtgcggcaaggccttctaccacctgggcagcttccagagacacatgatcgtgcacaccggcgacggcccccacaagtgcaagatctgcggcaagggcttcctgagccccagcagcgtgagaagacacaagagaacccacaccggcgagaagccctacgagtgcaagtactgcggcaaggccttcagcgactgcaccggcttcagaagacacatgatcacccacaccggcgacggcccccacaagtgcaaggtgtgcggcaaggccttcgacagccccagcctgtgcagaagacacgagaccacccacaccggcgagaagccctacaagtgcgagtgcggcaaggccttcagcgacttctactacttcagaaaccacgagaccacccacaccggcgagaagccctacaagtgcaagcagtgcggcaaggccttcatctgctgcacctacctgcagatccacgagagaatccacaccggcgagagaccctacaagtgcaagcagtgcggcaaggccttcagaagcagcaactacatcagagtgcacgagaagacccacaccggcgagaagccctacgagtgcaagcagtgcggcaaggccctgagccacctgaagagcttccagagacacatgatcatgcacaccggcgacggcccccacaagtgcaagatctgcggcaagagcttcgacagccccagcagcttcagaagacacgagagaatccacaccggcgagagaccctacaagtgcaagctgtgcggcaagggcttcagaagcagcagctacatccagctgcacgagagaacccacaccggcgagaagccctacggctgccagcagtgcggcaaggccctgagcgacctgagcagcttcagaagacacatgatcacccacaccggcaacggcccccacaagtgcaagatctgcggcaagggcttcgactaccccagcagcgtgcagagacacgagagaacccacaccggcgagaagccctacgagtgcaaggagtgcggcaaggccttcagccacagcagctacctgagaatccacgagagagtgcacaccggcgagaagccctacaagtgcaaggagtgcggcaagcccttccactgccccagcgccttccacaagcacgagagaacccacagcatggagaagccctacaagtgcaaggagtgcggcgaggccttccactgcatcagcagcttccacaagcacgagatgacccactag

SEQ ID NO: 10507 - DNA, 1881 bp, Artificial Sequence
  Description of Artificial Sequence: Synthetic coding sequence
atggtggagagagcctgcgagatcaaggacaacagccagtgcggcggccccttcacccagacccaggacagcatcgtgaacgagaagatccccggcgtggacccctgggagagcagcgagtgcaccgacgtgctgatgggcagaagcagcctgaactgctacgtgagagtggacagcgagcacaagccctgcgagtaccaggagtacggcgagaagccctacacccacacccagtgcggcaccgccttcagctaccagccctgcttccagatccacgagagaccccagcacggcaagaagctgtacgactgcaaggagtgcgccagcttcagcagcctggagaacctgcagagacacatggccgcccaccacggcgacggccccagaatctgcaagctgtgcggcaacgccttcatctggcccagcctgttccacatgctgagaagaacccacaccgaggagaagccctacgagtacgagcagtgcagcaccgccttccccgcctacagcagcaccctgagacacgagagaacccacagcggcgagaagccctaccagtgcaagcagtgcggcaaggccttcagctgcagctgctacacccagctgtacgagagaacccacaccggcgagcagagctacgagtgcaagcagtgcggcaaggccttctaccacctgggcagcttccagagacacatgatcgtgcacaccggcgacggcccccacaagtgcaagatctgcggcaagggcttcctgagccccagcagcgtgagaagacacaagagaacccacaccggcgagaagccctacgagtgcaagtactgcggcaaggccttcagcgactgcaccggcttcagaagacacatgatcacccacaccggcgacggcccccacaagtgcaaggtgtgcggcaaggccttcgacagccccagcctgtgcagaagacacgagaccacccacaccggcgagaagccctacaagtgcgagtgcggcaaggccttcagcgacttctactacttcagaaaccacgagaccacccacaccggcgagaagccctacaagtgcaagcagtgcggcaaggccttcatctgctgcacctacctgcagatccacgagagaatccacaccggcgagagaccctacaagtgcaagcagtgcggcaaggccttcagaagcagcaactacatcagagtgcacgagaagacccacaccggcgagaagccctacgagtgcaagcagtgcggcaaggccctgagccacctgaagagcttccagagacacatgatcatgcacaccggcgacggcccccacaagtgcaagatctgcggcaagagcttcgacagccccagcagcttcagaagacacgagagaatccacaccggcgagagaccctacaagtgcaagctgtgcggcaagggcttcagaagcagcagctacatccagctgcacgagagaacccacaccggcgagaagccctacggctgccagcagtgcggcaaggccctgagcgacctgagcagcttcagaagacacatgatcacccacaccggcaacggcccccacaagtgcaagatctgcggcaagggcttcgactaccccagcagcgtgcagagacacgagagaacccacaccggcgagaagccctacgagtgcaaggagtgcggcaaggccttcagccacagcagctacctgagaatccacgagagagtgcacaccggcgagaagccctacaagtgcaaggagtgcggcaagcccttccactgccccagcgccttccacaagcacgagagaacccacagcatggagaagccctacaagtgcaaggagtgcggcgaggccttccactgcatcagcagcttccacaagcacgagatgacccactag

SEQ ID NO: 10508 - DNA, 1884 bp, Artificial Sequence
  Description of Artificial Sequence: Synthetic coding sequence
atgatcgtgttcggcggcgaggacagaagcgacctgttcctgcccgacagccagaccaacgaggagagaaagcagtacgacagcgtggccttcgaggacgtggccgtgaacttcacccaggaggagtgggccctgctgggccccagccagaagagcctgtacagagacgtgatgtgggagaccatcagaaacctggactgcatcggcatgaagtgggaggacaccaacatcgaggaccagcacagaaaccccagaagaagcctgagatgccacatcatcgagagattcagcgagagcagacagcccgacagcaccgtgaacgagaagccccccggcgtggacccctgcaagagcagcgtgtgcggcgagatcatgggctgcagcttcctgaactgctacatcaccttcgacgccggccacaagcccgacgagtgccaggagtacggcgagaagccccacacccacaagcagtgcggcaccgccttcaactaccaccacagcttccagacccaggagagaccccacaccggcaagaagagatacgactgcaaggagtgcggcaagaccttcagcagcagcggcaacctgagaagacacatcatcgtgcagagaggcggcggcccctacatctgcaagctgtgcggcaaggccttcttctggcccagcctgttcagaatgcacgagagaacccacaccggcgagaagccctacgagtgcaagcagtgctgcaaggccttccccatctacagcagctacctgagacacgagagaacccacaccggcgagaagccctacgagtgcaagcactgcagcaaggccttccccgactacagcagctacgtgagacacgagagaacccacaccggcgagaagccctacaagtgcaagagatgcggcagagccttcagcgtgagcagcagcctgagaatccacgagagaacccacaccggcgagaagccctacgagtgcaagcagtgcggcaaggccttccaccacctgggcagcttccagagacacatgatcagacacaccggcgacggcccccacaagtgcaagatctgcggcaagggcttcgactgccccagcagcctgcagagccacgagagaacccacaccggcgagaagccctacgagtgcaagcagtgcggcaaggccctgagccaccacagcagcttcagaagccacatgatcatgcacaccggcgacggcccccacaagtgcaaggtgtgcggcaaggccttcatctaccccagcgtgttccagggccacgagagaacccacaccggcgagaagccctacgagtgcaaggagtgcggcaaggccttcagaatcagcagcagcctgagaagacacgagaccacccacaccggcgagaagccctacaagtgcaagtgcggcaaggccttcatcgacttctacagcttccagaaccacgagaccacccacaccggcgagaagccctacgagtgcaaggagtgcggcaaggccttcagctgcttcacctacctgagccagcacagaagaacccacatggccgagaagccctacgagtgcaagacctgcaagaaggccttcagccacttcggcaacctgaaggtgcacgagagaatccacaccggcgagaagccctacgagtgcaaggagtgcagaaaggccttcagctggctgacctgcctgctgagacacgagagaatccacaccggcaagaagagctacgagtgccagcagtgcggcaaggccttcaccagaagcagattcctgagaggccacgagaagacccacaccggcgagaagatgcacgagtgcaaggagtgcggcaaggccctgagcagcctgagcagcctgcacagacacaagagaacccactggagagacaccctgtag

SEQ ID NO: 10509 - DNA, 1677 bp, Artificial Sequence
  Description of Artificial Sequence: Synthetic coding sequence
atgaagtgggaggacaccaacatcgaggaccagcacagaaaccccagaagaagcctgagatgccacatcatcgagagattcagcgagagcagacagcccgacagcaccgtgaacgagaagccccccggcgtggacccctgcaagagcagcgtgtgcggcgagatcatgggctgcagcttcctgaactgctacatcaccttcgacgccggccacaagcccgacgagtgccaggagtacggcgagaagccccacacccacaagcagtgcggcaccgccttcaactaccaccacagcttccagacccaggagagaccccacaccggcaagaagagatacgactgcaaggagtgcggcaagaccttcagcagcagcggcaacctgagaagacacatcatcgtgcagagaggcggcggcccctacatctgcaagctgtgcggcaaggccttcttctggcccagcctgttcagaatgcacgagagaacccacaccggcgagaagccctacgagtgcaagcagtgctgcaaggccttccccatctacagcagctacctgagacacgagagaacccacaccggcgagaagccctacgagtgcaagcactgcagcaaggccttccccgactacagcagctacgtgagacacgagagaacccacaccggcgagaagccctacaagtgcaagagatgcggcagagccttcagcgtgagcagcagcctgagaatccacgagagaacccacaccggcgagaagccctacgagtgcaagcagtgcggcaaggccttccaccacctgggcagcttccagagacacatgatcagacacaccggcgacggcccccacaagtgcaagatctgcggcaagggcttcgactgccccagcagcctgcagagccacgagagaacccacaccggcgagaagccctacgagtgcaagcagtgcggcaaggccctgagccaccacagcagcttcagaagccacatgatcatgcacaccggcgacggcccccacaagtgcaaggtgtgcggcaaggccttcatctaccccagcgtgttccagggccacgagagaacccacaccggcgagaagccctacgagtgcaaggagtgcggcaaggccttcagaatcagcagcagcctgagaagacacgagaccacccacaccggcgagaagccctacaagtgcaagtgcggcaaggccttcatcgacttctacagcttccagaaccacgagaccacccacaccggcgagaagccctacgagtgcaaggagtgcggcaaggccttcagctgcttcacctacctgagccagcacagaagaacccacatggccgagaagccctacgagtgcaagacctgcaagaaggccttcagccacttcggcaacctgaaggtgcacgagagaatccacaccggcgagaagccctacgagtgcaaggagtgcagaaaggccttcagctggctgacctgcctgctgagacacgagagaatccacaccggcaagaagagctacgagtgccagcagtgcggcaaggccttcaccagaagcagattcctgagaggccacgagaagacccacaccggcgagaagatgcacgagtgcaaggagtgcggcaaggccctgagcagcctgagcagcctgcacagacacaagagaacccactggagagacaccctgtag

SEQ ID NO: 10510 - DNA, 2016 bp, Artificial Sequence
  Description of Artificial Sequence: Synthetic coding sequence
atggccagcgtggccctggaggacgtggccgtgaacttcaccagagaggagtgggccctgctgggcccctgccagaagaacctgtacaaggacgtgatgcaggagaccatcagaaacctggactgcgtggtgatgaagtggaaggaccagaacatcgaggaccagtacagataccccagaaagaacctgagatgcagaatgctggagagattcgtggagagcaaggacggcacccagtgcggcgagaccagcagccagatccaggacagcatcgtgaccaagaacaccctgcccggcgtgggcccctgcgagagcagcatgagaggcgagaaggtgatgggccacagcagcctgaactgctacatcagagtgggcgccggccacaagccccacgagtaccacgagtgcggcgagaagcccgacacccacaagcagagaggcaaggccttcagctaccacaacagcttccagacccacgagagactgcacaccggcaagaagccctacgactgcaaggagtgcggcaagagcttcagcagcctgggcaacctgcagagacacatggccgtgcagagaggcgacggcccctacaagtgcaagctgtgcggcaaggccttcttctggcccagcctgctgcacatgcacgagagaacccacaccggcgagaagccctacgagtgcaagcagtgcagcaaggccttcagcttctacagcagctacctgagacacgagagaacccacaccggcgagaagccctacgagtgcaagcagtgcagcaaggccttccccttctacagcagctacctgagacacgagagaacccacaccggcgagaagccctacaagtgcaagcagtgcagcaaggccttccccgacagcagcagctgcctgatccacgagagaacccacaccggcgagaagccctacacctgcaagcagtgcggcaaggccttcagcgtgagcggcagcctgcagagacacgagaccacccacagcgccgagaagccctacgcctgccagcagtgcggcaaggccttccaccacctgggcagcttccagagacacatgatcagacacaccggcaacggcccccacaagtgcaagatctgcggcaagggcttcgactgccccagcagcctgcagagccacgagagaacccacaccggcgagaagccctacgagtgcaagcagtgcggcaaggccctgagccacagaagcagcttcagaagccacatgatcatgcacaccggcgacggcccccacaagtgcaaggtgtgcggcaaggccttcgtgtaccccagcgtgttccagagacacgagagaacccacaccgccgagaagccctacaagtgcaagcagtgcggcaaggcctacagaatcagcagcagcctgagaagacacgagaccacccacaccggcgagaagccctacaagtgcaagctgggcaaggcctgcatcgacttctgcagcttccagaaccacaagaccacccacaccggcgagaagccctacgagtgcaaggagtgcggcaaggccttcagcagattcagatacctgagcagacacaagagaacccacaccggcgagaagccctacgagtgcaagacctgcagaaaggccttcggccactacgacaacctgaaggtgcacgagagaatccacagcggcgagaagccctacgagtgcaaggagtgcggcaaggccttcagctggctgacctgcttcctgagacacgagagaatccacatgagagagaagagctacgagtgcccccagtgcggcaaggccttcacccacagcagattcctgcagggccacgagaagacccacaccggcgagaacccctacgagtgcaaggagtgcggcaaggccttcgccagcctgagcagcctgcacagacacaagaagacccactggaagaagacccacaccggcgagaacccctacgagtgcaaggagtgcggcaaggccttcgccagcctgagcagcctgcacagacacaagaagacccactag

SEQ ID NO: 10511 - DNA, 1932 bp, Artificial Sequence
  Description of Artificial Sequence: Synthetic coding sequence
atggccagcgtggccctggaggacgtggccgtgaacttcaccagagaggagtgggccctgctgggcccctgccagaagaacctgtacaaggacgtgatgcaggagaccatcagaaacctggactgcgtggtgatgaagtggaaggaccagaacatcgaggaccagtacagataccccagaaagaacctgagatgcagaatgctggagagattcgtggagagcaaggacggcacccagtgcggcgagaccagcagccagatccaggacagcatcgtgaccaagaacaccctgcccggcgtgggcccctgcgagagcagcatgagaggcgagaaggtgatgggccacagcagcctgaactgctacatcagagtgggcgccggccacaagccccacgagtaccacgagtgcggcgagaagcccgacacccacaagcagagaggcaaggccttcagctaccacaacagcttccagacccacgagagactgcacaccggcaagaagccctacgactgcaaggagtgcggcaagagcttcagcagcctgggcaacctgcagagacacatggccgtgcagagaggcgacggcccctacaagtgcaagctgtgcggcaaggccttcttctggcccagcctgctgcacatgcacgagagaacccacaccggcgagaagccctacgagtgcaagcagtgcagcaaggccttcagcttctacagcagctacctgagacacgagagaacccacaccggcgagaagccctacgagtgcaagcagtgcagcaaggccttccccttctacagcagctacctgagacacgagagaacccacaccggcgagaagccctacaagtgcaagcagtgcagcaaggccttccccgacagcagcagctgcctgatccacgagagaacccacaccggcgagaagccctacacctgcaagcagtgcggcaaggccttcagcgtgagcggcagcctgcagagacacgagaccacccacagcgccgagaagccctacgcctgccagcagtgcggcaaggccttccaccacctgggcagcttccagagacacatgatcagacacaccggcaacggcccccacaagtgcaagatctgcggcaagggcttcgactgccccagcagcctgcagagccacgagagaacccacaccggcgagaagccctacgagtgcaagcagtgcggcaaggccctgagccacagaagcagcttcagaagccacatgatcatgcacaccggcgacggcccccacaagtgcaaggtgtgcggcaaggccttcgtgtaccccagcgtgttccagagacacgagagaacccacaccgccgagaagccctacaagtgcaagcagtgcggcaaggcctacagaatcagcagcagcctgagaagacacgagaccacccacaccggcgagaagccctacaagtgcaagctgggcaaggcctgcatcgacttctgcagcttccagaaccacaagaccacccacaccggcgagaagccctacgagtgcaaggagtgcggcaaggccttcagcagattcagatacctgagcagacacaagagaacccacaccggcgagaagccctacgagtgcaagacctgcagaaaggccttcggccactacgacaacctgaaggtgcacgagagaatccacatgagagagaagagctacgagtgcccccagtgcggcaaggccttcacccacagcagattcctgcagggccacgagaagacccacaccggcgagaacccctacgagtgcaaggagtgcggcaaggccttcgccagcctgagcagcctgcacagacacaagaagacccactggaagaagacccacaccggcgagaacccctacgagtgcaaggagtgcggcaaggccttcgccagcctgagcagcctgcacagacacaagaagacccactag

SEQ ID NO: 10512 - DNA, 1053 bp, Artificial Sequence
  Description of Artificial Sequence: Synthetic coding sequence
atgccccccggcagatggcacgccgccagcagcggccccgtgttcgagggcgccagactgcagaccgtgaagaaggaggaggaggacgagagctacacccccgtgcaggccgccagaccccagaccctgaacagacccggccaggagctgttcagacagctgttcagacagctgagataccacgagagcagcggccccctggagaccctgagcagactgagagagctgtgcagatggtggctgagacccgacgtgctgagcaaggcccagatcctggagctgctggtgctggagcagttcctgagcatcctgcccggcgagctgagagtgtgggtgcagctgcacaaccccgagagcggcgaggagtggccctgctggagaagctgcagaggcaccctgatgggccaccccggcggcaccagagcccccgagcccagatgcgccctggacggctacagaagcagaagcgcccagatctggagcctggccagccccctgagaagcagcagcgccctgggcgaccacctggagcccccctacgagatcgaggccagagacttcctggccggccagagcgacacccccgccgcccagatgcccgccctgttccccagagagggctgccccggcgaccaggtgacccccaccagaagcctgaccgcccagctgcaggagaccatgaccttcaaggacgtggaggtgaccttcagccaggacgagtggggctggctggacagcgcccagagaaacctgtacagagacgtgatgctggagaactacagaaacatggccagcctggtgggccccttcaccaagcccgccctgatcagctggctggaggccagagagccctggggcctgaacatgcaggccgcccagcccaagggcaaccccgtggccgcccccaccggcgacgacctgcagagcaagaccaacaagttcatcctgaaccaggagcccctggaggaggccgagaccctggccgtgagcagcggctgccccgccaccagcgtgagcgagggcatcggcctgagagagagcttccagcagtag

SEQ ID NO: 10513 - DNA, 3096 bp, Artificial Sequence
  Description of Artificial Sequence: Synthetic coding sequence
atgccccccggcagatggcacgccgcctaccccgcccaggcccagagcagcagagagagaggcagactgcagaccgtgaagaaggaggaggaggacgagagctacacccccgtgcaggccgccagaccccagaccctgaacagacccggccaggagctgttcagacagctgttcagacagctgagataccacgagagcagcggccccctggagaccctgagcagactgagagagctgtgcagatggtggctgagacccgacgtgctgagcaaggcccagatcctggagctgctggtgctggagcagttcctgagcatcctgcccggcgagctgagagtgtgggtgcagctgcacaaccccgagagcggcgaggaggccgtggccctgctggaggagctgcagagagacctggacggcaccagctggagagaccccggccccgcccagagccccgacgtgcactggatgggcaccggcgccctgagaagcgcccagatctggagcctggccagccccctgagaagcagcagcgccctgggcgaccacctggagcccccctacgagatcgaggccagagacttcctggccggccagagcgacacccccgccgcccagatgcccgccctgttccccagagagggctgccccggcgaccaggtgacccccaccagaagcctgaccgcccagctgcaggagaccatgaccttcaaggacgtggaggtgaccttcagccaggacgagtggggctggctggacagcgcccagagaaacctgtacagagacgtgatgctggagaactacagaaacatggccagcctggtgggccccttcaccaagcccgccctgatcagctggctggaggccagagagccctggggcctgaacatgcaggccgcccagcccaagggcaaccccgtggccgcccccaccggcgacgacctgcagagcaagaccaacaagttcatcctgaaccaggagcccctggaggaggccgagaccctggccgtgagcagcggctgccccgccaccagcgtgagcgagggcatcggcctgagagagagcttccagcagaagagcagacagaaggaccagtgcgagaaccccatccaggtgagagtgaagaaggaggagaccaacttcagccacagaaccggcaaggacagcgaggtgagcggcagcaacagcctggacctgaagcacgtgacctacctgagagtgagcggcagaaaggagagcctgaagcacggctgcggcaagcacttcagaatgagcagccaccactacgactacaagaagtacggcaagggcctgagacacatgatcggcggcttcagcctgcaccagagaatccacagcggcctgaagggcaacaagaaggacgtgtgcggcaaggacttcagcctgagcagccaccaccagagaggccagagcctgcacaccgtgggcgtgagcttcaagtgcagcgactgcggcagaaccttcagccacagcagccacctggcctaccaccagagactgcacacccaggagaaggccttcaagtgcagagtgtgcggcaaggccttcagatggagcagcaactgcgccagacacgagaagatccacaccggcgtgaagccctacaagtgcgacctgtgcgagaaggccttcagaagactgagcgcctacagactgcacagagagacccacgccaagaagaagttcctggagctgaaccagtacagagccgccctgacctacagcagcggcttcgaccaccacctgggcgaccagagcggcgagaagctgttcgactgcagccagtgcagaaagagcttccactgcaagagctacgtgctggagcaccagagaatccacacccaggagaagccctacaagtgcaccaagtgcagaaagaccttcagatggagaagcaacttcaccagacacatgagactgcacgaggaggagaagttctacaagcaggacgagtgcagagagggcttcagacagagccccgactgcagccagccccagggcgcccccgccgtggagaagaccttcctgtgccagcagtgcggcaagaccttcaccagaaagaagaccctggtggaccaccagagaatccacaccggcgagaagccctaccagtgcagcgactgcggcaaggacttcgcctacagaagcgccttcatcgtgcacaagaagaagcacgccatgaagagaaagcccgagggcggccccagcttcagccaggacaccgtgttccaggtgccccagagcagccacagcaaggaggagccctacaagtgcagccagtgcggcaaggccttcagaaaccacagcttcctgctgatccaccagagagtgcacaccggcgagaagccctacaagtgcagagagtgcggcaaggccttcagatggagcagcaacctgtacagacaccagagaatccacagcctgcagaagcagtacgactgccacgagagcgagaagacccccaacgtggagcccaagatcctgaccggcgagaagagattctggtgccaggagtgcggcaagaccttcaccagaaagagaaccctgctggaccacaagggcatccacagcggcgagaagagatacaagtgcaacctgtgcggcaagagctacgacagaaactacagactggtgaaccaccagagaatccacagcaccgagagacccttcaagtgccagtggtgcggcaaggagttcatcggcagacacaccctgagcagccaccagagaaagcacaccagagccgcccaggccgagagaagcccccccgccagaagcagcagccaggacaccaagctgagactgcagaagctgaagcccagcgaggagatgcccctggaggactgcaaggaggcctgcagccagagcagcagactgaccggcctgcaggacatcagcatcggcaagaagtgccacaagtgcagcatctgcggcaagaccttcaacaagagcagccagctgatcagccacaagagattccacaccagagagagacccttcaagtgcagcaagtgcggcaagaccttcagatggagcagcaacctggccagacacatgaagaaccacatcagagactag

SEQ ID NO: 10514 - DNA, 3096 bp, Artificial Sequence; identical to SEQ ID NO: 10513
  Description of Artificial Sequence: Synthetic coding sequence

SEQ ID NO: 10515 - DNA, 822 bp, Artificial Sequence
  Description of Artificial Sequence: Synthetic coding sequence
atgccccccggcagatggcacgccgccatcagcagcggccccgtgttcgagggcgccagagccctgcagaccgtgaagaaggaggaggaggacgagagctacacccccgtgcaggccgccagaccccagaccctgaacagacccggccaggagctgttcagacagctgttcagacagctgagataccacgagagcagcggccccctggagaccctgagcagactgagagagctgtgcagatggtggctgagacccgacgtgctgagcaaggcccagatcctggagctgctggtgctggagcagttcctgagcatcctgcccggcgagctgagagtgtgggtgcagctgcacaaccccgagagcggcgaggagctgtggccctgctggagaagctgcagaggcaccctgatgggccaccccggcggcaccagagccctgcccgagcccagatgcgccctggacggctacagaagcctgagaagcgcccagatctggagcctggccagccccctgagaagcagcagcgccctgggcgaccacctggagcccccctacgagatcgaggccagagacttcctggccggccagagcgacacccccgccgcccagatgcccgccctgttccccagagagggctgccccggcgaccaggtgacccccaccagaagcctgaccgcccagctgcaggagaccatgaccttcaaggacgtggaggtgaccttcagccaggacgagtggggctggctggacagcgcccagagaaacctgtacagagacgtgatgctggagaactacagaaacatggccagcctgggcaagtag

SEQ ID NO: 10516 - DNA, 1353 bp, Artificial Sequence
  Description of Artificial Sequence: Synthetic coding sequence
atgcccagccccctgggccccccctgcctgcccgtgatggaccccgagaccaccctggaggagcccgagaccgccagactgagattcagaggcttctgctaccaggaggtggccggccccagagaggccctggccagactgagagagctgtgctgccagtggctgcagcccgaggcccacagcaaggagcagatgctggagatgctggtgctggagcagttcctgggcaccctgccccccgagatccaggcctgggtgagaggccagagacccggcagccccgaggaggccgccgccctggtggagggcctgcagcacgaccccggccagctgctgggctggatcaccgcccacgtgctgaagcaggaggtgctgcccgccgcccagaagaccgaggagcccctgggcagcccccaccccagcggcaccgtggagagccccggcgagggcccccaggacaccagaatcgagggcagcgtgcagctgagctgcagcgtgaaggaggagcccaacgtggacggccaggaggtggcccccagcagcccccccctggccgcccagagccccgagggcaaccacggccaccaggagcccgccagcaccagcttccacccccccagaatccaggaggagtggggcctgctggacagaagccagaaggagctgtactgggacgccatgctggagaagtacggcaccgtggtgagcctgggcctgcccccccaccagcccgaggcccaggcccagagcgagctgggcatgctgctgaccggcaccggcgtgtgcagaagcctgagaagcggcaacgagagcgagggcccccccggctgccccgaggcccagcccccccagggccccggccccgccgcctgggagggcctgagcggcgccgccacccccgcccccaccgtgagacccggcaccccccccgtgcccacccagcccacccccgccgagaccagactggagcccgccgccacccccagaaagccctacacctgcgagcagtgcggcagaggcttcgactggaagagcgtgttcgtgatccaccacagaacccacaccagcggccccggcgtgcagagccccggcctggccaccggcgagagcaccgagaagcccccccagggcgaggtggccttcccccaccaccccagaagaagcctgaccggccccagaagctacccctgcgaggagtgcggctgcagcttcagctggaagagccagctggtgatccacagaaagagccacaccggccagagaagacacttctgcagcgactgcggcagagccttcgactggaagagccagctggtgatccacagaaagggccacagacccgaggtgccctag

SEQ ID NO: 10517 - DNA, 1044 bp, Artificial Sequence
  Description of Artificial Sequence: Synthetic coding sequence
atgagcatggacagaaagtggcacccccccgccctgcacctgcagcacagccccctgagaggcaccatggacaccaagaaccagcccccccaccccagcacccaccccggcttcagaagaagcggcggctgctggaccggccacagaagaaactgcaccggcatgagatgctggagaagcaccgcccagtggagcccctgggtgagaaccagccagccccaccccgcccccctgcccggcgcctgcacccaccccgccgccggcctggccggccagggcctgtgcgccaccagccccacccagctgagccacctgcccgaggagcaccccgtgacctaccagaacagaccccaccccagcttcatgcagaccccctgcctgaccgtgccccccaccagagccggcctgcccccccaccagcccgaggcccaggcccagagcgagctgggcatgctgctgaccggcaccggcgtgtgcagaagcctgagaagcggcaacgagagcgagggcccccccggctgccccgaggcccagcccccccagggccccggccccgccgcctgggagggcctgagcggcgccgccacccccgcccccaccgtgagacccggcaccccccccgtgcccacccagcccacccccgccgagaccagactggagcccgccgccacccccagaaagccctacacctgcgagcagtgcggcagaggcttcgactggaagagcgtgttcgtgatccaccacagaacccacaccagcggccccggcgtgcagagccccggcctggccaccggcgagagcaccgagaagcccccccagggcgaggtggccttcccccaccaccccagaagaagcctgaccggccccagaagctacccctgcgaggagtgcggctgcagcttcagctggaagagccagctggtgatccacagaaagagccacaccggccagagaagacacttctgcagcgactgcggcagagccttcgactggaagagccagctggtgatccacagaaagggccacagacccgaggtgccctag

SEQ ID NO: 10518 - DNA, 468 bp, Artificial Sequence
  Description of Artificial Sequence: Synthetic coding sequence
atgcccagccccctgggccccccctgcctgcccgtgatggaccccgagaccaccctggaggagcccgagaccgccagactgagattcagaggcttctgctaccaggaggtggccggccccagagaggccctggccagactgagagagctgtgctgccagtggctgcagcccgaggcccacagcaaggagcagatgctggagatgctggtgctggagcagttcctgggcaccctgccccccgagatccaggcctgggtgagaggccagagacccggcagccccgaggaggccgccgccctggtggagggcctgcagcacgaccccggccagctgctgggctggatcaccgcccacgtgctgaagcaggaggtgctgcccgccgcccagaagaccgaggagcccctgggcgcccccaccccccagggccagtggagccccctgggcaaggtgcccagaacccccgagtag

SEQ ID NO: 10519 - DNA, 1269 bp, Artificial Sequence
  Description of Artificial Sequence: Synthetic coding sequence
atgcccagccccctgggccccccctgcctgcccgtgatggaccccgagaccaccctggaggagcccgagaccgccagactgagattcagaggcttctgctaccaggaggtggccggccccagagaggccctggccagactgagagagctgtgctgccagtggctgcagcccgaggcccacagcaaggagcagatgctggagatgctggtgctggagcagttcctgggcaccctgccccccgagatccaggcctgggtgagaggccagagacccggcagccccgaggaggccgccgccctggtggagggcctgcagcacgaccccggccagctgctgggctggatcaccgcccacgtgctgaagcaggaggtgctgcccgccgcccagaagaccgaggagcccctgggcagcccccaccccagcggcaccgtggagagccccggcgagggcccccaggacaccagaatcgagggcagcgtgcagctgagctgcagcgtgaaggaggagcccaacgtggacggccaggaggtggcccccagcagcccccccctggccgcccagagccccgagggcaaccacggccaccaggagcccgccagcaccagcttccacccccccagaatccaggaggagtggggcctgctggacagaagccagaaggagctgtactgggacgccatgctggagaagtacggcaccgtggtgagcctgggcctgcccccccaccagcccgaggcccaggcccagagcgagctgggcatgctgctgaccggcaccggcgtgtgcagaagcctgagaagcggcaacgagagcgagggcccccccggctgccccgaggcccagcccccccagggccccggccccgccgcctgggagggcctgagcggcgccgccacccccgcccccaccgtgagacccggcaccccccccgtgcccacccagcccacccccgccgagaccagactggagcccgccgccacccccagaaagccctacacctgcgagcagtgcggcagaggcttcgactggaagagcgtgttcgtgatccaccacagaacccacaccagcggccccggcgtgcagagccccggcctggccaccggcgagagcaccgagaagcccccccagggcgaggtggccttcccccaccaccccagaagaagcctgaccggccccagaagctacccctgcgaggagtgcggctgcagcttcagctggaagagccagctggtgatccacagaaagagccacagacccgaggtgccctag

SEQ ID NO: 10520 - DNA, 1353 bp, Artificial Sequence; identical to SEQ ID NO: 10516
  Description of Artificial Sequence: Synthetic coding sequence

SEQ ID NO: 10521 - DNA, 3042 bp, Artificial Sequence
  Description of Artificial Sequence: Synthetic coding sequence
atgggcgaccccggcagcgagatcatcgagagcgtgccccccgccggccccgaggccagcgagagcaccaccgacgagaacgaggacgacatccagttcgtgagcgagggccccctgagacccgtgctggagtacatcgacctggtgagcagcgacgacgaggagcccagcaccagctacaccgacgagaacatcaagagaaaggaccacatcgactaccagaaggacaaggtggccctgaccctggccagactggccagacacgtggaggtggagaagcagcagaaggaggagaagaacagagccttcagagagaagatcgacttccagcacgcccacggcctgcaggagctggagttcatcagaggccacagcgacaccgaggccgccagactgtgcgtggaccagtggctgaagatgcccggcctgaagaccggcaccatcaactgcggcaccaagagcagcttcagaagaggcggccacacctgggtgagcggcaagcccatcctgtgccccatcatgcactgcaacaaggagttcgacaacggccacctgctgctgggccacctgaagagattcgaccacagcccctgcgaccccaccatcaccctgcacggccccttcttcagcagcttcgcctgcgtggtgtgctacaagaagttcgtgacccagcagcagtacagagaccacctgttcgacaaggaggccaccgacgacggccacaacaacaacctgctgccccagatcatccagtgcttcgcctgccccaactgcttcctgctgttcagcagaaaggaggagtgcagcaagcacatgagcggcaagaaccacttccaccagagcttcaagctgggcgacaacaagggcatcgcccaccccatcagcttccccagcttcgccaagaagctgctgatcagcctgtgcaaggacgtgcccttccaggtgaagtgcgtggcctgccacaagaccctgagaagccacatggagctgaccgcccacttcagagtgcactgcagaaacgccggccccgtggccgtggccgagaagagcatcacccaggtggccgagaagttcatcctgagaggctactgccccgactgcaaccaggtgttcgtggacgagaccagcacccagaaccacaagcagaacagcggccacaaggtgagagtgatcaacagcgtggaggagagcgtgctgctgtactgccacagcagcgagggcaacaaggaccccagcagcgacctgcacctgctgctggaccagagcaagttcagcagcctgaagagaaccatgagcatcaaggagagcagcagcctggagtgcatcgccatccccaagaagaagatgaacctgaaggacaagagccacgagggcgtggcctgcgtgcagaaggagaagagcgtggtgaagacctggttctgcgagtgcaaccagagattccccagcgaggacgccgtggagaagcacgtgttcagcgccaacaccatgggctacaagtgcgtggtgtgcggcaaggtgtgcgacgacagcggcgtgatcagactgcacatgagcagaatccacggcggcgcccacctgaacaacttcctgttctggtgcagaacctgcaagaaggagctgaccagaaaggacaccatcatggcccacgtgaccgagttccacaacggccacagatacttctacgagatggacgaggtggagggcgagaccctgcccagcagcagcaccaccctggacaacctgaccgccaacaagcccagcagcgccatcaccgtgatcgaccacagccccgccaacagcagccccagaggcaagtggcagtgcagaatctgcgaggacatgttcgacagccaggagtacgtgaagcagcactgcatgagcctggccagccacaagttccacagatacagctgcgcccactgcagaaagcccttccacaagatcgagaccctgtacagacactgccaggacgagcacgacaacgagatcaagatcaagtacttctgcggcctgtgcgacctgatcttcaacgtggaggaggccttcctgagccactacgaggagcaccacagcatcgactacgtgttcgtgagcgagaagaccgagaccagcatcaagaccgaggacgacttccccgtgatcgagaccagcaaccagctgacctgcggctgcagagagagctacatctgcaaggtgaacagaaaggaggactacagcagatgcctgcagatcatgctggacaagggcaagctgtggttcagatgcagcctgtgcagcgccaccgcccagaacctgaccgacatgaacacccacatccaccaggtgcacaaggagaagagcgacgaggaggagcagcagtacgtgatcaagtgcggcacctgcaccaaggccttccacgaccccgagagcgcccagcagcacttccacagaaagcactgcttcctgcagaagcccagcgtggcccacttcggcagcgagaagagcaacctgtacaagttcaccgccagcgccagccacaccgagagaaagctgaagcaggccatcaactacagcaagagcctggacatggagaagggcgtggagaacgacctgagctaccagaacatcggcggcaacaccaactggaagccccccctgaactgcaagatctacaactacctgaacagaatcggctgcttcttcctgcaccccagatgcagcaagagaaaggacgccgccgacttcgccatctgcatgcacgccggcagactggacgagcagctgcccaagcagatccccttcaccatcctgagcggcgaccagggcttcctggagctggagaaccagttcaagaagacccagagacccgcccacatcctgaacccccaccacctggagggcgacatgatgtgcgccctgctgaacagcatcagcgacaccaccaaggagtgcgacagcgacgacaacatgggcgccaagaacaccagcatcggcgaggagttcatcagcaccgaggacgtggagctggaggaggccatcagaagaagcctggaggagatgtag

SEQ ID NO: 10522 - DNA, 3186 bp, Artificial Sequence
  Description of Artificial Sequence: Synthetic coding sequence
atgggcgaccccggcagcgagatcatcgagagcgtgccccccgccggccccgaggccagcgagagcaccaccgacgagaacgaggacgacatccagttcgtgagcgagggccccctgagacccgtgctggagtacatcgacctggtgagcagcgacgacgaggagcccagcaccagctacaccgacgagaacatcaagagaaaggaccacatcgactaccagaaggacaaggtggccctgaccctggccagactggccagacacgtggaggtggagaagcagcagaaggaggagaagaacagagccttcagagagaagatcgacttccagcacgcccacggcctgcaggagctggagttcatcagaggccacagcgacaccgaggccgccagactgtgcgtggaccagtggctgaagatgcccggcctgaagaccggcaccatcaactgcggcaccaagagcagcttcagaagaggcggccacacctgggtgagcggcaagcccatcctgtgccccatcatgcactgcaacaaggagttcgacaacggccacctgctgctgggccacctgaagagattcgaccacagcccctgcgaccccaccatcaccctgcacggccccttcttcagcagcttcgcctgcgtggtgtgctacaagaagttcgtgacccagcagcagtacagagaccacctgttcgacaaggaggccaccgacgacggccacaacaacaacctgctgccccagatcatccagtgcttcgcctgccccaactgcttcctgctgttcagcagaaaggaggagtgcagcaagcacatgagcggcaagaaccacttccaccagagcttcaagctgggcgacaacaagggcatcgcccaccccatcagcttccccagcttcgccaagaagctgctgatcagcctgtgcaaggacgtgcccttccaggtgaagtgcgtggcctgccacaagaccctgagaagccacatggagctgaccgcccacttcagagtgcactgcagaaacgccggccccgtggccgtggccgagaagagcatcacccaggtggccgagaagttcatcctgagaggctactgccccgactgcaaccaggtgttcgtggacgagaccagcacccagaaccacaagcagaacagcggccacaaggtgagagtgatcaacagcgtggaggagagcgtgctgctgtactgccacagcagcgagggcaacaaggaccccagcagcgacctgcacctgctgctggaccagagcaagttcagcagcctgaagagaaccatgagcatcaaggagagcagcagcctggagtgcatcgccatccccaagaagaagatgaacctgaaggacaagagccacgagggcgtggcctgcgtgcagaaggagaagagcgtggtgaagacctggttctgcgagtgcaaccagagattccccagcgaggacgccgtggagaagcacgtgttcagcgccaacaccatgggctacaagtgcgtggtgtgcggcaaggtgtgcgacgacagcggcgtgatcagactgcacatgagcagaatccacggcggcgcccacctgaacaacttcctgttctggtgcagaacctgcaagaaggagctgaccagaaaggacaccatcatggcccacgtgaccgagttccacaacggccacagatacttctacgagatggacgaggtggagggcgagaccctgcccagcagcagcaccaccctggacaacctgaccgccaacaagcccagcagcgccatcaccgtgatcgaccacagccccgccaacagcagccccagaggcaagtggcagtgcagaatctgcgaggacatgttcgacagccaggagtacgtgaagcagcactgcatgagcctggccagccacaagttccacagatacagctgcgcccactgcagaaagcccttccacaagatcgagaccctgtacagacactgccaggacgagcacgacaacgagatcaagatcaagtacttctgcggcctgtgcgacctgatcttcaacgtggaggaggccttcctgagccactacgaggagcaccacagcatcgactacgtgttcgtgagcgagaagaccgagaccagcatcaagaccgaggacgacttccccgtgatcgagaccagcaaccagctgacctgcggctgcagagagagctacatctgcaaggtgaacagaaaggaggactacagcagatgcctgcagatcatgctggacaagggcaagctgtggttcagatgcagcctgtgcagcgccaccgcccagaacctgaccgacatgaacacccacatccaccaggtgcacaaggagaagagcgacgaggaggagcagcagtacgtgatcaagtgcggcacctgcaccaaggccttccacgaccccgagagcgcccagcagcacttccacagaaagcactgcttcctgcagaagcccagcgtggcccacttcggcagcgagaagagcaacctgtacaagttcaccgccagcgccagccacaccgagagaaagctgaagcaggccatcaactacagcaagagcctggacatggagaagggcgtggagaacgacctgagctaccagaacatcgaggaggagatcgtggagctgcccgacctggactacctgagaaccatgacccacatcgtgttcgtggacttcgacaactggagcaacttcttcggccacctgcccggccacctgaaccagggcaccttcatctggggcttccagggcggcaacaccaactggaagccccccctgaactgcaagatctacaactacctgaacagaatcggctgcttcttcctgcaccccagatgcagcaagagaaaggacgccgccgacttcgccatctgcatgcacgccggcagactggacgagcagctgcccaagcagatccccttcaccatcctgagcggcgaccagggcttcctggagctggagaaccagttcaagaagacccagagacccgcccacatcctgaacccccaccacctggagggcgacatgatgtgcgccctgctgaacagcatcagcgacaccaccaaggagtgcgacagcgacgacaacatgggcgccaagaacaccagcatcggcgaggagttcatcagcaccgaggacgtggagctggaggaggccatcagaagaagcctggaggagatgtag

SEQ ID NO: 10523 - DNA, 1680 bp, Artificial Sequence
  Description of Artificial Sequence: Synthetic coding sequence
atgggcgaccccggcagcgagatcatcgagagcgtgccccccgccggccccgaggccagcgagagcaccaccgacgagaacgaggacgacatccagttcgtgagcgagggccccctgagacccgtgctggagtacatcgacctggtgagcagcgacgacgaggagcccagcaccagctacaccgacagaatgcccgagagcaaggtgcccagcagcgagaaccacagacccgagatgtgcagcagctgcaacgtgcccctgcccatcggcgacagcagcagcttcagcggcagctgcagcagcagccccgagagaatcgtgagccagaccagcagcgtggagaaccccctggagaaccagaagaacgaccagaacaacagcgacaccaagatcagcgagaccgagaccctgaagagcagccagaacttccagaccctgcccagcagccccctgctggtgccccaggagagcctggccagcagcgaggtgaaggagaacctgagaatcgacagcagcagcgccagccagcacggcagagacgccatcctgtacctgcagacccaggtggccgagatgagcagagtgatcagagacctgcagagcagaagctgcttcagattccaccacagcagacccagcgagaacagcagcgtgccctgggacatcagcaccagcaaggaggagaacctgagcaccgtggaggaggagaccgactacaagagccccagcgccgacgacaagggccagcccagcgaccccagccagagcagcttcaccggcctgctgaagagaatggagcagagaggcgtgatcaagagagtgaccctgcagagcgaggccgagagctgcgagggcaagcccgactgcgtgaccagcaagaagagactggtgccccccctgcaccccctgctgagaatcgccaccaccgaggtgttcaaggaccccgccgactgccaccccagcagcttcatgggccacagagtgtaccccgtggccaaggacaccagccccttccagcccaacccccccgccgagggccccatcgtggaggccctggagcacagcaagagaggcaacaccaccagccccctggacagcaccagcaaggagatggaggtgatgggctgcagattctaccacgccgccagcatcgccgccagagccgccagctacatggcctacatgacccagtaccagagaaagctgtgggaggacatggaggacctggtgcacgaccccgagttcgacagaggcaaggccagatgcatcatcagcgacggcatggacgccggcctgtggcagctgtgcaccaccagagacatcatggacagcgtggtgagagtgatggccatggccatcgactacagaagacaggcctggctgagactgaccagcctgaccaagaagacccaggagaagatcagccacctgcccttcgacggcaccagcctgttcggccaggacgtgaaggccgtggtggccgaggacaacaacatcaaggagaacgactacaaggaccacaagtactacaaccagcacagatacttctacagccacgaccagaaggcccactaccacaacagaggctacagcaagggcgactggtacaagcccagaaaccacccctacagatacagaaagaagggcgacagccccgagagacacggctacaagaactag

SEQ ID NO: 10524 - DNA, 1569 bp, Artificial Sequence
  Description of Artificial Sequence: Synthetic coding sequence
atggccgtgagccacctgcccaccatggtgcaggagagcgtgaccttcaaggacgtggccatcctgttcacccaggaggagtggggccagctgagccccgcccagagagccctgtacagagacgtgatgctggagaactacagcaacctggtgagcctgggcctgctgggccccaagcccgacaccttcagccagctggagaagagagaggtgtggatgcccgaggacacccccggcggcttctgcctggactggatgaccatgcccgccagcaagaagagcaccgtgaaggccgagatccccgaggaggagctggaccagtggaccatcaaggagagattcagcagcagcagccactggaagtgcgccagcctgctggagtggcagtgcggcggccaggagatcagcctgcagagagtggtgctgacccaccccaacacccccagccaggagtgcgacgagagcggcagcaccatgagcagcagcctgcacagcgaccagagccagggcttccagcccagcaagaacgccttcgagtgcagcgagtgcggcaaggtgttcagcaagagcagcaccctgaacaagcaccagaagatccacaacgagaagaacgccaaccagaagatccacatcaaggagaagagatacgagtgcagagagtgcggcaaggccttccaccagagcacccacctgatccaccaccagagaatccacaccggcgagaagccctacgagtgcaaggagtgcggcaaggccttcagcgtgagcagcagcctgacctaccaccagaagatccacaccggcgagaagcccttcgagtgcaacctgtgcggcaaggccttcatcagaaacatccacctggcccaccaccacagaatccacaccggcgagaagcccttcaagtgcaacatctgcgagaaggccttcgtgtgcagagcccacctgaccaagcaccagaacatccacagcggcgagaagccctacaagtgcaacgagtgcggcaaggccttcaaccagagcaccagcttcctgcagcaccagagaatccacaccggcgagaagcccttcgagtgcaacgagtgcggcaaggccttcagagtgaacagcagcctgaccgagcaccagagaatccacaccggcgagaagccctacaagtgcaacgagtgcggcaaggccttcagagacaacagcagcttcgccagacacagaaagatccacaccggcgagaagccctacagatgcggcctgtgcgagaaggccttcagagaccagagcgccctggcccagcaccagagaatccacaccggcgagaagccctacacctgcaacatctgcgagaaggccttcagcgaccacagcgccctgacccagcacaagagaatccacaccagagagaagccctacaagtgcaagatctgcgagaaggccttcatcagaagcacccacctgacccagcaccagagaatccacaccggcgagaagccctacaagtgcaacaagtgcggcaaggccttcaaccagaccgccaacctgatccagcaccagagacaccacatcggcgagaagtag

SEQ ID NO: 10525 - DNA, 1569 bp, Artificial Sequence; identical to SEQ ID NO: 10524
  Description of Artificial Sequence: Synthetic coding sequence

SEQ ID NO: 10526 - DNA, 7521 bp, Artificial Sequence
  Description of Artificial Sequence: Synthetic coding sequence
atggaggtgctgcagtgcgacggctgcgacttcagagcccccagctacgaggacctgaaggcccacatccaggacgtgcacaccgccttcctgcagcccaccgacgtggccgaggacaacgtgaacgagctgagatgcggcagcgtgaacgccagcaaccagaccgaggtggagttcagcagcatcaaggacgagttcgccatcgccgaggacctgagcggccagaacgccaccagcctgggcaccggcggctactacggccacagccccggctactacggccagcacatcgccgccaaccccaagcccaccaacaagttcttccagtgcaagttctgcgtgagatacttcagaagcaagaacctgctgatcgagcacaccagaaaggtgcacggcgcccaggccgagggcagcagcagcggcccccccgtgcccggcagcctgaactacaacatcatgatgcacgagggcttcggcaaggtgttcagctgccagttctgcacctacaagagccccagaagagccagaatcatcaagcaccagaagatgtaccacaagaacaacctgaaggagaccaccgcccccccccccgcccccgcccccatgcccgaccccgtggtgccccccgtgagcctgcaggacccctgcaaggagctgcccgccgaggtggtggagagaagcatcctggagagcatggtgaagcccctgaccaagagcagaggcaacttctgctgcgagtggtgcagctaccagacccccagaagagagagatggtgcgaccacatgatgaagaagcacagaagcatggtgaagatcctgagcagcctgagacagcagcaggagggcaccaacctgcccgacgtgcccaacaagagcgcccccagccccaccagcaacagcacctacctgaccatgaacgccgccagcagagagatccccaacaccaccgtgagcaacttcagaggcagcatgggcaacagcatcatgagacccaacagcagcgccagcaagttcagccccatgagctacccccagatgaagcccaagagcccccacaacagcggcctggtgaacctgaccgagagaagcagatacggcatgaccgacatgaccaacagcagcgccgacctggagaccaacagcatgctgaacgacagcagcagcgacgaggagctgaacgagatcgacagcgagaacggcctgagcgccatggaccaccagaccagcggcctgagcgccgagcagctgatgggcagcgacggcaacaagctgctggagaccaagggcatccccttcagaagattcatgaacagattccagtgccccttctgccccttcctgaccatgcacagaagaagcatcagcagacacatcgagaacatccacctgagcggcaagaccgccgtgtacaagtgcgacgagtgccccttcacctgcaagagcagcctgaagctgggcgcccacaagcagtgccacaccggcaccaccagcgactgggacgccgtgaacagccagagcgagagcatcagcagcagcctgaacgagggcgtggtgagctacgagagcagcagcatcaacggcagaaagagcggcgtgatgctggaccccctgcagcagcagcagcccccccagccccccccccccccccccccccccccccccagccagccccagcccctgcagcagccccagcccccccagctgcagcccccccaccaggtgcccccccagccccagacccagcccccccccacccagcagccccagccccccacccaggccgcccccctgcacccctacaagtgcaccatgtgcaactacagcaccaccaccctgaagggcctgagagtgcaccagcagcacaagcacagcttctgcgacaacctgcccaagttcgagggccagcccagcagcctgcccctggagaacgagaccgacagccaccccagcagcagcaacaccgtgaagaagagccagaccagcatcctgggcctgagcagcaagaacaacttcgtggccaaggccagcagaaagctggccaacgacttccccctggacctgagccccgtgaagaagagaaccagaatcgacgagatcgccagcaacctgcagagcaagatcaaccagaccaagcagcaggaggacgccgtgatcaacgtggaggacgacgaggaggaggaggaggacaacgaggtggagatcgaggtggagctggacagagaggaggagcccaccgagcccatcatcgaggtgcccaccagcttcagcgcccagcagatctgggtgagagacaccagcgagccccagaaggagcccaacttcagaaacatcacccacgactacaacgccaccaacggcgccgagatcgagctgaccctgagcgaggacgaggaggactactacggcagcagcaccaacctgaaggaccaccaggtgagcaacaccgccctgctgaacacccagacccccatctacggcaccgagcacaacagcgagaacaccgacttcggcgacagcggcagactgtactactgcaagcactgcgacttcaacaacaagagcgccagaagcgtgagcacccactaccagagaatgcacccctacatcaagttcagcttcagatacatcctggaccccaacgaccacagcgccgtgtacagatgcctggagtgctacatcgactacaccaacttcgaggacctgcagcagcactacggcgagcaccaccccgaggccatgaacgtgctgaacttcgaccacagcgacctgatctacagatgcagattctgcagctacaccagccccaacgtgagaagcctgatgccccactaccagagaatgcaccccaccgtgaagatcaacaacgccatgatcttcagcagctacgtggtggagcagcaggagggcctgaacaccgagagccagaccctgagagagatcctgaacagcgcccccaagaacatggccaccagcacccccgtggccagaggcggcggcctgcccgccaccttcaacaagaacacccccaagaccttcacccccgagtgcgagaaccagaaggaccccctggtgaacaccgtggtggtgtacgactgcgacgtgtgcagcttcgccagccccaacatgcacagcgtgctggtgcactaccagaagaagcaccccgaggagaaggccagctacttcagaatccagaagaccatgagaatggtgagcgtggacagaggcagcgccctgagccagctgagcttcgaggtgggcgcccccatgagccccaagatgagcaacatgggcagccccccccccccccagccccccccccccgacctgagcaccgagctgtactactgcaagcactgcagctacagcaacagaagcgtggtgggcgtgctggtgcactaccagaagagacaccccgagatcaaggtgaccgccaagtacatcagacaggccccccccaccgccgccatgatgagaggcgtggagggcccccagggcagccccagaccccccgcccccatccagcagctgaacagaagcagcagcgagagagacggcccccccgtggagaacgagatgttcttctgccagcactgcgactacggcaacagaaccgtgaagggcgtgctgatccactaccagaagaagcacagagacttcaaggccaacgccgacgtgatcagacagcacaccgccaccatcagaagcctgtgcgacagaaaccagaagaagcccgccagctgcgtgctggtgagccccagcaacctggagagagacaagaccaagctgagagccctgaagtgcagacagtgcagctacaccagcccctacttctacgccctgagaaagcacatcaagaaggaccaccccgccctgaaggccaccgtgaccagcatcatgagatgggccttcctggacggcctgatcgaggccggctaccactgcgagtggtgcatctacagccacaccgagcccaacggcctgctgctgcactaccagagaagacaccccgagcactacgtggactacacctacatggccaccaagctgtgggccggccccgaccccagcccccccagcctgaccatgcccgccgaggccaagacctacagatgcagagactgcgtgttcgaggccgtgagcatctgggacatcaccaaccactaccaggccttccacccctgggccatgaacggcgacgagagcgtgctgctggacatcatcaaggagaaggacgccgtggagaagcccatcctgagcagcgaggagctggccggccccgtgaactgcgagaacagcatccccacccccttccccgagcaggaggccgagtgccccgaggacgccagactgagccccgagaagagcctgcagctggccagcgccaaccccgccatcagcagcaccccctaccagtgcaccgtgtgccagagcgagtacaacaacctgcacggcctgctgacccactacggcaagaagcaccccggcatgaaggtgaaggccgccgacttcgcccaggacatcgacatcaaccccggcgccgtgtacaagtgcagacactgcccctacatcaacaccagaatccacggcgtgctgacccactaccagaagagacaccccagcatcaaggtgaccgccgaggacttcgtgcacgacgtggagcagagcgccgacatcagccagaacgacgtggaggagaccagcagaatcttcaagcagggctacggcgcctacagatgcaagctgtgcccctacacccacggcaccctggagaagctgaagatccactacgagaagtaccacaaccagcccgagttcgacgtgttcagccagagcccccccaagctgcccgtgcccctggagcccgagatgaccaccgaggtgagccccagccaggtgagcatcaccgaggaggaggtgggcgaggagcccgtgagcaccagccacttcagcaccagccacctggtgagccacaccgtgttcagatgccagctgtgcaagtacttctgcagcaccagaaagggcatcgccagacactacagaatcaagcacaacaacgtgagagcccagcccgagggcaagaacaacctgttcaagtgcgccctgtgcgcctacaccaaccccatcagaaagggcctggccgcccactaccagaagagacacgacatcgacgcctactacacccactgcctggccgccagcagaaccatcagcgacaagcccaacaaggtgatcatccccagcccccccaaggacgacagcccccagctgagcgaggagctgagaagagccgtggagaagaagaagtgcagcctgtgcagcttccagagcttcagcaagaagggcatcgtgagccactacatgaagagacaccccggcgtgttccccaagaagcagcacgccagcaagctgggcggctacttcaccgccgtgtacgccgacgagcacgagaagcccaccctgatggaggaggaggagagaggcaacttcgagaaggccgaggtggagggcgaggcccaggagatcgagtggctgcccttcagatgcatcaagtgcttcaagctgagcttcagcaccgccgagctgctgtgcatgcactacaccgaccaccacagcagagacctgaagagagacttcatcatcctgggcaacggccccagactgcagaacagcacctaccagtgcaagcactgcgacagcaagctgcagagcaccgccgagctgaccagccacctgaacatccacaacgaggagttccagaagagagccaagagacaggagagaagaaagcagctgctgagcaagcagaagtacgccgacggcgccttcgccgacttcaagcaggagagacccttcggccacctggaggaggtgcccaagatcaaggagagaaaggtggtgggctacaagtgcaagttctgcgtggaggtgcaccccaccctgagagccatctgcaaccacctgagaaagcacgtgcagtacggcaacgtgcccgccgtgagcgccgccgtgaagggcctgagaagccacgagagaagccacctggccctggccatgttcaccagagaggacaagtacagctgccagtactgcagcttcgtgagcgccttcagacacaacctggacagacacatgcagacccaccacggccaccacaagcccttcagatgcaagctgtgcagcttcaagagcagctacaacagcagactgaagacccacatcctgaaggcccacgccggcgagcacgcctacaagtgcagctggtgcagcttcagcaccatgaccatcagccagctgaaggagcacagcctgaaggtgcacggcaaggccctgaccctgcccagacccagaatcgtgagcctgctgagcagccacagccaccacagcagccagaaggccacccccgccgaggaggtggaggacagcaacgacagcagctacagcgagccccccgacgtgcagcagcagctgaaccactaccagagcgccgccctggccagaaacaacagcagagtgagccccgtgcccctgagcggcgccgccgccggcaccgagcagaagaccgaggccgtgctgcactgcgagttctgcgagttcagcagcggctacatccagagcatcagaagacactacagagacaagcacggcggcaagaagctgttcaagtgcaaggactgcagcttctacaccggcttcaagagcgccttcaccatgcacgtggaggccggccacagcgccgtgcccgaggagggccccaaggacctgagatgccccctgtgcctgtaccacaccaagtacaagagaaacatgatcgaccacatcgtgctgcacagagaggagagagtggtgcccatcgaggtgtgcagaagcaagctgagcaagtacctgcagggcgtggtgttcagatgcgacaagtgcaccttcacctgcagcagcgacgagagcctgcagcagcacatcgagaagcacaacgagctgaagccctacaagtgccagctgtgctactacgagaccaagcacaccgaggagctggacagccacctgagagacgagcacaaggtgagcagaaacttcgagctggtgggcagagtgaacctggaccagctggagcagatgaaggagaagatggagagcagcagcagcgacgacgaggacaaggaggaggagatgaacagcaaggccgaggacagagagctgatgagattcagcgaccacggcgccgccctgaacaccgagaagagattcccctgcgagttctgcggcagagccttcagccagggcagcgagtgggagagacacgtgctgagacacggcatggccctgaacgacaccaagcaggtgagcagagaggagatccaccccaaggagatcatggagaacagcgtgaagatgcccagcatcgaggagaaggaggacgacgaggccatcggcatcgacttcagcctgaagaacgagaccgtggccatctgcgtggtgaccgccgacaagagcctgctggagaacgccgaggccaagaaggagtag

SEQ ID NO: 10527 - DNA, 627 bp, Artificial Sequence
  Description of Artificial Sequence: Synthetic coding sequence
tgagagcacagcctgaaggtgcacggcaaggccctgaccctgcccagacccagaatcgtgagcctgctgagcagccacagccaccacagcagccagaaggccacccccgccgaggaggtggaggacagcaacgacagcagctacagcgagccccccgacgtgcagcagcagctgaaccactaccagagcgccgccctggccagaaacaacagcagagtgagccccgtgcccctgagcggcgccgccgccggcaccgagcagaagaccgaggccgtgctgcactgcgagttctgcgagttcagcagcggctacatccagagcatcagaagacactacagagacaagcacggcggcaagaagctgttcaagtgcaaggactgcagcttctacaccggcttcaagagcgccttcaccatgcacgtggaggccggccacagcgccgtgcccgaggagggccccaaggacctgagatgccccctgtgcctgtaccacaccaagtacaagagaaacatgatcgaccacatcgtgctgcacagaggcaacctgagcaacctggtgttcctggacgccgccggcggcagacagcagagatggcccagcagagacgccctgagcgagtggcagtag

SEQ ID NO: 10528 - DNA, 7701 bp, Artificial Sequence
  Description of Artificial Sequence: Synthetic coding sequence
atggaggtgctgcagtgcgacggctgcgacttcagagcccccagctacgaggacctgaaggcccacatccaggacgtgcacaccgccttcctgcagcccaccgacgtggccgaggacaacgtgaacgagctgagatgcggcagcgtgaacgccagcaaccagaccgaggtggagttcagcagcatcaaggacgagttcgccatcgccgaggacctgagcggccagaacgccaccagcctgggcaccggcggctactacggccacagccccggctactacggccagcacatcgccgccaaccccaagcccaccaacaagttcttccagtgcaagttctgcgtgagatacttcagaagcaagaacctgctgatcgagcacaccagaaaggtgcacggcgcccaggccgagggcagcagcagcggcccccccgtgcccggcagcctgaactacaacatcatgatgcacgagggcttcggcaaggtgttcagctgccagttctgcacctacaagagccccagaagagccagaatcatcaagcaccagaagatgtaccacaagaacaacctgaaggagaccaccgcccccccccccgcccccgcccccatgcccgaccccgtggtgccccccgtgagcctgcaggacccctgcaaggagctgcccgccgaggtggtggagagaagcatcctggagagcatggtgaagcccctgaccaagagcagaggcaacttctgctgcgagtggtgcagctaccagacccccagaagagagagatggtgcgaccacatgatgaagaagcacagaagcatggtgaagatcctgagcagcctgagacagcagcaggagggcaccaacctgcccgacgtgcccaacaagagcgcccccagccccaccagcaacagcacctacctgaccatgaacgccgccagcagagagatccccaacaccaccgtgagcaacttcagaggcagcatgggcaacagcatcatgagacccaacagcagcgccagcaagttcagccccatgagctacccccagatgaagcccaagagcccccacaacagcggcctggtgaacctgaccgagagaagcagatacggcatgaccgacatgaccaacagcagcgccgacctggagaccaacagcatgctgaacgacagcagcagcgacgaggagctgaacgagatcgacagcgagaacggcctgagcgccatggaccaccagaccagcggcctgagcgccgagcagctgatgggcagcgacggcaacaagctgctggagaccaagggcatccccttcagaagattcatgaacagattccagtgccccttctgccccttcctgaccatgcacagaagaagcatcagcagacacatcgagaacatccacctgagcggcaagaccgccgtgtacaagtgcgacgagtgccccttcacctgcaagagcagcctgaagctgggcgcccacaagcagtgccacaccggcaccaccagcgactgggacgccgtgaacagccagagcgagagcatcagcagcagcctgaacgagggcgtggtgagctacgagagcagcagcatcaacggcagaaagagcggcgtgatgctggaccccctgcagcagcagcagcccccccagccccccccccccccccccccccccccccccagccagccccagcccctgcagcagccccagcccccccagctgcagcccccccaccaggtgcccccccagccccagacccagcccccccccacccagcagccccagccccccacccaggccgcccccctgcacccctacaagtgcaccatgtgcaactacagcaccaccaccctgaagggcctgagagtgcaccagcagcacaagcacagcttctgcgacaacctgcccaagttcgagggccagcccagcagcctgcccctggagaacgagaccgacagccaccccagcagcagcaacaccgtgaagaagagccagaccagcatcctgggcctgagcagcaagaacaacttcgtggccaaggccagcagaaagctggccaacgacttccccctggacctgagccccgtgaagaagagaaccagaatcgacgagatcgccagcaacctgcagagcaagatcaaccagaccaagcagcaggaggacgccgtgatcaacgtggaggacgacgaggaggaggaggaggacaacgaggtggagatcgaggtggagctggacagagaggaggagcccaccgagcccatcatcgaggtgcccaccagcttcagcgcccagcagatctgggtgagagacaccagcgagccccagaaggagcccaacttcagaaacatcacccacgactacaacgccaccaacggcgccgagatcgagctgaccctgagcgaggacgaggaggactactacggcagcagcaccaacctgaaggaccaccaggtgagcaacaccgccctgctgaacacccagacccccatctacggcaccgagcacaacagcgagaacaccgacttcggcgacagcggcagactgtactactgcaagcactgcgacttcaacaacaagagcgccagaagcgtgagcacccactaccagagaatgcacccctacatcaagttcagcttcagatacatcctggaccccaacgaccacagcgccgtgtacagatgcctggagtgctacatcgactacaccaacttcgaggacctgcagcagcactacggcgagcaccaccccgaggccatgaacgtgctgaacttcgaccacagcgacctgatctacagatgcagattctgcagctacaccagccccaacgtgagaagcctgatgccccactaccagagaatgcaccccaccgtgaagatcaacaacgccatgatcttcagcagctacgtggtggagcagcaggagggcctgaacaccgagagccagaccctgagagagatcctgaacagcgcccccaagaacatggccaccagcacccccgtggccagaggcggcggcctgcccgccaccttcaacaagaacacccccaagaccttcacccccgagtgcgagaaccagaaggaccccctggtgaacaccgtggtggtgtacgactgcgacgtgtgcagcttcgccagccccaacatgcacagcgtgctggtgcactaccagaagaagcaccccgaggagaaggccagctacttcagaatccagaagaccatgagaatggtgagcgtggacagaggcagcgccctgagccagctgagcttcgaggtgggcgcccccatgagccccaagatgagcaacatgggcagccccccccccccccagccccccccccccgacctgagcaccgagctgtactactgcaagcactgcagctacagcaacagaagcgtggtgggcgtgctggtgcactaccagaagagacaccccgagatcaaggtgaccgccaagtacatcagacaggccccccccaccgccgccatgatgagaggcgtggagggcccccagggcagccccagaccccccgcccccatccagcagctgaacagaagcagcagcgagagagacggcccccccgtggagaacgagatgttcttctgccagcactgcgactacggcaacagaaccgtgaagggcgtgctgatccactaccagaagaagcacagagacttcaaggccaacgccgacgtgatcagacagcacaccgccaccatcagaagcctgtgcgacagaaaccagaagaagcccgccagctgcgtgctggtgagccccagcaacctggagagagacaagaccaagctgagagccctgaagtgcagacagtgcagctacaccagcccctacttctacgccctgagaaagcacatcaagaaggaccaccccgccctgaaggccaccgtgaccagcatcatgagatgggccttcctggacggcctgatcgaggccggctaccactgcgagtggtgcatctacagccacaccgagcccaacggcctgctgctgcactaccagagaagacaccccgagcactacgtggactacacctacatggccaccaagctgtgggccggccccgaccccagcccccccagcctgaccatgcccgccgaggccaagacctacagatgcagagactgcgtgttcgaggccgtgagcatctgggacatcaccaaccactaccaggccttccacccctgggccatgaacggcgacgagagcgtgctgctggacatcatcaaggagaaggacgccgtggagaagcccatcctgagcagcgaggagctggccggccccgtgaactgcgagaacagcatccccacccccttccccgagcaggaggccgagtgccccgaggacgccagactgagccccgagaagagcctgcagctggccagcgccaaccccgccatcagcagcaccccctaccagtgcaccgtgtgccagagcgagtacaacaacctgcacggcctgctgacccactacggcaagaagcaccccggcatgaaggtgaaggccgccgacttcgcccaggacatcgacatcaaccccggcgccgtgtacaagtgcagacactgcccctacatcaacaccagaatccacggcgtgctgacccactaccagaagagacaccccagcatcaaggtgaccgccgaggacttcgtgcacgacgtggagcagagcgccgacatcagccagaacgacgtggaggagaccagcagaatcttcaagcagggctacggcgcctacagatgcaagctgtgcccctacacccacggcaccctggagaagctgaagatccactacgagaagtaccacaaccagcccgagttcgacgtgttcagccagagcccccccaagctgcccgtgcccctggagcccgagatgaccaccgaggtgagccccagccaggtgagcatcaccgaggaggaggtgggcgaggagcccgtgagcaccagccacttcagcaccagccacctggtgagccacaccgtgttcagatgccagctgtgcaagtacttctgcagcaccagaaagggcatcgccagacactacagaatcaagcacaacaacgtgagagcccagcccgagggcaagaacaacctgttcaagtgcgccctgtgcgcctacaccaaccccatcagaaagggcctggccgcccactaccagaagagacacgacatcgacgcctactacacccactgcctggccgccagcagaaccatcagcgacaagcccaacaaggtgatcatccccagcccccccaaggacgacagcccccagctgagcgaggagctgagaagagccgtggagaagaagaagtgcagcctgtgcagcttccagagcttcagcaagaagggcatcgtgagccactacatgaagagacaccccggcgtgttccccaagaagcagcacgccagcaagctgggcggctacttcaccgccgtgtacgccgacgagcacgagaagcccaccctgatggaggaggaggagagaggcaacttcgagaaggccgaggtggagggcgaggcccaggagatcgagtggctgcccttcagatgcatcaagtgcttcaagctgagcttcagcaccgccgagctgctgtgcatgcactacaccgaccaccacagcagagacctgaagagagacttcatcatcctgggcaacggccccagactgcagaacagcacctaccagtgcaagcactgcgacagcaagctgcagagcaccgccgagctgaccagccacctgaacatccacaacgaggagttccagaagagagccaagagacaggagagaagaaagcagctgctgagcaagcagaagtacgccgacggcgccttcgccgacttcaagcaggagagacccttcggccacctggaggaggtgcccaagatcaaggagagaaaggtggtgggctacaagtgcaagttctgcgtggaggtgcaccccaccctgagagccatctgcaaccacctgagaaagcacgtgcagtacggcaacgtgcccgccgtgagcgccgccgtgaaggaggccgacgaccccgcccacctgttcctggacggcctggaggccgccaaggacgccagcggcgccctggtgggcagagtggacggcgagcactgcctgctggacggcatgctggaggacgagaccagacccggcggctaccactgcagccagtgcgacagagtgctgatgagcatgcagggcctgagaagccacgagagaagccacctggccctggccatgttcaccagagaggacaagtacagctgccagtactgcagcttcgtgagcgccttcagacacaacctggacagacacatgcagacccaccacggccaccacaagcccttcagatgcaagctgtgcagcttcaagagcagctacaacagcagactgaagacccacatcctgaaggcccacgccggcgagcacgcctacaagtgcagctggtgcagcttcagcaccatgaccatcagccagctgaaggagcacagcctgaaggtgcacggcaaggccctgaccctgcccagacccagaatcgtgagcctgctgagcagccacagccaccacagcagccagaaggccacccccgccgaggaggtggaggacagcaacgacagcagctacagcgagccccccgacgtgcagcagcagctgaaccactaccagagcgccgccctggccagaaacaacagcagagtgagccccgtgcccctgagcggcgccgccgccggcaccgagcagaagaccgaggccgtgctgcactgcgagttctgcgagttcagcagcggctacatccagagcatcagaagacactacagagacaagcacggcggcaagaagctgttcaagtgcaaggactgcagcttctacaccggcttcaagagcgccttcaccatgcacgtggaggccggccacagcgccgtgcccgaggagggccccaaggacctgagatgccccctgtgcctgtaccacaccaagtacaagagaaacatgatcgaccacatcgtgctgcacagagaggagagagtggtgcccatcgaggtgtgcagaagcaagctgagcaagtacctgcagggcgtggtgttcagatgcgacaagtgcaccttcacctgcagcagcgacgagagcctgcagcagcacatcgagaagcacaacgagctgaagccctacaagtgccagctgtgctactacgagaccaagcacaccgaggagctggacagccacctgagagacgagcacaaggtgagcagaaacttcgagctggtgggcagagtgaacctggaccagctggagcagatgaaggagaagatggagagcagcagcagcgacgacgaggacaaggaggaggagatgaacagcaaggccgaggacagagagctgatgagattcagcgaccacggcgccgccctgaacaccgagaagagattcccctgcgagttctgcggcagagccttcagccagggcagcgagtgggagagacacgtgctgagacacggcatggccctgaacgacaccaagcaggtgagcagagaggagatccaccccaaggagatcatggagaacagcgtgaagatgcccagcatcgaggagaaggaggacgacgaggccatcggcatcgacttcagcctgaagaacgagaccgtggccatctgcgtggtgaccgccgacaagagcctgctggagaacgccgaggccaagaaggagtag

SEQ ID NO: 10529 - DNA, 1392 bp, Artificial Sequence
  Description of Artificial Sequence: Synthetic coding sequence
atgcagacccaccacggccaccacaagcccttcagatgcaagctgtgcagcttcaagagcagctacaacagcagactgaagacccacatcctgaaggcccacgccggcgagcacgcctacaagtgcagctggtgcagcttcagcaccatgaccatcagccagctgaaggagcacagcctgaaggtgcacggcaaggccctgaccctgcccagacccagaatcgtgagcctgctgagcagccacagccaccacagcagccagaaggccacccccgccgaggaggtggaggacagcaacgacagcagctacagcgagccccccgacgtgcagcagcagctgaaccactaccagagcgccgccctggccagaaacaacagcagagtgagccccgtgcccctgagcggcgccgccgccggcaccgagcagaagaccgaggccgtgctgcactgcgagttctgcgagttcagcagcggctacatccagagcatcagaagacactacagagacaagcacggcggcaagaagctgttcaagtgcaaggactgcagcttctacaccggcttcaagagcgccttcaccatgcacgtggaggccggccacagcgccgtgcccgaggagggccccaaggacctgagatgccccctgtgcctgtaccacaccaagtacaagagaaacatgatcgaccacatcgtgctgcacagagaggagagagtggtgcccatcgaggtgtgcagaagcaagctgagcaagtacctgcagggcgtggtgttcagatgcgacaagtgcaccttcacctgcagcagcgacgagagcctgcagcagcacatcgagaagcacaacgagctgaagccctacaagtgccagctgtgctactacgagaccaagcacaccgaggagctggacagccacctgagagacgagcacaaggtgagcagaaacttcgagctggtgggcagagtgaacctggaccagctggagcagatgaaggagaagatggagagcagcagcagcgacgacgaggacaaggaggaggagatgaacagcaaggccgaggacagagagctgatgagattcagcgaccacggcgccgccctgaacaccgagaagagattcccctgcgagttctgcggcagagccttcagccagggcagcgagtgggagagacacgtgctgagacacggcatggccctgaacgacaccaagcaggtgagcagagaggagatccaccccaaggagatcatggagaacagcgtgaagatgcccagcatcgaggagaaggaggacgacgaggccatcggcatcgacttcagcctgaagaacgagaccgtggccatctgcgtggtgaccgccgacaagagcctgctggagaacgccgaggccaagaaggagtag

SEQ ID NO: 10530 - DNA, 1569 bp, Artificial Sequence
  Description of Artificial Sequence: Synthetic coding sequence
atggccctgccccagggcctgctgaccttcagagacgtggccatcgagttcagccaggaggagtggaagtgcctggaccccgcccagagaaccctgtacagagacgtgatgctggagaactacagaaacctggtgagcctggacatcagcagcaagtgcatgctgaagaccctgagcagcaccggccagggcaacaccgaggtgatccacaccggcaccctgcacagacaggccagccaccacatcggcgagttctgcttccacgagatcgagaaggacatccacggcttcgagttccagtggaaggaggacgagaccaacggccacgccgcccccatgaccgagatcaaggagctggccggcagcaccggccagcacgaccagagacacgccggcaacaagagaatcaaggaccagctgggcagcagcttccacctgcacctgcccgagccccacatcttccagagcgagggcaagatcggcaaccaggtggagaagagcatcaacaacgccagcagcgtgagcaccagccagagaatctgctgcagacccaagacccacatcagcaacaagtacggcaacaacagcctgcacagcagcctgctgacccagaagtgggaggtgcacatgagagagaagagcttcgagtgcatccagagcttcaagagcttcaactgcagcagcctgctgaagaagcaccagatcatccacctggaggagaagcagtgcaagtgcgacgtgtgcggcaaggtgttcaaccagaagagatacctggcctgccacagaagatgccacaccggcgagaagccctacaagtgcaacgagtgcggcaagaccttcggccacaacagcagcctgttcatccacaaggccctgcacaccggcgagaagccctacgagtgcgaggagtgcgacaaggtgttcagcagaaagagccacctggagagacacaagagaatccacaccggcgagaagccctacaagtgcaaggtgtgcgacgaggccttcgcctacaacagctacctggccaagcacaccatcctgcacaccggcgagaagccctacacctgcaacgagtgcggcaaggtgttcaacagactgagcaccctggccagacaccacagactgcacaccggcgagaagccctacaagtgcgaggagtgcgacaaggtgttcagcagaaagagccacctggagagacacagaagaatccacagcggcgagaagccctacaagtgcgaggagtgctgcaaggtgttcagcagaaagagcaacctggagagacacagaagaatccacaccggcgagaagccctacaagtgcaaggtgtgcgacaaggccttccagagagacagccacctggcccagcaccagagagtgcacaccggcgagaagccctacaagtgcaacgagtgcggcaagaccttcggccagaccagcagcctgatcatccacagaagactgcacaccggcgagaagccctacaagtgcaacgagtgcggcaagaccttcagccagatgagcagcctggtgtaccaccacagactgcacagcggcgagaagccctag

SEQ ID NO: 10531 - DNA, 1410 bp, Artificial Sequence
  Description of Artificial Sequence: Synthetic coding sequence
atgctgaagaccctgagcagcaccggccagggcaacaccgaggtgatccacaccggcaccctgcacagacaggccagccaccacatcggcgagttctgcttccacgagatcgagaaggacatccacggcttcgagttccagtggaaggaggacgagaccaacggccacgccgcccccatgaccgagatcaaggagctggccggcagcaccggccagcacgaccagagacacgccggcaacaagagaatcaaggaccagctgggcagcagcttccacctgcacctgcccgagccccacatcttccagagcgagggcaagatcggcaaccaggtggagaagagcatcaacaacgccagcagcgtgagcaccagccagagaatctgctgcagacccaagacccacatcagcaacaagtacggcaacaacagcctgcacagcagcctgctgacccagaagtgggaggtgcacatgagagagaagagcttcgagtgcatccagagcttcaagagcttcaactgcagcagcctgctgaagaagcaccagatcatccacctggaggagaagcagtgcaagtgcgacgtgtgcggcaaggtgttcaaccagaagagatacctggcctgccacagaagatgccacaccggcgagaagccctacaagtgcaacgagtgcggcaagaccttcggccacaacagcagcctgttcatccacaaggccctgcacaccggcgagaagccctacgagtgcgaggagtgcgacaaggtgttcagcagaaagagccacctggagagacacaagagaatccacaccggcgagaagccctacaagtgcaaggtgtgcgacgaggccttcgcctacaacagctacctggccaagcacaccatcctgcacaccggcgagaagccctacacctgcaacgagtgcggcaaggtgttcaacagactgagcaccctggccagacaccacagactgcacaccggcgagaagccctacaagtgcgaggagtgcgacaaggtgttcagcagaaagagccacctggagagacacagaagaatccacagcggcgagaagccctacaagtgcgaggagtgctgcaaggtgttcagcagaaagagcaacctggagagacacagaagaatccacaccggcgagaagccctacaagtgcaaggtgtgcgacaaggccttccagagagacagccacctggcccagcaccagagagtgcacaccggcgagaagccctacaagtgcaacgagtgcggcaagaccttcggccagaccagcagcctgatcatccacagaagactgcacaccggcgagaagccctacaagtgcaacgagtgcggcaagaccttcagccagatgagcagcctggtgtaccaccacagactgcacagcggcgagaagccctag

SEQ ID NO: 10532 - DNA, 654 bp, Artificial Sequence
  Description of Artificial Sequence: Synthetic coding sequence
gtgttcaaccagaagagatacctggcctgccacagaagatgccacaccggcgagaagccctacaagtgcaacgagtgcggcaagaccttcggccacaacagcagcctgttcatccacaaggccctgcacaccggcgagaagccctacgagtgcgaggagtgcgacaaggtgttcagcagaaagagccacctggagagacacaagagaatccacaccggcgagaagccctacaagtgcaaggtgtgcgacgaggccttcgcctacaacagctacctggccaagcacaccatcctgcacaccggcgagaagccctacacctgcaacgagtgcggcaaggtgttcaacagactgagcaccctggccagacaccacagactgcacaccggcgagaagccctacaagtgcgaggagtgcgacaaggtgttcagcagaaagagccacctggagagacacagaagaatcgtggagagaaacctgaccaacgtgaagaacgtggccaagttcagcagccagatcaagcccggcaagacccaggagttcatcctggagagaaaccacaccaacgtgagattcgtgaccagactgagcagaggcatccacacctggcacaacatcagagagttcatcctggagagaaacctgaccagcgtgtag

SEQ ID NO: 10533 - DNA, 1410 bp, Artificial Sequence; identical to SEQ ID NO: 10531
  Description of Artificial Sequence: Synthetic coding sequence

SEQ ID NO: 10534 - DNA, 1569 bp, Artificial Sequence; identical to SEQ ID NO: 10530
  Description of Artificial Sequence: Synthetic coding sequence

SEQ ID NO: 10535 - DNA, 2154 bp, Artificial Sequence
  Description of Artificial Sequence: Synthetic coding sequence
atgaagagccaggaggaggtggaggtggccggcatcaagctgtgcaaggccatgagcctgggcagcgtgaccttcaccgacgtggccatcgacttcagccaggacgagtgggagtggctgaacctggcccagagaagcctgtacaagaaggtgatgctggagaactacagaaacctggtgagcgtgggcctgtgcatcagcaagcccgacgtgatcagcctgctggagcaggagaaggacccctgggtgatcaagggcggcatgaacagaggcctgtgccccgacctggagtgcgtgtgggtgaccaagagcctgagcctgaaccaggacatctacgaggagaagctgccccccgccatcatcatggagagactgaagagctacgacctggagtgcagcaccctgggcaagaactggaagtgcgaggacctgttcgagagagagctggtgaaccagaagacccacttcagacaggagaccatcacccacatcgacaccctgatcgagaagagagaccacagcaacaagagcggcaccgtgttccacctgaacaccctgagctacatcaagcagatcttccccatggaggagagaatcttcaacttccacaccgacaagaagagcctgaagacccacagcgtggtgaagaagcacaagcaggacagaggcgagaagaagctgctgaagtgcaacgactgcgagaagatcttcagcaagatcagcaccctgaccctgcaccagagaatccacaccggcgagaagccctacgagtgcatcgagtgcggcaaggccttcagccagagcgcccacctggcccagcaccagagaatccacaccggcgagaagcccttcgagtgcaccgagtgcggcaaggccttcagccagaacgcccacctggtgcagcaccagagagtgcacaccggcgagaagccctaccagtgcaagcagtgcaacaaggccttcagccagctggcccacctggcccagcaccagagagtgcacaccggcgagaagccctacgagtgcatcgagtgcggcaaggccttcagcgactgcagcagcctggcccaccacagaagaatccacaccggcaagagaccctacgagtgcatcgactgcggcaaggccttcagacagaacgccagcctgatcagacacagaagatactaccacaccggcgagaagcccttcgactgcatcgactgcggcaaggccttcaccgaccacatcggcctgatccagcacaagagaacccacaccggcgagagaccctacaagtgcaacgtgtgcggcaaggccttcagccacggcagcagcctgaccgtgcaccagagaatccacaccggcgagaagccctacgagtgcaacatctgcgagaaggccttcagccacagaggcagcctgaccctgcaccagagagtgcacaccggcgagaagccctacgagtgcaaggagtgcggcaaggccttcagacagagcacccacctggcccaccaccagagaatccacaccggcgagaagccctacgagtgcaaggagtgcagcaagaccttcagccagaacgcccacctggcccagcaccagaagatccacaccggcgagaagccctacgagtgcaaggagtgcggcaaggccttcagccagatcgcccacctggtgcagcaccagagagtgcacaccggcgagaagccctacgagtgcatcgagtgcggcaaggccttcagcgacggcagctacctggtgcagcaccagagactgcacagcggcaagagaccctacgagtgcctggagtgcggcaaggccttcagacagagagccagcctgatctgccaccagagatgccacaccggcgagaagccctacgagtgcaacgtgtgcggcaaggccttcagccacagaaagagcctgaccctgcaccagagaatccacaccggcgagaagccctacgagtgcaaggagtgcagcaaggccttcagccaggtggcccacctgaccctgcacaagagaatccacaccggcgagagaccctacgagtgcaaggagtgcggcaaggccttcagacagagcgtgcacctggcccaccaccagagaatccacaccggcgagagcagcgtgatcctgagcagcgccctgccctaccaccaggtgctgtag

SEQ ID NO: 10536 - DNA, 2154 bp, Artificial Sequence; identical to SEQ ID NO: 10535
  Description of Artificial Sequence: Synthetic coding sequence

SEQ ID NO: 10537 - DNA, 1881 bp, Artificial Sequence
  Description of Artificial Sequence: Synthetic coding sequence
atgaacgtggaggtggtgaaggtgatgccccaggacctggtgaccttcaaggacgtggccatcgacttcagccaggaggagtggcagtggatgaaccccgcccagaagagactgtacagaagcatgatgctggagaactaccagagcctggtgagcctgggcctgtgcatcagcaagccctacgtgatcagcctgctggagcagggcagagagccctgggagatgaccagcgagatgaccagaagccccttcagcgactgggagagcatctacgtgacccaggagctgcccctgaagcagttcatgtacgacgacgcctgcatggagggcatcaccagctacggcctggagtgcagcaccttcgaggagaactggaagtgggaggacctgttcgagaagcagatgggcagccacgagatgttcagcaagaaggagatcatcacccacaaggagaccatcaccaaggagaccgagttcaagtacaccaagttcggcaagtgcatccacctggagaacatcgaggagagcatctacaaccacaccagcgacaagaagagcttcagcaagaacagcatggtgatcaagcacaagaaggtgtacgtgggcaagaagctgttcaagtgcaacgagtgcgacaagaccttcacccacagcagcagcctgaccgtgcacttcagaatccacaccggcgagaagccctacgcctgcgaggagtgcggcaaggccttcaagcagagacagcacctggcccagcaccacagaacccacaccggcgagaagctgttcgagtgcaaggagtgcagaaaggccttcaagcagagcgagcacctgatccagcaccagagaatccacaccggcgagaagccctacaagtgcaaggagtgcagaaaggccttcagacagcccgcccacctggcccagcaccagagaatccacaccggcgagaagccctacgagtgcaaggagtgcggcaaggccttcagcgacggcagcagcttcgccagacaccagagatgccacaccggcaagagaccctacgagtgcatcgagtgcggcaaggccttcagatacaacaccagcttcatcagacactggagaagctaccacaccggcgagaagcccttcaactgcatcgactgcggcaaggccttcagcgtgcacatcggcctgatcctgcacagaagaatccacaccggcgagaagccctacaagtgcggcgtgtgcggcaagaccttcagcagcggcagcagcagaaccgtgcaccagagaatccacaccggcgagaagccctacgagtgcgacatctgcggcaaggacttcagccaccacgccagcctgacccagcaccagagagtgcacagcggcgagaagccctacgagtgcaaggagtgcggcaaggccttcagacagaacgtgcacctggtgagccacctgagaatccacaccggcgagaagccctacgagtgcaaggagtgcggcaaggccttcagaatcagcagccagctggccacccaccagagaatccacaccggcgagaagccctacgagtgcatcgagtgcggcaacgccttcaagcagagaagccacctggcccagcaccagaagacccacaccggcgagaagccctacgagtgcaacgagtgcggcaaggccttcagccagaccagcaacctgacccagcaccagagaatccacaccggcgagaagccctacaagtgcaccgagtgcggcaaggccttcagcgacagcagcagctgcgcccagcaccagagactgcacaccggccagagaccctaccagtgcttcgagtgcggcaaggccttcagaagaaagctgagcctgatctgccaccagagaagccacaccggcgaggagccctag

SEQ ID NO: 10538 - DNA, 2616 bp, Artificial Sequence
  Description of Artificial Sequence: Synthetic coding sequence
atggccgaggagttcgtgaccctgaaggacgtgggcatggacttcaccctgggcgactgggagcagctgggcctggagcagggcgacaccttctgggacaccgccctggacaactgccaggacctgttcctgctggacccccccagacccaacctgaccagccaccccgacggcagcgaggacctggagcccctggccggcggcagccccgaggccaccagccccgacgtgaccgagaccaagaacagccccctgatggaggacttcttcgaggagggcttcagccaggagatcatcgagatgctgagcaaggacggcttctggaacagcaacttcggcgaggcctgcatcgaggacacctggctggacagcctgctgggcgaccccgagagcctgctgagaagcgacatcgccaccaacggcgagagccccaccgagtgcaagagccacgagctgaagagaggcctgagccccgtgagcaccgtgagcaccggcgaggacagcatggtgcacaacgtgagcgagaagaccctgacccccgccaagagcaaggagtacagaggcgagttcttcagctacagcgaccacagccagcaggacagcgtgcaggagggcgagaagccctaccagtgcagcgagtgcggcaagagcttcagcggcagctacagactgacccagcactggatcacccacaccagagagaagcccaccgtgcaccaggagtgcgagcagggcttcgacagaaacgccagcctgagcgtgtaccccaagacccacaccggctacaagttctacgtgtgcaacgagtacggcaccaccttcagccagagcacctacctgtggcaccagaagacccacaccggcgagaagccctgcaagagccaggacagcgaccacccccccagccacgacacccagcccggcgagcaccagaagacccacaccgacagcaagagctacaactgcaacgagtgcggcaaggccttcaccagaatcttccacctgaccagacaccagaagatccacaccagaaagagatacgagtgcagcaagtgccaggccaccttcaacctgagaaagcacctgatccagcaccagaagacccacgccgccaagaccaccagcgagtgccaggagtgcggcaagatcttcagacacagcagcctgctgatcgagcaccaggccctgcacgccggcgaggagccctacaagtgcaacgagagaggcaagagcttcagacacaacagcaccctgaagatccaccagagagtgcacagcggcgagaagccctacaagtgcagcgagtgcggcaaggccttccacagacacacccacctgaacgagcacagaagaatccacaccggctacagaccccacaagtgccaggagtgcgtgagaagcttcagcagacccagccacctgatgagacaccaggccatccacaccgccgagaagccctacagctgcgccgagtgcaaggagaccttcagcgacaacaacagactggtgcagcaccagaagatgcacaccgtgaagaccccctacgagtgccaggagtgcggcgagagattcatctgcggcagcaccctgaagtgccacgagagcgtgcacgccagagagaagcagggcttcttcgtgagcggcaagatcctggaccagaaccccgagcagaaggagaagtgcttcaagtgcaacaagtgcgagaagaccttcagctgcagcaagtacctgacccagcacgagagaatccacaccagaggcgtgaagcccttcgagtgcgaccagtgcggcaaggccttcggccagagcaccagactgatccaccaccagagaatccacagcagagtgagactgtacaagtggggcgagcagggcaaggccatcagcagcgccagcctgatcaagctgcagagcttccacaccaaggagcaccccttcaagtgcaacgagtgcggcaagaccttcagccacagcgcccacctgagcaagcaccagctgatccacgccggcgagaaccccttcaagtgcagcaagtgcgacagagtgttcacccagagaaactacctggtgcagcacgagagaacccacgccagaaagaagcccctggtgtgcaacgagtgcggcaagaccttcagacagagcagctgcctgagcaagcaccagagaatccacagcggcgagaagccctacgtgtgcgactactgcggcaaggccttcggcctgagcgccgagctggtgagacaccagagaatccacaccggcgagaagccctacgtgtgccaggagtgcggcaaggccttcacccagagcagctgcctgagcatccacagaagagtgcacaccggcgagaagccctacagatgcggcgagtgcggcaaggccttcgcccagaaggccaacctgacccagcaccagagaatccacaccggcgagaagccctacagctgcaacgtgtgcggcaaggccttcgtgctgagcgcccacctgaaccagcacctgagagtgcacacccaggagaccctgtaccagtgccagagatgccagaaggccttcagatgccacagcagcctgagcagacaccagagagtgcacaacaagcagcagtactgcctgtag

SEQ ID NO: 10539 - DNA, 2616 bp, Artificial Sequence; identical to SEQ ID NO: 10538
  Description of Artificial Sequence: Synthetic coding sequence

SEQ ID NO: 10540 - DNA, 2580 bp, Artificial Sequence
  Description of Artificial Sequence: Synthetic coding sequence
atggacttcaccctgggcgactgggagcagctgggcctggagcagggcgacaccttctgggacaccgccctggacaactgccaggacctgttcctgctggacccccccagacccaacctgaccagccaccccgacggcagcgaggacctggagcccctggccggcggcagccccgaggccaccagccccgacgtgaccgagaccaagaacagccccctgatggaggacttcttcgaggagggcttcagccaggagatcatcgagatgctgagcaaggacggcttctggaacagcaacttcggcgaggcctgcatcgaggacacctggctggacagcctgctgggcgaccccgagagcctgctgagaagcgacatcgccaccaacggcgagagccccaccgagtgcaagagccacgagctgaagagaggcctgagccccgtgagcaccgtgagcaccggcgaggacagcatggtgcacaacgtgagcgagaagaccctgacccccgccaagagcaaggagtacagaggcgagttcttcagctacagcgaccacagccagcaggacagcgtgcaggagggcgagaagccctaccagtgcagcgagtgcggcaagagcttcagcggcagctacagactgacccagcactggatcacccacaccagagagaagcccaccgtgcaccaggagtgcgagcagggcttcgacagaaacgccagcctgagcgtgtaccccaagacccacaccggctacaagttctacgtgtgcaacgagtacggcaccaccttcagccagagcacctacctgtggcaccagaagacccacaccggcgagaagccctgcaagagccaggacagcgaccacccccccagccacgacacccagcccggcgagcaccagaagacccacaccgacagcaagagctacaactgcaacgagtgcggcaaggccttcaccagaatcttccacctgaccagacaccagaagatccacaccagaaagagatacgagtgcagcaagtgccaggccaccttcaacctgagaaagcacctgatccagcaccagaagacccacgccgccaagaccaccagcgagtgccaggagtgcggcaagatcttcagacacagcagcctgctgatcgagcaccaggccctgcacgccggcgaggagccctacaagtgcaacgagagaggcaagagcttcagacacaacagcaccctgaagatccaccagagagtgcacagcggcgagaagccctacaagtgcagcgagtgcggcaaggccttccacagacacacccacctgaacgagcacagaagaatccacaccggctacagaccccacaagtgccaggagtgcgtgagaagcttcagcagacccagccacctgatgagacaccaggccatccacaccgccgagaagccctacagctgcgccgagtgcaaggagaccttcagcgacaacaacagactggtgcagcaccagaagatgcacaccgtgaagaccccctacgagtgccaggagtgcggcgagagattcatctgcggcagcaccctgaagtgccacgagagcgtgcacgccagagagaagcagggcttcttcgtgagcggcaagatcctggaccagaaccccgagcagaaggagaagtgcttcaagtgcaacaagtgcgagaagaccttcagctgcagcaagtacctgacccagcacgagagaatccacaccagaggcgtgaagcccttcgagtgcgaccagtgcggcaaggccttcggccagagcaccagactgatccaccaccagagaatccacagcagagtgagactgtacaagtggggcgagcagggcaaggccatcagcagcgccagcctgatcaagctgcagagcttccacaccaaggagcaccccttcaagtgcaacgagtgcggcaagaccttcagccacagcgcccacctgagcaagcaccagctgatccacgccggcgagaaccccttcaagtgcagcaagtgcgacagagtgttcacccagagaaactacctggtgcagcacgagagaacccacgccagaaagaagcccctggtgtgcaacgagtgcggcaagaccttcagacagagcagctgcctgagcaagcaccagagaatccacagcggcgagaagccctacgtgtgcgactactgcggcaaggccttcggcctgagcgccgagctggtgagacaccagagaatccacaccggcgagaagccctacgtgtgccaggagtgcggcaaggccttcacccagagcagctgcctgagcatccacagaagagtgcacaccggcgagaagccctacagatgcggcgagtgcggcaaggccttcgcccagaaggccaacctgacccagcaccagagaatccacaccggcgagaagccctacagctgcaacgtgtgcggcaaggccttcgtgctgagcgcccacctgaaccagcacctgagagtgcacacccaggagaccctgtaccagtgccagagatgccagaaggccttcagatgccacagcagcctgagcagacaccagagagtgcacaacaagcagcagtactgcctgtag

SEQ ID NO: 10541 - DNA, 2616 bp, Artificial Sequence; identical to SEQ ID NO: 10538
  Description of Artificial Sequence: Synthetic coding sequence

SEQ ID NO: 10542 - DNA, 1575 bp, Artificial Sequence
  Description of Artificial Sequence: Synthetic coding sequence
atggccaagagacccggcccccccggcagcagagagatgggcctgctgaccttcagagacatcgccatcgagttcagcctggaggagtggcagtgcctggactgcgcccagagaaacctgtacagagacgtgatgctggagaactacagaaacctggtgagcctgggcatcgccgtgagcaagcccgacctgatcacctgcctggagcagaacaaggagagccagaacatcaagagaaacgagatggtggccaagcaccccgtgaccagaagccacttcacccaggacctgcagcccgagcagggcatcaaggacagcctgcagaaggtgatccccagaacctacggcaagtgcggccacgagaagctgcagttcaagaagtgctgcaagagcgtgggcgagtacgaggtgcacaagggcggctacagcgaggtgaaccagtgcctgagcaccacccagaacaagatcttccagacccacaagtacgtgaaggtgttcggcaagttcagcaacagcaacagagacaagaccagatacaccggcaacaagcacttcaagtgcaacaagtacggcaagagcttctgcatgctgagccacctgaaccagcaccaggtgatccacaccagagagaagagctacaagtgcaaggagtgcggcaagagcttcaactgcagcagcaaccacaccacccacaagatcatccacaccggcgagaagccctacagatgcgaggagtgcggcaaggccttcagctggagcgccaacctgaccagacacaagagaacccacaccggcgagaagccctacacctgcgaggagtgcggccaggccttcagaagaagcagcgccctgaccaaccacaagagaatccacaccggcgagagaccctacaagtgcgaggagtgcggcaaggccttcagcgtgagcagcaccctgaccgaccacaagagaatccacaccggcgagaagccctgcagatgcgaggagtgcggcaaggccttcagctggagcagcaacctgaccagacacaagagaatccacaccagagagaagccctacgcctgcgaggagtgcggccaggccttcagcctgagcagcaacctgatgagacacagaagaatccacaccggcgagaagccctacacctgcgaggagtgcggccaggacttcagaagaagcagcgccctgaccatccacaagagaatccacaccggcgagagaccctacaagtgcgaggagtgcggcaaggtgttcagcctgagcagcaccctgaccgaccacaagagaatccacaccggcgagagaccctacaagtgcgaggagtgcggcaaggccttcagcctgagcagcaccctgaccgaccacaagagaatccacaccggcgagagaccctacacctgcgaggagtgcggcaaggccttcaactgcagcagcaccctgatgcagcacaagagaatccacaccggcgagaagccctacaagtgcgaggagtgcgagcaggccttcaagtggcacagcagcctggccaagcacaagatcatccacaccggcgagaagccctacaagtgcgagtag

SEQ ID NO: 10543 - DNA, 1857 bp, Artificial Sequence
  Description of Artificial Sequence: Synthetic coding sequence
atggagagagccgtggagccctggggccccgacctgcacagacccgaggagagagagccccagagaggcgccagaaccggcctgggcagcgagaacgtgatcagccagcccaacgagttcgagcacaccccccaggaggacgacctgggcttcaaggaggaggacctggcccccgaccacgaggtgggcaacgccagcctgaagcccgagggcatccagaactgggacgacctgtgggtgcagagagagggcctgggcaagccccagcccagagacagaggccccagactgctgggcgagcccagatggggccaggccagcagcgacagagccgccgtgtgcggcgagtgcggcaagagcttcagacagatgagcgacctggtgaagcaccagagaacccacaccggcgagaagccctacaagtgcggcgtgtgcggcaagggcttcggcgacagcagcgccagaatcaagcaccagagaacccacagcggcgagaagccctacagagccagaccccccgcccagggcccccccaagatccccagaagcagaatccccgccggcgagagacccaccatctgcggcgagtgcggcaagagcttcagacagagcagcgacctggtgaagcaccagagaacccacaccggcgagaagccctacaagtgcggcatctgcggcaagggcttcggcgacagcagcgccagaatcaagcaccagagaacccacagaggcgagcagccccccagacccgtggtgcccagaagacagcccagcagagccgccaccgccgccacccagggccccaaggcccaggacaagccctacatctgcaccgactgcggcaagagattcgtgctgagctgcagcctgctgagccaccagagaagccacctgggccccaagcccttcggctgcgacgtgtgcggcaaggagttcgccagaggcagcgacctggtgaagcacctgagagtgcacaccggcgagaagccctacctgtgccccgagtgcggcaagggcttcgccgacagcagcgccagagtgaagcacctgagaacccacagcggcgagagaccccacgcctgccccgagtgcgacagaaccttcagcctgagcagcaccctgctgagacacagactgacccacatggagccccaggacttcagcttccccggctaccccctgcccgccctgatccccagccccccccccccccccctgggcaccagcccccccctgacccccagaagccccagccacagcggcgagcccttcggcctgcccggcctggagcccgagcccggcggcccccaggccggcgagccccccccccccctggccggcgacaagccccacaagtgccccgagtgcggcaagggcttcagaagaagcagcgacctggtgaagcaccacagagtgcacaccggcgagaagccctacctgtgccccgagtgcggcaagggcttcgccgacagcagcgccagagtgaagcacctgagaacccacagaggcgagagagccagaccccccccccccagcaccctgctgagaccccacaacccccccggccccgtgcccatggcccccagacccagagtgagagcccagcccagcggccccagccagccccacgtgtgcggcttctgcggcaaggagttccccagaagcagcgacctggtgaagcacagaagaacccacaccggcgagaagccctacaagtgcgccgagtgcggcaagggcttcggcgacagcagcgccagaatcaagcaccagagaggccacctggtgctgacccccttcggcatcggcgacggcagagccagacccctgaagcaggaggccgccaccggcctggagtag

SEQ ID NO: 10544 - DNA, 432 bp, Artificial Sequence
  Description of Artificial Sequence: Synthetic coding sequence
atggagagagccgtggagccctggggccccgacctgcacagacccgaggagagagagccccagagaggcgccagaaccggcctgggcagcgagaacgtgatcagccagcccaacgagttcgagcacaccccccaggaggacgacctgggcttcaaggaggaggacctggcccccgaccacgaggtgggcaacgccagcctgaagcccgagggcatccagaactgggacgacctgtgggtgcagagagagggcctgggcaagccccagcccagagacagaggccccagactgctgggcgagcccagatggggccaggccagcagcgacagagccgccgtgtgcggcgagtgcggcaagagcttcagacagatgagcgacctggtgaagcaccagagaacccacaccggcgagaagccctacaagtgcggctag

SEQ ID NO: 10545 - DNA, 444 bp, Artificial Sequence
  Description of Artificial Sequence: Synthetic coding sequence
atggagagagccgtggagccctggggccccgacctgcacagacccgaggagagagagccccagagaggcgccagaaccggcctgggcagcgagaacgtgatcagccagcccaacgagttcgagcacaccccccaggaggacgacctgggcttcaaggaggaggacctggcccccgaccacgaggtgggcaacgccagcctgaagcccgagggcatccagaactgggacgacctgtgggtgcagagagagggcctgggcaagccccagcccagagacagaggccccagactgctgggcgagcccagatggggccaggccagcagcgacagagccgccgtgtgcggcgagtgcggcaagagcttcagacagatgagcgacctggtgaagcaccagagaacccacaccggcgagaagccctacaagtgcggcgtgtgcggcaagtag

SEQ ID NO: 10546 - DNA, 2235 bp, Artificial Sequence
  Description of Artificial Sequence: Synthetic coding sequence
atgcaggccgtggtgcccctgaacaagatgaccgccatcagccccgagccccagaccctggccagcaccgagcagaacgaggtgcccagagtggtgaccagcggcgagcaggaggccatcctgagaggcaacgccgccgacgccgagagcttcagacagagattcagatggttctgctacagcgaggtggccggccccagaaaggccctgagccagctgtgggagctgtgcaaccagtggctgagacccgacatccacaccaaggagcagatcctggagctgctggtgttcgagcagttcctgaccatcctgcccggcgagatcagaatctgggtgaagagccagcaccccgagagcagcgaggaggtggtgaccctgatcgaggacctgacccagatgctggaggagaaggaccccgtgagccaggacagcaccgtgagccaggaggagaacagcaaggaggacaagatggtgaccgtgtgccccaacaccgagagctgcgagagcatcaccctgaaggacgtggccgtgaacttcagcagaggcgagtggaagaagctggagcccttccagaaggagctgtacaaggaggtgctgctggagaacctgagaaacctggagttcctggacttccccgtgagcaagctggagctgatcagccagctgaagtgggtggagctgccctggctgctggaggaggtgagcaagagcagcagactggacgagagcgccctggacaagatcatcgagagatgcctgagagacgacgaccacggcctgatggaggagagccagcagtactgcggcagcagcgaggaggaccacggcaaccagggcaacagcaagggcagagtggcccagaacaagaccctgggcagcggcagcagaggcaagaagttcgaccccgacaagagccccttcggccacaacttcaaggagaccagcgacctgatcaagcacctgagagtgtacctgagaaagaagagcagaagatacaacgagagcaagaagcccttcagcttccacagcgacctggtgctgaacagaaaggagaagaccgccggcgagaagagcagaaagagcaacgacggcggcaaggtgctgagccacagcagcgccctgaccgagcaccagaagagacagaagatccacctgggcgacagaagccagaagtgcagcaagtgcggcatcatcttcatcagaagaagcaccctgagcagaagaaagacccccatgtgcgagaagtgcagaaaggacagctgccaggaggccgccctgaacaaggacgagggcaacgagagcggcgagaagacccacaagtgcagcaagtgcggcaaggccttcggctacagcgccagcctgaccaagcacagaagaatccacaccggcgagaagccctacatgtgcaacgagtgcggcaaggccttcagcgacagcagcagcctgaccccccaccacagaacccacagcggcgagaagcccttcaagtgcgacgactgcggcaagggcttcaccctgagcgcccacctgatcaagcaccagagaatccacaccggcgagaagccctacaagtgcaaggactgcggcagacccttcagcgacagcagcagcctgatccagcaccagagaatccacaccggcgagaagccctacacctgcagcaactgcggcaagagcttcagccacagcagcagcctgagcaagcaccagagaatccacaccggcgagaagccctacaagtgcggcgagtgcggcaaggccttcagacagaacagctgcctgaccagacaccagagaatccacaccggcgagaagccctacctgtgcaacgactgcggcatgaccttcagccacttcaccagcgtgatctaccaccagagactgcacagcggcgagaagccctacaagtgcaaccagtgcgagaaggccttccccacccacagcctgctgagcagacaccagagaatccacaccggcgtgaagccctacaagtgcaaggagtgcggcaagagcttcagccagagcagcagcctgaacgagcaccacagaatccacaccggcgagaagccctacgagtgcaactactgcggcgccaccttcagcagaagcagcatcctggtggagcacctgaagatccacaccggcagaagagagtacgagtgcaacgagtgcgagaagaccttcaagagcaacagcggcctgatcagacacagaggcttccacagcgccgagtag

SEQ ID NO: 10547 - DNA, 735 bp, Artificial Sequence
  Description of Artificial Sequence: Synthetic coding sequence
atgcaggccgtggtgcccctgaacaagatgaccgccatcagccccgagccccagaccctggccagcaccgagcagaacgaggtgcccagagtggtgaccagcggcgagcaggaggccatcctgagaggcaacgccgccgacgccgagagcttcagacagagattcagatggttctgctacagcgaggtggccggccccagaaaggccctgagccagctgtgggagctgtgcaaccagtggctgagacccgacatccacaccaaggagcagatcctggagctgctggtgttcgagcagttcctgaccatcctgcccggcgagatcagaatctgggtgaagagccagcaccccgagagcagcgaggaggtggtgaccctgatcgaggacctgacccagatgctggaggagaaggaccccgtgagccaggacagcaccgtgagccaggaggagaacagcaaggaggacaagatggtgaccgtgtgccccaacaccgagagctgcgagagcatcaccctgaaggacgtggccgtgaacttcagcagaggcgagtggaagaagctggagcccttccagaaggagctgtacaaggaggtgctgctggagaacctgagaaacctggagttcctggacttccccgtgagcaagctggagctgatcagccagctgaagtgggtggagctgccctggctgctggaggaggtgagcaagagcagcagactgggcagcgtgatctag

SEQ ID NO: 10548 - DNA, 771 bp, Artificial Sequence
  Description of Artificial Sequence: Synthetic coding sequence
atgcaggccgtggtgcccctgaacaagatgaccgccatcagccccgagccccagaccctggccagcaccgagcagaacgaggtgcccagagtggtgaccagcggcgagcaggaggccatcctgagaggcaacgccgccgacgccgagagcttcagacagagattcagatggttctgctacagcgaggtggccggccccagaaaggccctgagccagctgtgggagctgtgcaaccagtggctgagacccgacatccacaccaaggagcagatcctggagctgctggtgttcgagcagttcctgaccatcctgcccggcgagatcagaatctgggtgaagagccagcaccccgagagcagcgaggaggtggtgaccctgatcgaggacctgacccagatgctggaggagaaggaccccgtgagccaggacagcaccgtgagccaggaggagaacagcaaggaggacaagatggtgaccgtgtgccccaacaccgagagctgcgagagcatcaccctgaaggacgtggccgtgaacttcagcagaggcgagtggaagaagctggagcccttccagaaggagctgtacaaggaggtgctgctggagaacctgagaaacctggagttcctggacttccccgtgagcaagctggagctgatcagccagctgaagtgggtggagctgccctggctgctggaggaggtgagcaagagcagcagactggacatccacggcgccgtgaagaagatgcagatgttcagcgaggccgagtag

SEQ ID NO: 10549 - DNA, 537 bp, Artificial Sequence
  Description of Artificial Sequence: Synthetic coding sequence
atgcaggccgtggtgcccctgaacaagatgaccgccatcagccccgagccccagaccctggccagcaccgagcagaacgaggtgcccagagtggtgaccagcggcgagcaggaggccatcctgagaggcaacgccgccgacgccgagagcttcagacagagattcagatggttctgctacagcgaggtggccggccccagaaaggccctgagccagctgtgggagctgtgcaaccagtggctgagacccgacatccacaccaaggagcagatcctggagctgctggtgttcgagcagttcctgaccatcctgcccggcgagatcagaatctgggtgaagagccagcaccccgagagcagcgaggaggtggtgaccctgatcgaggacctgacccagatgctggaggagaagggcgagatctacagatggagagaggaggccggcgacatcgccagcaagagcgagagcaagttcctgaagagaagacagttcaccgccaaggaggagagcgaggtgagaagctgggactgggtgtag

SEQ ID NO: 10550 - DNA, 2451 bp, Artificial Sequence
  Description of Artificial Sequence: Synthetic coding sequence
atgctggagaactacttcaacctgatcagcgtgggctgccaggtgcccaagcccgaggtgatcttcagcctggagcaggaggagccctgcatgctggacggcgagatccccagccagagcagacccgacggcgacatcggcttcggccccctgcagcagagaatgagcgaggaggtgagcttccagagcgagatcaacatcaacctgttcaccagagacgacccctacagcatcctggaggagctgtggaaggacgacgagcacaccagaaagtgcggcgagaaccagaacaagcccctgagcagagtggtgttcatcaacaagaagaccctggccaacgacagcatcttcgagtacaaggacatcggcgagatcgtgcacgtgaacacccacctggtgagcagcagaaagagaccccacaactgcaacagctgcggcaagaacctggagcccatcatcaccctgtacaacagaaacaacgccaccgagaacagcgacaagaccatcggcgacggcgacatcttcacccacctgaacagccacaccgaggtgaccgcctgcgagtgcaaccagtgcggcaagcccctgcaccacaagcaggccctgatccagcagcagaagatccacaccagagagagcctgtacctgttcagcgactacgtgaacgtgttcagccccaagagccacgccttcgcccacgagagcatctgcgccgaggagaagcagcacgagtgccacgagtgcgaggccgtgttcacccagaagagccagctggacggcagccagagagtgtacgccggcatctgcaccgagtacgagaaggacttcagcctgaagagcaacagacagaagaccccctacgagggcaactactacaagtgcagcgactacggcagagccttcatccagaagagcgacctgttcagatgccagagaatccacagcggcgagaagccctacgagtacagcgagtgcgagaagaacctgccccagaacagcaacctgaacatccacaagaagatccacaccggcggcaagcacttcgagtgcaccgagtgcggcaaggccttcaccagaaagagcaccctgagcatgcaccagaagatccacaccggcgagaagccctacgtgtgcaccgagtgcggcaaggccttcatcagaaagagccacttcatcacccacgagagaatccacaccggcgagaagccctacgagtgcagcgactgcggcaagagcttcatcaagaagagccagctgcacgtgcaccagagaatccacaccggcgagaaccccttcatctgcagcgagtgcggcaaggtgttcacccacaagaccaacctgatcatccaccagaagatccacaccggcgagagaccctacatctgcaccgtgtgcggcaaggccttcaccgacagaagcaacctgatcaagcaccagaagatccacaccggcgagaagccctacaagtgcagcgactgcggcaagagcttcacctggaagagcagactgagaatccaccagaagtgccacaccggcgagagacactacgagtgcagcgagtgcggcaaggccttcatccagaagagcaccctgagcatgcaccagagaatccacagaggcgagaagccctacgtgtgcaccgagtgcggcaaggccttcttccacaagagccacttcatcacccacgagagaatccacaccggcgagaagccctacgagtgcagcatctgcggcaagagcttcaccaagaagagccagctgcacgtgcaccagcagatccacaccggcgagaagccctacagatgcgccgagtgcggcaaggccttcaccgacagaagcaacctgttcacccaccagaagatccacaccggcgagaagccctacaagtgcagcgactgcggcaaggccttcaccagaaagagcggcctgcacatccaccagcagagccacaccggcgagagacactacgagtgcagcgagtgcggcaaggccttcgccagaaagagcaccctgatcatgcaccagagaatccacaccggcgagaagccctacatctgcaacgagtgcggcaagagcttcatccagaagagccacctgaacagacacagaagaatccacaccggcgagaagccctacgagtgcagcgactgcggcaagagcttcatcaagaagagccagctgcacgagcaccacagaatccacaccggcgagaagccctacatctgcgccgagtgcggcaaggccttcaccatcagaagcaacctgatcaagcaccagaagatccacaccaagcagaagccctacaagtgcagcgacctgggcaaggccctgaactggaagccccagctgagcatgccccagaagagcgacaacggcgaggtggagtgcagcatgccccagctgtggtgcggcgacagcgagggcgaccagggccagctgagcagcatctag

SEQ ID NO: 10551 - DNA, 2559 bp, Artificial Sequence
  Description of Artificial Sequence: Synthetic coding sequence
atgaccaagagcctggagagcgtgagcttcaaggacgtgaccgtggacttcagcagagacgagtggcagcagctggacctggcccagaagagcctgtacagagaggtgatgctggagaactacttcaacctgatcagcgtgggctgccaggtgcccaagcccgaggtgatcttcagcctggagcaggaggagccctgcatgctggacggcgagatccccagccagagcagacccgacggcgacatcggcttcggccccctgcagcagagaatgagcgaggaggtgagcttccagagcgagatcaacatcaacctgttcaccagagacgacccctacagcatcctggaggagctgtggaaggacgacgagcacaccagaaagtgcggcgagaaccagaacaagcccctgagcagagtggtgttcatcaacaagaagaccctggccaacgacagcatcttcgagtacaaggacatcggcgagatcgtgcacgtgaacacccacctggtgagcagcagaaagagaccccacaactgcaacagctgcggcaagaacctggagcccatcatcaccctgtacaacagaaacaacgccaccgagaacagcgacaagaccatcggcgacggcgacatcttcacccacctgaacagccacaccgaggtgaccgcctgcgagtgcaaccagtgcggcaagcccctgcaccacaagcaggccctgatccagcagcagaagatccacaccagagagagcctgtacctgttcagcgactacgtgaacgtgttcagccccaagagccacgccttcgcccacgagagcatctgcgccgaggagaagcagcacgagtgccacgagtgcgaggccgtgttcacccagaagagccagctggacggcagccagagagtgtacgccggcatctgcaccgagtacgagaaggacttcagcctgaagagcaacagacagaagaccccctacgagggcaactactacaagtgcagcgactacggcagagccttcatccagaagagcgacctgttcagatgccagagaatccacagcggcgagaagccctacgagtacagcgagtgcgagaagaacctgccccagaacagcaacctgaacatccacaagaagatccacaccggcggcaagcacttcgagtgcaccgagtgcggcaaggccttcaccagaaagagcaccctgagcatgcaccagaagatccacaccggcgagaagccctacgtgtgcaccgagtgcggcaaggccttcatcagaaagagccacttcatcacccacgagagaatccacaccggcgagaagccctacgagtgcagcgactgcggcaagagcttcatcaagaagagccagctgcacgtgcaccagagaatccacaccggcgagaaccccttcatctgcagcgagtgcggcaaggtgttcacccacaagaccaacctgatcatccaccagaagatccacaccggcgagagaccctacatctgcaccgtgtgcggcaaggccttcaccgacagaagcaacctgatcaagcaccagaagatccacaccggcgagaagccctacaagtgcagcgactgcggcaagagcttcacctggaagagcagactgagaatccaccagaagtgccacaccggcgagagacactacgagtgcagcgagtgcggcaaggccttcatccagaagagcaccctgagcatgcaccagagaatccacagaggcgagaagccctacgtgtgcaccgagtgcggcaaggccttcttccacaagagccacttcatcacccacgagagaatccacaccggcgagaagccctacgagtgcagcatctgcggcaagagcttcaccaagaagagccagctgcacgtgcaccagcagatccacaccggcgagaagccctacagatgcgccgagtgcggcaaggccttcaccgacagaagcaacctgttcacccaccagaagatccacaccggcgagaagccctacaagtgcagcgactgcggcaaggccttcaccagaaagagcggcctgcacatccaccagcagagccacaccggcgagagacactacgagtgcagcgagtgcggcaaggccttcgccagaaagagcaccctgatcatgcaccagagaatccacaccggcgagaagccctacatctgcaacgagtgcggcaagagcttcatccagaagagccacctgaacagacacagaagaatccacaccggcgagaagccctacgagtgcagcgactgcggcaagagcttcatcaagaagagccagctgcacgagcaccacagaatccacaccggcgagaagccctacatctgcgccgagtgcggcaaggccttcaccatcagaagcaacctgatcaagcaccagaagatccacaccaagcagaagccctacaagtgcagcgacctgggcaaggccctgaactggaagccccagctgagcatgccccagaagagcgacaacggcgaggtggagtgcagcatgccccagctgtggtgcggcgacagcgagggcgaccagggccagctgagcagcatctag

SEQ ID NO: 10552 - DNA, 2451 bp, Artificial Sequence; identical to SEQ ID NO: 10550
  Description of Artificial Sequence: Synthetic coding sequence

SEQ ID NO: 10553 - DNA, 2565 bp, Artificial Sequence
  Description of Artificial Sequence: Synthetic coding sequence
atgagcgtgctgagcctgcccgagagcgtgagcttcaaggacgtgaccgtggacttcagcagagacgagtggcagcagctggacctggcccagaagagcctgtacagagaggtgatgctggagaactacttcaacctgatcagcgtgggctgccaggtgcccaagcccgaggtgatcttcagcctggagcaggaggagccctgcatgctggacggcgagatccccagccagagcagacccgacggcgacatcggcttcggccccctgcagcagagaatgagcgaggaggtgagcttccagagcgagatcaacatcaacctgttcaccagagacgacccctacagcatcctggaggagctgtggaaggacgacgagcacaccagaaagtgcggcgagaaccagaacaagcccctgagcagagtggtgttcatcaacaagaagaccctggccaacgacagcatcttcgagtacaaggacatcggcgagatcgtgcacgtgaacacccacctggtgagcagcagaaagagaccccacaactgcaacagctgcggcaagaacctggagcccatcatcaccctgtacaacagaaacaacgccaccgagaacagcgacaagaccatcggcgacggcgacatcttcacccacctgaacagccacaccgaggtgaccgcctgcgagtgcaaccagtgcggcaagcccctgcaccacaagcaggccctgatccagcagcagaagatccacaccagagagagcctgtacctgttcagcgactacgtgaacgtgttcagccccaagagccacgccttcgcccacgagagcatctgcgccgaggagaagcagcacgagtgccacgagtgcgaggccgtgttcacccagaagagccagctggacggcagccagagagtgtacgccggcatctgcaccgagtacgagaaggacttcagcctgaagagcaacagacagaagaccccctacgagggcaactactacaagtgcagcgactacggcagagccttcatccagaagagcgacctgttcagatgccagagaatccacagcggcgagaagccctacgagtacagcgagtgcgagaagaacctgccccagaacagcaacctgaacatccacaagaagatccacaccggcggcaagcacttcgagtgcaccgagtgcggcaaggccttcaccagaaagagcaccctgagcatgcaccagaagatccacaccggcgagaagccctacgtgtgcaccgagtgcggcaaggccttcatcagaaagagccacttcatcacccacgagagaatccacaccggcgagaagccctacgagtgcagcgactgcggcaagagcttcatcaagaagagccagctgcacgtgcaccagagaatccacaccggcgagaaccccttcatctgcagcgagtgcggcaaggtgttcacccacaagaccaacctgatcatccaccagaagatccacaccggcgagagaccctacatctgcaccgtgtgcggcaaggccttcaccgacagaagcaacctgatcaagcaccagaagatccacaccggcgagaagccctacaagtgcagcgactgcggcaagagcttcacctggaagagcagactgagaatccaccagaagtgccacaccggcgagagacactacgagtgcagcgagtgcggcaaggccttcatccagaagagcaccctgagcatgcaccagagaatccacagaggcgagaagccctacgtgtgcaccgagtgcggcaaggccttcttccacaagagccacttcatcacccacgagagaatccacaccggcgagaagccctacgagtgcagcatctgcggcaagagcttcaccaagaagagccagctgcacgtgcaccagcagatccacaccggcgagaagccctacagatgcgccgagtgcggcaaggccttcaccgacagaagcaacctgttcacccaccagaagatccacaccggcgagaagccctacaagtgcagcgactgcggcaaggccttcaccagaaagagcggcctgcacatccaccagcagagccacaccggcgagagacactacgagtgcagcgagtgcggcaaggccttcgccagaaagagcaccctgatcatgcaccagagaatccacaccggcgagaagccctacatctgcaacgagtgcggcaagagcttcatccagaagagccacctgaacagacacagaagaatccacaccggcgagaagccctacgagtgcagcgactgcggcaagagcttcatcaagaagagccagctgcacgagcaccacagaatccacaccggcgagaagccctacatctgcgccgagtgcggcaaggccttcaccatcagaagcaacctgatcaagcaccagaagatccacaccaagcagaagccctacaagtgcagcgacctgggcaaggccctgaactggaagccccagctgagcatgccccagaagagcgacaacggcgaggtggagtgcagcatgccccagctgtggtgcggcgacagcgagggcgaccagggccagctgagcagcatctag

SEQ ID NO: 10554 - DNA, 1326 bp, Artificial Sequence
  Description of Artificial Sequence: Synthetic coding sequence
atggcccccagagcccagatccagggccccctgaccttcggcgacgtggccgtggccttcaccagaatcgagtggagacacctggacgccgcccagagagccctgtacagagacgtgatgctggagaactacggcaacctggtgagcgtgggcctgctgagcagcaagcccaagctgatcacccagctggagcagggcgccgagccctggaccgaggtgagagaggcccccagcggcacccacgccgtggaggactactggttcgagaccaagatgagcgccctgaagcagagcaccagcgaggccagcgtgctgggcgagagaaccaagagcgtgatgatggagaagggcctggactgggagggcagaagcagcaccgagaagaactacaagtgcaaggagtgcggcaaggtgttcaagtacaacagcagcttcatcagccaccagagaaaccacaccagcgagaagccccacaagtgcaaggagtgcggcatcgccttcatgaacagcagcagcctgctgaaccaccacaaggtgcacgccggcaagcagccctacagatgcatcgagtgcggcaagttcctgaagaagcacagcaccttcatcaaccaccagagaatccacagcagagagaagccccacaagtgcatcgagtgcggcaagaccttcagaaagaacagcatcctgctgagccaccagagaatccacaccggccagaagccctacaagtgcaacgactgcggcaaggccttcgcccagaacgccgccctgaccagacacgagagaatccacagcggcgagaagcccttcaagtgcaacaagtgcggcagagccttcagagacaacagcaccgtgctggagcaccagaagatccacaccggcgagaagccctaccagtgcaacgagtgcggcaaggccttcagaaagagcagcaccctgatcagccaccagagaatgcacaccggcgagaagccctaccactgcagcaagtgcggcaagagcttcagatacagcagcagcttcgccggccaccagaagacccacagcggcaacaagccctaccagtgcagagactgcggcaaggccttcaccaagagcagcaccctgaccggccaccagagaatccacaccggcgagaagccctaccactgcaagaagtgcggcaaggccttcagacacagcagcggcctggtggagcaccagagactgcacaccggcgagaagccctacaagtgcaacgagtgcggcaaggccttccccagaagcagcgccctgaagcagcacaagaagatccacaacaaggagagagccatgaagtgcagctag

SEQ ID NO: 10555 - DNA, 1326 bp, Artificial Sequence; identical to SEQ ID NO: 10554
  Description of Artificial Sequence: Synthetic coding sequence

SEQ ID NO: 10556 - DNA, 1053 bp, Artificial Sequence
  Description of Artificial Sequence: Synthetic coding sequence
atgagcgccctgaagcagagcaccagcgaggccagcgtgctgggcgagagaaccaagagcgtgatgatggagaagggcctggactgggagggcagaagcagcaccgagaagaactacaagtgcaaggagtgcggcaaggtgttcaagtacaacagcagcttcatcagccaccagagaaaccacaccagcgagaagccccacaagtgcaaggagtgcggcatcgccttcatgaacagcagcagcctgctgaaccaccacaaggtgcacgccggcaagcagccctacagatgcatcgagtgcggcaagttcctgaagaagcacagcaccttcatcaaccaccagagaatccacagcagagagaagccccacaagtgcatcgagtgcggcaagaccttcagaaagaacagcatcctgctgagccaccagagaatccacaccggccagaagccctacaagtgcaacgactgcggcaaggccttcgcccagaacgccgccctgaccagacacgagagaatccacagcggcgagaagcccttcaagtgcaacaagtgcggcagagccttcagagacaacagcaccgtgctggagcaccagaagatccacaccggcgagaagccctaccagtgcaacgagtgcggcaaggccttcagaaagagcagcaccctgatcagccaccagagaatgcacaccggcgagaagccctaccactgcagcaagtgcggcaagagcttcagatacagcagcagcttcgccggccaccagaagacccacagcggcaacaagccctaccagtgcagagactgcggcaaggccttcaccaagagcagcaccctgaccggccaccagagaatccacaccggcgagaagccctaccactgcaagaagtgcggcaaggccttcagacacagcagcggcctggtggagcaccagagactgcacaccggcgagaagccctacaagtgcaacgagtgcggcaaggccttccccagaagcagcgccctgaagcagcacaagaagatccacaacaaggagagagccatgaagtgcagctag

SEQ ID NO: 10557 - DNA, 354 bp, Artificial Sequence
  Description of Artificial Sequence: Synthetic coding sequence
atggcccccagagcccagatccagggccccctgaccttcggcgacgtggccgtggccttcaccagaatcgagtggagacacctggacgccgcccagagagccctgtacagagacgtgatgctggagaactacggcaacctggtgagcgtgggcctgctgagcagcaagcccaagctgatcacccagctggagcagggcgccgagccctggaccgaggtgagagaggcccccagcggcacccacgccgtggaggactactggttcgagaccaagatgagcgccctgaagcagagcaccagcgaggccagcgtgctgggcgagagaaccaagagcgtgatgatggagaagggctag

SEQ ID NO: 10558 - DNA, 1392 bp, Artificial Sequence
  Description of Artificial Sequence: Synthetic coding sequence
atgcccggccccctgagaagcctggagatggagagcctgcagttcagagacgtggccgtggagttcagcctggaggagtggcactgcctggacaccgcccagcagaacctgtacagagacgtgatgctggagaactacagacacctggtgttcctgggcatcatcgtgagcaagcccgacctgatcacctgcctggagcagggcatcaagcccctgaccatgaagagacacgagatgatcgccaagccccccgtggtgtgcagccacttcgcccaggacctgtggcccgagcagagcatcaaggacagctaccagaaggtgatcctgagaaagttcgagaagtgcggccacggcaacctgcacttcaagaagggctgcgagagcgtggacgagtgcaagctgcacaagagaggctacaacggcctgaaccagtgcctgaccaccacccagagcaagatcttccagtgcggcaagtacgtgaaggtgttccaccagttcagcaacagcaagagacacaagagaagacacaccgagaagaagcccctgaagtacatcgagggcgacaaggccttcaaccagagcagcacccacaccacccacaagaagatcgacaccggcgagaagccctacaagtgcgaggagtgcggcaaggccttcaacagaagcagccacctgaccacccacaagatcacccacaccagagagaagccctacaagtgcgaggagtgcggcaaggtgttcaagtacttcagcagcttcaccacccacaagaagatccacagcggcgagaagccctacatctgcgaggagtgcggcaaggccttcatgtacccctacaccctgaccacccacaagatcatccacaccggcgagcagccctacaagtgcaaggagtgcgacaaggccttcaaccaccccgccaccctgagcagccacaagaagatccacaccggcgagaagccctacacctgcgacaagtgcggcaaggccttcatcagcagcagcatcctgagcaagcacgagaagatccacaccggcgagaagccctacaagtgcgaggagtgcggcaaggccttcaccagaagcagccacctgaccatgcacaagatcatccacaccggcgagaagccctacaagtgcgaggagtgcggcaaggccttcacctggagcgccggcctgcacaagcacagaagaacccacaccggcgagaagccctacaagtgcgaggagtgcggcaaggcctacaccaccagcagcaacctgaccgagcacaagaccacccacaccggcgagaagccctacaagtgcaaggagtgcggcaaggccttcaactggagcagcgacctgaacaagcacaagagaatccacatcggccagaagcccagaacctag

SEQ ID NO: 10559 - DNA, 1509 bp, Artificial Sequence
  Description of Artificial Sequence: Synthetic coding sequence
gtgagcagatgcatctggagcagcagaagccccctgagatacagcgtgagcagcgcccccagaggcccccccagcgtggccctgtgccccgtgggcatcggcagaagcaccgccaagatgcccggccccctgagaagcctggagatggagagcctgcagttcagagacgtggccgtggagttcagcctggaggagtggcactgcctggacaccgcccagcagaacctgtacagagacgtgatgctggagaactacagacacctggtgttcctgggcatcatcgtgagcaagcccgacctgatcacctgcctggagcagggcatcaagcccctgaccatgaagagacacgagatgatcgccaagccccccgtggtgtgcagccacttcgcccaggacctgtggcccgagcagagcatcaaggacagctaccagaaggtgatcctgagaaagttcgagaagtgcggccacggcaacctgcacttcaagaagggctgcgagagcgtggacgagtgcaagctgcacaagagaggctacaacggcctgaaccagtgcctgaccaccacccagagcaagatcttccagtgcggcaagtacgtgaaggtgttccaccagttcagcaacagcaagagacacaagagaagacacaccgagaagaagcccctgaagtacatcgagggcgacaaggccttcaaccagagcagcacccacaccacccacaagaagatcgacaccggcgagaagccctacaagtgcgaggagtgcggcaaggccttcaacagaagcagccacctgaccacccacaagatcacccacaccagagagaagccctacaagtgcgaggagtgcggcaaggtgttcaagtacttcagcagcttcaccacccacaagaagatccacagcggcgagaagccctacatctgcgaggagtgcggcaaggccttcatgtacccctacaccctgaccacccacaagatcatccacaccggcgagcagccctacaagtgcaaggagtgcgacaaggccttcaaccaccccgccaccctgagcagccacaagaagatccacaccggcgagaagccctacacctgcgacaagtgcggcaaggccttcatcagcagcagcatcctgagcaagcacgagaagatccacaccggcgagaagccctacaagtgcgaggagtgcggcaaggccttcaccagaagcagccacctgaccatgcacaagatcatccacaccggcgagaagccctacaagtgcgaggagtgcggcaaggccttcacctggagcgccggcctgcacaagcacagaagaacccacaccggcgagaagccctacaagtgcgaggagtgcggcaaggcctacaccaccagcagcaacctgaccgagcacaagaccacccacaccggcgagaagccctacaagtgcaaggagtgcggcaaggccttcaactggagcagcgacctgaacaagcacaagagaatccacatcggccagaagcccagaacctag

SEQ ID NO: 10560 - DNA, 573 bp, Artificial Sequence
  Description of Artificial Sequence: Synthetic coding sequence
tgaagacccagacccagaacccccagcagaggccccagcgacctgagattcagaggcgaggccggcctgagaagagtgttcctgaagaaggccggcggcagcgtgagcttcagcgacgtggccgtgggcttcacccaggaggagtggcagcacctggacagcgcccagagaaccccctacagagacatgatgctggagaactacagcctgctgctgagcgtgggctactgcatcaccaagcccgaggtggtgtgcaagctggagcacggccaggtgctgtggatcctggaggaggagagccccagccagagccacctggactgctgcatcgacgacgacctgatggagaagagacaggagaaccaggaccagcacctgcagaaggtggacttcgtgaacaacaagaccctgaccatggacagaaacggcgtgctgggcaagaccttcagcctggacaccaaccccatcctgagcagaaagatcagaggcaactgcgacagcagcggcatgaacctgaacaacatcagcgagctgatcatcagcaacagaagcagcttcgtgagaaacccctag

SEQ ID NO: 10561 - DNA, 1347 bp, Artificial Sequence
  Description of Artificial Sequence: Synthetic coding sequence
atggccagcagacccagacccagaacccccagcagaggccccagcgacctgagattcagaggcgaggccggcctgagaagagtgttcctgaagaaggccggcggcagcgtgagcttcagcgacgtggccgtgggcttcacccaggaggagtggcagcacctggacagcgcccagagaaccccctacagagacatgatgctggagaactacagcctgctgctgagcgtgggctactgcatcaccaagcccgaggtggtgtgcaagctggagcacggccaggtgctgtggatcctggaggaggagagccccagccagagccacctggactgctgcatcgacgacgacctgatggagaagagacaggagaaccaggaccagcacctgcagaaggtggacttcgtgaacaacaagaccctgaccatggacagaaacggcgtgctgggcaagaccttcagcctggacaccaaccccatcctgagcagaaagatcagaggcaactgcgacagcagcggcatgaacctgaacaacatcagcgagctgatcatcagcaacagaagcagcttcgtgagaaaccccgccgagtgcaacgtgagaggcaagttcctgctgtgcatgaagagagagaacccctacgccagaggcaagcccctggagtacgacggcaacggcaaggccgtgagccagaacgaggacctgttcagacaccagtacatccagaccctgaagcagtgcttcgagtacaaccacagaggctacaccgaggagagaaaccccatgaacgccctgaacgtgggcaagctgctggacatcggccacgccctgcagtacatcaaggagcacaccagagacaagacctacgagtgcaacgagtgcggcaagaacttctgcgagaagagcaacctgcacgtgcaccagagaacccacaccggcgagaagccctacggctgcaacgagtgccagaaggccttcggcgacagaagcgccctgaaggtgcaccagagaatccacaccggcgagaagccctacgagctgcaccagagaacccacaccggcgagaagccctacgcctgcagcgagtgcggcaagaccttctaccagaagagcagcctgaccacccaccagagaacccacaccagagagcagccctacgagtacaacgagagcttctaccagaaccccaacttcaccaagtgccagagagacaacatcgaggagaccctggtgaacatcctgaaggcccagaagcccagccccagctggaccagaagcatcgccgagaccacccaggtgggcggcagcgtgagcctgaaggacgtgaccgtggacttcacccaggaggagtggtag

SEQ ID NO: 10562 - DNA, 627 bp, Artificial Sequence
  Description of Artificial Sequence: Synthetic coding sequence
atgatgctggagaactacagcctgctgctgagcgtgggctactgcatcaccaagcccgaggtggtgtgcaagctggagcacggccaggtgctgtggatcctggaggaggagagccccagccagagccacctggactgctgcatcgacgacgacctgatggagaagagacaggagaaccaggaccagcacctgcagaaggtggacttcgtgaacaacaagaccctgaccatggacagaaacggcgtgctgggcaagaccttcagcctggacaccaaccccatcctgagcagaaagatcagaggcaactgcgacagcagcggcatgaacctgaacaacatcagcgagctgatcatcagcaacagaagcagcttcgtgagaaaccccgccgagtgcaacgtgagaggcaagttcctgctgtgcatgaagagagagaacccctacgccagaggcaagcccctggagtacgacggcaacggcaaggccgtgagccagaacgaggacctgttcagacaccagtacatccagaccctgaagcagtgcttcgagtacaaccagtgcggcaaggccttccacgaggaggccgcctgcagcacccacaagagagtgtgcagctgggagaccctgtag

SEQ ID NO: 10563 - DNA, 420 bp, Artificial Sequence
  Description of Artificial Sequence: Synthetic coding sequence
atgatgctggagaactacagcctgctgctgagcgtgggctactgcatcaccaagcccgaggtggtgtgcaagctggagcacggccaggtgctgtggatcctggaggaggagagccccagccagagccacctggactgctgcatcgacgacgacctgatggagaagagacaggagaaccaggaccagcacctgcagaaggtggacttcgtgaacaacaagaccctgaccatggacagaaacggcgtgctgggcaagaccttcagcctggacaccaaccccatcctgagcagaaagatcagaggcaactgcgacagcagcggcatgaacctgaacaacatcagcgagctgatcatcagcaacagaagcagcttcgtgagaaaccccgccgagtgcaacgtgagaggcaagttcctgctgtag

SEQ ID NO: 10564 - DNA, 360 bp, Artificial Sequence
  Description of Artificial Sequence: Synthetic coding sequence
atgatgctggagaactacagcctgctgctgagcgtgggctactgcatcaccaagcccgaggtggtgtgcaagctggagcacggccaggtgctgtggatcctggaggaggagagccccagccagagccacctggactgctgcatcgacgacgacctgatggagaagagacaggagaaccaggaccagcacctgcagaaggtggacttcgtgaacaacaagaccctgaccatggacagaaacggcgtgctgggcaagaccttcagcctggacaccaaccccatcctgagcagaaagatcagaggcaactgcgacagcagcggcatgaacctgaacaacatcagcgagctgatcatcagctag

SEQ ID NO: 10565 - DNA, 1023 bp, Artificial Sequence
  Description of Artificial Sequence: Synthetic coding sequence
atgcccgagtggcccccctgcctgagcgtggcccccgccctggtgatcaccatggccgccggcaagggcgcccccctgagccccagcgccgagaacagatggagactgagcgagcccgagctgggcagaggctgcaagcccgtgctgctggagaagaccaacagactgggccccgaggccgccgtgggcagagccggcagagacgtgggcagcgccgagctggccctgctggtggcccccggcaagcccagacccggcaagcccctgccccccaagaccagaggcgagcagagacagagcgccttcaccgagctgcccagaatgaaggacagacaggtggacgcccaggcccaggagagagagcacgacgaccccaccggccagcccggcgccccccagctgacccagaacatccccagaggccccgccggcagcaaggtgttcagcgtgtggcccagcggcgccagaagcgagcagagaagcgccttcagcaagcccaccaagagacccgccgagagacccgagctgaccagcgtgttccccgccggcgagagcgccgacgccctgggcgagctgagcggcctgctgaacaccaccgacctggcctgctggggcagactgagcacccccaagctgctggtgggcgacctgtggaacctgcaggccctgccccagaacgcccccctgtgcagcaccttcctgggcgcccccaccctgtggctggagcacacccaggcccaggtgcccccccccagcagcagcagcaccaccagctgggccctgctgccccccaccctgaccagcctgggcctgagcacccagaactggtgcgccaagtgcaacctgagcttcagactgaccagcgacctggtgttccacatgagaagccaccacaagaaggagcacgccggccccgacccccacagccagaagagaagagaggaggccctggcctgccccgtgtgccaggagcacttcagagagagacaccacctgagcagacacatgaccagccacagctag

SEQ ID NO: 10566 - DNA, 222 bp, Artificial Sequence
  Description of Artificial Sequence: Synthetic coding sequence
atgcccgagtggcccccctgcctgagcgtggcccccgccctggtgatcaccatggccgccggcaagggcgcccccctgagccccagcgccgagaacagatggagactgagcgagcccgagctgggcagaggctgcaagcccgtgctgctggagaagaccaacagactgggccccgaggccgccgtgggcagagccggcagagacgtgggcagcgccgagtag

SEQ ID NO: 10567 - DNA, 360 bp, Artificial Sequence
  Description of Artificial Sequence: Synthetic coding sequence
atgcccgagtggcccccctgcctgagcgtggcccccgccctggtgatcaccatggccgccggcaagggcgcccccctgagccccagcgccgagaacagatggagactgagcgagcccgagctgggcagaggctgcaagcccgtgctgctggagaagaccaacagactgggccccgaggccgccgtgggcagagccggcagagacgtgggcagcgccgagctggccctgctggtggcccccggcaagcccagacccggcaagcccctgccccccaagaccagaggcgagcagagacagagcgccttcaccgagctgcccagaatgaaggacagacaggtggacgcccaggcccaggagtag

SEQ ID NO: 10568 - DNA, 318 bp, Artificial Sequence
  Description of Artificial Sequence: Synthetic coding sequence
atgcccgagtggcccccctgcctgagcgtggcccccgccctggtgatcaccatggccgccggcaagggcgcccccctgagccccagcgccgagaacagatggagactgagcgagcccgagctgggcagaggctgcaagcccgtgctgctggagaagaccaacagactgggccccgaggccgccgtgggcagagccggcagagacgtgggcagcgccgagctggccctgctggtggcccccggcaagcccagacccggcaagcccctgccccccaagaccagaggcgagcagagacagagcgccttcaccgagctgtag

SEQ ID NO: 10569 - DNA, 261 bp, Artificial Sequence
  Description of Artificial Sequence: Synthetic coding sequence
atgcccgagtggcccccctgcctgagcgtggcccccgccctggtgatcaccatggccgccggcaagggcgcccccctgagccccagcgccgagaacagatggagactgagcgagcccgagctgggcagaggctgcaagcccgtgctgctggagaagaccaacagactgggccccgaggccgccgtgggcagagccggcagagacgtgggcagcgccgagctggccctgctggtggcccccggcaagcccagacccggctag

SEQ ID NO: 10570 - DNA, 210 bp, Artificial Sequence
  Description of Artificial Sequence: Synthetic coding sequence
atgcccgagtggcccccctgcctgagcgtggcccccgccctggtgatcaccatggccgccggcaagggcgcccccctgagccccagcgccgagaacagatggagactgagcgagcccgagctgggcagaggctgcaagcccgtgctgctggagaagaccaacagactgggccccgaggccgccgtgggcagagccggcagagacgtgtag

SEQ ID NO: 10571 - DNA, 393 bp, Artificial Sequence
  Description of Artificial Sequence: Synthetic coding sequence
atgcccgagtggcccccctgcctgagcgtggcccccgccctggtgatcaccatggccgccggcaagggcgcccccctgagccccagcgccgagaacagatggagactgagcgagcccgagctgggcagaggctgcaagcccgtgctgctggagaagaccaacagactgggccccgaggccgccgtgggcagagccggcagagacgtgggcagcgccgagctggccctgctggtggcccccggcaagcccagacccggcaagcccctgccccccaagaccagaggcgagcagagacagagcgccttcaccgagctgcccagaatgaaggacagacaggtggacgcccaggcccaggagagagagcacgacgaccccaccggccagcccggctag

SEQ ID NO: 10572 - DNA, 1590 bp, Artificial Sequence
  Description of Artificial Sequence: Synthetic coding sequence
atgagaagaaacagcagcctgagcttccagatggagagacccctggaggagcaggtgcagagcaagtggagcagcagccagggcagaaccggcaccggcggcagcgacgtgctgcagatgcagaacagcgagcaccacggccagagcatcaagacccagaccgacagcatcagcctggaggacgtggccgtgaacttcaccctggaggagtgggccctgctggaccccggccagagaaacatctacagagacgtgatgagagccaccttcaagaacctggcctgcatcggcgagaagtggaaggaccaggacatcgaggacgagcacaagaaccagggcagaaacctgagaagccccatggtggaggccctgtgcgagaacaaggaggactgcccctgcggcaagagcaccagccagatccccgacctgaacaccaacctggagacccccaccggcctgaagccctgcgactgcagcgtgtgcggcgaggtgttcatgcaccaggtgagcctgaacagacacatgagaagccacaccgagcagaagcccaacgagtgccacgagtacggcgagaagccccacaagtgcaaggagtgcggcaagaccttcaccagaagcagcagcatcagaacccacgagagaatccacaccggcgagaagccctacgagtgcaaggagtgcggcaaggccttcgccttcctgttcagcttcagaaaccacatcagaatccacaccggcgagaccccctacgagtgcaaggagtgcggcaaggccttcagatacctgaccgccctgagaagacacgagaagaaccacaccggcgagaagccctacaagtgcaagcagtgcggcaaggccttcatctactaccagcccttcctgacccacgagagaacccacaccggcgagaagccctacgagtgcaagcagtgcggcaaggccttcagctgccccacctacctgagaagccacgagaagacccacaccggcgagaagcccttcgtgtgcagagagtgcggcagagccttcttcagccacagcagcctgagaaagcacgtgaagacccacaccggcgtgcagccctacacctgcaagaagtgcggcgaggccttcaagagcagcagcagctgcgaggtgcacgagagaacccacttcggcgagaagccctacgagtgcaagcagtgcggcaaggccttcaacagcagcagctacctgcagctgcacgagagagtgcacaccggcgagaagacctacgagtgcaaggagtgcggcaaggccttcctgtacagcacccacttcagaatccacgagagaacccacaccagagagaagccctacgagtgcaagcagtgcggcagagtgttcatctacttcagccacctgagaagacacgagagaagccacaccggcgtgaagccctgcgagtgcaagcagtgcggcaaggccttcacctgcctgaacagcctgaaggtgcacaagagaatccacaccggcgagagacccttccagtgcagacagtgcggcaaggccttcagctacagcaagagcctgcacgtgcacgagagaacccacagcagacagaagccctag

SEQ ID NO: 10573 - DNA, 1314 bp, Artificial Sequence
  Description of Artificial Sequence: Synthetic coding sequence
atgggcgagagactgttcgagagcgccgagggcagccagtgcggcgagaccttcacccaggtgcccgaggacatgctgaacaagaagaccctgcccggcgtgaagagctgcgagagcggcacctgcggcgagatcttcatgggctacagcagcttcaacagaaacatcagaaccgacaccggccaccagccccacaagtgccagaagttcctggagaagccctacaagcacaagcagagaagaaaggccctgagccacagccactgcttcagaacccacgagagaccccacaccagagagaagcccttcgactgcaaggagtgcgagaagagcttcatcagccccgccagcatcagaagatacatggtgacccacagcggcgacggcccctacaagtgcaagttctgcggcaaggccctggactgcctgagcctgtacctgacccacgagagaacccacaccggcgagaagagatacgagtgcaagcagtgcggcaaggccttcagctggcacagcagcgtgagaatccacgagagaacccacaccggcgagaagccctacgagtgcaaggagtgcggcaagagcttcaacttcagcagcagcttcagaagacacgagagaacccacaccggcgagaagccctacaagtgcaaggagtgcggcaaggccttcaactgccccagcagcttccacagacacgagagaacccacaccggcgagaagccctacgagtgcaagctgtacggcaaggccctgagcagactgatcagcttcagaagacacatgagaatgcacaccggcgagagaccccacaagtgcaagatctgcggcaaggccttctacagccccagcagcttccagagacacgagagaagccacaccggcgagaagccctacaagtgcaagcagtgcggcaaggccttcacctgcagcaccagcttccagtaccacgagagaacccacaccggcgagaagcccgacggctgcaagcagtgcggcaaggccttcagaagcgccaagtacatcagaatccacggcagaacccacaccggcgagaagccctacgagtgcaagcagtgcggcaaggccttccactgcgtgagcagcttccacagacacgagagaacccacgccggcgagaagccctacgagtgcaagcactgcggcaaggccttcacctgcagcatctacatcagaatccacgagagaatccacaccggcgagaagccctaccagtgcaaggagtgcggcaaggccttcatcagaagcagctactgcagaaagcacgagagaacccacaccatcaacatctag

SEQ ID NO: 10574 - DNA, 420 bp, Artificial Sequence
  Description of Artificial Sequence: Synthetic coding sequence
atgggcgagagactgttcgagagcgccgagggcagccagtgcggcgagaccttcacccaggtgcccgaggacatgctgaacaagaagaccctgcccggcgtgaagagctgcgagagcggcacctgcggcgagatcttcatgggctacagcagcttcaacagaaacatcagaaccgacaccggccaccagccccacaagtgccagaagttcctggagaagccctacaagcacaagcagagaagaaaggccctgagccacagccactgcttcagaacccacgagagaccccacaccagagagaagcccttcgactgcaaggagtgcgagaagagcttcatcagccccgccagcatcagaagatacatggtgacccacagcggcgacggcccctacaagtgcaagttctgcggcaaggcctag

SEQ ID NO: 10575 - DNA, 1230 bp, Artificial Sequence
  Description of Artificial Sequence: Synthetic coding sequence
atgggcgagagactgttcgagagcgccgagggcagccagtgcggcgagaccttcacccaggtgcccgaggacatgctgaacaagaagaccctgcccggcgtgaagagctgcgagagcggcacctgcggcgagatcttcatgggctacagcagcttcaacagaaacatcagaaccgacaccggccaccagccccacaagtgccagaagttcctggagaagccctacaagcacaagcagagaagaaaggccctgagccacagccactgcttcagaacccacgagagaccccacaccagagagaagcccttcgactgcaaggagtgcgagaagagcttcatcagccccgccagcatcagaagatacatggtgacccacagcggcgacggcccctacaagtgcaagttctgcggcaaggccctggactgcctgagcctgtacctgacccacgagagaacccacaccggcgagaagagatacgagtgcaagcagtgcggcaaggccttcagctggcacagcagcgtgagaatccacgagagaacccacaccggcgagaagccctacgagtgcaaggagtgcggcaagagcttcaacttcagcagcagcttcagaagacacgagagaacccacaccggcgagaagccctacgagtgcaagctgtacggcaaggccctgagcagactgatcagcttcagaagacacatgagaatgcacaccggcgagagaccccacaagtgcaagatctgcggcaaggccttctacagccccagcagcttccagagacacgagagaagccacaccggcgagaagccctacaagtgcaagcagtgcggcaaggccttcacctgcagcaccagcttccagtaccacgagagaacccacaccggcgagaagcccgacggctgcaagcagtgcggcaaggccttcagaagcgccaagtacatcagaatccacggcagaacccacaccggcgagaagccctacgagtgcaagcagtgcggcaaggccttccactgcgtgagcagcttccacagacacgagagaacccacgccggcgagaagccctacgagtgcaagcactgcggcaaggccttcacctgcagcatctacatcagaatccacgagagaatccacaccggcgagaagccctaccagtgcaaggagtgcggcaaggccttcatcagaagcagctactgcagaaagcacgagagaacccacaccatcaacatctag

SEQ ID NO: 10576 - DNA, 1596 bp, Artificial Sequence
  Description of Artificial Sequence: Synthetic coding sequence
atgctggagaactacagaaacctggtgttcgtgggcatcgccgccagcaagcccgacctgatcacctgcctggagcagggcaaggagccctggaacgtgaagagacacgagatggtggccgagccccccgtggtgtgcagctacttcgccagagacctgtggcccaagcagggcaagaagaactacttccagaaggtgatcctgagaagatacaagaagtgcggctgcgagaacctgcagctgagaaagtactgcaagagcatggacgagtgcaaggtgcacaaggagtgctacaacggcctgaaccagtgcctgaccaccacccagaacaagatcttccagtgcgacaagtacgtgaaggtgttccacaagttcagcaacagcaacagacacaccatcagacacaccggcaagaagagcttcaagtgcaaggagtgcgagaagagcttctgcatgctgagccacctggcccagcacaagagaatccacagcggcgagaagccctacaagtgcaaggagtgcggcaaggcctacaacgagaccagcaacctgagcacccacaagagaatccacaccggcaagaagccctacaagtgcgaggagtgcggcaaggccttcaacagactgagccacctgaccacccacaagatcatccacaccggcaagaagccctacaagtgcgaggagtgcggcaaggccttcaaccagagcgccaacctgaccacccacaagagaatccacaccggcgagaagccctacaagtgcgaggagtgcggcagagccttcagccagagcagcaccctgaccgcccacaagatcatccacgccggcgagaagccctacaagtgcgaggagtgcggcaaggccttcagccagagcagcaccctgaccacccacaagatcatccacaccggcgagaagttctacaagtgcgaggagtgcggcaaggccttcagccagctgagccacctgaccacccacaagagaatccacagcggcgagaagccctacaagtgcgaggagtgcggcaaggccttcaagcagagcagcaccctgaccacccacaagagaatccacgccggcgagaagttctacaagtgcgaggtgtgcagcaaggccttcagcagattcagccacctgaccacccacaagagaatccacaccggcgagaagccctacaagtgcgaggagtgcggcaaggccttcaacctgagcagccagctgaccacccacaagatcatccacaccggcgagaagccctacaagtgcgaggagtgcggcaaggccttcaaccagagcagcaccctgagcaagcacaaggtgatccacaccggcgagaagccctacaagtacgaggagtgcggcaaggccttcaaccagagcagccacctgaccacccacaagatgatccacaccggcgagaagccctacaagtgcgaggagtgcggcaaggccttcaacaacagcagcatcctgaacagacacaagatgatccacaccggcgagaagctgtacaagcccgagagctgcaacaacgcctgcgacaacatcgccaagatcagcaagtacaagagaaactgcgccggcgagaagtag

SEQ ID NO: 10577 - DNA, 1941 bp, Artificial Sequence
  Description of Artificial Sequence: Synthetic coding sequence
atgaacgagtgcaacgtgcacaaggagggctacaacgagctgaaccagtacctgaccaccacccagagcaagatcttccagtgcgacaagtacgtgaaggtgttccacaagctgctgaacagcaacagacacaacaccaagcacaccggcaagaagcccttcaagtgcaagaagtgcggcaagagcttctgcatgctgctgcacctgtgccagcacaagagaatccacatcagagagaacagctacagatgcgaggagtgcggcaaggccttcatctggttcagcaccctgaccagacacagaagagtgcacaccggcgagaagagctacaagtacgagtgcggcaagagcttcaaccaggacagcaacctgaccacccacaagagaatccacaccggccagaagccctacaagtgcgaggagtgcggcaccagcttctaccagttcagctacctgaccagacacaagctgatccacaccagagagaagccctacaagtgcgagcagtacggcaagaccttcaaccagagcagcaccctgaccggccacaagatcatccacaacggcgagaagccctacaagtgcgaggagtgcggcaaggccttcagcatcttcagcacccccaccaagcacaagatcatccacaccgaggagaagagccacagatgcgaggagtactgcaaggcctacaaggagagcagccacctgaccacccacaagagaatccacaccggcgagaagccctacaagtgcgaggagtgcggcaaggccttcagcatcttcagcaccctgaccaagcacaagatcatccacaccgaggagaagagccacagatgcgaggagtgcggcaaggcctacaaggagagcagccacctgaccacccacaagagaatccacaccggcgagaagccctacaagtgcgaggagtgcggcaagaccttcagcgtgttcagcatcctgaccaagcacaagatcatccacaccgaggagaagccctacaagtgcgaggagtgcggcaaggccttcaagagaagcagcaccctgaccaagcacagaatcatccacaccgaggagaagccctacaagtgcgaggagtgcggcaaggccttcaaccagagcagcaccctgagcatccacaagatcatccacaccggcgagaagccctacaagtgcgaggagtgcggcaaggccttcaagagaagcagcaccctgaccatccacaagatgatccacaccggcgagaagccctacaagtgcgaggagtgcggcaaggccttcaacagaagcagccacctgaccacccacaagagaatccacaccggccacaagccctacaagtgcaaggagtgcggcaagagcttcagcgtgttcagcaccctgaccaagcacaagatcatccacaccgacaagaagccctacaagtgcgaggagtgcggcaaggccttcaacagaagcagcatcctgagcatccacaagaagatccacaccggcgagaagccctacaagtgcgaggagtgcggcaaggccttcaagagaagcagccacctggccggccacaagcagatccacagcgtgcagaagccctacaagtgcgaggagtgcggcaaggccttcagcatcttcagcaccctgaccaagcacaagatcatccacaccgaggagaagccctacaagtgcgagaagtgcggcaagaccttctacagattcagcaacctgaacacccacaagatcatccacaccggcgagaagccctgcaagtgcgaggagtgcggcaaggccttcaaccacagcagcaacctgatcaagcacaagctgatccacaccggcgacaagccctacaagtgcgaggcctgcggcaaggccttcagaagaagcagccacctgagcagacacaagatcatccacatcggcatccacaccgaggagaccgtgcagaagtag

SEQ ID NO: 10578 - DNA, 2325 bp, Artificial Sequence
  Description of Artificial Sequence: Synthetic coding sequence
atgcccggcccccccgagagcctggacatgggccccctgaccttcagagacgtggccatcgagttcagcctggaggagtggcagtgcctggacaccgcccagcaggacctgtacagaaaggtgatgctggagaactacagaaacctggtgttcctgggcatcgccgtgagcaagcccgacctggtgacctgcctggagcagggcaaggacccctggaacatgaagggccacagcaccgtggtgaagccccccgtgatctgcagccacttcgccgaggacttctgccccggccccggcatcaaggacagcttccagaaggtgatcctgagagagtacgtgaagtgcggccacaaggacctgcagctgagaaagggctgcaagagcatgaacgagtgcaacgtgcacaaggagggctacaacgagctgaaccagtacctgaccaccacccagagcaagatcttccagtgcgacaagtacgtgaaggtgttccacaagctgctgaacagcaacagacacaacaccaagcacaccggcaagaagcccttcaagtgcaagaagtgcggcaagagcttctgcatgctgctgcacctgtgccagcacaagagaatccacatcagagagaacagctacagatgcgaggagtgcggcaaggccttcatctggttcagcaccctgaccagacacagaagagtgcacaccggcgagaagagctacaagtacgagtgcggcaagagcttcaaccaggacagcaacctgaccacccacaagagaatccacaccggccagaagccctacaagtgcgaggagtgcggcaccagcttctaccagttcagctacctgaccagacacaagctgatccacaccagagagaagccctacaagtgcgagcagtacggcaagaccttcaaccagagcagcaccctgaccggccacaagatcatccacaacggcgagaagccctacaagtgcgaggagtgcggcaaggccttcagcatcttcagcacccccaccaagcacaagatcatccacaccgaggagaagagccacagatgcgaggagtactgcaaggcctacaaggagagcagccacctgaccacccacaagagaatccacaccggcgagaagccctacaagtgcgaggagtgcggcaaggccttcagcatcttcagcaccctgaccaagcacaagatcatccacaccgaggagaagagccacagatgcgaggagtgcggcaaggcctacaaggagagcagccacctgaccacccacaagagaatccacaccggcgagaagccctacaagtgcgaggagtgcggcaagaccttcagcgtgttcagcatcctgaccaagcacaagatcatccacaccgaggagaagccctacaagtgcgaggagtgcggcaaggccttcaagagaagcagcaccctgaccaagcacagaatcatccacaccgaggagaagccctacaagtgcgaggagtgcggcaaggccttcaaccagagcagcaccctgagcatccacaagatcatccacaccggcgagaagccctacaagtgcgaggagtgcggcaaggccttcaagagaagcagcaccctgaccatccacaagatgatccacaccggcgagaagccctacaagtgcgaggagtgcggcaaggccttcaacagaagcagccacctgaccacccacaagagaatccacaccggccacaagccctacaagtgcaaggagtgcggcaagagcttcagcgtgttcagcaccctgaccaagcacaagatcatccacaccgacaagaagccctacaagtgcgaggagtgcggcaaggccttcaacagaagcagcatcctgagcatccacaagaagatccacaccggcgagaagccctacaagtgcgaggagtgcggcaaggccttcaagagaagcagccacctggccggccacaagcagatccacagcgtgcagaagccctacaagtgcgaggagtgcggcaaggccttcagcatcttcagcaccctgaccaagcacaagatcatccacaccgaggagaagccctacaagtgcgagaagtgcggcaagaccttctacagattcagcaacctgaacacccacaagatcatccacaccggcgagaagccctgcaagtgcgaggagtgcggcaaggccttcaaccacagcagcaacctgatcaagcacaagctgatccacaccggcgacaagccctacaagtgcgaggcctgcggcaaggccttcagaagaagcagccacctgagcagacacaagatcatccacatcggcatccacaccgaggagaccgtgcagaagtag

SEQ ID NO: 10579 - DNA, 312 bp, Artificial Sequence
  Description of Artificial Sequence: Synthetic coding sequence
atgcccggcccccccgagagcctggacatgggccccctgaccttcagagacgtggccatcgagttcagcctggaggagtggcagtgcctggacaccgcccagcaggacctgtacagaaaggtgatgctggagaactacagaaacctggtgttcctggccggcatcgccgtgagcaagcccgacctggtgacctgcctggagcagggcaaggacccctggaacatgaagggccacagcaccgtggtgaagccccccgtggagaccggcttccacagattcagccaggacggcctgtacctgctgaccagctag

SEQ ID NO: 10580 - DNA, 1497 bp, Artificial Sequence
  Description of Artificial Sequence: Synthetic coding sequence
atggagagccccagaggctggaccctgcaggtggcccccgaggagggccaggtgctgtgcaacgtgaagaccgccaccagaggcctgagcgagggcgccgtgagcggcggctggggcgcctgggagaacagcaccgaggtgcccagagaggccggcgacggccagagacagcaggccaccctgggcgccgccgacgagcagggcggccccggcagagagctgggccccgccgacggcggcagagacggcgccggccccagaagcgagcccgccgacagagccctgagacccagccccctgcccgaggagcccggctgcagatgcggcgagtgcggcaaggccttcagccagggcagctacctgctgcagcacagaagagtgcacaccggcgagaagccctacacctgccccgagtgcggcaaggccttcgcctggagcagcaacctgagccagcaccagagaatccacagcggcgagaagccctacgcctgcagagagtgcggcaaggccttcagagcccacagccagctgatccaccaccaggagacccacagcggcctgaagcccttcagatgccccgactgcggcaagagcttcggcagaagcaccaccctggtgcagcacagaagaacccacaccggcgagaagccctacgagtgccccgagtgcggcaaggccttcagctggaacagcaacttcctggagcacagaagagtgcacaccggcgccagaccccacgcctgcagagactgcggcaaggccttcagccagagcagcaacctggccgagcacctgaagatccacgccggcgccagaccccacgcctgccccgactgcggcaaggccttcgtgagagtggccggcctgagacagcacagaagaacccacagcagcgagaagcccttcccctgcgccgagtgcggcaaggccttcagagagagcagccagctgctgcagcaccagagaacccacaccggcgagagacccttcgagtgcgccgagtgcggccaggccttcgtgatgggcagctacctggccgagcacagaagagtgcacaccggcgagaagccccacgcctgcgcccagtgcggcaaggccttcagccagagaagcaacctgctgagccacagaagaacccacagcggcgccaagcccttcgcctgcgccgactgcggcaaggccttcagaggcagcagcggcctggcccaccacagactgagccacaccggcgagagacccttcgcctgcgccgagtgcggcaaggccttcagaggcagcagcgagctgagacagcaccagagactgcacagcggcgagagacccttcgtgtgcgcccactgcagcaaggccttcgtgagaaagagcgagctgctgagccacagaagaacccacaccggcgagagaccctacgcctgcggcgagtgcggcaagcccttcagccacagatgcaacctgaacgagcaccagaagagacacggcggcagagccgccccctag

SEQ ID NO: 10581 - DNA, 678 bp, Artificial Sequence
  Description of Artificial Sequence: Synthetic coding sequence
cacagcggcgagaagccctacgcctgcagagagtgcggcaaggccttcagagcccacagccagctgatccaccaccaggagacccacagcggcctgaagcccttcagatgccccgactgcggcaagagcttcggcagaagcaccaccctggtgcagcacagaagaacccacaccggcgagaagccctacgagtgccccgagtgcggcaaggccttcgtgagagtggccggcctgagacagcacagaagaacccacagcagcgagaagcccttcccctgcgccgagtgcggcaaggccttcagagagagcagccagctgctgcagcaccagagaacccacaccggcgagagacccttcgagtgcgccgagtgcggccaggccttcgtgatgggcagctacctggccgagcacagaagagtgcacaccggcgagaagccccacgcctgcgcccagtgcggcaaggccttcagccagagaagcaacctgctgagccacagaagaacccacagcggcgccaagcccttcgcctgcgccgactgcggcaaggccttcagaggcagcagcggcctggcccaccacagactgagccacaccggcgagagacccttcgcctgcgccgagtgcggcaaggccttcagaggcagcagcgagctgagacagcaccagagactgcactag

SEQ ID NO: 10582 - DNA, 1497 bp, Artificial Sequence; identical to SEQ ID NO: 10580
  Description of Artificial Sequence: Synthetic coding sequence

SEQ ID NO: 10583 - DNA, 1419 bp, Artificial Sequence
  Description of Artificial Sequence: Synthetic coding sequence
atgctgaaggagcaccccgagatggccgaggccccccagcagcagctgggcatccccgtggtgaagctggagaaggagctgccctggggcagaggcagagaggaccccagccccgagaccttcagactgagattcagacagttcagataccaggaggccgccggcccccaggaggccctgagagagctgcaggagctgtgcagaagatggctgagacccgagctgcacaccaaggagcagatcctggagctgctggtgctggagcagttcctgaccatcctgcccagagagttctacgcctggatcagagagcacggccccgagagcggcaaggccctggccgccatggtggaggacctgaccgagagagccctggaggccaaggccgtgccctgccacagacagggcgagcaggaggagaccgccctgtgcagaggcgcctgggagcccggcatccagctgggccccgtggaggtgaagcccgagtggggcatgccccccggcgagggcgtgcagggccccgaccccggcaccgaggagcagctgagccaggaccccggcgacgagaccagagccttccaggagcagggcggcggcagcaaggagaaggaggccaagcccccccaggaggacctgaagggcgccctggtggccctgaccagcgagagattcggcgaggccagcctgcagggccccggcctgggcagagtgtgcgagcaggagcccggcggccccgccggcagcgcccccggcctgccccccccccagcacggcgccatccccctgcccgacgaggtgaagacccacagcagcttctggaagcccttccagtgccccgagtgcggcaagggcttcagcagaagcagcaacctggtgagacaccagagaacccacgaggagaagagctacggctgcgtggagtgcggcaagggcttcaccctgagagagtacctgatgaagcaccagagaacccacctgggcaagagaccctacgtgtgcagcgagtgctggaagaccttcagccagagacaccacctggaggtgcaccagagaagccacaccggcgagaagccctacaagtgcggcgactgctggaagagcttcagcagaagacagcacctgcaggtgcacagaagaacccacaccggcgagaagccctacacctgcgagtgcggcaagagcttcagcagaaacgccaacctggccgtgcacagaagagcccacaccggcgagaagccctacggctgccaggtgtgcggcaagagattcagcaagggcgagagactggtgagacaccagagaatccacaccggcgagaagccctaccactgccccgcctgcggcagaagcttcaaccagagaagcatcctgaacagacaccagaagacccagcacagacaggagcccctggtgcagtag

SEQ ID NO: 10584 - DNA, 1635 bp, Artificial Sequence
  Description of Artificial Sequence: Synthetic coding sequence
atgctgaaggagcaccccgagatggccgaggccccccagcagcagctgggcatccccgtggtgaagctggagaaggagctgccctggggcagaggcagagaggaccccagccccgagaccttcagactgagattcagacagttcagataccaggaggccgccggcccccaggaggccctgagagagctgcaggagctgtgcagaagatggctgagacccgagctgcacaccaaggagcagatcctggagctgctggtgctggagcagttcctgaccatcctgcccagagagttctacgcctggatcagagagcacggccccgagagcggcaaggccctggccgccatggtggaggacctgaccgagagagccctggaggccaaggccgtgccctgccacagacagggcgagcaggaggagaccgccctgtgcagaggcgcctgggagcccggcatccagctgggccccgtggaggtgaagcccgagtggggcatgccccccggcgagggcgtgcagggccccgaccccggcaccgaggagcagctgagccaggaccccggcgacgagaccagagccttccaggagcaggccctgcccgtgctgcaggccggccccggcctgcccgccgtgaaccccagagaccaggagatggccgccggcttcttcaccgccggcagccagggcctgggccccttcaaggacatggccctggccttccccgaggaggagtggagacacgtgacccccgcccagatcgactgcttcggcgagtacgtggagccccaggactgcagagtgagccccggcggcggcagcaaggagaaggaggccaagcccccccaggaggacctgaagggcgccctggtggccctgaccagcgagagattcggcgaggccagcctgcagggccccggcctgggcagagtgtgcgagcaggagcccggcggccccgccggcagcgcccccggcctgccccccccccagcacggcgccatccccctgcccgacgaggtgaagacccacagcagcttctggaagcccttccagtgccccgagtgcggcaagggcttcagcagaagcagcaacctggtgagacaccagagaacccacgaggagaagagctacggctgcgtggagtgcggcaagggcttcaccctgagagagtacctgatgaagcaccagagaacccacctgggcaagagaccctacgtgtgcagcgagtgctggaagaccttcagccagagacaccacctggaggtgcaccagagaagccacaccggcgagaagccctacaagtgcggcgactgctggaagagcttcagcagaagacagcacctgcaggtgcacagaagaacccacaccggcgagaagccctacacctgcgagtgcggcaagagcttcagcagaaacgccaacctggccgtgcacagaagagcccacaccggcgagaagccctacggctgccaggtgtgcggcaagagattcagcaagggcgagagactggtgagacaccagagaatccacaccggcgagaagccctaccactgccccgcctgcggcagaagcttcaaccagagaagcatcctgaacagacaccagaagacccagcacagacaggagcccctggtgcagtag

SEQ ID NO: 10585 - DNA, 1635 bp, Artificial Sequence; identical to SEQ ID NO: 10584
  Description of Artificial Sequence: Synthetic coding sequence

SEQ ID NO: 10586 - DNA, 213 bp, Artificial Sequence
  Description of Artificial Sequence: Synthetic coding sequence
atgctgaaggagcaccccgagatggccgaggccccccagcagcagctgggcatccccgtggtgaagctggagaaggagctgccctggggcagaggcagagaggaccccagccccgagaccttcagactgagattcagacagttcagataccaggaggccgccggcccccaggaggccctgagagagctgcaggagctgtgcagaagatggtag

SEQ ID NO: 10587 - DNA, 5424 bp, Artificial Sequence
  Description of Artificial Sequence: Synthetic coding sequence
atggccaagcccaccagcaaggacagcggcctgaaggagaagttcaagatcctgctgggcctgggcacccccagacccaaccccagaagcgccgagggcaagcagaccgagttcatcatcaccgccgagatcctgagagagctgagcatggagtgcggcctgaacaacagaatcagaatgatcggccagatctgcgaggtggccaagaccaagaagttcgaggagcacgccgtggaggccctgtggaaggccgtggccgacctgctgcagcccgagagacccctggaggccagacacgccgtgctggccctgctgaaggccatcgtgcagggccagggcgagagactgggcgtgctgagagccctgttcttcaaggtgatcaaggactaccccagcaacgaggacctgcacgagagactggaggtgttcaaggccctgaccgacaacggcagacacatcacctacctggaggaggagctggccgacttcgtgctgcagtggatggacgtgggcctgagcagcgagttcctgctggtgctggtgaacctggtgaagttcaacagctgctacctggacgagtacatcgccagaatggtgcagatgatctgcctgctgtgcgtgagaaccgccagcagcgtggacatcgaggtgagcctgcaggtgctggacgccgtggtgtgctacaactgcctgcccgccgagagcctgcccctgttcatcgtgaccctgtgcagaaccatcaacgtgaaggagctgtgcgagccctgctggaagctgatgagaaacctgctgggcacccacctgggccacagcgccatctacaacatgtgccacctgatggaggacagagcctacatggaggacgcccccctgctgagaggcgccgtgttcttcgtgggcatggccctgtggggcgcccacagactgtacagcctgagaaacagccccaccagcgtgctgcccagcttctaccaggccatggcctgccccaacgaggtggtgagctacgagatcgtgctgagcatcaccagactgatcaagaagtacagaaaggagctgcaggtggtggcctgggacatcctgctgaacatcatcgagagactgctgcagcagctgcagaccctggacagccccgagctgagaaccatcgtgcacgacctgctgaccaccgtggaggagctgtgcgaccagaacgagttccacggcagccaggagagatacttcgagctggtggagagatgcgccgaccagagacccgagagcagcctgctgaacctgatcagctacagagcccagagcatccaccccgccaaggacggctggatccagaacctgcaggccctgatggagagattcttcagaagcgagagcagaggcgccgtgagaatcaaggtgctggacgtgctgagcttcgtgctgctgatcaacagacagttctacgaggaggagctgatcaacagcgtggtgatcagccagctgagccacatccccgaggacaaggaccaccaggtgagaaagctggccacccagctgctggtggacctggccgagggctgccacacccaccacttcaacagcctgctggacatcatcgagaaggtgatggccagaagcctgagccccccccccgagctggaggagagagacgtggccgcctacagcgccagcctggaggacgtgaagaccgccgtgctgggcctgctggtgatcctgcagaccaagctgtacaccctgcccgccagccacgccaccagagtgtacgagatgctggtgagccacatccagctgcactacaagcacagctacaccctgcccatcgccagcagcatcagactgcaggccttcgacttcctgctgctgctgagagccgacagcctgcacagactgggcctgcccaacaaggacggcgtggtgagattcagcccctactgcgtgtgcgactacatggagcccgagagaggcagcgagaagaagaccagcggccccctgagcccccccaccggcccccccggccccgcccccgccggccccgccgtgagactgggcagcgtgccctacagcctgctgttcagagtgctgctgcagtgcctgaagcaggagagcgactggaaggtgctgaagctggtgctgggcagactgcccgagagcctgagatacaaggtgctgatcttcaccagcccctgcagcgtggaccagctgtgcagcgccctgtgcagcatgctgagcggccccaagaccctggagagactgagaggcgcccccgagggcttcagcagaaccgacctgcacctggccgtggtgcccgtgctgaccgccctgatcagctaccacaactacctggacaagaccaagcagagagagatggtgtactgcctggagcagggcctgatccacagatgcgccagccagtgcgtggtggccctgagcatctgcagcgtggagatgcccgacatcatcatcaaggccctgcccgtgctggtggtgaagctgacccacatcagcgccaccgccagcatggccgtgcccctgctggagttcctgagcaccctggccagactgccccacctgtacagaaacttcgccgccgagcagtacgccagcgtgttcgccatcagcctgccctacaccaaccccagcaagttcaaccagtacatcgtgtgcctggcccaccacgtgatcgccatgtggttcatcagatgcagactgcccttcagaaaggacttcgtgcccttcatcaccaagggcctgagaagcaacgtgctgctgagcttcgacgacacccccgagaaggacagcttcagagccagaagcaccagcctgaacgagagacccaagagcctgagaatcgccagaccccccaagcagggcctgaacaacagcccccccgtgaaggagttcaaggagagcagcgccgccgaggccttcagatgcagaagcatcagcgtgagcgagcacgtggtgagaagcagaatccagaccagcctgaccagcgccagcctgggcagcgccgacgagaacagcgtggcccaggccgacgacagcctgaagaacctgcacctggagctgaccgagacctgcctggacatgatggccagatacgtgttcagcaacttcaccgccgtgcccaagagaagccccgtgggcgagttcctgctggccggcggcagaaccaagacctggctggtgggcaacaagctggtgaccgtgaccaccagcgtgggcaccggcaccagaagcctgctgggcctggacagcggcgagctgcagagcggccccgagagcagcagcagccccggcgtgcacgtgagacagaccaaggaggcccccgccaagctggagagccaggccggccagcaggtgagcagaggcgccagagacagagtgagaagcatgagcggcggccacggcctgagagtgggcgccctggacgtgcccgccagccagttcctgggcagcgccaccagccccggccccagaaccgcccccgccgccaagcccgagaaggccagcgccggcaccagagtgcccgtgcaggagaagaccaacctggccgcctacgtgcccctgctgacccagggctgggccgagatcctggtgagaagacccaccggcaacaccagctggctgatgagcctggagaaccccctgagccccttcagcagcgacatcaacaacatgcccctgcaggagctgagcaacgccctgatggccgccgagagattcaaggagcacagagacaccgccctgtacaagagcctgagcgtgcccgccgccagcaccgccaagcccccccccctgcccagaagcaacaccgtggccagcttcagcagcctgtaccagagcagctgccagggccagctgcacagaagcgtgagctgggccgacagcgccgtggtgatggaggagggcagccccggcgaggtgcccgtgctggtggagccccccggcctggaggacgtggaggccgccctgggcatggacagaagaaccgacgcctacagcagaagcagcagcgtgagcagccaggaggagaagagcctgcacgccgaggagctggtgggcagaggcatccccatcgagagagtggtgagcagcgagggcggcagacccagcgtggacctgagcttccagcccagccagcccctgagcaagagcagcagcagccccgagctgcagaccctgcaggacatcctgggcgaccccggcgacaaggccgacgtgggcagactgagccccgaggtgaaggccagaagccagagcggcaccctggacggcgagagcgccgcctggagcgccagcggcgaggacagcagaggccagcccgagggccccctgcccagcagcagccccagaagccccagcggcctgagacccagaggctacaccatcagcgacagcgcccccagcagaagaggcaagagagtggagagagacgccctgaagagcagagccaccgccagcaacgccgagaaggtgcccggcatcaaccccagcttcgtgttcctgcagctgtaccacagccccttcttcggcgacgagagcaacaagcccatcctgctgcccaacgagagccagagcttcgagagaagcgtgcagctgctggaccagatccccagctacgacacccacaagatcgccgtgctgtacgtgggcgagggccagagcaacagcgagctggccatcctgagcaacgagcacggcagctacagatacaccgagttcctgaccggcctgggcagactgatcgagctgaaggactgccagcccgacaaggtgtacctgggcggcctggacgtgtgcggcgaggacggccagttcacctactgctggcacgacgacatcatgcaggccgtgttccacatcgccaccctgatgcccaccaaggacgtggacaagcacagatgcgacaagaagagacacctgggcaacgacttcgtgagcatcgtgtacaacgacagcggcgaggacttcaagctgggcaccatcaagggccagttcaacttcgtgcacgtgatcgtgacccccctggactacgagtgcaacctggtgagcctgcagtgcagaaaggacatggagggcctggtggacaccagcgtggccaagatcgtgagcgacagaaacctgcccttcgtggccagacagatggccctgcacgccaacatggccagccaggtgcaccacagcagaagcaaccccaccgacatctaccccagcaagtggatcgccagactgagacacatcaagagactgagacagagaatctgcgaggaggccgcctacagcaaccccagcctgcccctggtgcacccccccagccacagcaaggcccccgcccagacccccgccgagcccacccccggctacgaggtgggccagagaaagagactgatcagcagcgtggaggacttcaccgagttcgtgtag

SEQ ID NO: 10588 - DNA, 1326 bp, Artificial Sequence
  Description of Artificial Sequence: Synthetic coding sequence
atggccaccgtgcccggcctgcagcccctgcccaccctggagcaggacctggagcaggaggagatcctgatcgtgaaggtggaggaggacttctgcctggaggaggagcccagcgtggagaccgaggaccccagccccgagaccttcagacagctgttcagactgttctgctaccaggaggtggccggccccagagaggccctgagcagactgtgggagctgtgctgcagatggctgagacccgagctgagaaccaaggagcagatcctggagctgctggtgctggagcagttcctgaccgtgctgcccggcgagatccaggccagagtgagagagcagcagcccgagagcggcgaggaggccgtggtgctggtggagggcctgcagagaaagcccagaaagcacagacagagaggcagcgagctgctgagcgacgacgaggtgcccctgggcatcggcggccagttcctgaagcaccaggccgaggcccagcccgaggacctgagcctggaggaggaggccagattcagcagccagcagccccccgcccagctgagccacagaccccagagaggccccctgctgtggcccgagagaggcccccccgcccccagacaccaggagatggccagcgccagccccttcctgagcgcctggagccaggtgcccgtgaacctggaggacgtggccgtgtacctgagcggcgaggagcccagatgcatggaccccgcccagagagacgcccccctggagaacgagggccccggcatccagctggaggacggcggcgacggcagagaggacgcccccctgagaatggagtggtacagagtgctgagcgccagatgccagggccccggccaccccctgcccggccagagacccgcccccgtgagaggcctggtgagacccgaccagcccagaggcggccccccccccggcagaagagccagccacggcgccgacaagccctacacctgccccgagtgcggcaagggcttcagcaagaccagccacctgaccaagcaccagagaacccacaccggcgagagaccctacaagtgcctggtgtgcggcaagggcttcagcgacagaagcaacttcagcacccaccagagagtgcacaccggcgagaagccctacccctgccccgagtgcggcaagagattcagccagagcagcagcctggtgatccacagaagaacccacagcggcgagagaccctacgcctgcacccagtgcggcaagagattcaacaacagcagccacttcagcgcccacagaagaacccacaccggccacatcctgagaagcggctgcacctag

SEQ ID NO: 10589 - DNA, 648 bp, Artificial Sequence
  Description of Artificial Sequence: Synthetic coding sequence
atgaacagcagccagatcagcctgagaatgaagcacggcagagtgaacatgcagaagaagcccagcaagtgcagcgagtgcggcaagttcttcacccagagaagcagcctgacccagcaccagagaatccacagaggcgagaagccctacgtgtgcagcgagtgcggcagctgcttcagaaagcagagcaacctgacccagcacctgagaatccacaccggcgagaagccctacaagtgcaacgagtgcgagaaggccttccagaccaaggccatcctggtgcagcacctgagaatccacaccggcgagaagccctacaagtgcaacgagtgcggcaaggccttctgccagagccccagcctgatcaagcaccagagaatccacaccggcgagaagccctacacctgcaccgagtgcggcaaggccttcacccagaacagcagcctggtggagcacgagagaacccacaccggcgagaagctgtacaagtgcagcgagtgcgagaagaccttcagaaagcaggcccacctgagcgagcactacagaatccacaccggcgagaagccctacgagtgcgtgggctgcggcaagagcttcagacacagcagcgccctgctgagacaccagagactgcacgccggcgagtag

SEQ ID NO: 10590 - DNA, 816 bp, Artificial Sequence
  Description of Artificial Sequence: Synthetic coding sequence
atgaacagcagccagatcagcctgagaatgaagcacggcagagtgaacatgcagaagaagcccagcaagtgcagcgagtgcggcaagttcttcacccagagaagcagcctgacccagcaccagagaatccacagaggcgagaagccctacgtgtgcagcgagtgcggcagctgcttcagaaagcagagcaacctgacccagcacctgagaatccacaccggcgagaagccctacaagtgcaacgagtgcgagaaggccttccagaccaaggccatcctggtgcagcacctgagaatccacaccggcgagaagccctacaagtgcaacgagtgcggcaaggccttctgccagagccccagcctgatcaagcaccagagaatccacaccggcgagaagccctacaagtgcaccgagtgcggcaaggccttcagccagagcatctgcctgaccagacaccagagaagccacagcggcgacaagcccttcaagtgcaacgagtgcggcaaggccttcaaccagagcgcctgcctgatgcagcaccagagaatccacagcggcgagaagccctacacctgcaccgagtgcggcaaggccttcacccagaacagcagcctggtggagcacgagagaacccacaccggcgagaagctgtacaagtgcagcgagtgcgagaagaccttcagaaagcaggcccacctgagcgagcactacagaatccacaccggcgagaagccctacgagtgcgtgggctgcggcaagagcttcagacacagcagcgccctgctgagacaccagagactgcacgccggcgagtag

SEQ ID NO: 10591 - DNA, 1635 bp, Artificial Sequence
  Description of Artificial Sequence: Synthetic coding sequence
atgctgaacatgcagggcgccgaggagagagacatcagaagagagacctgccccggctgggtgaacaagaacaagcccgccctggagcaggacgtgtgcaagatcgacagcagcggcatcgtggtgaagagattccaggaggacgagtaccaggacagcaccttcgaggagaagtacgcctgcgagggcatgaaggagaacagccccagagagatcgccgagagctgcctgttccaggagggcggcttcggcagaatcaccttcatccacaaggaggccccccccgagatcatcagccagggctacaacttcgagaagagcctgctgctgaccagcagcctggtgaccagactgagagtgagcaccgaggagagcctgcaccagtgggagaccagcaacatccagaccaacgacatcagcgaccagagcaagtgccccaccctgtgcacccagaagaagagctggaagtgcaacgagtgcggcaagaccttcacccagagcagcagcctgacccagcaccagagaacccacaccggcgagagaccctacacctgcgaggagtgcggcaaggccttcagcagaagcagcttcctggtgcagcaccagagaatccacaccggcgtgaagccctacggctgcgagcagtgcggcaagaccttcagatgcagaagcttcctgacccagcaccagagaatccacaccggcgagaagccctacaagtgcaacgagtgcggcaacagcttcagaaaccacagccacctgaccgagcaccagagaatccacaccggcgagaagccctacaagtgcaacagatgcggcaaggccttcaaccagaacacccacctgatccaccaccagagaatccacaccggcgagaagccctacatctgcagcgagtgcggcagcagcttcagaaagcacagcaacctgacccagcaccagagaatccacaccggcgagaagccccacaagtgcgacgagtgcggcaagaccttccagaccaaggccaacctgagccagcaccagagaatccacagcggcgagaagccctacaagtgcaaggagtgcggcaaggccttctgccagagccccagcctgatcaagcaccagagaatccacaccggcgagaagccctacaagtgcaaggagtgcggcaaggccttcacccagagcacccccctgaccaagcaccagagaatccacaccggcgagagaccctacaagtgcagcgagtgcggcaaggccttcatccagagcatctgcctgatcagacaccagagaagccacaccggcgagaagccctacaagtgcaacgagtgcggcaagggcttcaaccagaacacctgcctgacccagcacatgagaatccacaccggcgagaagccctacaagtgcaaggagtgcggcaaggccttcgcccacagcagcagcctgaccgagcaccacagaacccacaccggcgagaagctgtacaagtgcagcgagtgcgagaagaccttcagaaagtacgcccacctgagcgagcactacagaatccacaccggcgagaagccctacgagtgcatcgagtgcggcaagttcttcagacacagcagcgtgctgttcagacaccagaagctgcacagcggcgactag

SEQ ID NO: 10592 - DNA, 468 bp, Artificial Sequence
  Description of Artificial Sequence: Synthetic coding sequence
atgctgaacatgcagggcgccgaggagagagacatcagaagagagacctgccccggctgggtgaacaagaacaagcccgccctggagcaggacgtgtgcaagatcgacagcagcggcatcgtggtgaagagattccaggaggacgagtaccaggacagcaccttcgaggagaagtacgcctgcgagggcatgaaggagaacagccccagagagatcgccgagagctgcctgttccaggagggcggcttcggcagaatcaccttcatccacaaggaggccccccccgagatcatcagccagggctacaacttcgagaagagcctgctgctgaccagcagcctggtgaccagactgagagtgagcaccgaggagagcctgcaccagtgggagaccagcaacatccagaccaacgacatcagcgaccagagcaagtgccccaccctgtgcacccagaagaagagctggtag

SEQ ID NO: 10593 - DNA, 1362 bp, Artificial Sequence
  Description of Artificial Sequence: Synthetic coding sequence
atgctgaacatgcagggcgccgaggagagagacatcagaagagagacctgccccggctgggtgaacaagaacaagcccgccctggagcaggacgtgtgcaagatcgacagcagcggcatcgtggtgaagagattccaggaggacgagtaccaggacagcaccttcgaggagaagtacgcctgcgagggcatgaaggagaacagccccagagagatcgccgagagctgcctgttccaggagggcggcttcggcagaatcaccttcatccacaaggaggccccccccgagatcatcagccagggctacaacttcgagaagagcctgctgctgaccagcagcctggtgaccagactgagagtgagcaccgaggagagcctgcaccagtgggagaccagcaacatccagaccaacgacatcagcgaccagagcaagtgccccaccctgtgcacccagaagaagagctggaagtgcaacgagtgcggcaagaccttcacccagagcagcagcctgacccagcaccagagaacccacaccggcgagagaccctacacctgcgaggagtgcggcaaggccttcagcagaagcagcttcctggtgcagcaccagagaatccacaccggcgtgaagccctacggctgcgagcagtgcggcaagcacttcgacgtggaccacttcctgctgagcatcaaggagttcaccctggagagaaacctgatcaacgccatgaacgtgggcatccccagcgccatcacccacatcagcctgaacaccagagagttcaccctggagagaaacctgatcaacgccatcggcgtgggcagacacagcatcagaatccacaccctgttcatcatcagagagttcaccctggtgagaagcctgacctacgccgtgaacgtggccctgctgttcgagaacacccagatcctgagaaacatcagagagttcaccctgggcaagaaccccatcaacgtgaccaacgtgggcaagctgagcaagcagagacagaccagcctgagcatcagagagttcatcgtggagagaaaccccatcaacgtgaagaacgtggccaagcccttcgtgagagcccacctgctgctgaacaccagcgagttcatcctggagaagaaccacatcagcgtgaagaacgtggccaagagactgctgagagccccccacagcctgaacatcagagagtacatccagggcagagaccccaccaacgccgtgaacgtggtgaagcccagcttcagagccttcgccctgttcggcaccagagaggtgaccctggagaagaaccccatcaacgccatgaacgtggagagagccctgatcagaacccccgccagcctgagcatctag

SEQ ID NO: 10594 - DNA, 1635 bp, Artificial Sequence; identical to SEQ ID NO: 10591
  Description of Artificial Sequence: Synthetic coding sequence

SEQ ID NO: 10595 - DNA, 1635 bp, Artificial Sequence; identical to SEQ ID NO: 10591
  Description of Artificial Sequence: Synthetic coding sequence

SEQ ID NO: 10596 - DNA, 1335 bp, Artificial Sequence
  Description of Artificial Sequence: Synthetic coding sequence
atgggccccctgcagttcagagacgtggccatcgagttcagcctggaggagtggcactgcctggacgccgcccagagaaacctgtacagagacgtgatgctggagaactacagaaacctgatcttcctgggcatcgtggtgagcaagcccaacctgatcacctgcctggagcagggcaagaagcccctgaccatgaagagacacgagatgatcgccaagccccccgtgatgtacagccacttcgcccaggacctgtggagcgagcagagcatcaaggacagcttccagaaggtgatcctgagaagatacgagaagtgcagacacgacaacctgcagctgaagaagggctgcgagagcgtggacgagtgccccgtgcacaagagaggctacaacggcctgaagcagtgcctggccaccacccagagaaagatcttccagtgcgacgagtacgtgaagttcctgcacaagttcagcaacagcaacaagcacaagatcagagacaccggcaagaagagcttcaagtgcatcgagtacggcaagaccttcaaccagagcagcaccagaaccacctacaagaagatcgacgccggcgagaagagatacaagtgcgaggagtgcggcaaggcctacaagcagagcagccacctgaccacccacaagaagatccacaccggcgagaagccctacaagtgcgaggagtgcggcaaggcctacaagcagagctgcaacctgaccacccacaagatcatccacaccggcgagaagccctacagatgcagagagtgcggcaaggccttcaaccaccccgccaccctgttcagccacaagaagatccacaccggcgagaagccctacaagtgcgacaagtgcggcaaggccttcatcagcagcagcaccctgaccaagcacgagatcatccacaccggcgagaagccctacaagtgcgaggagtgcggcaaggccttcaacagaagcagcaacctgaccaagcacaagagaatccacaccggcgacgtgccctacaagtgcgacgagtgcggcaagaccttcacctggtacagcagcctgagcaagcacaagagagcccacaccggcgagaagccctacaagtgcgaggagtgcggcaaggccttcaccgccttcagcaccctgaccgagcacaagatcatccacaccggcgagaagccctacaagtgcgaggagtgcggcaaggccttcaactggagcagcgccctgaacaagcacaagaagatccacatcagacagaagccctgcatcgtgaagaacgtggagaacctgctgaacgtgccccagcccctgatcagcatcagatag

SEQ ID NO: 10597 - DNA, 1239 bp, Artificial Sequence
  Description of Artificial Sequence: Synthetic coding sequence
atgggccccctgcagttcagagacgtggccatcgagttcagcctggaggagtggcactgcctggacgccgcccagagaaacctgtacagagacgtgatgctggagaactacagaaacctgatcttcctggtgatgtacagccacttcgcccaggacctgtggagcgagcagagcatcaaggacagcttccagaaggtgatcctgagaagatacgagaagtgcagacacgacaacctgcagctgaagaagggctgcgagagcgtggacgagtgccccgtgcacaagagaggctacaacggcctgaagcagtgcctggccaccacccagagaaagatcttccagtgcgacgagtacgtgaagttcctgcacaagttcagcaacagcaacaagcacaagatcagagacaccggcaagaagagcttcaagtgcatcgagtacggcaagaccttcaaccagagcagcaccagaaccacctacaagaagatcgacgccggcgagaagagatacaagtgcgaggagtgcggcaaggcctacaagcagagcagccacctgaccacccacaagaagatccacaccggcgagaagccctacaagtgcgaggagtgcggcaaggcctacaagcagagctgcaacctgaccacccacaagatcatccacaccggcgagaagccctacagatgcagagagtgcggcaaggccttcaaccaccccgccaccctgttcagccacaagaagatccacaccggcgagaagccctacaagtgcgacaagtgcggcaaggccttcatcagcagcagcaccctgaccaagcacgagatcatccacaccggcgagaagccctacaagtgcgaggagtgcggcaaggccttcaacagaagcagcaacctgaccaagcacaagagaatccacaccggcgacgtgccctacaagtgcgacgagtgcggcaagaccttcacctggtacagcagcctgagcaagcacaagagagcccacaccggcgagaagccctacaagtgcgaggagtgcggcaaggccttcaccgccttcagcaccctgaccgagcacaagatcatccacaccggcgagaagccctacaagtgcgaggagtgcggcaaggccttcaactggagcagcgccctgaacaagcacaagaagatccacatcagacagaagccctgcatcgtgaagaacgtggagaacctgctgaacgtgccccagcccctgatcagcatcagatag

SEQ ID NO: 10598 - DNA, 1335 bp, Artificial Sequence; identical to SEQ ID NO: 10596
  Description of Artificial Sequence: Synthetic coding sequence

SEQ ID NO: 10599 - DNA, 237 bp, Artificial Sequence
  Description of Artificial Sequence: Synthetic coding sequence
atgggccccctgcagttcagagacgtggccatcgagttcagcctggaggagtggcactgcctggacgccgcccagagaaacctgtacagagacgtgatgctggagaactacagaaacctgatcttcctgggcatcgtggtgagcaagcccaacctgatcacctgcctggagcagggcaagaagcccctgaccatgaagagacacgagatgatcgccaagccccccggcggcctgtag

SEQ ID NO: 10600 - DNA, 2862 bp, Artificial Sequence
  Description of Artificial Sequence: Synthetic coding sequence
atggaggagagcagcagcgtggccatgctggtgcccgacatcggcgagcaggaggccatcctgaccgccgagagcatcatcagccccagcctggagatcgacgagcagagaaagaccaagcccgaccccctgatccacgtgatccagaagctgagcaagatcgtggagaacgagaagagccagaagtgcctgctgatcggcaagaagagacccagaagcagcgccgccacccacagcctggagacccaggagctgtgcgagatccccgccaaggtgatccagagccccgccgccgacaccagaagagccgagatgagccagaccaacttcacccccgacaccctggcccagaacgagggcaaggccatgagctaccagtgcagcctgtgcaagttcctgagcagcagcttcagcgtgctgaaggaccacatcaagcagcacggccagcagaacgaggtgatcctgatgtgcagcgagtgccacatcaccagcagaagccaggaggagctggaggcccacgtggtgaacgaccacgacaacgacgccaacatccacacccagagcaaggcccagcagtgcgtgagccccagcagcagcctgtgcagaaagaccaccgagagaaacgagaccatccccgacatccccgtgagcgtggacaacctgcagacccacaccgtgcagaccgccagcgtggccgagatgggcagaagaaagtggtacgcctacgagcagtacggcatgtacagatgcctgttctgcagctacacctgcggccagcagagaatgctgaagacccacgcctggaagcacgccggcgaggtggactgcagctaccccatcttcgagaacgagaacgagcccctgggcctgctggacagcagcgccgccgccgcccccggcggcgtggacgccgtggtgatcgccatcggcgagagcgagctgagcatccacaacggccccagcgtgcaggtgcagatctgcagcagcgagcagctgagcagcagcagccccctggagcagagcgccgagagaggcgtgcacctgagccagagcgtgaccctggaccccaacgaggaggagatgctggaggtgatcagcgacgccgaggagaacctgatccccgacagcctgctgaccagcgcccagaagatcatcagcagcagccccaacaagaagggccacgtgaacgtgatcgtggagagactgcccagcgccgaggagaccctgagccagaagagattcctgatgaacaccgagatggaggagggcaaggacctgagcctgaccgaggcccagatcggcagagagggcatggacgacgtgtacagagccgacaagtgcaccgtggacatcggcggcctgatcatcggctggagcagcagcgagaagaaggacgagctgatgaacaagggcctggccaccgacgagaacgccccccccggcagaagaagaaccaacagcgagagcctgagactgcacagcctggccgccgaggccctggtgaccatgcccatcagagccgccgagctgaccagagccaacctgggccactacggcgacatcaacctgctggaccccgacaccagccagagacaggtggacagcaccctggccgcctacagcaagatgatgagccccctgaagaacagcagcgacggcctgaccagcctgaaccagagcaacagcaccctggtggccctgcccgagggcagacaggagctgagcgacggccaggtgaagaccggcatcagcatgagcctgctgaccgtgatcgagaagctgagagagagaaccgaccagaacgccagcgacgacgacatcctgaaggagctgcaggacaacgcccagtgccagcccaacagcgacaccagcctgagcggcaacaacgtggtggagtacatccccaacgccgagagaccctacagatgcagactgtgccactacaccagcggcaacaagggctacatcaagcagcacctgagagtgcacagacagagacagccctaccagtgccccatctgcgagcacatcgccgacaacagcaaggacctggagagccacatgatccaccactgcaagaccagaatctaccagtgcaagcagtgcgaggagagcttccactacaagagccagctgagaaaccacgagagagagcagcacagcctgcccgacaccctgagcatcgccaccagcaacgagcccagaatcagcagcgacaccgccgacggcaagtgcgtgcaggagggcaacaagagcagcgtgcagaagcagtacagatgcgacgtgtgcgactacaccagcaccacctacgtgggcgtgagaaaccacagaagaatccacaacagcgacaagccctacagatgcagcctgtgcggctacgtgtgcagccacccccccagcctgaagagccacatgtggaagcacgccagcgaccagaactacaactacgagcaggtgaacaaggccatcaacgacgccatcagccagagcggcagagtgctgggcaagagccccggcaagacccagctgaagagcagcgaggagagcgccgaccccgtgaccggcagcagcgagaacgccgtgagcagcagcgagctgatgagccagacccccagcgaggtgctgggcaccaacgagaacgagaagctgagccccaccagcaacaccagctacagcctggagaagatcagcagcctggccccccccagcatggagtactgcgtgctgctgttctgctgctgcatctgcggcttcgagagcaccagcaaggagaacctgctggaccacatgaaggagcacgagggcgagatcgtgaacatcatcctgaacaaggaccacaacaccgccctgaacaccaactag

SEQ ID NO: 10601 - DNA, 2862 bp, Artificial Sequence; identical to SEQ ID NO: 10600
  Description of Artificial Sequence: Synthetic coding sequence

SEQ ID NO: 10602 - DNA, 2874 bp, Artificial Sequence
  Description of Artificial Sequence: Synthetic coding sequence
atggaggagagcagcagcgtggccatgctggtgcccgacatcggcgagcaggaggccatcctgaccgccgagagcatcatcagccccagcctggagatcgacgagcagagaaagaccaagcccgaccccctgatccacgtgatccagaagctgagcaagatcgtggagaacgagaagagccagaagtgcctgctgatcggcaagaagagacccagaagcagcgccgccacccacagcctggagacccaggagctgtgcgagatccccgccaaggtgatccagagccccgccgccgacaccagaagagccgagatgagccagaccaacttcacccccgacaccctggcccagaacgagggcaaggccatgagctaccagtgcagcctgtgcaagttcctgagcagcagcttcagcgtgctgaaggaccacatcaagcagcacggccagcagaacgaggtgatcctgatgtgcagcgagtgccacatcaccagcagaagccaggaggagctggaggcccacgtggtgaacgaccacgacaacgacgccaacatccacacccagagcaaggcccagcagtgcgtgagccccagcagcagcctgtgcagaaagaccaccgagagaaacgagaccatccccgacatccccgtgagcgtggacaacctgcagacccacaccgtgcagaccgccagcgtggccgagatgggcagaagaaagtggtacgcctacgagcagtacggcatgtacagatgcctgttctgcagctacacctgcggccagcagagaatgctgaagacccacgcctggaagcacgccggcgaggtggactgcagctaccccatcttcgagaacgagaacgagcccctgggcctgctggacagcagcgccgccgccgcccccggcggcgtggacgccgtggtgatcgccatcggcgagagcgagctgagcatccacaacggccccagcgtgcaggtgcagatctgcagcagcgagcagctgagcagcagcagccccctggagcagagcgccgagagaggcgtgcacctgagccagagcgtgaccctggaccccaacgaggaggagatgctggaggtgatcagcgacgccgaggagaacctgatccccgacagcctgctgaccagcgcccagaagatcatcagcagcagccccaacaagaagggccacgtgaacgtgatcgtggagagactgcccagcgccgaggagaccctgagccagaagagattcctgatgaacaccgagatggaggagggcaaggacctgagcctgaccgaggcccagatcggcagagagggcatggacgacgtgtacagagccgacaagtgcaccgtggacatcggcggcctgatcatcggctggagcagcagcgagaagaaggacgagctgatgaacaagggcctggccaccgacgagaacgccccccccggcagaagaagaaccaacagcgagagcctgagactgcacagcctggccgccgaggccctggtgaccatgcccatcagagccgccgagctgaccagagccaacctgggccactacggcgacatcaacctgctggaccccgacaccagccagagacaggtggacagcaccctggccgcctacagcaagatgatgagccccctgaagaacagcagcgacggcctgaccagcctgaaccagagcaacagcaccctggtggccctgcccgagggcagacaggagctgagcgacggccaggtgaagaccggcatcagcatgagcctgctgaccgtgatcgagaagctgagagagagaaccgaccagaacgccagcgacgacgacatcctgaaggagctgcaggacaacgcccagtgccagcccaacagcgacaccagcctgagcggcaacaacgtggtggagtacatccccaacgccgagagaccctacagatgcagactgtgccactacaccagcggcaacaagggctacatcaagcagcacctgagagtgcacagacagagacagccctaccagtgccccatctgcgagcacatcgccgacaacagcaaggacctggagagccacatgatccaccactgcaagaccagaatctaccagtgcaagcagtgcgaggagagcttccactacaagagccagctgagaaaccacgagagagagcagcacagcctgcccgacaccctgagcatcgccaccagcaacgagcccagaatcagcagcgacaccgccgacggcaagtgcgtgcaggagggcaacaagagcagcgtgcagaagcagtacagatgcgacgtgtgcgactacaccagcaccacctacgtgggcgtgagaaaccacagaagaatccacaacagcgacaagccctacagaaaggagttcagatgcagcctgtgcggctacgtgtgcagccacccccccagcctgaagagccacatgtggaagcacgccagcgaccagaactacaactacgagcaggtgaacaaggccatcaacgacgccatcagccagagcggcagagtgctgggcaagagccccggcaagacccagctgaagagcagcgaggagagcgccgaccccgtgaccggcagcagcgagaacgccgtgagcagcagcgagctgatgagccagacccccagcgaggtgctgggcaccaacgagaacgagaagctgagccccaccagcaacaccagctacagcctggagaagatcagcagcctggccccccccagcatggagtactgcgtgctgctgttctgctgctgcatctgcggcttcgagagcaccagcaaggagaacctgctggaccacatgaaggagcacgagggcgagatcgtgaacatcatcctgaacaaggaccacaacaccgccctgaacaccaactag

SEQ ID NO: 10603 - DNA, 1689 bp, Artificial Sequence
  Description of Artificial Sequence: Synthetic coding sequence
atgagcagaagcctgctgctgtggttcctgctgttcctgctgctgctgccccccctgcccgtgctgctggccgaccccggcgcccccacccccgtgaacccctgctgctactacccctgccagcaccagggcatctgcgtgagattcggcctggacagataccagtgcgactgcaccagaaccggctacagcggccccaactgcaccatccccggcctgtggacctggctgagaaacagcctgagacccagccccagcttcacccacttcctgctgacccacggcagatggttctgggagttcgtgaacgccaccttcatcagagagatgctgatgagactggtgctgaccgtgagaagcaacctgatccccagcccccccacctacaacagcgcccacgactacatcagctgggagagcttcagcaacgtgagctactacaccagaatcctgcccagcgtgcccaaggactgccccacccccatgggcaccaagggcaagaagcagctgcccgacgcccagctgctggccagaagattcctgctgagaagaaagttcatccccgacccccagggcaccaacctgatgttcgccttcttcgcccagcacttcacccaccagttcttcaagaccagcggcaagatgggccccggcttcaccaaggccctgggccacggcgtggacctgggccacatctacggcgacaacctggagagacagtaccagctgagactgttcaaggacggcaagctgaagtaccaggtgctggacggcgagatgtacccccccagcgtggaggaggcccccgtgctgatgcactaccccagaggcatccccccccagagccagatggccgtgggccaggaggtgttcggcctgctgcccggcctgatgctgtacgccaccctgtggctgagagagcacaacagagtgtgcgacctgctgaaggccgagcaccccacctggggcgacgagcagctgttccagaccaccagactgatcctgatcggcgagaccatcaagatcgtgatcgaggagtacgtgcagcagctgagcggctacttcctgcagctgaagttcgaccccgagctgctgttcggcgtgcagttccagtacagaaacagaatcgccatggagttcaaccacctgtaccactggcaccccctgatgcccgacagcttcaagatcggcggcggcagaaacatggaccaccacatcctgcacgtggccgtggacgtgatcagagagagcagagagatgagactgcagcccttcaacgagtacagaaagagattcggcatgaagccctacaccagcttccaggagctggtgggcgagaaggagatggccgccgagctggaggagctgtacggcgacatcgacgccctggagttctaccccggcctgctgctggagaagtgccaccccaacagcatcttcggcgagagcatgatcgagatcggcgcccccttcagcctgaagggcctgctgggcaaccccatctgcagccccgagtactggaagcccagcaccttcggcggcgaggtgggcttcaacatcgtgaagaccgccaccctgaagaagctggtgtgcctgaacaccaagacctgcccctacgtgagcttcagagtgcccgacgccagccaggacgacggccccgccgtggagagacccagcaccgagctgtag

SEQ ID NO: 10604 - DNA, 405 bp, Artificial Sequence
  Description of Artificial Sequence: Synthetic coding sequence
atgagcccccaccccgaggccatcaccgactgcgtgaccctgaacaccgtgggccagctggccgagggcggctaccccctgagattcagcaccctgttccaggagcagcagaagatgaacatcagccaggccagcgtgagcttcaaggacgtgaccatcgagttcacccaggaggagtggcagcagatggcccccgtgcagaagaacctgtacagagacgtgatgctggagaactacagcaacctggtgagcgtgggctactgctgcttcaagcccgaggtgatcttcaagctggagcagggcgaggagccctggttcagcgaggaggagttcagcaaccagagccaccccagcgagctgctgagcagcagcagacacaacagcgccggcgtggtgagactgtag

SEQ ID NO: 10605 - DNA, 2052 bp, Artificial Sequence
  Description of Artificial Sequence: Synthetic coding sequence
atgagcccccaccccgaggccatcaccgactgcgtgaccctgaacaccgtgggccagctggccgagggcggctaccccctgagattcagcaccctgttccaggagcagcagaagatgaacatcagccaggccagcgtgagcttcaaggacgtgaccatcgagttcacccaggaggagtggcagcagatggcccccgtgcagaagaacctgtacagagacgtgatgctggagaactacagcaacctggtgagcgtgggctactgctgcttcaagcccgaggtgatcttcaagctggagcagggcgaggagccctggttcagcgaggaggagttcagcaaccagagccaccccaaggactacagaggcgacgacctgatcaagcagaacaagaagatcaaggacaagcacctggagcaggccatctgcatcaacaacaagaccctgaccaccgaggaggagaaggtgctgggcaagcccttcaccctgcacgtggccgccgtggccagcaccaagatgagctgcaagtgcaacagctgggaggtgaacctgcagagcatcagcgagttcatcatcaacaacagaaactacagcaccaagaagatcggctgcggcaacgtgtgcgagaacagccccttcaagatcaacttcgagaagacccagaccggcgagaagttctacgagcacaacaagaacatgaaggccctgaactacaacgagaacctgcccaagcaccccaagttccagaccctggagcaggccttcgagtgcaacaagatcggcaaggccttcaacgacaaggccaactgcgtgaagcacaacagcagccacaccggcgagaccagcagcaaggacgacgagttcagaaagaactgcgacaagaagaccctgttcgaccacagaagaaccggcaccggcaagaagcacctgcacctgaaccagtgcggcaagagcttcgagaagagcaccgtggaggagtacaacaagctgaacatgggcatcaagcactacgagctgaaccccagcggcaacaacttcaacagaaaggcccacctgaccgacccccagaccgccgtgatcgaggagaaccccctggtgagcaacgacagaacccagacctgggtgaagagcagcgagtaccacgagaacaagaagagctaccagaccagcgtgcacagagtgagaagaagaagccacagcatgatgaagccctacaagtgcaacgagtgcggcaagagcttctgccagaagggccacctgatccagcaccagagaacccacaccggcgagaagcccttcgagtgcagcgagtgcggcaagaccttcagccagaagagccacctgagcacccaccagagaatccacaccgccgagaagccctacaagtgcaacgagtgcggcaagaccttcgtgcagaagagcaccctgagaggccaccagagaatccacaccggcgagaagccctacgagtgcagcgagtgcggcaagaccttcgtgcagaagagcaccctgagagaccaccacagaatccacaccggcgagaagagcttccagtgcaaccagtgcggcaagaccttcggccagaagagcaacctgagaatccaccagagaacccacaccggcgagaagacctaccagtgcaacgagtgcgagaagagcttctggagaaaggaccacctgatccagcaccagaagacccacaccggcgagaagcccttcaagtgcaacgagtgcggcaagaccttcgccagaaccagcaccctgagagtgcaccagagaatccacaccggcgagaagcccttcaagtgcaacgagtgcggcaagaagttcgtgagaaaggccatcctgagcgaccaccagagaatccacaccggcgagaagcccttccagtgcaacaagtgcggcaagaccttcggccagaagagcaacctgagaatccaccagagaacccacagcggcgagaagagctacgagtgcaacgagtacggcaagctgtgcaagaagagcaccctgagcctgtaccagaagatccagggcgagggcaacccctactag

SEQ ID NO: 10606 - DNA, 789 bp, Artificial Sequence
  Description of Artificial Sequence: Synthetic coding sequence
atgcagctgccccccgccctgtgcgccagactggccgccggccccggcgccgccgagcccctgcccgtggagagagaccccgccgccggcgccgcccccttcagattcgtggccagacccgtgagattccccagagagcaccagttcttcgaggacggcgacgtgcagagacacctgtacctgcaggacgtgatcatgcaggtggccgacgtgcccgagaagcccagagtgcccgccttcgcctgccaggtggccggctgctgccaggtgttcgacgccctggacgactacgagcaccactaccacaccctgcacggcaacgtgtgcagcttctgcaagagagccttccccagcggccacctgctggacgcccacatcctggagtggcacgacagcctgttccagatcctgagcgagagacaggacatgtaccagtgcctggtggagggctgcaccgagaagttcaagaccagcagagacagaaaggaccacatggtgagaatgcacctgtaccccgccgacttcagattcgacaagcccaagaagagcagaagccccgccagcgccgaggcccccggcgacagcggcgagagaagcgagggcgaggccatggagatctgcagcgagcccgtggccgccagccccgcccccgccggcgagagaagaatctacagacacagaagcgtgagcgagctgttcctgaagcccgtgctgaacatgtgcagcgtgctgagaatcctgggctgcacctgggccgccgccctgctgatcctgaacagcgagagatag

SEQ ID NO: 10607 - DNA, 759 bp, Artificial Sequence
  Description of Artificial Sequence: Synthetic coding sequence
atgcagctgccccccgccctgtgcgccagactggccgccggccccggcgccgccgagcccctgcccgtggagagagaccccgccgccggcgccgcccccttcagattcgtggccagacccgtgagattccccagagagcaccagttcttcgaggacggcgacgtgcagagacacctgtacctgcaggacgtgatcatgcaggtggccgacgtgcccgagaagcccagagtgcccgccttcgcctgccaggtggccggctgctgccaggtgttcgacgccctggacgactacgagcaccactaccacaccctgcacggcaacgtgtgcagcttctgcaagagagccttccccagcggccacctgctggacgcccacatcctggagtggcacgacagcctgttccagatcctgagcgagagacaggacatgtaccagtgcctggtggagggctgcaccgagaagttcaagaccagcagagacagaaaggaccacatggtgagaatgcacctgtaccccgccgacttcagattcgacaagcccaagaagagcagaagccccgccagcgccgaggcccccggcgacagcggcgagagaagcgagggcgaggccatggagatctgcagcgagcccgtggccgccagccccgcccccgccggcgagagaagaatctacagacacagaatccccagcaccatctgcttcggccagggcgccgccagaggcttcaagagcaacaagaagaagaccaagcagtgctag

SEQ ID NO: 10608 - DNA, 933 bp, Artificial Sequence
  Description of Artificial Sequence: Synthetic coding sequence
atgcaggtggccgacgtgcccgagaagcccagagtgcccgccttcgcctgccaggtggccggctgctgccaggtgttcgacgccctggacgactacgagcaccactaccacaccctgcacggcaacgtgtgcagcttctgcaagagagccttccccagcggccacctgctggacgcccacatcctggagtggcacgacagcctgttccagatcctgagcgagagacaggacatgtaccagtgcctggtggagggctgcaccgagaagttcaagaccagcagagacagaaaggaccacatggtgagaatgcacctgtaccccgccgacttcagattcgacaagcccaagaagagcagaagccccgccagcgccgaggcccccggcgacagcggcgagagaagcgagggcgaggccatggagatctgcagcgagcccgtggccgccagccccgcccccgccggcgagagaagaatctacagacacagactgctgctggtgaccagcctggtggtggtgctgctgtgggaggccggcgccgtgcccgcccccaaggtgcccatcaagatgcaggtgaagcactggcccagcgagcaggaccccgagaaggcctggggcgccagagtggtggagccccccgagaaggacgaccagctggtggtgctgttccccgtgcagaagcccaagctgctgaccaccgaggagaagcccagaggccagggcagaggccccatcctgcccggcaccaaggcctggatggagaccgaggacaccctgggccacgtgctgagccccgagcccgaccacgacagcctgtaccaccccccccccgaggaggaccagggcgaggagagacccagactgtgggtgatgcccaaccaccaggtgctgctgggccccgaggaggaccaggaccacatctaccacccccagtag

SEQ ID NO: 10609 - DNA, 1704 bp, Artificial Sequence
  Description of Artificial Sequence: Synthetic coding sequence
atgagcagcagactgggcgccgtgcccgccaccagcggccccaccaccttcaagcagcagagaagcaccagaatcgtgggcgccaagaacagcagaacccagtgcagcatcaaggacaacagcttccagtacaccatcccccacgacgacagcctgagcggcagcagcagcgccagcagctgcgagcccgtgagcgacttccccgccagcttcagaaagagcacctactggatgaagatgagaagaatcaagcccgccgccaccagccacgtggagggcagcggcggcgtgagcgccaagggcaagagaaagcccagacaggaggaggacgaggactacagagagttcccccagaagaagcacaagctgtacggcagaaagcagagacccaagacccagcccaaccccaagagccaggccagaagaatcagaaaggagccccccgtgtacgccgccggcagcctggaggagcagtggtacctggagatcgtggacaagggcagcgtgagctgccccacctgccaggccgtgggcagaaagaccatcgagggcctgaagaagcacatggagaactgcaagcaggagatgttcacctgccaccactgcggcaagcagctgagaagcctggccggcatgaagtaccacgtgatggccaaccacaacagcctgcccatcctgaaggccggcgacgagatcgacgagcccagcgagagagagagactgagaaccgtgctgaagagactgggcaagctgagatgcatgagagagagctgcagcagcagcttcaccagcatcatgggctacctgtaccacgtgagaaagtgcggcaagggcgccgccgagctggagaagatgaccctgaagtgccaccactgcggcaagccctacagaagcaaggccggcctggcctaccacctgagaagcgagcacggccccatcagcttcttccccgagagcggccagcccgagtgcctgaaggagatgaacctggagagcaagagcggcggcagagtgcagagaagaagcgccaagatcgccgtgtaccacctgcaggagctggccagcgccgagctggccaaggagtggcccaagagaaaggtgctgcaggacctggtgcccgacgacagaaagctgaagtacaccagacccggcctgcccaccttcagccaggaggtgctgcacaagtggaagaccgacatcaagaagtaccacagaatccagtgccccaaccagggctgcgaggccgtgtacagcagcgtgagcggcctgaaggcccacctgggcagctgcaccctgggcaacttcgtggccggcaagtacaagtgcctgctgtgccagaaggagttcgtgagcgagagcggcgtgaagtaccacatcaacagcgtgcacgccgaggactggttcgtggtgaaccccaccaccaccaagagcttcgagaagctgatgaagatcaagcagagacagcaggaggaggagaagagaagacagcagcacagaagcagaagaagcctgagaagaagacagcagcccggcatcgagctgcccgagaccgagctgagcctgagagtgggcaaggaccagagaagaaacaacgaggagctggtggtgagcgccagctgcaaggagcccgagcaggagcccgtgcccgcccagttccagaaggtgaagccccccaagaccaaccacaagagaggcagaaagtag

SEQ ID NO: 10610 - DNA, 1701 bp, Artificial Sequence
  Description of Artificial Sequence: Synthetic coding sequence
atgagcagcagactgggcgccgtgcccgccaccagcggccccaccaccttcaagcagcagagaagcaccagaatcgtgggcgccaagaacagaacccagtgcagcatcaaggacaacagcttccagtacaccatcccccacgacgacagcctgagcggcagcagcagcgccagcagctgcgagcccgtgagcgacttccccgccagcttcagaaagagcacctactggatgaagatgagaagaatcaagcccgccgccaccagccacgtggagggcagcggcggcgtgagcgccaagggcaagagaaagcccagacaggaggaggacgaggactacagagagttcccccagaagaagcacaagctgtacggcagaaagcagagacccaagacccagcccaaccccaagagccaggccagaagaatcagaaaggagccccccgtgtacgccgccggcagcctggaggagcagtggtacctggagatcgtggacaagggcagcgtgagctgccccacctgccaggccgtgggcagaaagaccatcgagggcctgaagaagcacatggagaactgcaagcaggagatgttcacctgccaccactgcggcaagcagctgagaagcctggccggcatgaagtaccacgtgatggccaaccacaacagcctgcccatcctgaaggccggcgacgagatcgacgagcccagcgagagagagagactgagaaccgtgctgaagagactgggcaagctgagatgcatgagagagagctgcagcagcagcttcaccagcatcatgggctacctgtaccacgtgagaaagtgcggcaagggcgccgccgagctggagaagatgaccctgaagtgccaccactgcggcaagccctacagaagcaaggccggcctggcctaccacctgagaagcgagcacggccccatcagcttcttccccgagagcggccagcccgagtgcctgaaggagatgaacctggagagcaagagcggcggcagagtgcagagaagaagcgccaagatcgccgtgtaccacctgcaggagctggccagcgccgagctggccaaggagtggcccaagagaaaggtgctgcaggacctggtgcccgacgacagaaagctgaagtacaccagacccggcctgcccaccttcagccaggaggtgctgcacaagtggaagaccgacatcaagaagtaccacagaatccagtgccccaaccagggctgcgaggccgtgtacagcagcgtgagcggcctgaaggcccacctgggcagctgcaccctgggcaacttcgtggccggcaagtacaagtgcctgctgtgccagaaggagttcgtgagcgagagcggcgtgaagtaccacatcaacagcgtgcacgccgaggactggttcgtggtgaaccccaccaccaccaagagcttcgagaagctgatgaagatcaagcagagacagcaggaggaggagaagagaagacagcagcacagaagcagaagaagcctgagaagaagacagcagcccggcatcgagctgcccgagaccgagctgagcctgagagtgggcaaggaccagagaagaaacaacgaggagctggtggtgagcgccagctgcaaggagcccgagcaggagcccgtgcccgcccagttccagaaggtgaagccccccaagaccaaccacaagagaggcagaaagtag

SEQ ID NO: 10611 - DNA, 1473 bp, Artificial Sequence
  Description of Artificial Sequence: Synthetic coding sequence
atgaagatgagaagaatcaagcccgccgccaccagccacgtggagggcagcggcggcgtgagcgccaagggcaagagaaagcccagacaggaggaggacgaggactacagagagttcccccagaagaagcacaagctgtacggcagaaagcagagacccaagacccagcccaaccccaagagccaggccagaagaatcagaaaggagccccccgtgtacgccgccggcagcctggaggagcagtggtacctggagatcgtggacaagggcagcgtgagctgccccacctgccaggccgtgggcagaaagaccatcgagggcctgaagaagcacatggagaactgcaagcaggagatgttcacctgccaccactgcggcaagcagctgagaagcctggccggcatgaagtaccacgtgatggccaaccacaacagcctgcccatcctgaaggccggcgacgagatcgacgagcccagcgagagagagagactgagaaccgtgctgaagagactgggcaagctgagatgcatgagagagagctgcagcagcagcttcaccagcatcatgggctacctgtaccacgtgagaaagtgcggcaagggcgccgccgagctggagaagatgaccctgaagtgccaccactgcggcaagccctacagaagcaaggccggcctggcctaccacctgagaagcgagcacggccccatcagcttcttccccgagagcggccagcccgagtgcctgaaggagatgaacctggagagcaagagcggcggcagagtgcagagaagaagcgccaagatcgccgtgtaccacctgcaggagctggccagcgccgagctggccaaggagtggcccaagagaaaggtgctgcaggacctggtgcccgacgacagaaagctgaagtacaccagacccggcctgcccaccttcagccaggaggtgctgcacaagtggaagaccgacatcaagaagtaccacagaatccagtgccccaaccagggctgcgaggccgtgtacagcagcgtgagcggcctgaaggcccacctgggcagctgcaccctgggcaacttcgtggccggcaagtacaagtgcctgctgtgccagaaggagttcgtgagcgagagcggcgtgaagtaccacatcaacagcgtgcacgccgaggactggttcgtggtgaaccccaccaccaccaagagcttcgagaagctgatgaagatcaagcagagacagcaggaggaggagaagagaagacagcagcacagaagcagaagaagcctgagaagaagacagcagcccggcatcgagctgcccgagaccgagctgagcctgagagtgggcaaggaccagagaagaaacaacgaggagctggtggtgagcgccagctgcaaggagcccgagcaggagcccgtgcccgcccagttccagaaggtgaagccccccaagaccaaccacaagagaggcagaaagtag

SEQ ID NO: 10612 - DNA, 1617 bp, Artificial Sequence
  Description of Artificial Sequence: Synthetic coding sequence
atgagcagcagactgggcgccgtgcccgccaccagcggccccaccaccttcaagcagcagagaagcaccagaatcgtgggcgccaagaacagaacccagtgcagcatcaaggacaacagcttccagtacaccatcccccacgacgacagcctgagcggcagcagcagcgccagcagctgcgagcccgtgagcgacttccccgccagcttcagaaagagcacctactggatgaagatgagaagaatcaagcccgccgccaccagccacgtggagggcagcggcggcgtgagcgccaagggcaagagaaagcccagacaggaggaggacgaggactacagagagttcccccagaagaagcacaagctgtacggcagcctggaggagcagtggtacctggagatcgtggacaagggcagcgtgagctgccccacctgccaggccgtgggcagaaagaccatcgagggcctgaagaagcacatggagaactgcaagcaggagatgttcacctgccaccactgcggcaagcagctgagaagcctggccggcatgaagtaccacgtgatggccaaccacaacagcctgcccatcctgaaggccggcgacgagatcgacgagcccagcgagagagagagactgagaaccgtgctgaagagactgggcaagctgagatgcatgagagagagctgcagcagcagcttcaccagcatcatgggctacctgtaccacgtgagaaagtgcggcaagggcgccgccgagctggagaagatgaccctgaagtgccaccactgcggcaagccctacagaagcaaggccggcctggcctaccacctgagaagcgagcacggccccatcagcttcttccccgagagcggccagcccgagtgcctgaaggagatgaacctggagagcaagagcggcggcagagtgcagagaagaagcgccaagatcgccgtgtaccacctgcaggagctggccagcgccgagctggccaaggagtggcccaagagaaaggtgctgcaggacctggtgcccgacgacagaaagctgaagtacaccagacccggcctgcccaccttcagccaggaggtgctgcacaagtggaagaccgacatcaagaagtaccacagaatccagtgccccaaccagggctgcgaggccgtgtacagcagcgtgagcggcctgaaggcccacctgggcagctgcaccctgggcaacttcgtggccggcaagtacaagtgcctgctgtgccagaaggagttcgtgagcgagagcggcgtgaagtaccacatcaacagcgtgcacgccgaggactggttcgtggtgaaccccaccaccaccaagagcttcgagaagctgatgaagatcaagcagagacagcaggaggaggagaagagaagacagcagcacagaagcagaagaagcctgagaagaagacagcagcccggcatcgagctgcccgagaccgagctgagcctgagagtgggcaaggaccagagaagaaacaacgaggagctggtggtgagcgccagctgcaaggagcccgagcaggagcccgtgcccgcccagttccagaaggtgaagccccccaagaccaaccacaagagaggcagaaagtag

SEQ ID NO: 10613 - DNA, 1158 bp, Artificial Sequence
  Description of Artificial Sequence: Synthetic coding sequence
atgagcaagggccaggtggagtaccagcccagaggcaagggcaaccccggcagaaagaagatgaagaccatcgagaacttcctgagaagaagcatcagcttcatgggcggcagcaacggcctgaagctgagccccatccccaaccccagacccgtggtgttcggcagaaaccaccagttcatgcagcaggagatgttcacctgccaccactgcggcaagcagctgagaagcctggccggcatgaagtaccacgtgatggccaaccacaacagcctgcccatcctgaaggccggcgacgagatcgacgagcccagcgagagagagagactgagaaccgtgctgaagagactgggcaagctgagatgcatgagagagagctgcagcagcagcttcaccagcatcatgggctacctgtaccacgtgagaaagtgcggcaagggcgccgccgagctggagaagatgaccctgaagtgccaccactgcggcaagccctacagaagcaaggccggcctggcctaccacctgagaagcgagcacggccccatcagcttcttccccgagagcggccagcccgagtgcctgaaggagatgaacctggagagcaagagcggcggcagagtgcagagaagaagcgccaagatcgccgtgtaccacctgcaggagctggccagcgccgagctggccaaggagtggcccaagagaaaggtgctgcaggacctggtgcccgacgacagaaagctgaagtacaccagacccggcctgcccaccttcagccaggaggtgctgcacaagtggaagaccgacatcaagaagtaccacagaatccagtgccccaaccagggctgcgaggccgtgtacagcagcgtgagcggcctgaaggcccacctgggcagctgcaccctgggcaacttcgtggccggcaagtacaagtgcctgctgtgccagaaggagttcgtgagcgagagcggcgtgaagtaccacatcaacagcgtgcacgccgaggactggttcgtggtgaaccccaccaccaccaagagcttcgagaagctgatgaagatcaagcagagacagcaggaggaggagaagagaagacagcagcacagaagcagaagaggcagccaggacacctgcatgcccaaggccctgcacagaatgtag

SEQ ID NO: 10614 - DNA, 690 bp, Artificial Sequence
  Description of Artificial Sequence: Synthetic coding sequence
atggacagcgccggccaggacatcaacctgaacagccccaacaagggcctgctgagcgacagcatgaccgacgtgcccgtggacaccggcgtggccgccagaacccccgccgtggagggcctgaccgaggccgaggaggaggagctgagagccgagctgaccaaggtggaggaggagatcgtgaccctgagacaggtgctggccgccaaggagagacactgcggcgagctgaagagaagactgggcctgagcaccctgggcgagctgaagcagaacctgagcagaagctggcacgacgtgcaggtgagcagcgcctacgtgaagaccagcgagaagctgggcgagtggaacgagaaggtgacccagagcgacctgtacaagaagacccaggagaccctgagccaggccggccagaagaccagcgccgccctgagcaccgtgggcagcgccatcagcagaaagctgggcgacatgagagcccaccccttcagccacagcttcagcagctacagcatcagacacagcatcagcatgcccgccatgagaaacagcgccaccttcaagagcttcgaggacagagtgggcaccatcaagagcaaggtggtgggcgacagagagaacggcagcgacaacctgcccagcagcgccggcagcggcgacaagcccctgagcgaccccgcccccttctag

SEQ ID NO: 10615 - DNA, 2679 bp, Artificial Sequence
  Description of Artificial Sequence: Synthetic coding sequence
atgaccgaccccttctgcgtgggcggcagaagactgcccggcagcagcaagagcggccccggcaaggacggcagcagaaaggaggtgagactgcccatgctgcacgacccccccaagatgggcatgcccgtggtgagaggcggccagaccgtgcccggccaggcccccctgtgcttcgaccccggcagccccgccagcgacaagaccgagggcaagaagaagggcagacccaaggccgagaaccaggccctgagagacatccccctgagcctgatgaacgactggaaggacgagttcaaggcccacagcagagtgaagtgccccaacagcggctgctggctggagttccccagcatctacggcctgaagtaccactaccagagatgccagggcggcgccatcagcgacagactggccttcccctgccccttctgcgaggccgccttcaccagcaagacccagctggagaagcacagaatctggaaccacatggacagacccctgcccgccagcaagcccggccccatcagcagacccgtgaccatcagcagacccgtgggcgtgagcaagcccatcggcgtgagcaagcccgtgaccatcggcaagcccgtgggcgtgagcaagcccatcggcatcagcaagcccgtgagcgtgggcagacccatgcccgtgaccaaggccatccccgtgaccagacccgtgcccgtgaccaagcccgtgaccgtgagcagacccatgcccgtgaccaaggccatgcccgtgaccaagcccatcaccgtgaccaagagcgtgcccgtgaccaagcccgtgcccgtgaccaagcccatcaccgtgaccaagctggtgaccgtgaccaagcccgtgcccgtgaccaagcccgtgaccgtgagcagacccatcgtggtgagcaagcccgtgaccgtgagcagacccatcgccatcagcagacacacccccccctgcaagatggtgctgctgaccagaagcgagaacaaggcccccagagccaccggcagaaacagcggcaagaagagagccgccgacagcctggacacctgccccatcccccccaagcaggccagacccgagaacggcgagtacggccccagcagcatgggccagagcagcgccttccagctgagcgccgacaccagcagcggcagcctgagccccggcagcagacccagcggcggcatggaggccctgaaggccgccggccccgccagcccccccgaggaggaccccgagagaaccaagcacagaagaaagcagaagacccccaagaagttcaccggcgagcagcccagcatcagcggcaccttcggcctgaagggcctggtgaaggccgaggacaaggccagagtgcacagaagcaagaagcaggagggccccggccccgaggacgccagaaagaaggtgcccgccgcccccatcaccgtgagcaaggaggcccccgcccccgtggcccaccccgcccccggcggccccgaggagcagtggcagagagccatccacgagagaggcgaggccgtgtgccccacctgcaacgtggtgaccagaaagaccctggtgggcctgaagaagcacatggaggtgtgccagaagctgcaggacgccctgaagtgccagcactgcagaaagcagttcaagagcaaggccggcctgaactaccacaccatggccgagcacagcgccaagcccagcgacgccgaggccagcgagggcggcgagcaggaggagagagagagactgagaaaggtgctgaagcagatgggcagactgagatgcccccaggagggctgcggcgccgccttcagcagcctgatgggctaccagtaccaccagagaagatgcggcaagcccccctgcgaggtggacagccccagcttcccctgcacccactgcggcaagacctacagaagcaaggccggccacgactaccacgtgagaagcgagcacaccgcccccccccccgaggagcccaccgacaagagccccgaggccgaggaccccctgggcgtggagagaacccccagcggcagagtgagaagaaccagcgcccaggtggccgtgttccacctgcaggagatcgccgaggacgagctggccagagactggaccaagagaagaatgaaggacgacctggtgcccgagaccgccagactgaactacaccagacccggcctgcccaccctgaacccccagctgctggaggcctggaagaacgaggtgaaggagaagggccacgtgaactgccccaacgactgctgcgaggccatctacagcagcgtgagcggcctgaaggcccacctggccagctgcagcaagggcgcccacctggccggcaagtacagatgcctgctgtgccccaaggagttcagcagcgagagcggcgtgaagtaccacatcctgaagacccacgccgagaactggttcagaaccagcgccgaccccccccccaagcacagaagccaggacagcctggtgcccaagaaggagaagaagaagaacctggccggcggcaagaagagaggcagaaagcccaaggagagaacccccgaggagcccgtggccaagctgccccccagaagagacgactggccccccggctgcagagacaagggcgccagaggcagcaccggcagaaaggtgggcgtgagcaaggcccccgagaagtag

SEQ ID NO: 10616 - DNA, 2679 bp, Artificial Sequence; identical to SEQ ID NO: 10615
  Description of Artificial Sequence: Synthetic coding sequence

SEQ ID NO: 10617 - DNA, 1203 bp, Artificial Sequence
  Description of Artificial Sequence: Synthetic coding sequence
atgaccttcgaggacgtggccgtggagttcagccagtgggagtggggccagctgaaccccgcccagaaggacctgtacagagaggtgatgctggagaacttcagaaacctggccatcctgggcctgctggtgagcaagccctacgtgatctgccagctggaggagggcggcgagcccttcatggtggagagagagatcagcaccggcgcccacagcgactggaagagaagaagcaagagcaaggagagcatgcccagctggggcatcagcaaggaggagctgttccaggtggtgagcgtggagaagcacatccaggacgtgctgcagttcagcaagctgaaggccgcctgcggctgcgacggccagctggagatgcagcagatcaagcaggagagacacctgaagcagatgagcaccatccacaagagcgccaccaccctgagcagagactacaagtggaacggcttcggcagaagcctgggcctgagaagcgtgctggtgaaccagcacagcatcctgatgggcgagggcagctacaagtgcgacaccgagttcagacagaccctgggcggcaacaacagccagagaacccaccccgagaagaagagctgcaagtgcaacgagtgcggcaagagcttccacttccagagcgagctgagaagacaccagagatgccacaccggcgagaagccctacgagtgcagcgactgcggcagagccttcggccacatcagcagcctgatcaagcaccagagaacccacaccggcgagaagccctacgagtgcagcgagtgcggcagagccttcagccagagcagcagcctggtgctgcactacagattccacaccggcgagaagccctacaagtgcaacgagtgcggcagagccttcggccacaccagcagcctgatcaagcaccagagaacccacaccggcgagaagccctacgagtgcagagagtgcggcagaaccttcagccagagcagcagcctgatcgtgcactacagattccacaccggcgagaagccctacaagtgcaacaagtgcggcagagccttcagccagagcagcagcctgacccagcactacagattccacaccggcgagaagccctacaagtgcaacgagtgcggcagagccttcgcccacaccgccagcctgatcaagcaccagagaagccacgccggcaagaagaccctgtag

SEQ ID NO: 10618 - DNA, 1203 bp, Artificial Sequence; identical to SEQ ID NO: 10617
  Description of Artificial Sequence: Synthetic coding sequence

SEQ ID NO: 10619 - DNA, 162 bp, Artificial Sequence
  Description of Artificial Sequence: Synthetic coding sequence
cagagcgagctgagaagacaccagagatgccacaccggcgagaagccctacgagtgcagcgactgcggcagagccttcggccacatcagcagcctgatcaagcaccagctgatcctggagaagagccccatgaacgccgtgaacgtgggcgagcccagctag

SEQ ID NO: 10620 - DNA, 3492 bp, Artificial Sequence
  Description of Artificial Sequence: Synthetic coding sequence
atggacagaaacagagaggccgagatggagctgagaagaggccccagccccaccagagccggcagaggccacgaggtggacggcgacaaggccacctgccacacctgctgcatctgcggcaagagcttccccttccagagcagcctgagccagcacatgagaaagcacaccggcgagaagccctacaagtgcccctactgcgaccacagagccagccagaagggcaacctgaagatccacatcagaagccacagaaccggcaccctgatccagggccacgagcccgaggccggcgaggcccccctgggcgagatgagagccagcgagggcctggacgcctgcgccagccccaccaagagcgccagcgcctgcaacagactgctgaacggcgccagccaggccgacggcgccagagtgctgaacggcgccagccaggccgacagcggcagagtgctgctgagaagcagcaagaagggcgccgagggcagcgcctgcgcccccggcgaggccaaggccgccgtgcagtgcagcttctgcaagagccagttcgagagaaagaaggacctggagctgcacgtgcaccaggcccacaagcccttcaagtgcagactgtgcagctacgccaccctgagagaggagagcctgctgagccacatcgagagagaccacatcaccgcccagggccccggcagcggcgaggcctgcgtggagaacggcaagcccgagctgagccccggcgagttcccctgcgaggtgtgcggccaggccttcagccagacctggttcctgaaggcccacatgaagaagcacagaggcagcttcgaccacggctgccacatctgcggcagaagattcaaggagccctggttcctgaagaaccacatgaaggcccacggccccaagaccggcagcaagaacagacccaagagcgagctggaccccatcgccaccatcaacaacgtggtgcaggaggaggtgatcgtggccggcctgagcctgtacgaggtgtgcgccaagtgcggcaacctgttcaccaacctggacagcctgaacgcccacaacgccatccacagaagagtggaggccagcagaaccagagcccccgccgaggagggcgccgagggccccagcgacaccaagcagttcttcctgcagtgcctgaacctgagacccagcgccgccggcgacagctgccccggcacccaggccggcagaagagtggccgagctggaccccgtgaacagctaccaggcctggcagctggccaccagaggcaaggtggccgagcccgccgagtacctgaagtacggcgcctgggacgaggccctggccggcgacgtggccttcgacaaggacagaagagagtacgtgctggtgagccaggagaagagaaagagagagcaggacgcccccgccgcccagggcccccccagaaagagagccagcggccccggcgaccccgcccccgccggccacctggaccccagaagcgccgccagacccaacagaagagccgccgccaccaccggccagggcaagagcagcgagtgcttcgagtgcggcaagatcttcagaacctaccaccagatggtgctgcacagcagagtgcacagaagagccagaagagagagagacagcgacggcgacagagccgccagagccagatgcggcagcctgagcgagggcgacagcgccagccagcccagcagccccggcagcgcctgcgccgccgccgacagccccggcagcggcctggccgacgaggccgccgaggacagcggcgaggagggcgcccccgagcccgcccccggcggccagcccagaagatgctgcttcagcgaggaggtgaccagcaccgagctgagcagcggcgaccagagccacaagatgggcgacaacgccagcgagagagacaccggcgagagcaaggccggcatcgccgccagcgtgagcatcctggagaacagcagcagagagaccagcagaagacaggagcagcacagattcagcatggacctgaagatgcccgccttccaccccaagcaggaggtgcccgtgcccggcgacggcgtggagttccccagcagcaccggcgccgagggccagaccggccaccccgccgagaagctgagcgacctgcacaacaaggagcacagcggcggcggcaagagagccctggcccccgacctgatgcccctggacctgagcgccagaagcaccagagacgaccccagcaacaaggagaccgccagcagcctgcaggccgccctggtggtgcacccctgcccctactgcagccacaagacctactaccccgaggtgctgtggatgcacaagagaatctggcacagagtgagctgcaacagcgtggcccccccctggatccagcccaacggctacaagagcatcagaagcaacctggtgttcctgagcagaagcggcagaaccggccccccccccgccctgggcggcaaggagtgccagcccctgctgctggccagattcaccagaacccaggtgcccggcggcatgcccggcagcaagagcggcagcagccccctgggcgtggtgaccaaggccgccagcatgcccaagaacaaggagagccacagcggcggcccctgcgccctgtgggcccccggccccgacggctacagacagaccaagccctgccacggccaggagccccacggcgccgccacccagggccccctggccaagcccagacaggaggccagcagcaagcccgtgcccgcccccggcggcggcggcttcagcagaagcgccacccccacccccaccgtgatcgccagagccggcgcccagcccagcgccaacagcaagcccgtggagaagttcggcgtgccccccgccggcgccggcttcgcccccaccaacaagcacagcgcccccgacagcctgaaggccaagttcagcgcccagccccagggccccccccccgccaagggcgagggcggcgccccccccctgccccccagagagccccccagcaaggccgcccaggagctgagaaccctggccacctgcgccgccggcagcagaggcgacgccgccctgcaggcccagcccggcgtggccggcgccccccccgtgctgcacagcatcaagcaggagcccgtggccgagggccacgagaagagactggacatcctgaacatcttcaagacctacatccccaaggacttcgccaccctgtaccagggctggggcgtgagcggccccggcctggagcacagaggcaccctgagaacccaggccagacccggcgagttcgtgtgcatcgagtgcggcaagagcttccaccagcccggccacctgagagcccacatgagagcccacagcgtggtgttcgagagcgacggccccagaggcagcgaggtgcacaccaccagcgccgacgcccccaagcagggcagagaccacagcaacaccggcaccgtgcagaccgtgcccctgagaaagggcacctag

SEQ ID NO: 10621 - DNA, 228 bp, Artificial Sequence
  Description of Artificial Sequence: Synthetic coding sequence
atggacagaaacagagaggccgagatggagctgagaagaggccccagccccaccagagccggcagaggccacgaggtggacggcgacaaggccacctgccacacctgctgcatctgcggcaagagcttccccttccagagcagcctgagccagcacatgagaaagcacaccggcgagaagccctacaagtgcccctactgcgaccacagagccagccagaagggctag

SEQ ID NO: 10622 - DNA, 1479 bp, Artificial Sequence
  Description of Artificial Sequence: Synthetic coding sequence
atggccatggccctgcccatgcccggcccccaggaggccgtggtgttcgaggacgtggccgtgtacttcaccagaatcgagtggagctgcctggcccccgaccagcaggccctgtacagagacgtgatgctggagaactacggcaacctggccagcctgggcttcctggtggccaagcccgccctgatcagcctgctggagcagggcgaggagcccggcgccctgatcctgcaggtggccgagcagagcgtggccaaggccagcctgtgcaccgacagcagaatggaggccggcatcatggagagccccctgcagagaaagctgagcagacaggccggcctgcccggcaccgtgtggggctgcctgccctggggccaccccgtgggcggccaccccgcccccccccacccccacggcggccccgaggacggcagcgacaagcccacccaccccagagccagagagcacagcgccagccccagagtgctgcaggaggacctgggcagacccgtgggcagcagcgcccccagatacagatgcgtgtgcggcaaggccttcagatacaacagcctgctgctgagacaccagatcatccacaccggcgccaagcccttccagtgcaccgagtgcggcaaggccttcaagcagagcagcatcctgctgagacaccagctgatccacaccgaggagaagcccttccagtgcggcgagtgcggcaaggccttcagacagagcacccagctggccgcccaccacagagtgcacaccagagagagaccctacgcctgcggcgagtgcggcaaggccttcagcagaagcagcagactgctgcagcaccagaagttccacaccggcgagaagcccttcgcctgcaccgagtgcggcaaggccttctgcagaagattcaccctgaacgagcacggcagaatccacagcggcgagagaccctacagatgcctgagatgcggccagagattcatcagaggcagcagcctgctgaagcaccacagactgcacgcccaggagggcgcccaggacggcggcgtgggccagggcgccctgctgggcgccgcccagagaccccaggccggcgaccccccccacgagtgccccgtgtgcggcagacccttcagacacaacagcctgctgctgctgcacctgagactgcacaccggcgagaagcccttcgagtgcgccgagtgcggcaaggccttcggcagaaagagcaacctgaccctgcaccagaagatccacaccaaggagaagcccttcgcctgcaccgagtgcggcaaggccttcagaagaagctacaccctgaacgagcactacagactgcacagcggcgagagaccctacagatgcagagcctgcggcagagcctgcagcagactgagcaccctgatccagcaccagaaggtgcacggcagagagcccggcgaggacaccgagggcagaagagccccctgctgggccagctag

SEQ ID NO: 10623 - DNA, 1479 bp, Artificial Sequence; identical to SEQ ID NO: 10622
  Description of Artificial Sequence: Synthetic coding sequence

SEQ ID NO: 10624 - DNA, 1479 bp, Artificial Sequence; identical to SEQ ID NO: 10622
  Description of Artificial Sequence: Synthetic coding sequence

SEQ ID NO: 10625 - DNA, 3225 bp, Artificial Sequence
  Description of Artificial Sequence: Synthetic coding sequence
atgaaggacatcggccagcagctgtacaccacccacctgaacggcggccacaacagcctgaccatgagccccaagcagcccgacgccaacggcgcccccagacccaacagacaggaggcccagaccctgctgtaccagggcagcgaggccgaggccgccatgatgaccatcgccacctgcgccaagtgcaagagcgtgcacaagatcagcctgcaggacctgcagaagggcaccggcaaggacggcatgtacgtgtgcttccagtgcagcctgggcgccgccccccccaacttccacttcgtgagcaacaacagcagcgccacccacgtgggcaacaagaccgagaacttcagcagcagcgtgaacagcaagttcaaggtgagaaacttcaagcccggcaagtactactgcgacaagtgcagattcagcaccaaggaccccctgcagtacaagaagcacaccctgcagcacgaggagatcaagttcatctgcagccactgcagctacatcagctacaccaagggcgagttccagagacacctggtgaagcacaccggcatcttcccctaccagtgcgagtactgcgactacggcgccatcagaaacgactacatcgtgaagcacaccaagagagtgcacgagagagccggcgccaagagacccgtgaaggccgtggccaagctggagcccaagagaaccggcaccagcaagcagaaccccgagctgctgaaggccagcaaccccagaaccaccttccagaacaagtggagcgaccagctgagcggcttcagcctgcacgccaacaaggacaagatgcacaacatcatgctgctgcccgagcccaaggagtaccagaaggacgtggtgtgcatccccaacaagatgaccctgagcgagcccaacgaggtgaacctgttcgagaacaagaacgtggaggtggaggtgctgagccccgccaaggagcccgtgcagcccggcatgcccctgaccgtggtggcccccgccgagctggtggtgcccgccaactgcctggcccagctgatcgacgtgaaggtggtgaacggcacccagcagctggtgctgaagctgttccccctggaggagaacaactgcctggaggccggcagagacaacggcggcaacagcgagagaatggtgaaggagaagggcagcaacgagcaggagaaggtgctgagcgccgagaagaccaagagcctgaccgtggacggcaacgtgggcaagctggtgggcatcgacagcttccagcccagcgtgcagaagcagctgaagaacgtgaagtgggtgagaagctacgacttcatcatgcccaacagcagcgtgcacaacaacggcaagagcttcatcaacagcgagaccatcgaggacttccagaagaagaacaacctgtacccccacagaaccgccttccccagcgtggccctgaagggccacagcctggccagcgtgttcaagaacagcgtgctgagaagcctgggcgccgccagcaaccccttcccctacaaggccgccgtgtgcttcgccgagagcggcagaaacctgcacagcagcagccagcagctgctgcccttcgccgccagccccgccacctgcagcttcagcggcgagaagggcctgctgcccgtgagcgagaacgacctggagagcaccagcaaggtgaacatccccgtgaaggtggtgagcagcaacagaaagcaggaggacaaccagaccgaggagcacaaggccgtgagcaccgtgggccagatcagcagccagcacaagagcgagtacctgcacatcaacatcaccggcgaggacagaagccagcagcccggcgacaagcccctggagctgaagaacagcgagagaaccaacaacaccaacgacggccccgtgatcagcagcgtgttcagcctgagcagcggcagcgagaacgtgcccgagggcatcaagtggaacagcagcaccagcaagatcaagagcatcgagctgctgagaagaaagatcgcccagctgatcgagagctgcggcaagcccagcagcctggccagcaacagcgcccacagaagaagcgtgggccaggccagcaagggcaccagcaaggccaccagcgagggcatccaggagatcaacgtgagcctgaccggcctgggccacagcaccggcaccctgcagaagccccccaacgacggcggcatcaccggcaacagacagctgacccaccagcagatctacccccacttcgccgacggcagcaacagaaagaccaagagcagagtggccagaaaggcccacgtggccacccccgtgctgatccccaagggcgccgtgctgagagtgctgaacagcagcgagaacgcccacatcatcgaggccacctgcgaggcccccgtgagcatcccctgcagcgagagacagctgatcaagcccgtgcccttctgccccgtgagacaggccgacagcgacctgcagcccctgagaagcgagagaggccccatcgacatgagccccaacatcgagacccccctgagacccaagctgagaaaggagagcgccgtgtgcagcaccatccacagaaagaccggcctgctgtacggccagcagggcagcagcgagctgaacaagcagggcagactgctgagcagaagcctgagcatcagcagaaacaagaccaagcaggtgcacctgagcagaaagaagaacaagatccaggccgagcccagcagatgcctgaaggaccccagcatcttccaggtggccagacagctgagactgatcgccgccaagcccgaccagctgatcaagtgccccagaagaaaccagcccgtgatcgtgctgaaccaccccgacgtggacagccccgaggtgaccaacgtgatgaaggtgatcaacaagtacaagggcaacgtgctgaaggtggtgctgagcgagagaaccagatgccagctgggcatcagaagacaccacgtgagactgacctaccagaacgccgaggaggccagccagatcaagagacagatgatgctgaagatgaagctgaagaaggtgcacaagaacaactaccaggtggtggacagcctgcccgacgacagcagccagtgcgtgttcaagtgctggttctgcggcagactgtacgaggaccaggaggagtggatgagccacggccagagacacctgatcgaggccaccagagactgggacgtgctgagcagcaagggcaagtag

SEQ ID NO: 10626 - DNA, 228 bp, Artificial Sequence
  Description of Artificial Sequence: Synthetic coding sequence
atgaaggacatcggccagcagctgtacaccacccacctgaacggcggccacaacagcctgaccatgagccccaagcagcccgacgccaacggcgcccccagacccaacagacaggaggcccagaccctgctgtaccagggcagcgaggccgaggccgccatgatgaccatcgccacctgcgccaagtgcaagagcgtgcacaagatcagcctgcaggacctgcagtag

SEQ ID NO: 10627 - DNA, 1623 bp, Artificial Sequence
  Description of Artificial Sequence: Synthetic coding sequence
atggagctgctgaccttcagagacgtggccatcgagttcagccccgaggagtggaagtgcctggaccccgcccagcagaacctgtacagagacgtgatgctggagaactacagaaacctggtgagcctggccgtgtacagctactacaaccagggcatcctgcccgagcagggcatccaggacagcttcaagaaggccaccctgggcagatacggcagctgcggcctggagaacatctgcctgtggaagaactgggagagcatcggcgagggcgagggccagaaggagtgctacaacctgtgcagccagtacctgaccaccagccacaacaagcacctgaccgtgaagggcgacaaggagtacagaatcttccagaagaagccccagttcctgagcgccgcccccaccgagccctgcatccccatgaacaagtaccagcacaagttcctgaagagcgtgttctgcaacaagaaccagatcaacttcaaccacgacagcaacatcagcaagcaccacagcacccacttcctggagaactactacaactgcaacgagtgcgagaaggtgttctaccagagcagcaagctgatcttccccgagaacatccacatccagaagaagccctacaacagcaacgagtgcggcgagaccagcgaccccttcagcaagctgacccagcaccagagaatctacatcggcgagagcagccagagatgcaacaagaagtgcatcatcgtgttcagccagagccacctgaagggccacaagatcatcaacaccggcgagaagagcgtgaagtacaaggagagaggcaaggccttcaccagaggcctgcacctgggccaccagaagatccacaccggcgagaagccctacaagtgcaagaagtgcgacaaggccttcaacaagagcagccacctggcccagcaccagagaatccacaccggcgagaagcccttcaagtgcaaggagtgcggcaaggccttcaacagaggcagctacctgacccagcaccagagaatccacaccggcgagagagccttcaagtgcgaggagtgcggcaaggccttcaacagaggcagctacctgacccagcaccagagaatccacaccggcgagaagcccttcagatgcaaggagtgcggcaaggccttcaacagaagcagctacgtgacccagcaccagagaatgcacaccggcgagaagcccttcaagtgcaaggagtgcggcaaggccttcaacagagccagccacctgacccagcaccagagaatccacaccggcgagaagcacttcaagtgcaaggagtgcggcaaggccttcaacagaggcagccacctgaccagacaccagagaatccacaccggcgagaagagcttcaagtgcgaggagtgcggcaaggccttcatctggggcagccacctgacccagcaccagagagtgcacaccggcgagaagttcttcaagtgcaaggagtgcggcaaggccttcaccagaagcagccacctgacccagcaccagagaatccacaccggcgagaagcccttcaagtgcaaggagtgcggcaaggccttcaacagaagaagcaccctgacccagcaccagatcatccacaccagatag

SEQ ID NO: 10628 - DNA, 1623 bp, Artificial Sequence; identical to SEQ ID NO: 10627
  Description of Artificial Sequence: Synthetic coding sequence

SEQ ID NO: 10629 - DNA, 795 bp, Artificial Sequence
  Description of Artificial Sequence: Synthetic coding sequence
atggacacccccagccccgaccccctgcccagccccctgcccggcgaggaggagaagcccctggccctgagcccccccgtgcccagaggcagaagaggcagaagacccggcggcgccaccagcagcaacagaaccctgaaggccagcctgcccagaaagagaggcagaccccccaagagcggccaggagccccccctggtgcaggtgcagggcgtgaccgcccccgtgggcagcagcggcggcagcgacctgctgctgatcgacgaccagggcgtgccctacaccgtgagcgagggcagcgccgccggccccgagggcagcggccccagaaaggccccccacttctgccccgtgtgcctgagagccttcccctacctgagcgacctggagagacacagcatcagccacagcgagctgaagccccaccagtgcaaggtgtgcggcaagaccttcaagagaagcagccacctgagaagacactgcaacatccacgccggcctgagacccttcagatgccccctgtgccccagaagattcagagaggccggcgagctggcccaccaccacagagtgcacagcggcgagagaccctaccagtgccccatctgcagactgagattcaccgaggccaacaccctgagaagacacgccaagagaaagcaccccgaggccatgggcgtgcccctgtgcgcccccgaccccggcagcgagcccccctgggacgaggagggcatccccgccaccgccggcgccgaggaggaggaggagaccgagggcaagggcgagcccgcctag

SEQ ID NO: 10630 - DNA, 594 bp, Artificial Sequence
  Description of Artificial Sequence: Synthetic coding sequence
atgagcagcctgacctaccaccacagactgcacaccggcgagaagccctacaagtgcgaggagtgcgacaaggccttcagacacaacagcgccctgcagagacacagaagaatccacaccggcgagaagccccacaagtgcaacgagtgcggcaagaccttcagccagaagagctacctggcctgccacagaagcatccacaccggcaagaagccctacgagtgcgaggagtgcgacaaggccttcagcttcaagagcaacctggagagccacagaatcacccacaccggcgagaagccctacaagtgcaacgactgcggcaagaccttcagccacatgagcaccctgacctgccacagaagactgcacaccggcgagaagccctacaagtgcgaggagtgcgacgaggccttcagattcaagagcagcctggagagacacagaagaatccacaacggcgagaagctgtacaagtgcaacgagtgcggcaagaccttcagccaggagctgagcctgacctgccactgcagactgcacagcggcgagaagccctgcaagtgcggcgagtgcgacaaggcctacagcttcaagtag

SEQ ID NO: 10631 - DNA, 1332 bp, Artificial Sequence
  Description of Artificial Sequence: Synthetic coding sequence
atgctggagaactacagaaacctggtgagcctgggcatcagcagcaagtgcaccatgaaggagttcagcagcaccgcccagggcaacaccgaggtgatccacaccggcaccctgcagagacacgagagacaccacatcggcgacttcagcttccaggagatcgagaaggacatccacaacttcgagttccagtggcaggaggacgagagaaacggccacgaggcccccatgaccaagatcaagaagctgatgggcagcaccgagcagtacgaccacagacacgccggcaacaagcccatcaagtaccagctgggcagcagcttccacagccacctgagcgagctgcacatcttccagcccaagggcaagatcaacaaccaggtggagaagagcatcaacgacgccagcagcgtgagcaccgcccagagaatcagctgcagacccaagacccacatcagcaacaactacggcgacaacttcctgaactacagcctgctgacccagagacaggaggtgagaatgagagagaagagcttccagtgcatcgagagcggcaaggccttcaactacagcagcctgctgagaaagcaccagatcatccacctgggcgagaagcagtacaagtgcgacgtgtgcgacaaggtgttcatcagaaagagatacctggccagacacagaagatgccacaccggcgagaagccctacaagtgcaacgagtgcggcaagagcttcagccagatgagcagcctgacctaccaccacagactgcacaccggcgagaagccctacaagtgcgaggagtgcgacaaggccttcagacacaacagcgccctgcagagacacagaagaatccacaccggcgagaagccccacaagtgcaacgagtgcggcaagaccttcagccagaagagctacctggcctgccacagaagcatccacaccggcaagaagccctacgagtgcgaggagtgcgacaaggccttcagcttcaagagcaacctggagagccacagaatcacccacaccggcgagaagccctacaagtgcaacgactgcggcaagaccttcagccacatgagcaccctgacctgccacagaagactgcacaccggcgagaagccctacaagtgcgaggagtgcgacgaggccttcagattcaagagcagcctggagagacacagaagaatccacaacggcgagaagctgtacaagtgcaacgagtgcggcaagaccttcagccaggagctgagcctgacctgccactgcagactgcacagcggcgagaagccctgcaagtgcggcgagtgcgacaaggcctacagcttcaagtag

SEQ ID NO: 10632 - DNA, 1440 bp, Artificial Sequence
  Description of Artificial Sequence: Synthetic coding sequence
atggccctgccccagggcctgctgaccttcagagacgtggccatcgagttcagccaggaggagtggaagtgcctggaccccgcccagagaaccctgtacagagacgtgatgctggagaactacagaaacctggtgagcctgggcatcagcagcaagtgcaccatgaaggagttcagcagcaccgcccagggcaacaccgaggtgatccacaccggcaccctgcagagacacgagagacaccacatcggcgacttcagcttccaggagatcgagaaggacatccacaacttcgagttccagtggcaggaggacgagagaaacggccacgaggcccccatgaccaagatcaagaagctgatgggcagcaccgagcagtacgaccacagacacgccggcaacaagcccatcaagtaccagctgggcagcagcttccacagccacctgagcgagctgcacatcttccagcccaagggcaagatcaacaaccaggtggagaagagcatcaacgacgccagcagcgtgagcaccgcccagagaatcagctgcagacccaagacccacatcagcaacaactacggcgacaacttcctgaactacagcctgctgacccagagacaggaggtgagaatgagagagaagagcttccagtgcatcgagagcggcaaggccttcaactacagcagcctgctgagaaagcaccagatcatccacctgggcgagaagcagtacaagtgcgacgtgtgcgacaaggtgttcatcagaaagagatacctggccagacacagaagatgccacaccggcgagaagccctacaagtgcaacgagtgcggcaagagcttcagccagatgagcagcctgacctaccaccacagactgcacaccggcgagaagccctacaagtgcgaggagtgcgacaaggccttcagacacaacagcgccctgcagagacacagaagaatccacaccggcgagaagccccacaagtgcaacgagtgcggcaagaccttcagccagaagagctacctggcctgccacagaagcatccacaccggcaagaagccctacgagtgcgaggagtgcgacaaggccttcagcttcaagagcaacctggagagccacagaatcacccacaccggcgagaagccctacaagtgcaacgactgcggcaagaccttcagccacatgagcaccctgacctgccacagaagactgcacaccggcgagaagccctacaagtgcgaggagtgcgacgaggccttcagattcaagagcagcctggagagacacagaagaatccacaacggcgagaagctgtacaagtgcaacgagtgcggcaagaccttcagccaggagctgagcctgacctgccactgcagactgcacagcggcgagaagccctgcaagtgcggcgagtgcgacaaggcctacagcttcaagtag

SEQ ID NO: 10633 - DNA, 153 bp, Artificial Sequence
  Description of Artificial Sequence: Synthetic coding sequence
atggccctgccccagggcctgctgaccttcagagacgtggccatcgagttcagccaggaggagtggaagtgcctggaccccgcccagagaaccctgtacagagacgtgatgctggagaactacagaaacctggtgagcctgggcttcctgtag

SEQ ID NO: 10634 - DNA, 1887 bp, Artificial Sequence
  Description of Artificial Sequence: Synthetic coding sequence
atggccctgacccagggccccctgaagttcatggacgtggccatcgagttcagccaggaggagtggaagtgcctggaccccgcccagagaaccctgtacagagacgtgatgctggagaactacagaaacctggtgagcctgggcatctgcctgcccgacctgagcgtgaccagcatgctggagcagaagagagacccctggaccctgcagagcgaggagaagatcgccaacgaccccgacggcagagagtgcatcaagggcgtgaacaccgagagaagcagcaagctgggcagcaacgccggcaacaagccctgcaagaaccagctgggcttcaccttccagctgcacctgagcgacctgcagctgttccaggccgagagaaagatcagcggctgcaagcacttcgagaagcccgtgagcgacaacagcagcgtgagccccctggagaagatcagcagcagcgtgaagagccacctgctgaacaagtacagaaacaacttcgaccacgcccccctgctgccccaggagcagaaggcccacatcagagagaaggcctacaagtgcaacgagcacggccaggtgttcagagccagcgccagcctgaccaaccaggtgatccacaacgccgacaacccctacaagtgcagcgagtgcggcaaggtgttcagctgcagcagcaagctggtgatccacagaagaatgcacaccggcgagaagccctacaagtgccacgagtgcggcaagctgttcagcagcaacagcaacctgagccagcaccagagaatccacaccggcgagaagccctacaagtgccacgagtgcgacaaggtgttcagaagcagcagcaagctggcccagcaccagagaatccacaccggcgagaagccctacaagtgccacgagtgcgacaaggtgttcaaccagatcgcccacctggtgagacaccagaagatccacaccggcgagaagccctacagctgcaacaagtgcggcaaggtgttcagcagacacagctacctggccgagcaccagaccgtgcacaccggcgagaagccctacaagtgcgaggagtgcggcaaggccttcagcgtgagaagcagcctgatcacccaccagctgatccacaccggcagaaagccctacaagtgcaaggagtgcgacaaggtgttcggcagaaagtgcttcctgaccagccaccagagaatccacaccagagagagaccctacggctgcagccagtgcggcaagatcttcagccagaagagcgacctgatcagacacagaaagacccacaccgacgagaagccctacaagtgcaacaagtgcggcaccgccttcagagagttcagcgacctgaccgcccacttcctgatccacagcggcgagaagccctacgagtgcaaggagtgcggcaaggtgttcagatacaagagcagcctgaccagccaccacagaatccacaccggcgagaagccctacaagtgcaacagatgcggcaaggtgttcagcagaagcagcaacctggtgtgccaccagaagatccacaccggcgagaagccctacaagtgcaaccagtgcggcaaggtgttcaaccaggccagctacctgaccagacaccagatcatccacaccggcgagagaccctacagatgcagcaagtgcggcaaggccttcagaggctgcagcggcctgaccgcccacctggccatccacaccgagaagaagagccacgagtgcaaggagtgcggcaagatcttcacccagaagagcagcctgaccaaccaccacagaatccacatcggcgagaagccctacaagtgcaccctgtgcagcaaggtgttcagccacaacagcgacctggcccagcaccagagagtgcacagctag

SEQ ID NO: 10635 - DNA, 246 bp, Artificial Sequence
  Description of Artificial Sequence: Synthetic coding sequence
atggccctgacccagggccccctgaagttcatggacgtggccatcgagttcagccaggaggagtggaagtgcctggaccccgcccagagaaccctgtacagagacgtgatgctggagaactacagaaacctggtgagcctgggcatctgcctgcccgacctgagcgtgaccagcatgctggagcagaagagagacccctggaccctgcagagcgaggagaagatcgccaacgaccccgacggctag

SEQ ID NO: 10636 - DNA, 45 bp, Artificial Sequence
  Description of Artificial Sequence: Synthetic coding sequence
atggccctgacccagggccccctgaagttcatggacgtggcctag

SEQ ID NO: 10637 - DNA, 1800 bp, Artificial Sequence
  Description of Artificial Sequence: Synthetic coding sequence
atggccgccgccctgagagcccccacccagcaggtgttcgtggccttcgaggacgtggccatctacttcagccaggaggagtgggagctgctggacgagatgcagagactgctgtacagagacgtgatgctggagaacttcgccgtgatggccagcctgggctgctggtgcggcgccgtggacgagggcacccccagcgccgagagcgtgagcgtggaggagctgagccagggcagaacccccaaggccgacaccagcaccgacaagagccacccctgcgagatctgcacccccgtgctgagagacatcctgcagatgatcgagctgcacgccagcccctgcggccagaagctgtacctgggcggcgccagcagagacttctggatgagcagcaacctgcaccagctgcagaagctggacaacggcgagaagctgttcaaggtggacggcgaccaggccagcttcatgatgaactgcagattccacgtgagcggcaagcccttcaccttcggcgaggtgggcagagacttcagcgccaccagcggcctgctgcagcaccaggtgacccccaccatcgagagaccccacagcagaatcagacacctgagagtgcccaccggcagaaagcccctgaagtacaccgagagcagaaagagcttcagagagaagagcgtgttcatccagcaccagagagccgacagcggcgagagaccctacaagtgcagcgagtgcggcaagagcttcagccagagcagcggcttcctgagacacagaaaggcccacggcagaaccagaacccacgagtgcagcgagtgcggcaagagcttcagcagaaagacccacctgacccagcaccagagagtgcacaccggcgagagaccctacgactgcagcgagtgcggcaagagcttcagacaggtgagcgtgctgatccagcaccagagagtgcacaccggcgagagaccctacgagtgcagcgagtgcggcaagagcttcagccacagcaccaacctgtacagacacagaagcgcccacaccagcaccagaccctacgagtgcagcgagtgcggcaagagcttcagccacagcaccaacctgttcagacactggagagtgcacaccggcgtgagaccctacgagtgcagcgagtgcggcaaggccttcagctgcaacatctacctgatccaccaccagagattccacaccggcgagagaccctacgtgtgcagcgagtgcggcaagagcttcggccagaagagcgtgctgatccagcaccagagagtgcacaccggcgagagaccctacgagtgcagcgagtgcggcaaggtgttcagccagagcagcggcctgttcagacacagaagagcccacaccaagaccaagccctacgagtgcagcgagtgcgagaagagcttcagctgcaagaccgacctgatcagacaccagaccgtgcacaccggcgagagaccctacgagtgcagcgtgtgcggcaagagcttcatcagaaagacccacctgatcagacaccagaccgtgcacaccaacgagagaccctacgagtgcgacgagtgcggcaagagctacagccagagcagcgccctgctgcagcacagaagagtgcacaccggcgagagaccctacgagtgcagagagtgcggcaagagcttcaccagaaagaaccacctgatccagcacaagaccgtgcacaccggcgagagaccctacgagtgcagcgagtgcggcaagagcttcagccagagcagcggcctgctgagacacagaagagtgcacgtgcagtag

SEQ ID NO: 10638 - DNA, 3906 bp, Artificial Sequence
  Description of Artificial Sequence: Synthetic coding sequence
atgaccatgggcgacatgaagacccccgacttcgacgacctgctggccgccttcgacatccccgacatggtggaccccaaggccgccatcgagagcggccacgacgaccacgagagccacatgaagcagaacgcccacggcgaggacgacagccacgcccccagcagcagcgacgtgggcgtgagcgtgatcgtgaagaacgtgagaaacatcgacagcagcgagggcggcgagaaggacggccacaaccccaccggcaacggcctgcacaacggcttcctgaccgccagcagcctggacagctacagcaaggacggcgccaagagcctgaagggcgacgtgcccgccagcgaggtgaccctgaaggacagcaccttcagccagttcagccccatcagcagcgccgaggagttcgacgacgacgagaagatcgaggtggacgacccccccgacaaggaggacatgagaagcagcttcagaagcaacgtgctgaccggcagcgccccccagcaggactacgacaagctgaaggccctgggcggcgagaacagcagcaagaccggcctgagcaccagcggcaacgtggagaagaacaaggccgtgaagagagagaccgaggccagcagcatcaacctgagcgtgtacgagcccttcaaggtgagaaaggccgaggacaagctgaaggagagcagcgacaaggtgctggagaacagagtgctggacggcaagctgagcagcgagaagaacgacaccagcctgcccagcgtggcccccagcaagaccaagagcagcagcaagctgagcagctgcatcgccgccatcgccgccctgagcgccaagaaggccgccagcgacagctgcaaggagcccgtggccaacagcagagagagcagccccctgcccaaggaggtgaacgacagccccagagccgccgacaagagccccgagagccagaacctgatcgacggcaccaagaagcccagcctgaagcagcccgacagccccagaagcatcagcagcgagaacagcagcaagggcagccccagcagccccgccggcagcacccccgccatccccaaggtgagaatcaagaccatcaagaccagcagcggcgagatcaagagaaccgtgaccagagtgctgcccgaggtggacctggacagcggcaagaagcccagcgagcagaccgccagcgtgatggccagcgtgaccagcctgctgagcagccccgccagcgccgccgtgctgagcagcccccccagagcccccctgcagagcgccgtggtgaccaacgccgtgagccccgccgagctgacccccaagcaggtgaccatcaagcccgtggccaccgccttcctgcccgtgagcgccgtgaagaccgccggcagccaggtgatcaacctgaagctggccaacaacaccaccgtgaaggccaccgtgatcagcgccgccagcgtgcagagcgccagcagcgccatcatcaaggccgccaacgccatccagcagcagaccgtggtggtgcccgccagcagcctggccaacgccaagctggtgcccaagaccgtgcacctggccaacctgaacctgctgccccagggcgcccaggccaccagcgagctgagacaggtgctgaccaagccccagcagcagatcaagcaggccatcatcaacgccgccgccagccagccccccaagaaggtgagcagagtgcaggtggtgagcagcctgcagagcagcgtggtggaggccttcaacaaggtgctgagcagcgtgaaccccgtgcccgtgtacatccccaacctgagcccccccgccaacgccggcatcaccctgcccaccagaggctacaagtgcctggagtgcggcgacagcttcgccctggagaagagcctgacccagcactacgacagaagaagcgtgagaatcgaggtgacctgcaaccactgcaccaagaacctggtgttctacaacaagtgcagcctgctgagccacgccagaggccacaaggagaagggcgtggtgatgcagtgcagccacctgatcctgaagcccgtgcccgccgaccagatgatcgtgagccccagcagcaacaccagcaccagcaccagcaccctgcagagccccgtgggcgccggcacccacaccgtgaccaagatccagagcggcatcaccggcaccgtgatcagcgcccccagcagcacccccatcacccccgccatgcccctggacgaggaccccagcaagctgtgcagacacagcctgaagtgcctggagtgcaacgaggtgttccaggacgagaccagcctggccacccacttccagcaggccgccgacaccagcggccagaagacctgcaccatctgccagatgctgctgcccaaccagtgcagctacgccagccaccagagaatccaccagcacaagagcccctacacctgccccgagtgcggcgccatctgcagaagcgtgcacttccagacccacgtgaccaagaactgcctgcactacaccagaagagtgggcttcagatgcgtgcactgcaacgtggtgtacagcgacgtggccgccctgaagagccacatccagggcagccactgcgaggtgttctacaagtgccccatctgccccatggccttcaagagcgcccccagcacccacagccacgcctacacccagcaccccggcatcaagatcggcgagcccaagatcatctacaagtgcagcatgtgcgacaccgtgttcaccctgcagaccctgctgtacagacacttcgaccagcacatcgagaaccagaaggtgagcgtgttcaagtgccccgactgcagcctgctgtacgcccagaagcagctgatgatggaccacatcaagagcatgcacggcaccctgaagagcatcgagggcccccccaacctgggcatcaacctgcccctgagcatcaagcccgccacccagaacagcgccaaccagaacaaggaggacaccaagagcatgaacggcaaggagaagctggagaagaagagccccagccccgtgaagaagagcatggagaccaagaaggtggccagccccggctggacctgctgggagtgcgactgcctgttcatgcagagagacgtgtacatcagccacgtgagaaaggagcacggcaagcagatgaagaagcacccctgcagacagtgcgacaagagcttcagcagcagccacagcctgtgcagacacaacagaatcaagcacaagggcatcagaaaggtgtacgcctgcagccactgccccgacagcagaagaaccttcaccaagagactgatgctggagaagcacgtgcagctgatgcacggcatcaaggaccccgacctgaaggagatgaccgacgccaccaacgaggaggagaccgagatcaaggaggacaccaaggtgcccagccccaagagaaagctggaggagcccgtgctggagttcagaccccccagaggcgccatcacccagcccctgaagaagctgaagatcaacgtgttcaaggtgcacaagtgcgccgtgtgcggcttcaccaccgagaacctgctgcagttccacgagcacatcccccagcacaagagcgacggcagcagctaccagtgcagagagtgcggcctgtgctacaccagccacgtgagcctgagcagacacctgttcatcgtgcacaagctgaaggagccccagcccgtgagcaagcagaacggcgccggcgaggacaaccagcaggagaacaagcccagccacgaggacgagagccccgacggcgccgtgagcgacagaaagtgcaaggtgtgcgccaagaccttcgagaccgaggccgccctgaacacccacatgagaacccacggcatggccttcatcaagagcaagagaatgagcagcgccgagaagtag

SEQ ID NO: 10639 - DNA, 582 bp, Artificial Sequence
  Description of Artificial Sequence: Synthetic coding sequence
atggccctgacccagggccagctgagcttcagcgacgtggccatcgagttcagccaggaggagtggaagtgcctggaccccggccagaaggccctgtacagagacgtgatgctggagaactacagaaacctggtgagcctgggcatctgcctgcccgacctgagcgtgaccagcatgctggagcagaagagagacccctggaccctgcagagcgaggtgaagatcatcaacaaccccgacggcagagagtgcatcaagggcgtgaacaccgacttcagcctgctggcctgggacgccagagtgttcagagtggaggcctggagagccagcggcggcgccgaggagcccaccggccccaacttcgtgggcaacgacagccccctgcccagccccctggccctgctgcccttccccagcgtgagcgccagcctgggcgacgccaagagagccagactgaccgccgagggcagaggccacggcaccctgagagccggccccgcccccagacccagaagcgccgccccccacgcccccgacgccgtgcagagatggccccccgagcagagactgcccagaagctag

SEQ ID NO: 10640 - DNA, 2025 bp, Artificial Sequence
  Description of Artificial Sequence: Synthetic coding sequence
atggccctgacccagggccagctgagcttcagcgacgtggccatcgagttcagccaggaggagtggaagtgcctggaccccggccagaaggccctgtacagagacgtgatgctggagaactacagaaacctggtgagcctgggcgaggacaacgtgagacccgaggcctgcatctgcagcggcatctgcctgcccgacctgagcgtgaccagcatgctggagcagaagagagacccctggaccctgcagagcgaggtgaagatcatcaacaaccccgacggcagagagtgcatcaagggcgtgaacaccgagaagagcagcaagctgggcagcagcgccggcaacaagagcctgaagaaccagcacggcctgaccctgcagctgcacctgaccgagtggcagcccttccaggccgtgagaaacatctacggctgcaagcacgtggagaagagcatcagcgacaacagcagcgtgagccccgtgcagatcagcttcttcagcgtgaagacccacatcttcaacaactacagaaacgacttcctgttcagcaccctgctgccccaggagcagaaggtgcacatcagagagaagccctacggctgcaacgagcacggcaaggtgttcagagtgagcagcagcctgaccaacagacaggtgatccacatcgccgacaagacctacaagtgcagcgactgcggcgagatcttcagcagcaacagcaacttcgcccagcaccagagaatccacaccggcgagaagccctacaagtacaacgagtgcggcaaggtgttcaaccagaacagccacctggcccagcaccagaagatccacaccggccagaagccctacaacaacaaggagtgcggcaaggtgttcagccaccacgcctacctggcccagcacagaaagatccacaccggcgagaagccctacaagtgcagcgagtgcggcaaggccttcagcgtgtgcagcagcctgaccgcccacctggtgatccacaccggcgagaagccctacgactgcaaggagtgcggcaaggtgttcagacacaagagcagcctgaccacccaccagaccgtgcacaccggcgagagaccctacaagtgcaacgagtgcggcaagggcttcagcagaatcgccttcctggccagacacagaaaggtgcacaccggcgagaagccctacaagtgcaacgagtgcggcaaggtgttcatcggcaacagcagactggccagacacagaaagatccacaccggcggcagaagatacaagtgcaacgagtgcggcaaggccttcagaacctgcagcgacctgaccgcccacctgctgatccacaccggcgagaagccctacgagtgcatcgactgcggcaaggtgttcagacacaagagcagcctgacctaccactgcagaatccacaccggcgagaagccctacaagtgcaacgagtgcggcaaggtgttcagccagaacagcaacctgcagagacacagaaagatccacaccggcgagaagctgtacaagtgcaacgagtgcggcaaggtgttcagacagaacagccacctggcccagcacagagacatccacaccggcgagaagccctacagctgcaacgagtgcggcaaggtgttcagaagaaacagccacctggtgagacacagaaacgtgcacaccggcgagaagccctacagctgcaacgagtgcggcaaggtgttcagcagaaacagccacctggccagacacagaaacatccacaccggcgagaagccccacagctgcaacgagtgcggcaaggtgttcagcagaaacagccacctggccagacacagaaagatccacaccggcgagaagctgtacaagtgcaacgagtgcagcaaggtgttcagcagaaacagcagactggcccagcacagaaacatccacaccggcgtgaagccctacagctgcaacgagtgcggcaaggtgttcagcaagaacagcatcctggtgcagcactgcagcatccacaccagagagaagccctag

SEQ ID NO: 10641 - DNA, 2022 bp, Artificial Sequence
  Description of Artificial Sequence: Synthetic coding sequence
gtgctgaccaccggccagctgagcttcagcgacgtggccatcgagttcagccaggaggagtggaagtgcctggaccccggccagaaggccctgtacagagacgtgatgctggagaactacagaaacctggtgagcctgggcgaggacaacgtgagacccgaggcctgcatctgcagcggcatctgcctgcccgacctgagcgtgaccagcatgctggagcagaagagagacccctggaccctgcagagcgaggtgaagatcatcaacaaccccgacggcagagagtgcatcaagggcgtgaacaccgagaagagcagcaagctgggcagcagcgccggcaacaagagcctgaagaaccagcacggcctgaccctgcagctgcacctgaccgagtggcagcccttccaggccgtgagaaacatctacggctgcaagcacgtggagaagagcatcagcgacaacagcagcgtgagccccgtgcagatcagcttcttcagcgtgaagacccacatcttcaacaactacagaaacgacttcctgttcagcaccctgctgccccaggagcagaaggtgcacatcagagagaagccctacggctgcaacgagcacggcaaggtgttcagagtgagcagcagcctgaccaacagacaggtgatccacatcgccgacaagacctacaagtgcagcgactgcggcgagatcttcagcagcaacagcaacttcgcccagcaccagagaatccacaccggcgagaagccctacaagtacaacgagtgcggcaaggtgttcaaccagaacagccacctggcccagcaccagaagatccacaccggccagaagccctacaacaacaaggagtgcggcaaggtgttcagccaccacgcctacctggcccagcacagaaagatccacaccggcgagaagccctacaagtgcagcgagtgcggcaaggccttcagcgtgtgcagcagcctgaccgcccacctggtgatccacaccggcgagaagccctacgactgcaaggagtgcggcaaggtgttcagacacaagagcagcctgaccacccaccagaccgtgcacaccggcgagagaccctacaagtgcaacgagtgcggcaagggcttcagcagaatcgccttcctggccagacacagaaaggtgcacaccggcgagaagccctacaagtgcaacgagtgcggcaaggtgttcatcggcaacagcagactggccagacacagaaagatccacaccggcggcagaagatacaagtgcaacgagtgcggcaaggccttcagaacctgcagcgacctgaccgcccacctgctgatccacaccggcgagaagccctacgagtgcatcgactgcggcaaggtgttcagacacaagagcagcctgacctaccactgcagaatccacaccggcgagaagccctacaagtgcaacgagtgcggcaaggtgttcagccagaacagcaacctgcagagacacagaaagatccacaccggcgagaagctgtacaagtgcaacgagtgcggcaaggtgttcagacagaacagccacctggcccagcacagagacatccacaccggcgagaagccctacagctgcaacgagtgcggcaaggtgttcagaagaaacagccacctggtgagacacagaaacgtgcacaccggcgagaagccctacagctgcaacgagtgcggcaaggtgttcagcagaaacagccacctggccagacacagaaacatccacaccggcgagaagccccacagctgcaacgagtgcggcaaggtgttcagcagaaacagccacctggccagacacagaaagatccacaccggcgagaagctgtacaagtgcaacgagtgcagcaaggtgttcagcagaaacagcagactggcccagcacagaaacatccacaccggcgtgaagccctacagctgcaacgagtgcggcaaggtgttcagcaagaacagcatcctggtgcagcactgcagcatccacaccagagagaagccctag

SEQ ID NO: 10642 - DNA, 453 bp, Artificial Sequence
  Description of Artificial Sequence: Synthetic coding sequence
atggccctgacccagggccagctgagcttcagcgacgtggccatcgagttcagccaggaggagtggaagtgcctggaccccggccagaaggccctgtacagagacgtgatgctggagaactacagaaacctggtgagcctggacttcagcctgctggcctgggacgccagagtgttcagagtggaggcctggagagccagcggcggcgccgaggagcccaccggccccaacttcgtgggcaacgacagccccctgcccagccccctggccctgctgcccttccccagcgtgagcgccagcctgggcgacgccaagagagccagactgaccgccgagggcagaggccacggcaccctgagagccggccccgcccccagacccagaagcgccgccccccacgcccccgacgccgtgcagagatggccccccgagcagagactgcccagaagctag

SEQ ID NO: 10643 - DNA, 1986 bp, Artificial Sequence
  Description of Artificial Sequence: Synthetic coding sequence
atggccctgacccagggccagctgagcttcagcgacgtggccatcgagttcagccaggaggagtggaagtgcctggaccccggccagaaggccctgtacagagacgtgatgctggagaactacagaaacctggtgagcctgggcatctgcctgcccgacctgagcgtgaccagcatgctggagcagaagagagacccctggaccctgcagagcgaggtgaagatcatcaacaaccccgacggcagagagtgcatcaagggcgtgaacaccgagaagagcagcaagctgggcagcagcgccggcaacaagagcctgaagaaccagcacggcctgaccctgcagctgcacctgaccgagtggcagcccttccaggccgtgagaaacatctacggctgcaagcacgtggagaagagcatcagcgacaacagcagcgtgagccccgtgcagatcagcttcttcagcgtgaagacccacatcttcaacaactacagaaacgacttcctgttcagcaccctgctgccccaggagcagaaggtgcacatcagagagaagccctacggctgcaacgagcacggcaaggtgttcagagtgagcagcagcctgaccaacagacaggtgatccacatcgccgacaagacctacaagtgcagcgactgcggcgagatcttcagcagcaacagcaacttcgcccagcaccagagaatccacaccggcgagaagccctacaagtacaacgagtgcggcaaggtgttcaaccagaacagccacctggcccagcaccagaagatccacaccggccagaagccctacaacaacaaggagtgcggcaaggtgttcagccaccacgcctacctggcccagcacagaaagatccacaccggcgagaagccctacaagtgcagcgagtgcggcaaggccttcagcgtgtgcagcagcctgaccgcccacctggtgatccacaccggcgagaagccctacgactgcaaggagtgcggcaaggtgttcagacacaagagcagcctgaccacccaccagaccgtgcacaccggcgagagaccctacaagtgcaacgagtgcggcaagggcttcagcagaatcgccttcctggccagacacagaaaggtgcacaccggcgagaagccctacaagtgcaacgagtgcggcaaggtgttcatcggcaacagcagactggccagacacagaaagatccacaccggcggcagaagatacaagtgcaacgagtgcggcaaggccttcagaacctgcagcgacctgaccgcccacctgctgatccacaccggcgagaagccctacgagtgcatcgactgcggcaaggtgttcagacacaagagcagcctgacctaccactgcagaatccacaccggcgagaagccctacaagtgcaacgagtgcggcaaggtgttcagccagaacagcaacctgcagagacacagaaagatccacaccggcgagaagctgtacaagtgcaacgagtgcggcaaggtgttcagacagaacagccacctggcccagcacagagacatccacaccggcgagaagccctacagctgcaacgagtgcggcaaggtgttcagaagaaacagccacctggtgagacacagaaacgtgcacaccggcgagaagccctacagctgcaacgagtgcggcaaggtgttcagcagaaacagccacctggccagacacagaaacatccacaccggcgagaagccccacagctgcaacgagtgcggcaaggtgttcagcagaaacagccacctggccagacacagaaagatccacaccggcgagaagctgtacaagtgcaacgagtgcagcaaggtgttcagcagaaacagcagactggcccagcacagaaacatccacaccggcgtgaagccctacagctgcaacgagtgcggcaaggtgttcagcaagaacagcatcctggtgcagcactgcagcatccacaccagagagaagccctag

SEQ ID NO: 10644 - DNA, 3903 bp, Artificial Sequence
  Description of Artificial Sequence: Synthetic coding sequence
atggaggaggccagcctgtgcctgggcgtgagcagcgccgagcccgaggccgagccccacctgagcggccccgtgctgaacggccagtacgccatgagccagaagctgcaccagatcaccagccagctgagccacgccttccccgagctgcaccccagacccaaccccgaggagaagccccccgccagcctggaggagaaggcccacgtgcccatgagcggccagcccatgggcagccagatggccctgctggccaaccagctgggcagagaggtggacaccagcctgaacggcagagtggacctgcagcagttcctgaacggccagaacctgggcatcatgagccagatgagcgacatcgaggacgacgccagaaagaacagaaagtacccctgccccctgtgcggcaagagattcagattcaacagcatcctgagcctgcacatgagaacccacaccggcgagaagcccttcaagtgcccctactgcgaccacagagccgcccagaagggcaacctgaagatccacctgagaacccacaagctgggcaacctgggcaagggcagaggcagagtgagagaggagaacagactgctgcacgagctggaggagagagccatcctgagagacaagcagctgaagggcagcctgctgcagcccagacccgacctgaagccccccccccacgcccagcaggcccccctggccgcctgcaccctggccctgcaggccaaccacagcgtgcccgacgtggcccaccccgtgcccagccccaagcccgccagcgtgcaggaggacgccgtggcccccgccgccggcttcagatgcaccttctgcaagggcaagttcaagaagagagaggagctggacagacacatcagaatcctgcacaagccctacaagtgcaccctgtgcgacttcgccgccagccaggaggaggagctgatcagccacgtggagaaggcccacatcaccgccgagagcgcccagggccagggccccaacggcggcggcgagcagagcgccaacgagttcagatgcgaggtgtgcggccaggtgttcagccaggcctggttcctgaagggccacatgagaaagcacaaggacagcttcgagcactgctgccagatctgcggcagaagattcaaggagccctggttcctgaagaaccacatgaaggtgcacctgaacaagctgagcgtgaagaacaagagccccagcgaccccgaggtgcccgtgcccatgggcggcatgagccaggaggcccacgccaacctgtacagcagatacctgagctgcctgcagagcggcttcatgacccccgacaaggccggcctgagcgagcccagccagctgtacggcaagggcgagctgcccatgaaggagaaggaggccctgggcaagctgctgagccccatcagcagcatggcccacggcgtgcccgagggcgacaagcacagcctgctgggctgcctgaacctggtgccccccctgaagagcagctgcatcgagagactgcaggccgccgccaaggccgccgagatggaccccgtgaacagctaccaggcctggcagctgatggccagaggcatggccatggagcacggcttcctgagcaaggagcaccccctgcagagaaaccacgaggacaccctggccaacgccggcgtgctgttcgacaaggagaagagagagtacgtgctggtgggcgccgacggcagcaagcagaagatgcccgccgacctggtgcacagcaccaaggtgggcagccagagagacctgcccagcaagctggaccccctggagagcagcagagacttcctgagccacggcctgaaccagaccctggagtacaacctgcagggccccggcaacatgaaggagaagcccaccgagtgccccgactgcggcagagtgttcagaacctaccaccaggtggtggtgcacagcagagtgcacaagagagacagaaagggcgaggaggacggcctgcacgtgggcctggacgagagaagaggcagcggcagcgaccaggagagccagagcgtgagcagaagcaccacccccggcagcagcaacgtgaccgaggagagcggcgtgggcggcggcctgagccagaccggcagcgcccaggaggacagcccccaccccagcagccccagcagcagcgacatcggcgaggaggccggcagaagcgccggcgtgcagcagcccgccctgctgagagacagaagcctgggcagcgccatgaaggactgcccctactgcggcaagaccttcagaaccagccaccacctgaaggtgcacctgagaatccacaccggcgagaagccctacaagtgcccccactgcgactacgccggcacccagagcgccagcctgaagtaccacctggagagacaccacagagagagacagaacggcgccggccccctgagcggccagccccccaaccaggaccacaaggacgagatgagcagcaaggccagcctgttcatcagacccgacatcctgagaggcgccttcaagggcctgcccggcatcgacttcagaggcggccccgccagccagcagtggaccagcggcgtgctgagcagcggcgaccacagcggccaggccaccggcatgagcagcgaggtgcccagcgacgccctgaagggcaccgacctgcccagcaagagcacccacttcagcgagatcggcagagcctaccagagcatcgtgagcaacggcgtgaacttccagggcagcctgcaggccttcatggacagcttcgtgctgagcagcctgaagaaggagaaggacatgaaggacaaggccctggccgacccccccagcatgaaggtgcacggcgtggacggcggcgaggagaagcccagcggcaagagcagccagagaaagagcgagaagagccagtacgagcccctggacctgagcgtgagacccgacgccgccagcctgcccggcagcagcgtgaccgtgcaggacagcatcgcctggcacggctgcctgttctgcgccttcaccaccagcagcatggagctgatggccctgcacctgcaggccaaccacctgggcaaggccaagagaaaggacaacaccatcggcgtgaccgtgaactgcaaggaccaggccagagaggccagcaagatggccctgctgcccagcctgcagagcaacaaggacctgggcctgagcaacatgatcagcagcctggacagcgccagcgagaagatggcccagggccagctgaaggagaccctgggcgagcagaagagcggcgcctggaccggccacgtggaccccgccttctgcaacttccccagcgacttctacaagcagttcggcgtgtaccccggcatggtgggcagcggcgccagcagcagctgccccaacaaggagcccgacggcaaggcccacagcgaggaggacgtgcccatcctgatccccgagaccaccagcaagaacaccaccgacgacctgagcgacatcgccagcagcgaggacatggacagcagcaagggcgagaacaacgacgaggaggacgtggagaccgagcccgagatgatgaccaagcccctgagcgccctgagcaaggacagcagcagcgacggcggcgacagcctgcagcccaccggcaccagccagcccgtgcagggcctggtgagccccctgagccaggcccccgagaagcagtggcacagccagggcctgctgcaggcccaggaccccctggccggcctgcccaagcccgagagaggcccccagagcctggacaagcccatgaacatgctgagcgtgctgagagcctacagcagcgacggcctggccgccttcaacggcctggccagcagcaccgccaacagcggctgcatcaagagacccgacctgtgcggcaagtag

SEQ ID NO: 10645 - DNA, 4098 bp, Artificial Sequence
  Description of Artificial Sequence: Synthetic coding sequence
atggaccagtacagcctgggcgacgagggcgccctgcccagcgagatgcacctgcccagcttcagcgagagccagggcctgaactgcagcgacaccctgaacagagacctgggccccaacaccagaggcttcctgtacgccggcctgagcggcctggaccccgaccccagcctgcccacccccgacatgagcagcgaggtgctggaggacaacctggacaccctgagcctgtacagcggcaaggacagcgacagcgtgaagctgctggaggagtacgccgacagcgagagccaggccagcctgcaggacctgggcctgggcgtgctgaaggccaaggaggccgacgagggcggcagagccaccagcggcagcgccagaaagggcaagagacagcacagcagcccccagaaccccctgctggactgcagcctgtgcggcaaggtgttcagcagcgccagcagcctgagcaagcactacctgacccacagccaggagagaaagcacgtgtgcaagatctgcagcaaggccttcaagagacaggaccacctgaccggccacatgctgacccaccagaagaccaagcccttcgtgtgcatcgagcagggctgcagcaagagctactgcgactacagaagcctgagaagacactacgaggtgcaccacggcctgtgcatcctgaaggaggccccccccgaggaggaggcctgcggcgacagcccccacgcccacgagagcgccggccagcccccccccagcagcctgagaagcctggtgccccccgaggccagaagccccggcagcctgctgccccacagagacctgctgagaagaatcgtgagcagcatcgtgcaccagaagacccccagccccggccccgcccccgccggcgccagcgacagcgagggcagaaacaccgcctgcccctgccccgccagcagcggcagcagcagctgcacccccgccggcccccacgccgcccccgccgccctggacaccgagctgcccgaggagccctgcctgccccagaaggagcccgccaccgacgtgttcaccgcccccaacagcagagccgccgagaacggcgcccccgacccccccgagcccgagcccgacaccgccctgctgcaggccagaagcaccgccgagtgctggcccgagggcggcagcgtgcccgcctgcctgcccctgttcagaggccagaccgtgcccgccagcagccagcccagcagccacagcttccagtggctgagaaacctgcccggctgccccaagagcaagggcaacaacgtgttcgtggtgcacaagcccagcgccgtgcccagcagagagggcagcgagagcggccccggccccagcagcggcagccccagcgaggagagcccccccggccccggcggcggcctggaggacgccctgcccttccccgccgccctgctgagagtgcccgccgaggcccccagcgaccccagaagcgccagcggcgaggacgacccctgcgcccccaagaaggtgaaggtggactgcgacagcttcctgtgccagaaccccggcgagcccggcctgcaggaggcccagaaggccggcggcctgcccgccgacgccagccccctgttcagacagctgttcctgaagagccaggagcccctggtgagccacgagcagatgcaggtgttccagatgatcaccaagagccagagaatcttcagccacgcccaggtggccgccgtgagcagccagctgcccgcccccgagggcaagcccgccgccctgagacccctgcagggcccctggccccagcagcccccccccctggcccccgccgtggacagcctgcacgccggccccggcaaccccgaggccgagggcagccccgccagaagaagaaagaccacccccggcgtgcccagagaggccagccccggcagcaccagaagagacgccaagggcggcctgaaggtggccgccgtgcccacccccctggccgcccccagcctggaccccagcagaaaccccgacatcagcagcctggccaagcagctgagaagcagcaagggcaccctggacctggaggacatcttccccagcaccggccagagacagacccagctgggcggcgaggagccccccggcgccagcctgcccggcaagcaggcccccgccgagaacggcgccgccagcagaatcaccaagggcgagaagggccccgcctgcagcagaggcggcggctacagactgctgggcaaccccagagcccccagattcagcggcttcagaaaggagaaggccaagatggacatgtgctgcgccgccagccccagccaggtggccatggccagcttcagcagcgccggcccccccgccgaccccagcaagagcaagctgaccatcttcagcagaatccagggcggcaacatctacagactgccccaccccgtgaaggaggagaacgtggccggcagaggcaaccagcagaacggcagccccaccgactggaccaagcccagaagcaccttcgtgtgcaagaactgcagccagatgttctacaccgagaagggcctgagcagccacatgtgcttccacagcgaccagtggcccagccccagaggcaagcaggagccccaggtgttcggcaccgagttctgcaagcccctgagacaggtgctgagacccgagggcgacagacacagcccccccggcaccaagaagcccctggaccccaccgccgccgcccccctggtggtgccccagagcatccccgtggtgcccgtgaccagacacatcggcagcatggccatgatggagtggtgcagcagatggctgcaggccaccacctgcggcagcaagctgctgcagggccaggagaaggacggcgaggagagagacagcaaggagagcagccagcagagaaagagaaagaagagacccccccccagcaccgccggcgagcccggccccgccggctgccaccagagcagactgagaagccccatgttcctggtggactgcctgctgaagggcctgttccagtgcagcccctacacccccccccccatgctgagccccatcagagagggcagcggcgtgtacttcaacaccctgtgcagcaccagcacccaggccagccccgaccagctgatcagcagcatgctggaccaggtggacggcagcttcggcatctgcgtggtgaaggacgacaccaagatcagcatcgagccccacatcaacatcggcagcagattccaggccgagatccccgagctgcaggagagaagcctggccggcaccgacgagcacgtggccagcctggtgtggaagccctggggcgacatgatgatcagcagcgagacccaggacagagtgaccgagctgtgcaacgtggcctgcagcagcgtgatgcccggcggcggcaccaacctggagctggccctgcactgcctgcacgaggcccagggcaacgtgcaggtggccctggagaccctgctgctgagaggcccccacaagcccagaacccacctgctggccgactacagatacaccggcagcgacgtgtggacccccatcgagaagagactgttcaagaaggccttctacgcccacaagaaggacttctacctgatccacaagatgatccagaccaagaccgtggcccagtgcgtggagtactactacatctggaagaagatgatcaagttcgactgcggcagagcccccggcctggagaagagagtgaagagagagcccgaggaggtggagagaaccgaggagaaggtgccctgcagccccagagagagacccagccaccaccccacccccaagctgaagaccaagagctacagaagagagagcatcctgagcagcagccccaacgccggcagcaagagaacccccgagctgctgggcagcgccgagagccagggcatcttcccctgcagagagtgcgagagagtgttcgacaagatcaagagcagaaacgcccacatgaagagacacagactgcaggaccacgtggagcccatcatcagagtgaagtggcccgtgaagcccttccagctgaaggaggaggagctgggcgccgacatcggccccctgcagtggtag

SEQ ID NO: 10646 - DNA, 3267 bp, Artificial Sequence
  Description of Artificial Sequence: Synthetic coding sequence
atggaccagtacagcctgggcgacgagggcgccctgcccagcgagatgcacctgcccagcttcagcgagagccagggcctgaactgcagcgacaccctgaacagagacctgggccccaacaccagaggcttcctgtacgccggcctgagcggcctggaccccgaccccagcctgcccacccccgacatgagcagcgaggtgctggaggacaacctggacaccctgagcctgtacagcggcaaggacagcgacagcgtgaagctgctggaggagtacgccgacagcgagagccaggccagcctgcaggacctgggcctgggcgtgctgaaggccaaggaggccgacgagggcggcagagccaccagcggcagcgccagaaagggcaagagacagcacagcagcccccagaaccccctgctggactgcagcctgtgcggcaaggtgttcagcagcgccagcagcctgagcaagcactacctgacccacagccaggagagaaagcacgtgtgcaagatctgcagcaaggccttcaagagacaggaccacctgaccggccacatgctgacccaccagaagaccaagcccttcgtgtgcatcgagcagggctgcagcaagagctactgcgactacagaagcctgagaagacactacgaggtgcaccacggcctgtgcatcctgaaggaggccccccccgaggaggaggcctgcggcgacagcccccacgcccacgagagcgccggccagcccccccccagcagcctgagaagcctggtgccccccgaggccagaagccccggcagcctgctgccccacagagacctgctgagaagaatcgtgagcagcatcgtgcaccagaagacccccagccccggccccgcccccgccggcgccagcgacagcgagggcagaaacaccgcctgcccctgccccgccagcagcggcagcagcagctgcacccccgccggcccccacgccgcccccgccgccctggacaccgagctgcccgaggagccctgcctgccccagaaggagcccgccaccgacgtgttcaccgcccccaacagcagagccgccgagaacggcgcccccgacccccccgagcccgagcccgacaccgccctgctgcaggccagaagcaccgccgagtgctggcccgagggcggcagcgtgcccgcctgcctgcccctgttcagaggccagaccgtgcccgccagcagccagcccagcagccacagcttccagtggctgagaaacctgcccggctgccccaagagcaagggcaacaacgtgttcgtggtgcacaagcccagcgccgtgcccagcagagagggcagcgagagcggccccggccccagcagcggcagccccagcgaggagagcccccccggccccggcggcggcctggaggacgccctgcccttccccgccgccctgctgagagtgcccgccgaggcccccagcgaccccagaagcgccagcggcgaggacgacccctgcgcccccaagaaggtgaaggtggactgcgacagcttcctgtgccagaaccccggcgagcccggcctgcaggaggcccagaaggccggcggcctgcccgccgacgccagccccctgttcagacagctgttcctgaagagccaggagcccctggtgagccacgagcagatgcaggtgttccagatgatcaccaagagccagagaatcttcagccacgcccaggtggccgccgtgagcagccagctgcccgcccccgagggcaagcccgccgccctgagacccctgcagggcccctggccccagcagcccccccccctggcccccgccgtggacagcctgcacgccggccccggcaaccccgaggccgagggcagccccgccagaagaagaaagaccacccccggcgtgcccagagaggccagccccggcagcaccagaagagacgccaagggcggcctgaaggtggccgccgtgcccacccccctggccgcccccagcctggaccccagcagaaaccccgacatcagcagcctggccaagcagctgagaagcagcaagggcaccctggacctggaggacatcttccccagcaccggccagagacagacccagctgggcggcgaggagccccccggcgccagcctgcccggcaagcaggcccccgccgagaacggcgccgccagcagaatcaccaagggcgagaagggccccgcctgcagcagaggcggcggctacagactgctgggcaaccccagagcccccagattcagcggcttcagaaaggagaaggccaagatggacatgtgctgcgccgccagccccagccaggtggccatggccagcttcagcagcgccggcccccccgccgaccccagcaagagcaagctgaccatcttcagcagaatccagggcggcaacatctacagactgccccaccccgtgaaggaggagaacgtggccggcagaggcaaccagcagaacggcagccccaccgactggaccaagcccagaagcaccttcgtgtgcaagaactgcagccagatgttctacaccgagaagggcctgagcagccacatgtgcttccacagcgaccagtggcccagccccagaggcaagcaggagccccaggtgttcggcaccgagttctgcaagcccctgagacaggtgctgagacccgagggcgacagacacagcccccccggcaccaagaagcccctggaccccaccgccgccgcccccctggtggtgccccagagcatccccgtggtgcccgtgaccagacacatcggcagcatggccatgatccagaccaagaccgtggcccagtgcgtggagtactactacatctggaagaagatgatcaagttcgactgcggcagagcccccggcctggagaagagagtgaagagagagcccgaggaggtggagagaaccgaggagaaggtgccctgcagccccagagagagacccagccaccaccccacccccaagctgaagaccaagagctacagaagagagagcatcctgagcagcagccccaacgccggcagcaagagaacccccgagctgctgggcagcgccgagagccagggcatcttcccctgcagagagtgcgagagagtgttcgacaagatcaagagcagaaacgcccacatgaagagacacagactgcaggaccacgtggagcccatcatcagagtgaagtggcccgtgaagcccttccagctgaaggaggaggagctgggcgccgacatcggccccctgcagtggtag

SEQ ID NO: 10647 - DNA, 1803 bp, Artificial Sequence
  Description of Artificial Sequence: Synthetic coding sequence
atggccgccagcgcccaggtgagcgtgaccttcgaggacgtggccgtgaccttcacccaggaggagtggggccagctggacgccgcccagagaaccctgtaccaggaggtgatgctggagacctgcggcctgctgatgagcctgggctgccccctgttcaagcccgagctgatctaccagctggaccacagacaggagctgtggatggccaccaaggacctgagccagagcagctaccccggcgacaacaccaagcccaagaccaccgagcccaccttcagccacctggccctgcccgaggaggtgctgctgcaggagcagctgacccagggcgccagcaagaacagccagctgggccagagcaaggaccaggacggccccagcgagatgcaggaggtgcacctgaagatcggcatcggcccccagagaggcaagctgctggagaagatgagcagcgagagagacggcctgggcagcgacgacggcgtgtgcaccaagatcacccagaagcaggtgagcaccgagggcgacctgtacgagtgcgacagccacggccccgtgaccgacgccctgatcagagaggagaagaacagctacaagtgcgaggagtgcggcaaggtgttcaagaagaacgccctgctggtgcagcacgagagaatccacacccaggtgaagccctacgagtgcaccgagtgcggcaagaccttcagcaagagcacccacctgctgcagcacctgatcatccacaccggcgagaagccctacaagtgcatggagtgcggcaaggccttcaacagaagaagccacctgaccagacaccagagaatccacagcggcgagaagccctacaagtgcagcgagtgcggcaaggccttcacccacagaagcaccttcgtgctgcaccacagaagccacaccggcgagaagcccttcgtgtgcaaggagtgcggcaaggccttcagagacagacccggcttcatcagacactacatcatccacaccggcgagaagccctacgagtgcatcgagtgcggcaaggccttcaacagaagaagctacctgacctggcaccagcagatccacaccggcgtgaagcccttcgagtgcaacgagtgcggcaaggccttctgcgagagcgccgacctgatccagcactacatcatccacaccggcgagaagccctacaagtgcatggagtgcggcaaggccttcaacagaagaagccacctgaagcagcaccagagaatccacaccggcgagaagccctacgagtgcagcgagtgcggcaaggccttcacccactgcagcaccttcgtgctgcacaagagaacccacaccggcgagaagccctacgagtgcaaggagtgcggcaaggccttcagcgacagagccgacctgatcagacacttcagcatccacaccggcgagaagccctacgagtgcgtggagtgcggcaaggccttcaacagaagcagccacctgaccagacaccagcagatccacaccggcgagaagccctacgagtgcatccagtgcggcaaggccttctgcagaagcgccaacctgatcagacacagcatcatccacaccggcgagaagccctacgagtgcagcgagtgcggcaaggccttcaacagaggcagcagcctgacccaccaccagagaatccacaccggcagaaaccccaccatcgtgaccgacgtgggcagacccttcatgaccgcccagaccagcgtgaacatccaggagctgctgctgggcaaggagttcctgaacatcaccaccgaggagaacctgtggtag

SEQ ID NO: 10648 - DNA, 2148 bp, Artificial Sequence
  Description of Artificial Sequence: Synthetic coding sequence
atggaggccagaagcatgctggtgcccccccaggccagcgtgtgcttcgaggacgtggccatggccttcacccaggaggagtgggagcagctggacctggcccagagaaccctgtacagagaggtgaccctggagacctgggagcacatcgtgagcctgggcctgttcctgagcaagagcgacgtgatcagccagctggagcaggaggaggacctgtgcagagccgagcaggaggcccccagagactggaaggccaccctggaggagaacagactgaacagcgagaaggacagagccagagaggagctgagccaccacgtggaggtgtacagaagcggccccgaggagccccccagcctggtgctgggcaaggtgcaggaccagagcaaccagctgagagagcaccaggagaacagcctgagattcatggtgctgaccagcgagagactgttcgcccagagagagcactgcgagctggagctgggcggcggctacagcctgcccagcaccctgagcctgctgcccaccaccctgcccaccagcaccggcttccccaagcccaacagccaggtgaaggagctgaagcagaacagcgccttcatcaaccacgagaagaacggcgccgacggcaagcactgcgagagccaccagtgcgccagagccttctgccagagcatctacctgagcaagctgggcaacgtggagaccggcaagaagaacccctacgagtacatcgtgagcggcgacagcctgaactacggcagcagcctgtgcttccacggcagaaccttcagcgtgaagaagagcgacgactgcaaggactacggcaacctgttcagccacagcgtgagcctgaacgagcagaagcccgtgcacttcggcaagagccagtacgagtgcgacgagtgcagagagacctgcagcgagagcctgtgcctggtgcagaccgagagaagcggccccggcgagacccccttcagatgcgaggagagatgcgccgccttccccatggccagcagcttcagcgactgcaacatcatccagaccaccgagaagcccagcgtgtgcaaccagtgcggcaagagcttcagctgctgcaagctgatccaccagagaacccacaccggcgagaagcccttcgagtgcacccagtgcggcaagagcttcagccagagctacgacctggtgatccaccagagaacccacaccggcgagaagccctacgagtgcgacctgtgcggcaagagcttcacccagagaagcaagctgatcacccaccagagaatccacaccggcgagaagccctaccagtgcatcgagtgcagaaagagcttcagatggaacagcaacctgatcgtgcaccagagaatccacaccggcgagaagccctacgagtgcacccactgcggcaagagcttcagccagagctacgagctggtgacccacaagagaacccacaccggcgagaagcccttcaagtgcacccagtgcggcaagagcttcagccagaagtacgacctggtggtgcaccagagaacccacaccggcgagaagccctacgagtgcaacctgtgcggcaagagcttcagccagagcagcaagctgatcacccaccagagaatccacaccggcgagaagccctaccagtgcatcgagtgcggcaagagcttcagatggaacagcaacctggtgatccaccagagaatccacaccggcgagaagccctacgactgcacccactgcggcaagagcttcagccagagctaccagctggtggcccacaagagaacccacaccggcgagaagccctacgagtgcaacgagtgcggcaaggccttcaacagaagcacccagctgatcagacacctgcagatccacaccggcgagaagccctacaagtgcaaccagtgcaacaaggccttcgccagaagcagctacctggtgatgcaccagagaacccacaccggcgagaagcccttcgagtgcagccagtgcggcaaggccttcagcggcagcagcaacctgctgagccaccacagaatccacagcggcgagaagccctacgagtgcagcgactgcggcaagagcttcagacagcagagccagctggtggtgcacagaagaacccacaccggcgagaagccctag

SEQ ID NO: 10649 - DNA, 321 bp, Artificial Sequence
  Description of Artificial Sequence: Synthetic coding sequence
atggaggccagaagcatgctggtgcccccccaggccagcgtgtgcttcgaggacgtggccatggccttcacccaggaggagtgggagcagctggacctggcccagagaaccctgtacagagaggtgaccctggagacctgggagcacatcgtgagcctgggcctgttcctgagcaagagcgacgtgatcagccagctggagcaggaggaggacctgtgcagagccgagcaggaggcccccagaggcaccagcggcctgagccaggtgaccggcgtggtggccgacggcagcttcagattccccgtgtgggacttcacctag

SEQ ID NO: 10650 - DNA, 2064 bp, Artificial Sequence
  Description of Artificial Sequence: Synthetic coding sequence
atggaggccagaagcatgctggtgcccccccaggccagcgtgtgcttcgaggacgtggccatggccttcacccaggaggagtgggagcagctggacctggcccagagaaccctgtacagagaggtgaccctggagacctgggagcacatcgtgagcctggactggaaggccaccctggaggagaacagactgaacagcgagaaggacagagccagagaggagctgagccaccacgtggaggtgtacagaagcggccccgaggagccccccagcctggtgctgggcaaggtgcaggaccagagcaaccagctgagagagcaccaggagaacagcctgagattcatggtgctgaccagcgagagactgttcgcccagagagagcactgcgagctggagctgggcggcggctacagcctgcccagcaccctgagcctgctgcccaccaccctgcccaccagcaccggcttccccaagcccaacagccaggtgaaggagctgaagcagaacagcgccttcatcaaccacgagaagaacggcgccgacggcaagcactgcgagagccaccagtgcgccagagccttctgccagagcatctacctgagcaagctgggcaacgtggagaccggcaagaagaacccctacgagtacatcgtgagcggcgacagcctgaactacggcagcagcctgtgcttccacggcagaaccttcagcgtgaagaagagcgacgactgcaaggactacggcaacctgttcagccacagcgtgagcctgaacgagcagaagcccgtgcacttcggcaagagccagtacgagtgcgacgagtgcagagagacctgcagcgagagcctgtgcctggtgcagaccgagagaagcggccccggcgagacccccttcagatgcgaggagagatgcgccgccttccccatggccagcagcttcagcgactgcaacatcatccagaccaccgagaagcccagcgtgtgcaaccagtgcggcaagagcttcagctgctgcaagctgatccaccagagaacccacaccggcgagaagcccttcgagtgcacccagtgcggcaagagcttcagccagagctacgacctggtgatccaccagagaacccacaccggcgagaagccctacgagtgcgacctgtgcggcaagagcttcacccagagaagcaagctgatcacccaccagagaatccacaccggcgagaagccctaccagtgcatcgagtgcagaaagagcttcagatggaacagcaacctgatcgtgcaccagagaatccacaccggcgagaagccctacgagtgcacccactgcggcaagagcttcagccagagctacgagctggtgacccacaagagaacccacaccggcgagaagcccttcaagtgcacccagtgcggcaagagcttcagccagaagtacgacctggtggtgcaccagagaacccacaccggcgagaagccctacgagtgcaacctgtgcggcaagagcttcagccagagcagcaagctgatcacccaccagagaatccacaccggcgagaagccctaccagtgcatcgagtgcggcaagagcttcagatggaacagcaacctggtgatccaccagagaatccacaccggcgagaagccctacgactgcacccactgcggcaagagcttcagccagagctaccagctggtggcccacaagagaacccacaccggcgagaagccctacgagtgcaacgagtgcggcaaggccttcaacagaagcacccagctgatcagacacctgcagatccacaccggcgagaagccctacaagtgcaaccagtgcaacaaggccttcgccagaagcagctacctggtgatgcaccagagaacccacaccggcgagaagcccttcgagtgcagccagtgcggcaaggccttcagcggcagcagcaacctgctgagccaccacagaatccacagcggcgagaagccctacgagtgcagcgactgcggcaagagcttcagacagcagagccagctggtggtgcacagaagaacccacaccggcgagaagccctag

SEQ ID NO: 10651 - DNA, 804 bp, Artificial Sequence
  Description of Artificial Sequence: Synthetic coding sequence
atggccagcagcttcagcgactgcaacatcatccagaccaccgagaagcccagcgtgtgcaaccagtgcggcaagagcttcagctgctgcaagctgatccaccagagaacccacaccggcgagaagcccttcgagtgcacccagtgcggcaagagcttcagccagagctacgacctggtgatccaccagagaacccacaccggcgagaagccctacgagtgcgacctgtgcggcaagagcttcacccagagaagcaagctgatcacccaccagagaatccacaccggcgagaagccctaccagtgcatcgagtgcagaaagagcttcagatggaacagcaacctgatcgtgcaccagagaatccacaccggcgagaagccctacgagtgcacccactgcggcaagagcttcagccagagctacgagctggtggcccacaagagaacccacaccggcgagaagccctacgagtgcaacgagtgcggcaaggccttcaacagaagcacccagctgatcagacacctgcagatccacaccggcgagaagccctacaagtgcaaccagtgcaacaaggccttcgccagaagcagctacctggtgatgcaccagagaacccacaccggcgagaagcccttcgagtgcagccagtgcggcaaggccttcagcggcagcagcaacctgctgagccaccacagaatccacagcggcgagaagccctacgagtgcagcgactgcggcaagagcttcagacagcagagccagctggtggtgcacagaagaacccacaccggcgagaagccctag

SEQ ID NO: 10652 - DNA, 2511 bp, Artificial Sequence
  Description of Artificial Sequence: Synthetic coding sequence
atgcaggtggacccccccctgcacggcccccccaacgacttcctgatcttccagatcatccccctgcacagcctgagcatcatgcccagattcctgtggatcctgtgcttcagcatggaggagacccagggcgagctgaccagcagctgcggcagcaagaccatggccaacgtgagcctggccttcagagacgtgagcatcgacctgagccaggaggagtgggagtgcctggacgccgtgcagagagacctgtacaaggacgtgatgctggagaactacagcaacctggtgagcctgggctacaccatccccaagcccgacgtgatcaccctgctggagcaggagaaggagccctggatcgtgatgagagagggcaccagaaactggttcaccgacctggagtacaagtacatcaccaagaacctgctgagcgagaagaacgtgtgcaagatctacctgagccagctgcagaccggcgagaagagcaagaacaccatccacgaggacaccatcttcagaaacggcctgcagtgcaagcacgagttcgagagacaggagagacaccagatgggctgcgtgagccagatgctgatccagaagcagatcagccaccccctgcaccccaagatccacgccagagagaagagctacgagtgcaaggagtgcagaaaggccttcagacagcagagctacctgatccagcacctgagaatccacaccggcgagagaccctacaagtgcatggagtgcggcaaggccttctgcagagtgggcgacctgagagtgcaccacaccatccacgccggcgagagaccctacgagtgcaaggagtgcggcaaggccttcagactgcactaccacctgaccgagcaccagagaatccacagcggcgtgaagccctacgagtgcaaggagtgcggcaaggccttcagcagagtgagagacctgagagtgcaccagaccatccacgccggcgagagaccctacgagtgcaaggagtgcggcaaggccttcagactgcactaccagctgaccgagcaccagagaatccacaccggcgagagaccctacgagtgcaaggtgtgcggcaagaccttcagagtgcagagacacatcagccagcaccagaagatccacaccggcgtgaagccctacaagtgcaacgagtgcggcaaggccttcagccacggcagctacctggtgcagcaccagaagatccacaccggcgagaagccctacgagtgcaaggagtgcggcaagagcttcagcttccacgccgagctggccagacacagaagaatccacaccggcgagaagccctacgagtgcagagagtgcggcaaggccttcagactgcagaccgagctgaccagacaccacagaacccacaccggcgagaagccctacgagtgcaaggagtgcggcaaggccttcatctgcggctaccagctgaccctgcacctgagaacccacaccggcgagatcccctacgagtgcaaggagtgcggcaagaccttcagcagcagataccacctgacccagcactacagaatccacaccggcgagaagccctacatctgcaacgagtgcggcaaggccttcagactgcagggcgagctgaccagacaccacagaatccacacctgcgagaagccctacgagtgcaaggagtgcggcaaggccttcatccacagcaaccagttcatcagccaccagagaatccacaccagcgagagcacctacatctgcaaggagtgcggcaagatcttcagcagaagatacaacctgacccagcacttcaagatccacaccggcgagaagccctacatctgcaacgagtgcggcaaggccttcagattccagaccgagctgacccagcaccacagaatccacaccggcgagaagccctacaagtgcaccgagtgcggcaaggccttcatcagaagcacccacctgacccagcaccacagaatccacaccggcgagaagccctacgagtgcaccgagtgcggcaagaccttcagcagacactaccacctgacccagcaccacagaggccacaccggcgagaagccctacatctgcaacgagtgcggcaacgccttcatctgcagctacagactgaccctgcaccagagaatccacaccggcgagctgccctacgagtgcaaggagtgcggcaagaccttcagcagaagataccacctgacccagcacttcagactgcacaccggcgagaagccctacagctgcaaggagtgcggcaacgccttcagactgcaggccgagctgaccagacaccacatcgtgcacaccggcgagaagccctacaagtgcaaggagtgcggcaaggccttcagcgtgaacagcgagctgaccagacaccacagaatccacaccggcgagaagccctaccagtgcaaggagtgcggcaaggccttcatcagaagcgaccagctgaccctgcaccagagaaaccacatcagcgaggaggtgctgtgcatcatgtag

SEQ ID NO: 10653 - DNA, 1344 bp, Artificial Sequence
  Description of Artificial Sequence: Synthetic coding sequence
aagaccttcagagtgcagagacacatcagccagcaccagaagatccacaccggcgtgaagccctacaagtgcaacgagtgcggcaaggccttcagccacggcagctacctggtgcagcaccagaagatccacaccggcgagaagccctacgagtgcaaggagtgcggcaagagcttcagcttccacgccgagctggccagacacagaagaatccacaccggcgagaagccctacgagtgcagagagtgcggcaaggccttcagactgcagaccgagctgaccagacaccacagaacccacaccggcgagaagccctacgagtgcaaggagtgcggcaaggccttcatctgcggctaccagctgaccctgcacctgagaacccacaccggcgagatcccctacgagtgcaaggagtgcggcaagaccttcagcagcagataccacctgacccagcactacagaatccacaccggcgagaagccctacgagtgcaaggagtgcggcaaggccttcatccacagcaaccagttcatcagccaccagagaatccacaccagcgagagcacctacatctgcaaggagtgcggcaagatcttcagcagaagatacaacctgacccagcacttcaagatccacaccggcgagaagccctacatctgcaacgagtgcggcaaggccttcagattccagaccgagctgacccagcaccacagaatccacaccggcgagaagccctacaagtgcaccgagtgcggcaaggccttcatcagaagcacccacctgacccagcaccacagaatccacaccggcgagaagccctacgagtgcaccgagtgcggcaagaccttcagcagacactaccacctgacccagcaccacagaggccacaccggcgagaagccctacatctgcaacgagtgcggcaacgccttcatctgcagctacagactgaccctgcaccagagaatccacaccggcgagctgccctacgagtgcaaggagtgcggcaagaccttcagcagaagataccacctgacccagcacttcagactgcacaccggcgagaagccctacagctgcaaggagtgcggcaacgccttcagactgcaggccgagctgaccagacaccacatcgtgcacaccggcgagaagccctacaagtgcaaggagtgcggcaaggccttcagcgtgaacagcgagctgaccagacaccacagaatccacaccggcgagaagccctaccagtgcaaggagtgcggcaaggccttcatcagaagcgaccagctgaccctgcaccagagaaaccacatcagcgacagagagttcgtgatctgcaaggagtag

SEQ ID NO: 10654 - DNA, 1209 bp, Artificial Sequence
  Description of Artificial Sequence: Synthetic coding sequence
atggccgagatgaaccccgcccagggccacgtggtgttcgaggacgtggccatctacttcagccaggaggagtggggccacctggacgaggcccagagactgctgtacagagacgtgatgctggagaacctggccctgctgagcagcctgggctgctgccacggcgccgaggacgaggaggcccccctggagcccggcgtgagcgtgggcgtgagccaggtgatggcccccaagccctgcctgagcacccagaacacccagccctgcgagacctgcagcagcctgctgaaggacatcctgagactggccgagcacgacggcacccaccccgagcagggcctgtacacctgccccgcccacctgcaccagcaccagaaggagcagatcagagagaagctgagcagaggcgacggcggcagacccaccttcgtgaagaaccacagagtgcacatggccggcaagaccttcctgtgcagcgagtgcggcaaggccttcagccacaagcacaagctgagcgaccaccagaagatccacaccggcgagagaacctacaagtgcagcaagtgcggcatcctgttcatggagagaagcaccctgaacagacaccagagaacccacaccggcgagagaccctacgagtgcaacgagtgcggcaaggccttcctgtgcaagagccacctggtgagacaccagaccatccacagcggcgagagaccctacgagtgcagcgagtgcggcaagctgttcatgtggagcagcaccctgatcacccaccagagagtgcacaccggcaagagaccctacggctgcagcgagtgcggcaagttcttcaagtgcaacagcaacctgttcagacactacagaatccacaccggcaagagaagctacggctgcagcgagtgcggcaagttcttcatggagagaagcaccctgagcagacaccagagagtgcacaccggcgagagaccctacgagtgcaacgagtgcggcaagttcttcagcctgaagagcgtgctgatccagcaccagagagtgcacaccggcgagagaccctacgagtgcagcgagtgcggcaaggccttcctgaccaagagccacctgatctgccaccagaccgtgcacaccgccgccaagcagtgcagcgagtgcggcaagttcttcagatacaacagcaccctgctgagacaccagaaggtgcacaccggctag

SEQ ID NO: 10655 - DNA, 1065 bp, Artificial Sequence
  Description of Artificial Sequence: Synthetic coding sequence
atggccgagatgaaccccgcccagggccacgtggtgttcgaggacgtggccatctacttcagccaggaggagtggggccacctggacgaggcccagagactgctgtacagagacgtgatgctggagaacctggccctgctgagcagcctgggctgctgccacggcgccgaggacgaggaggcccccctggagcccggcgtgagcgtgggcgtgagccaggtgatggcccccaagccctgcctgagcacccagaacacccagccctgcgagacctgcagcagcctgctgaaggacatcctgagactggccgagcacgacggcacccaccccgagcagggcctgtacacctgccccgcccacctgcaccagcaccagaaggagcagatcagagagaagctgagcagaggcgacggcggcagacccaccttcgtgaagaaccacagagtgcacatggccggcaagaccttcctgtgcagcgagtgcggcaaggccttcagccacaagcacaagctgagcgaccaccagaagatccacaccggcgagagaacctacaagtgcagcaagtgcggcatcctgttcatggagagaagcaccctgaacagacaccagagaacccacaccggcgagagaccctacgagtgcaacgagtgcggcaaggccttcctgtgcaagagccacctggtgagacaccagaccatccacagcggcgagagaccctacgagtgcagcgagtgcggcaagctgttcatgtggagcagcaccctgatcacccaccagagagtgcacaccggcaagagaccctacggctgcagcgagtgcggcaagttcttcaagtgcaacagcaacctgttcagacactacagaatccacaccggcaagagaagctacggctgcagcgagtgcggcaagttcttcatggagagaagcaccctgagcagacaccagagagtgcacaccggcgagagaccctacgagtgcaacgagtgcggcaagttcttcagcctgaagagcgtgctgatccagcaccagagaagagtgtacaccgaggaggagagcttccagtag

SEQ ID NO: 10656 - DNA, 1638 bp, Artificial Sequence
  Description of Artificial Sequence: Synthetic coding sequence
atgaacctgaccgagggccccctggccatggccgagatggaccccacccagggcagagtggtgttcgaggacgtggccatctacttcagccaggaggagtggggccacctggacgaggcccagagactgctgtacagagacgtgatgctggagaacctggccctgctgagcagcctgggcagctggcacggcgccgaggacgaggaggcccccagccagcagggcttcagcgtgggcgtgagcgaggtgaccgccagcaagccctgcctgagcagccagaaggtgcaccccagcgagacctgcggcccccccctgaaggacatcctgtgcctggtggagcacaacggcatccaccccgagcagcacatctacatctgcgaggccgagctgttccagcaccccaagcagcagatcggcgagaacctgagcagaggcgacgactggatccccagcttcggcaagaaccacagagtgcacatggccgaggagatcttcacctgcatggagggctggaaggacctgcccgccaccagctgcctgctgcagcaccagggcccccagagcgagtggaagccctacagagacaccgaggacagagaggccttccagaccggccagaacgactacaagtgcagcgagtgcggcaagaccttcacctgcagctacagcttcgtggagcaccagaagatccacaccggcgagagaagctacgagtgcaacaagtgcggcaagttcttcaagtacagcgccaacttcatgaagcaccagaccgtgcacaccagcgagagaacctacgagtgcagagagtgcggcaagagcttcatgtacaactacagactgatgagacacaagagagtgcacaccggcgagagaccctacgagtgcaacacctgcggcaagttcttcagatacagcagcaccttcgtgagacaccagagagtgcacaccggcgagagaccctacgagtgcagagagtgcggcaagttcttcatggacagcagcaccctgatcaagcaccagagagtgcacaccggcgagagaccctacaagtgcaacgactgcggcaagttcttcagatacatcagcaccctgatcagacaccagagaatccacaccggcgagagaccctacgagtgcagcgtgtgcggcgagctgttcagatacaacagcagcctggtgaagcactggagaaaccacaccggcgagagaccctacaagtgcagcgagtgcggcaagagcttcagataccactgcagactgatcagacaccagagagtgcacaccggcgagagaccctacgagtgcagcgagtgcggcaagttcttcagatacaacagcaacctgatcaagcactggagaaaccacaccggcgagagaccctacgagtgcagagagtgcggcaaggccttcagccacaagcacatcctggtggagcaccagaagatccacagcggcgagagaccctacgagtgcagcgagtgccagaaggccttcatcagaaagagccacctggtgcaccaccagaagatccacagcgaggagagactggtgtgcagcatgaacgtgggcaacagcctggccaagacccccaccagcctgaacatcagagacttcaccatggagaaggtgtaccactag

SEQ ID NO: 10657 - DNA, 1602 bp, Artificial Sequence
  Description of Artificial Sequence: Synthetic coding sequence
atgaacctgaccgagggcagagtggtgttcgaggacgtggccatctacttcagccaggaggagtggggccacctggacgaggcccagagactgctgtacagagacgtgatgctggagaacctggccctgctgagcagcctgggcagctggcacggcgccgaggacgaggaggcccccagccagcagggcttcagcgtgggcgtgagcgaggtgaccgccagcaagccctgcctgagcagccagaaggtgcaccccagcgagacctgcggcccccccctgaaggacatcctgtgcctggtggagcacaacggcatccaccccgagcagcacatctacatctgcgaggccgagctgttccagcaccccaagcagcagatcggcgagaacctgagcagaggcgacgactggatccccagcttcggcaagaaccacagagtgcacatggccgaggagatcttcacctgcatggagggctggaaggacctgcccgccaccagctgcctgctgcagcaccagggcccccagagcgagtggaagccctacagagacaccgaggacagagaggccttccagaccggccagaacgactacaagtgcagcgagtgcggcaagaccttcacctgcagctacagcttcgtggagcaccagaagatccacaccggcgagagaagctacgagtgcaacaagtgcggcaagttcttcaagtacagcgccaacttcatgaagcaccagaccgtgcacaccagcgagagaacctacgagtgcagagagtgcggcaagagcttcatgtacaactacagactgatgagacacaagagagtgcacaccggcgagagaccctacgagtgcaacacctgcggcaagttcttcagatacagcagcaccttcgtgagacaccagagagtgcacaccggcgagagaccctacgagtgcagagagtgcggcaagttcttcatggacagcagcaccctgatcaagcaccagagagtgcacaccggcgagagaccctacaagtgcaacgactgcggcaagttcttcagatacatcagcaccctgatcagacaccagagaatccacaccggcgagagaccctacgagtgcagcgtgtgcggcgagctgttcagatacaacagcagcctggtgaagcactggagaaaccacaccggcgagagaccctacaagtgcagcgagtgcggcaagagcttcagataccactgcagactgatcagacaccagagagtgcacaccggcgagagaccctacgagtgcagcgagtgcggcaagttcttcagatacaacagcaacctgatcaagcactggagaaaccacaccggcgagagaccctacgagtgcagagagtgcggcaaggccttcagccacaagcacatcctggtggagcaccagaagatccacagcggcgagagaccctacgagtgcagcgagtgccagaaggccttcatcagaaagagccacctggtgcaccaccagaagatccacagcgaggagagactggtgtgcagcatgaacgtgggcaacagcctggccaagacccccaccagcctgaacatcagagacttcaccatggagaaggtgtaccactag

SEQ ID NO: 10658 - DNA, 1884 bp, Artificial Sequence
  Description of Artificial Sequence: Synthetic coding sequence
atggccgaggccgccctggtgatcaccccccagggccacgtgaccttcgaggacatcgccgtgtacttcagccaggaggagtggggcctgctggacgaggcccagagatgcctgtaccacgacgtgatgctggagaacttcagcctgatggccagcgtgggctgcctgcacggcatcgaggccgaggaggcccccagcgagcagaccctgagcgcccagggcgtgagccaggccagaacccccaagctgggccccagcatccccaacgcccacagctgcgagatgtgcatcctggtgatgaaggacatcctgtacctgagcgagcaccagggcaccctgccctggcagaagccctacaccagcgtggccagcggcaagtggttcagcttcggcagcaacctgcagcagcaccagaaccaggacagcggcgagaagcacatcagaaaggaggagagcagcgccctgctgctgaacagctgcaagatccccctgagcgacaacctgttcccctgcaaggacgtggagaaggacttccccaccatcctgggcctgctgcagcaccagaccacccacagcagacaggagtacgcccacagaagcagagagaccttccagcagagaagatacaagtgcgagcaggtgttcaacgagaaggtgcacgtgaccgagcaccagagagtgcacaccggcgagaaggcctacaagagaagagagtacggcaagagcctgaacagcaagtacctgttcgtggagcaccagagaacccacaacgccgagaagccctacgtgtgcaacatctgcggcaagagcttcctgcacaagcagaccctggtgggccaccagcagagaatccacaccagagagagaagctacgtgtgcatcgagtgcggcaagagcctgagcagcaagtacagcctggtggagcaccagagaacccacaacggcgagaagccctacgtgtgcaacgtgtgcggcaagagcttcagacacaagcagaccttcgtgggccaccagcagagaatccacaccggcgagagaccctacgtgtgcatggagtgcggcaagagcttcatccacagctacgacagaatcagacaccagagagtgcacaccggcgagggcgcctaccagtgcagcgagtgcggcaagagcttcatctacaagcagagcctgctggaccaccacagaatccacaccggcgagagaccctacgagtgcaaggagtgcggcaaggccttcatccacaagaagagactgctggagcaccagagaatccacaccggcgagaagccctacgtgtgcatcatctgcggcaagagcttcatcagaagcagcgactacatgagacaccagagaatccacaccggcgagagagcctacgagtgcagcgactgcggcaaggccttcatcagcaagcagaccctgctgaagcaccacaagatccacaccagagagagaccctacgagtgcagcgagtgcggcaagggcttctacctggaggtgaagctgctgcagcaccagagaatccacaccagagagcagctgtgcgagtgcaacgagtgcggcaaggtgttcagccaccagaagagactgctggagcaccagaaggtgcacaccggcgagaagccctgcgagtgcagcgagtgcggcaagtgcttcagacacagaaccagcctgatccagcaccagaaggtgcacagcggcgagagaccctacaactgcaccgcctgcgagaaggccttcatctacaagaacaagctggtggagcaccagagaatccacaccggcgagaagccctacgagtgcggcaagtgcggcaaggccttcaacaagagatacagcctggtgagacaccagaaggtgcacatcaccgaggagccctag

SEQ ID NO: 10659 - DNA, 1923 bp, Artificial Sequence
  Description of Artificial Sequence: Synthetic coding sequence
atggccgaggccgccctggtgatcaccccccagatccccatggtgaccgaggagttcgtgaagcccagccagggccacgtgaccttcgaggacatcgccgtgtacttcagccaggaggagtggggcctgctggacgaggcccagagatgcctgtaccacgacgtgatgctggagaacttcagcctgatggccagcgtgggctgcctgcacggcatcgaggccgaggaggcccccagcgagcagaccctgagcgcccagggcgtgagccaggccagaacccccaagctgggccccagcatccccaacgcccacagctgcgagatgtgcatcctggtgatgaaggacatcctgtacctgagcgagcaccagggcaccctgccctggcagaagccctacaccagcgtggccagcggcaagtggttcagcttcggcagcaacctgcagcagcaccagaaccaggacagcggcgagaagcacatcagaaaggaggagagcagcgccctgctgctgaacagctgcaagatccccctgagcgacaacctgttcccctgcaaggacgtggagaaggacttccccaccatcctgggcctgctgcagcaccagaccacccacagcagacaggagtacgcccacagaagcagagagaccttccagcagagaagatacaagtgcgagcaggtgttcaacgagaaggtgcacgtgaccgagcaccagagagtgcacaccggcgagaaggcctacaagagaagagagtacggcaagagcctgaacagcaagtacctgttcgtggagcaccagagaacccacaacgccgagaagccctacgtgtgcaacatctgcggcaagagcttcctgcacaagcagaccctggtgggccaccagcagagaatccacaccagagagagaagctacgtgtgcatcgagtgcggcaagagcctgagcagcaagtacagcctggtggagcaccagagaacccacaacggcgagaagccctacgtgtgcaacgtgtgcggcaagagcttcagacacaagcagaccttcgtgggccaccagcagagaatccacaccggcgagagaccctacgtgtgcatggagtgcggcaagagcttcatccacagctacgacagaatcagacaccagagagtgcacaccggcgagggcgcctaccagtgcagcgagtgcggcaagagcttcatctacaagcagagcctgctggaccaccacagaatccacaccggcgagagaccctacgagtgcaaggagtgcggcaaggccttcatccacaagaagagactgctggagcaccagagaatccacaccggcgagaagccctacgtgtgcatcatctgcggcaagagcttcatcagaagcagcgactacatgagacaccagagaatccacaccggcgagagagcctacgagtgcagcgactgcggcaaggccttcatcagcaagcagaccctgctgaagcaccacaagatccacaccagagagagaccctacgagtgcagcgagtgcggcaagggcttctacctggaggtgaagctgctgcagcaccagagaatccacaccagagagcagctgtgcgagtgcaacgagtgcggcaaggtgttcagccaccagaagagactgctggagcaccagaaggtgcacaccggcgagaagccctgcgagtgcagcgagtgcggcaagtgcttcagacacagaaccagcctgatccagcaccagaaggtgcacagcggcgagagaccctacaactgcaccgcctgcgagaaggccttcatctacaagaacaagctggtggagcaccagagaatccacaccggcgagaagccctacgagtgcggcaagtgcggcaaggccttcaacaagagatacagcctggtgagacaccagaaggtgcacatcaccgaggagccctag

SEQ ID NO: 10660 - DNA, 1173 bp, Artificial Sequence
  Description of Artificial Sequence: Synthetic coding sequence
atggccgagaccaaggacgccgcccagatgctggtgaccttcaaggacgtggccgtgaccttcaccagagaggagtggagacagctggacctggcccagagaaccctgtacagagaggtgatgctggagacctgcggcctgctggtgagcctgggcgacagagcccaggtgcacaccagagagcccaccacctacccccccgtgctgagcgagagagccttcctgagaggcagcctgaccctggagagcagcaccagcagcgacagcagactgggcagagccagagacgaggagggcctgctggagatgcagaagggcaaggtgacccccgagaccgacctgcacaaggagacccacctgggcaaggtgagcctggagggcgagggcctgggcaccgacgacggcctgcacagcagagccctgcaggagtggctgagcgccgacgtgctgcacgagtgcgacagccagcagcccggcaaggacgccctgatccacgccggcaccaacccctacaagtgcaagcagtgcggcaagggcttcaacagaaagtggtacctggtgagacaccagagagtgcacaccggcatgaagccctacgagtgcaacgcctgcggcaaggccttcagccagagcagcaccctgatcagacactacctgatccacaccggcgagaagccctacaagtgcctggagtgcggcaaggccttcaagagaagaagctacctgatgcagcaccaccccatccacaccggcgagaagccctacgagtgcagccagtgcagaaaggccttcacccacagaagcaccttcatcagacacaacagaacccacaccggcgagaagcccttcgagtgcaaggagtgcgagaaggccttcagcaacagagcccacctgatccagcactacatcatccacaccggcgagaagccctacgactgcatggcctgcggcaaggccttcagatgcagcagcgagctgatccagcaccagagaatccacaccggcgagaagccctacgagtgcacccagtgcggcaaggccttccacagaagcacctacctgatccagcacagcgtgatccacaccggcgagatgccctacaagtgcatcgagtgcggcaaggccttcaagagaagaagccacctgctgcagcaccagagagtgcacacctag

SEQ ID NO: 10661 - DNA, 1269 bp, Artificial Sequence
  Description of Artificial Sequence: Synthetic coding sequence
atggccgagaccaaggacgccgcccagatgctggtgaccttcaaggacgtggccgtgaccttcaccagagaggagtggagacagctggacctggcccagagaaccctgtacagagaggtgatgctggagacctgcggcctgctggtgagcctgggccacagagtgcccaagcccgagctggtgcacctgctggagcacggccaggagctgtggatcgtgaagagaggcctgagccacgccacctgcgccggcgacagagcccaggtgcacaccagagagcccaccacctacccccccgtgctgagcgagagagccttcctgagaggcagcctgaccctggagagcagcaccagcagcgacagcagactgggcagagccagagacgaggagggcctgctggagatgcagaagggcaaggtgacccccgagaccgacctgcacaaggagacccacctgggcaaggtgagcctggagggcgagggcctgggcaccgacgacggcctgcacagcagagccctgcaggagtggctgagcgccgacgtgctgcacgagtgcgacagccagcagcccggcaaggacgccctgatccacgccggcaccaacccctacaagtgcaagcagtgcggcaagggcttcaacagaaagtggtacctggtgagacaccagagagtgcacaccggcatgaagccctacgagtgcaacgcctgcggcaaggccttcagccagagcagcaccctgatcagacactacctgatccacaccggcgagaagccctacaagtgcctggagtgcggcaaggccttcaagagaagaagctacctgatgcagcaccaccccatccacaccggcgagaagccctacgagtgcagccagtgcagaaaggccttcacccacagaagcaccttcatcagacacaacagaacccacaccggcgagaagcccttcgagtgcaaggagtgcgagaaggccttcagcaacagagcccacctgatccagcactacatcatccacaccggcgagaagccctacgactgcatggcctgcggcaaggccttcagatgcagcagcgagctgatccagcaccagagaatccacaccggcgagaagccctacgagtgcacccagtgcggcaaggccttccacagaagcacctacctgatccagcacagcgtgatccacaccggcgagatgccctacaagtgcatcgagtgcggcaaggccttcaagagaagaagccacctgctgcagcaccagagagtgcacacctag

SEQ ID NO: 10662 - DNA, 1146 bp, Artificial Sequence
  Description of Artificial Sequence: Synthetic coding sequence
atgctggtgaccttcaaggacgtggccgtgaccttcaccagagaggagtggagacagctggacctggcccagagaaccctgtacagagaggtgatgctggagacctgcggcctgctggtgagcctgggcgacagagcccaggtgcacaccagagagcccaccacctacccccccgtgctgagcgagagagccttcctgagaggcagcctgaccctggagagcagcaccagcagcgacagcagactgggcagagccagagacgaggagggcctgctggagatgcagaagggcaaggtgacccccgagaccgacctgcacaaggagacccacctgggcaaggtgagcctggagggcgagggcctgggcaccgacgacggcctgcacagcagagccctgcaggagtggctgagcgccgacgtgctgcacgagtgcgacagccagcagcccggcaaggacgccctgatccacgccggcaccaacccctacaagtgcaagcagtgcggcaagggcttcaacagaaagtggtacctggtgagacaccagagagtgcacaccggcatgaagccctacgagtgcaacgcctgcggcaaggccttcagccagagcagcaccctgatcagacactacctgatccacaccggcgagaagccctacaagtgcctggagtgcggcaaggccttcaagagaagaagctacctgatgcagcaccaccccatccacaccggcgagaagccctacgagtgcagccagtgcagaaaggccttcacccacagaagcaccttcatcagacacaacagaacccacaccggcgagaagcccttcgagtgcaaggagtgcgagaaggccttcagcaacagagcccacctgatccagcactacatcatccacaccggcgagaagccctacgactgcatggcctgcggcaaggccttcagatgcagcagcgagctgatccagcaccagagaatccacaccggcgagaagccctacgagtgcacccagtgcggcaaggccttccacagaagcacctacctgatccagcacagcgtgatccacaccggcgagatgccctacaagtgcatcgagtgcggcaaggccttcaagagaagaagccacctgctgcagcaccagagagtgcacacctag

SEQ ID NO: 10663 - DNA, 1965 bp, Artificial Sequence
  Description of Artificial Sequence: Synthetic coding sequence
atggccgccgtggccctgagagacagcgcccagggcatgaccttcgaggacgtggccatctacttcagccaggaggagtgggagctgctggacgagagccagagattcctgtactgcgacgtgatgctggagaacttcgcccacgtgaccagcctgggctactgccacggcatggagaacgaggccatcgccagcgagcagagcgtgagcatccaggtgagaaccagcaagggcaacacccccacccagaagacccacctgagcgagatcaagatgtgcgtgcccgtgctgaaggacatcctgcccgccgccgagcaccagaccaccagccccgtgcagaagagctacctgggcagcaccagcatgagaggcttctgcttcagcgccgacctgcaccagcaccagaagcactacaacgaggaggagccctggaagagaaaggtggacgaggccaccttcgtgaccggctgcagattccacgtgctgaactacttcacctgcggcgaggccttccccgcccccaccgacctgctgcagcacgaggccacccccagcggcgaggagccccacagcagcagcagcaagcacatccaggccttcttcaacgccaagagctactacaagtggggcgagtacagaaaggccagcagccacaagcacaccctggtgcagcaccagagcgtgtgcagcgagggcggcctgtacgagtgcagcaagtgcgagaaggccttcacctgcaagaacaccctggtgcagcaccagcagatccacaccggccagaagatgttcgagtgcagcgagtgcgaggagagcttcagcaagaagtgccacctgatcctgcacaagatcatccacaccggcgagagaccctacgagtgcagcgacagagagaaggccttcatccacaagagcgagttcatccaccaccagagaagacacaccggcggcgtgagacacgagtgcggcgagtgcagaaagaccttcagctacaagagcaacctgatcgagcaccagagagtgcacaccggcgagagaccctacgagtgcggcgagtgcggcaagagcttcagacagagcagcagcctgttcagacaccagagagtgcacagcggcgagagaccctaccagtgctgcgagtgcggcaagagcttcagacagatcttcaacctgatcagacacagaagagtgcacaccggcgagatgccctaccagtgcagcgactgcggcaagagcttcagctgcaagagcgagctgatccagcaccagagaatccacagcggcgagagaccctacgagtgcagagagtgcggcaagagcttcagacagttcagcaacctgatcagacacagaagcatccacaccggcgacagaccctacgagtgcagcgagtgcgagaagagcttcagcagaaagttcatcctgatccagcaccagagagtgcacaccggcgagagaccctacgagtgcagcgagtgcggcaagagcttcaccagaaagagcgacctgatccagcacagaagaatccacaccggcaccagaccctacgagtgcagcgagtgcggcaagagcttcagacagagaagcggcctgatccagcacagaagactgcacaccggcgagagaccctacgagtgcagcgagtgcggcaagagcttcagccagagcgccagcctgatccagcaccagagagtgcacaccggcgagagaccctacgagtgcagcgagtgcggcaagagcttcagccagagcagcagcctgatccagcaccagagaggccacaccggcgagagaccctacgagtgcagccagtgcggcaagcccttcacccacaagagcgacctgatccagcaccagagagtgcacaccggcgagagaccctacgagtgcagcgagtgcggcaagagcttcagcagaaagagcaacctgatcagacacagaagagtgcacaccgaggagagaccctag

SEQ ID NO: 10664 - DNA, 2013 bp, Artificial Sequence
  Description of Artificial Sequence: Synthetic coding sequence
atgcccgcccccgtgggcagaagaagcccccccagccccagaagcagcatggccgccgtggccctgagagacagcgcccagggcatgaccttcgaggacgtggccatctacttcagccaggaggagtgggagctgctggacgagagccagagattcctgtactgcgacgtgatgctggagaacttcgcccacgtgaccagcctgggctactgccacggcatggagaacgaggccatcgccagcgagcagagcgtgagcatccaggtgagaaccagcaagggcaacacccccacccagaagacccacctgagcgagatcaagatgtgcgtgcccgtgctgaaggacatcctgcccgccgccgagcaccagaccaccagccccgtgcagaagagctacctgggcagcaccagcatgagaggcttctgcttcagcgccgacctgcaccagcaccagaagcactacaacgaggaggagccctggaagagaaaggtggacgaggccaccttcgtgaccggctgcagattccacgtgctgaactacttcacctgcggcgaggccttccccgcccccaccgacctgctgcagcacgaggccacccccagcggcgaggagccccacagcagcagcagcaagcacatccaggccttcttcaacgccaagagctactacaagtggggcgagtacagaaaggccagcagccacaagcacaccctggtgcagcaccagagcgtgtgcagcgagggcggcctgtacgagtgcagcaagtgcgagaaggccttcacctgcaagaacaccctggtgcagcaccagcagatccacaccggccagaagatgttcgagtgcagcgagtgcgaggagagcttcagcaagaagtgccacctgatcctgcacaagatcatccacaccggcgagagaccctacgagtgcagcgacagagagaaggccttcatccacaagagcgagttcatccaccaccagagaagacacaccggcggcgtgagacacgagtgcggcgagtgcagaaagaccttcagctacaagagcaacctgatcgagcaccagagagtgcacaccggcgagagaccctacgagtgcggcgagtgcggcaagagcttcagacagagcagcagcctgttcagacaccagagagtgcacagcggcgagagaccctaccagtgctgcgagtgcggcaagagcttcagacagatcttcaacctgatcagacacagaagagtgcacaccggcgagatgccctaccagtgcagcgactgcggcaagagcttcagctgcaagagcgagctgatccagcaccagagaatccacagcggcgagagaccctacgagtgcagagagtgcggcaagagcttcagacagttcagcaacctgatcagacacagaagcatccacaccggcgacagaccctacgagtgcagcgagtgcgagaagagcttcagcagaaagttcatcctgatccagcaccagagagtgcacaccggcgagagaccctacgagtgcagcgagtgcggcaagagcttcaccagaaagagcgacctgatccagcacagaagaatccacaccggcaccagaccctacgagtgcagcgagtgcggcaagagcttcagacagagaagcggcctgatccagcacagaagactgcacaccggcgagagaccctacgagtgcagcgagtgcggcaagagcttcagccagagcgccagcctgatccagcaccagagagtgcacaccggcgagagaccctacgagtgcagcgagtgcggcaagagcttcagccagagcagcagcctgatccagcaccagagaggccacaccggcgagagaccctacgagtgcagccagtgcggcaagcccttcacccacaagagcgacctgatccagcaccagagagtgcacaccggcgagagaccctacgagtgcagcgagtgcggcaagagcttcagcagaaagagcaacctgatcagacacagaagagtgcacaccgaggagagaccctag

SEQ ID NO: 10665 - DNA, 1269 bp, Artificial Sequence
  Description of Artificial Sequence: Synthetic coding sequence
atgaccttcgaggacgtggccatctacttcagccaggaggagtgggagctgctggacgagagccagagattcctgtactgcgacgtgatgctggagaacttcgcccacgtgaccagcctggtgaccagccaccagaagcactacaacgaggaggagccctggaagagaaaggtggacgaggccaccttcgtgaccggctgcagattccacgtgctgaactacttcacctgcggcgaggccttccccgcccccaccgacctgctgcagcacgaggccacccccagcggcgaggagccccacagcagcagcagcaagcacatccaggccttcttcaacgccaagagctactacaagtggggcgagtacagaaaggccagcagccacaagcacaccctggtgcagcaccagagcagagtgcacaccggcgagagaccctacgagtgcggcgagtgcggcaagagcttcagacagagcagcagcctgttcagacaccagagagtgcacagcggcgagagaccctaccagtgctgcgagtgcggcaagagcttcagacagatcttcaacctgatcagacacagaagagtgcacaccggcgagatgccctaccagtgcagcgactgcggcaagagcttcagctgcaagagcgagctgatccagcaccagagaatccacagcggcgagagaccctacgagtgcagagagtgcggcaagagcttcagacagttcagcaacctgatcagacacagaagcatccacaccggcgacagaccctacgagtgcagcgagtgcgagaagagcttcagcagaaagttcatcctgatccagcaccagagagtgcacaccggcgagagaccctacgagtgcagcgagtgcggcaagagcttcaccagaaagagcgacctgatccagcacagaagaatccacaccggcaccagaccctacgagtgcagcgagtgcggcaagagcttcagacagagaagcggcctgatccagcacagaagactgcacaccggcgagagaccctacgagtgcagcgagtgcggcaagagcttcagccagagcgccagcctgatccagcaccagagagtgcacaccggcgagagaccctacgagtgcagcgagtgcggcaagagcttcagccagagcagcagcctgatccagcaccagagaggccacaccggcgagagaccctacgagtgcagccagtgcggcaagcccttcacccacaagagcgacctgatccagcaccagagagtgcacaccggctag

SEQ ID NO: 10666 - DNA, 1224 bp, Artificial Sequence
  Description of Artificial Sequence: Synthetic coding sequence
atggccgccgccgccctgagattccccgtgcagggcaccgtgaccttcgaggacgtggccgtgaagttcacccaggaggagtggaacctgctgagcgaggcccagagatgcctgtacagagacgtgaccctggagaacctggccctgatgagcagcctgggctgctggtgcggcgtggaggacgaggccgcccccagcaagcagagcatctacatccagagagagacccaggtgagaacccccatggccggcgtgagccccaagaaggcccacccctgcgagatgtgcggccccatcctgggcgacatcctgcacgtggccgaccaccagggcacccaccacaagcagaagctgcacagatgcgaggcctggggcaacaagctgtacgacagcggcaacttccaccagcaccagaacgagcacatcggcgagaagccctacagaggcagcgtggaggaggccctgttcgccaagagatgcaagctgcacgtgagcggcgagagcagcgtgttcagcgagagcggcaaggacttcctgctgagaagcggcctgctgcagcaggaggccacccacaccggcaagagcaacagcaagaccgagtgcgtgagcctgttccacggcggcaagagccactacagctgcggcggctgcatgaagcacttcagcaccaaggacatcctgagccagcacgagagactgctgcccaccgaggagcccagcgtgtggtgcgagtgcggcaagagcagcagcaagtacgacagcttcagcaaccaccagggcgtgcacaccagagagaagccctacacctgcggcatctgcggcaagctgttcaacagcaagagccacctgctggtgcaccagagaatccacaccggcgagaagccctacgagtgcgaggtgtgccagaagttcttcagacacaagtaccacctgatcgcccaccagagagtgcacaccggcgagagaccctacgagtgcagcgactgcggcaagagcttcacccacagcagcaccttcagagtgcacaagagagtgcacaccggccagaagccctacgagtgcagcgagtgcggcaagagcttcgccgagagcagcagcctgaccaagcacagaagagtgcacaccggcgagaagccctacggctgcagcgagtgcgagaagaagttcagacagatcagcagcctgagacaccaccagagagtgcacaagagaaagggcctgtag

SEQ ID NO: 10667 - DNA, 1617 bp, Artificial Sequence
  Description of Artificial Sequence: Synthetic coding sequence
atggtgacctgcgcccacctgggcagaagagccagactgcccgccgcccagcccagcgcctgccccggcacctgcttcagccaggaggagagaatggccgccggctacctgcccagatggagccaggagctggtgaccttcgaggacgtgagcatggacttcagccaggaggagtgggagctgctggagcccgcccagaagaacctgtacagagaggtgatgctggagaactacagaaacgtggtgagcctggaggccctgaagaaccagtgcaccgacgtgggcatcaaggagggccccctgagccccgcccagaccagccaggtgaccagcctgagcagctggaccggctacctgctgttccagcccgtggccagcagccacctggagcagagagaggccctgtggatcgaggagaagggcaccccccaggccagctgcagcgactggatgaccgtgctgagaaaccaggacagcacctacaagaaggtggccctgcaggaggagcccgccagcggcatcaacatgatcaagctgatcagagaggacggcggctggaagcagctggaggacagccacgaggacccccagggcctgctgagccagaaggccagcctgcacgtggtggccgtgccccaggagaaggccaccgcctggcacggcttcggcgagaacggcaacctgagccccgccctggtgctgagccagggcagcagcaagggcaaccacctgtgcggcagcgagctggacatcaccagcctggccagcgacagcgtgctgaaccaccaccagctgggctacgccgacagaagaccctgcgagagcaacgagtgcggcaacgccatcagacagaacagccacttcatccagcacggcggcaagatgttcgtgtacctggagaacggccagagcctgaaccacggcatggccctgaccatccacaacaagatcaacaccgccgagaagcccttcgagtgccaccagtgcggcaaggtgttcaacagaagacacagcctgagcgagcaccagagaatccacaccggcgagaagccctacgagtgccaggagtgcggcagagccttcacccacagcagcaccctgaccagacacctgagaacccacaccggcgagaagccctacggctgcggcgagtgcggcaaggccttcaacagaatcagcagcctgacccagcaccagagaatccacaccggcgagaagccctacaagtgcgaggactgcggcaagagcttctgccagagcagctacctgatcctgcacaagagaacccacaccggcgagaagccctacgagtgcagcgagtgcggcaaggccttcagcgacagaagcagcctgaaccagcacgagagaacccacaccggcgagaacccctacgagtgcaagcagtgcggcagagccttcagccagagaagcagcctggtgagacacgagagaacccacaccggcgagaagccctacagatgccaggagtgcggcaaggccttcagccagagcagcagcctggtgacccaccagaagacccacagcagccagaagacctacaagatcatcgactgcggcaaggccttctaccagaacagacacctgatcggctactag

SEQ ID NO: 10668 - DNA, 1887 bp, Artificial Sequence
  Description of Artificial Sequence: Synthetic coding sequence
atggacagcgtggtgttcgaggacgtggccgtggacttcaccctggaggagtgggccctgctggacagcgcccagagagacctgtacagagacgtgatgctggagaccttccagaacctggccagcgtggacgacgagacccagttcaaggccagcggcagcgtgagccagcaggacatctacggcgagaagatccccaaggagagcaagatcgccaccttcaccagaaacgtgagctgggccagcgtgctgggcaagatctgggacagcctgagcatcgaggaccagaccaccaaccagggcagaaacctgagcagaaaccacggcctggagagactgtgcgagagcaacgaccagtgcggcgaggccctgagccagatcccccacctgaacctgtacaagaagatcccccccggcgtgaagcagtacgagtacaacacctacggcaaggtgttcatgcacagaagaaccagcctgaagagccccatcaccgtgcacaccggccacaagccctaccagtgccaggagtgcggccaggcctacagctgcagaagccacctgagaatgcacgtgagaacccacaacggcgagagaccctacgtgtgcaagctgtgcggcaagaccttccccagaaccagcagcctgaacagacacgtgagaatccacaccgccgagaagacctacgagtgcaagcagtgcggcaaggccttcatcgacttcagcagcctgaccagccacctgagaagccacaccggcgagaagccctacaagtgcaaggagtgcggcaaggccttcagctacagcagcaccttcagaagacacaccatcacccacaccggcgagaagccctacaagtgcaaggagtgcgccgaggccttcagctacagcagcaccttcagaagacacatgatcagccacaccggcgagaagccccacaagtgcaaggagtgcggcgaggccttcagctacagcagcgccttcagaagacacatgatcacccacaccggcgagaagccctacgagtgcaagcagtgcggcaagaccttcatctacctgcagagcttcagaagacacgagagaatccacaccggcgagaagccctacgagtgcaagcagtgcggcaagaccttcatctacccccagagcttcagaagacacgagagaacccacggcggcgagaagccctacgagtgcaaccagtgcggcaaggccttcagccaccccagcagcttcagaggccacatgagagtgcacaccggcgagaagccctacgagtgcaagcagtgcggcaagaccttcaactggcccatcagcctgagaaagcacatgagaacccacaccagagagaagccctacgagtgcaagcagtgcggcaaggccttcagcctgagcgcctgcttcagagagcacgtgagaatgcaccccgaggacaagagctacgagtgcaagctgtgcggcaaggccttctactgccacatcagcctgcagaagcacatgagaagacacaccgccgagaagctgtacaagtgcaagcagtgcggcaaggccttcagctggcccgagctgctgcagcagcacgtgagaacccacaccgtggagaagccctacgagtgcaaggagtgcggcaaggtgttcaagtggcccagcagcctgcccatccacatgagactgcacaccggcgagaagccctaccagtgcaagcactgcggcaaggccttcaactgcagcagcagcctgagaagacacgtgagaatccacaccaccgagaagcagtacaagtgcaacgtgggccacccccccgccaacgagttcatgtgcagcgccagcgagaagagccaccaggagagagacctgatcaaggtggtgaacatggtgctgcccctgtag

SEQ ID NO: 10669 - DNA, 1632 bp, Artificial Sequence
  Description of Artificial Sequence: Synthetic coding sequence
atggacagcgtggtgttcgaggacgtggccgtggacttcaccctggaggagtgggccctgctggacagcgcccagagagacctgtacagagacgtgatgctggagaccttccagaacctggccagcgtggacgacgagacccagttcaaggccagcggcagcgtgagccagcaggacatctacggcgagaagatccccaaggagagcaagatcgccaccttcaccagaaacgtgagctgggccagcgtgctgggcaagatctgggacagcctgagcatcgaggaccagaccaccaaccagggcagaaacctgagaaaccacggcctggagagactgtgcgagagcaacgaccagtgcggcgaggccctgagccagatcccccacctgaacctgtacaagaagatcccccccggcgtgaagcagtacgagtacaacacctacggcaaggtgttcatgcacagaagaaccagcctgaagagccccatcaccgtgcacaccggccacaagccctaccagtgccaggagtgcggccaggcctacagctgcagaagccacctgagaatgcacgtgagaacccacaacggcgagagaccctacgtgtgcaagctgtgcggcaagaccttccccagaaccagcagcctgaacagacacgtgagaatccacaccgccgagaagacctacgagtgcaagcagtgcggcaaggccttcatcgacttcagcagcctgaccagccacctgagaagccacaccggcgagaagccctacaagtgcaaggagtgcggcaaggccttcagctacagcagcaccttcagaagacacaccatcacccacaccggcgagaagccctacaagtgcaaggagtgcgccgaggccttcagctacagcagcaccttcagaagacacatgatcagccacaccggcgagaagccccacaagtgcaaggagtgcggcgaggccttcagctacagcagcgccttcagaagacacatgatcacccacaccggcgagaagccctacgagtgcaagcagtgcggcaagaccttcatctacctgcagagcttcagaagacacgagagaatccacaccggcgagaagccctacgagtgcaagcagtgcggcaagaccttcatctacccccagagcttcagaagacacgagagaacccacggcggcgagaagccctacgagtgcaaccagtgcggcaaggccttcagccaccccagcagcttcagaggccacatgagagtgcacaccggcgagaagccctacgagtgcaagcagtgcggcaagaccttcaactggcccatcagcctgagaaagcacatgagaacccacaccagagagaagccctacgagtgcaaggagtgcggcaaggtgttcaagtggcccagcagcctgcccatccacatgagactgcacaccggcgagaagccctaccagtgcaagcactgcggcaaggccttcaactgcagcagcagcctgagaagacacgtgagaatccacaccaccgagaagcagtacaagtgcaacgtgggccacccccccgccaacgagttcatgtgcagcgccagcgagaagagccaccaggagagagacctgatcaaggtggtgaacatggtgctgcccctgtag

SEQ ID NO: 10670 - DNA, 1371 bp, Artificial Sequence
  Description of Artificial Sequence: Synthetic coding sequence
atggacaccgtggtgttcgaggacgtggtggtggacttcaccctggaggagtgggccctgctgaaccccgcccagagaaagctgtacagagacgtgatgctggagaccttcaagcacctggccagcgtggacaacgaggcccagctgaaggccagcggcagcatcagccagcaggacaccagcggcgagaagctgagcctgaagcagaagatcgagaagttcaccagaaagaacatctgggccagcctgctgggcaagaactgggaggagcacagcgtgaaggacaagcacaacaccaaggagagacacctgagcagaaaccccagagtggagagaccctgcaagagcagcaagggcaacaagagaggcagaaccttcagaaagaccagaaactgcaacagacacctgagaaagaactgctgcaccagcgtgagaagatacgagtgcagccagtgcggcaagctgttcacccacagcagcagcctgatcagacacaagagagcccacagcggccagaagctgtacaagtgcaaggagtgcggcaaggccttcagcagacccagctacctgcagacccacgagaagacccacagcggcgagaagccctacgcctgccagagctgcggcaagaccttcctgagaagccacagcctgaccgagcacgtgagaacccacaccggcgagaagccctacgagtgcggccagtgcggcaagggcttcagctgccccaagagcttcagagcccacgtgatgatgcacgccggcggcagaccctacgagtgcaagcactgcggcaaggccttcagatgccagaagagcttcagagtgcacatgatcatgcacgccggcggcagaccctacgagtgcaagcagtgcggcaaggcctactgctgggccaccagcttccagagacacgtgagaatccacaacggcgagaagccctacaagtgcggcaagtgcggcaaggccttcggctggcccagcagcctgcacaagcacgccagaacccacgccaagaagaagcccgtgagcggcggcagcgtgggcaagagcagcgccagacccagacccagcaccgacgtgaagagccagaccagagagaaggtgtacaagtgcgagacctgcggcaagacctacggctggagcagcagcctgcacaagcacgagagaaagcacaccggcgagaagcccgtgaacgccgccagcgtgggcaagcccagcggcggcctgtgcagcagcaagaacgtgagaacccagatcggccagaagcccagcaagtgcgagaagtgcggcaaggccttcagctgccccaaggccttccagggccacgtgagaagccacaccggcaagaagagctgcaccagcaagtag

SEQ ID NO: 10671 - DNA, 1293 bp, Artificial Sequence
  Description of Artificial Sequence: Synthetic coding sequence
atggccgccgtggtgctgccccccaccgccgccctgagcagcctgttccccgccagccagagagagggccacaccgagggcggcgagctggtgaacgagctgctgaagagctggctgaagggcctggtgaccttcgaggacgtggccgtggagttcacccaggaggagtgggccctgctggaccccgcccagagaaccctgtacagagacgtgatgctggagaactgcagaaacctggccagcctgggcaaccaggtggacaagcccagactgatcagccagctggagcaggaggacaaggtgatgaccgaggagagaggcatcctgagcggcacctgccccgacgtggagaaccccttcaaggccaagggcctgacccccaagctgcacgtgttcagaaaggagcagagcagaaacatgaagatggagagaaaccacctgggcgccaccctgaacgagtgcaaccagtgcttcaaggtgttcagcaccaagagcagcctgaccagacacagaaagatccacaccggcgagagaccctacggctgcagcgagtgcggcaagagctacagcagcagaagctacctggccgtgcacaagagaatccacaacggcgagaagccctacgagtgcaacgactgcggcaagaccttcagcagcagaagctacctgaccgtgcacaagagaatccacaacggcgagaagccctacgagtgcagcgactgcggcaagaccttcagcaacagcagctacctgagaccccacctgagaatccacaccggcgagaagccctacaagtgcaaccagtgcttcagagagttcagaacccagagcatcttcaccagacacaagagagtgcacaccggcgagggccactacgtgtgcaaccagtgcggcaaggccttcggcaccagaagcagcctgagcagccactacagcatccacaccggcgagtacccctacgagtgccacgactgcggcagaaccttcagaagaagaagcaacctgacccagcacatcagaacccacaccggcgagaagccctacacctgcaacgagtgcggcaagagcttcaccaacagcttcagcctgaccatccacagaagaatccacaacggcgagaagagctacgagtgcagcgactgcggcaagagcttcaacgtgctgagcagcgtgaagaagcacatgagaacccacaccggcaagaagccctacgagtgcaactactgcggcaagagcttcaccagcaacagctacctgagcgtgcacaccagaatgcacaacagacagatgtag

SEQ ID NO: 10672 - DNA, 1293 bp, Artificial Sequence; identical to SEQ ID NO: 10671
  Description of Artificial Sequence: Synthetic coding sequence

SEQ ID NO: 10673 - DNA, 1272 bp, Artificial Sequence
  Description of Artificial Sequence: Synthetic coding sequence
atggccgccgtggtgctgccccccaccgccgccagccagagagagggccacaccgagggcggcgagctggtgaacgagctgctgaagagctggctgaagggcctggtgaccttcgaggacgtggccgtggagttcacccaggaggagtgggccctgctggaccccgcccagagaaccctgtacagagacgtgatgctggagaactgcagaaacctggccagcctgggcaaccaggtggacaagcccagactgatcagccagctggagcaggaggacaaggtgatgaccgaggagagaggcatcctgagcggcacctgccccgacgtggagaaccccttcaaggccaagggcctgacccccaagctgcacgtgttcagaaaggagcagagcagaaacatgaagatggagagaaaccacctgggcgccaccctgaacgagtgcaaccagtgcttcaaggtgttcagcaccaagagcagcctgaccagacacagaaagatccacaccggcgagagaccctacggctgcagcgagtgcggcaagagctacagcagcagaagctacctggccgtgcacaagagaatccacaacggcgagaagccctacgagtgcaacgactgcggcaagaccttcagcagcagaagctacctgaccgtgcacaagagaatccacaacggcgagaagccctacgagtgcagcgactgcggcaagaccttcagcaacagcagctacctgagaccccacctgagaatccacaccggcgagaagccctacaagtgcaaccagtgcttcagagagttcagaacccagagcatcttcaccagacacaagagagtgcacaccggcgagggccactacgtgtgcaaccagtgcggcaaggccttcggcaccagaagcagcctgagcagccactacagcatccacaccggcgagtacccctacgagtgccacgactgcggcagaaccttcagaagaagaagcaacctgacccagcacatcagaacccacaccggcgagaagccctacacctgcaacgagtgcggcaagagcttcaccaacagcttcagcctgaccatccacagaagaatccacaacggcgagaagagctacgagtgcagcgactgcggcaagagcttcaacgtgctgagcagcgtgaagaagcacatgagaacccacaccggcaagaagccctacgagtgcaactactgcggcaagagcttcaccagcaacagctacctgagcgtgcacaccagaatgcacaacagacagatgtag

SEQ ID NO: 10674 - DNA, 1209 bp, Artificial Sequence
  Description of Artificial Sequence: Synthetic coding sequence
atggccgccgtgatcctgcccagcaccgccgcccccagcagcctgttccccgccagccagcagaagggccacacccagggcggcgagctggtgaacgagctgctgaccagctggctgagaggcctggtgaccttcgaggacgtggccgtggagttcacccaggaggagtgggccctgctggaccccgcccagagaaccctgtacagagacgtgatgctggagaactgcagaaacctggccagcctgggctgcagagtgaacaagcccagcctgatcagccagctggagcaggacaagaaggtggtgaccgaggagagaggcatcctgcccagcacctgccccgacctggagaccctgctgaaggccaagtggctgacccccaagaagaacgtgttcagaaaggagcagagcaagggcgtgaagaccgagagaagccacagaggcgtgaagctgaacgagtgcaaccagtgcttcaaggtgttcagcaccaagagcaacctgacccagcacaagagaatccacaccggcgagaagccctacgactgcagccagtgcggcaagagcttcagcagcagaagctacctgaccatccacaagagaatccacaacggcgagaagccctacgagtgcaaccactgcggcaaggccttcagcgaccccagcagcctgagactgcacctgagaatccacaccggcgagaagccctacgagtgcaaccagtgcttccacgtgttcagaaccagctgcaacctgaagagccacaagagaatccacaccggcgagaaccaccacgagtgcaaccagtgcggcaaggccttcagcaccagaagcagcctgaccggccacaacagcatccacaccggcgagaagccctacgagtgccacgactgcggcaagaccttcagaaagagcagctacctgacccagcacgtgagaacccacaccggcgagaagccctacgagtgcaacgagtgcggcaagagcttcagcagcagcttcagcctgaccgtgcacaagagaatccacaccggcgagaagccctacgagtgcagcgactgcggcaaggccttcaacaacctgagcgccgtgaagaagcacctgagaacccacaccggcgagaagccctacgagtgcaaccactgcggcaagagcttcaccagcaacagctacctgagcgtgcacaagagaatccacaacagatggatctag

SEQ ID NO: 10675 - DNA, 996 bp, Artificial Sequence
  Description of Artificial Sequence: Synthetic coding sequence
atgctggagaactgcagaaacctggccagcctgggctgcagagtgaacaagcccagcctgatcagccagctggagcaggacaagaaggtggtgaccgaggagagaggcatcctgcccagcacctgccccgacctggagaccctgctgaaggccaagtggctgacccccaagaagaacgtgttcagaaaggagcagagcaagggcgtgaagaccgagagaagccacagaggcgtgaagctgaacgagtgcaaccagtgcttcaaggtgttcagcaccaagagcaacctgacccagcacaagagaatccacaccggcgagaagccctacgactgcagccagtgcggcaagagcttcagcagcagaagctacctgaccatccacaagagaatccacaacggcgagaagccctacgagtgcaaccactgcggcaaggccttcagcgaccccagcagcctgagactgcacctgagaatccacaccggcgagaagccctacgagtgcaaccagtgcttccacgtgttcagaaccagctgcaacctgaagagccacaagagaatccacaccggcgagaaccaccacgagtgcaaccagtgcggcaaggccttcagcaccagaagcagcctgaccggccacaacagcatccacaccggcgagaagccctacgagtgccacgactgcggcaagaccttcagaaagagcagctacctgacccagcacgtgagaacccacaccggcgagaagccctacgagtgcaacgagtgcggcaagagcttcagcagcagcttcagcctgaccgtgcacaagagaatccacaccggcgagaagccctacgagtgcagcgactgcggcaaggccttcaacaacctgagcgccgtgaagaagcacctgagaacccacaccggcgagaagccctacgagtgcaaccactgcggcaagagcttcaccagcaacagctacctgagcgtgcacaagagaatccacaacagatggatctag

SEQ ID NO: 10676 - DNA, 1617 bp, Artificial Sequence
  Description of Artificial Sequence: Synthetic coding sequence
atggtggccggctggctgaccaactacagccaggacagcgtgaccttcgaggacgtggccgtggacttcacccaggaggagtggaccctgctggaccagacccagagaaacctgtacagagacgtgatgctggagaactacaagaacctggtggccgtggactgggagagccacatcaacaccaagtggagcgccccccagcagaacttcctgcagggcaagaccagcagcgtggtggagatggagagaaaccacttcggcgaggagctgttcgacttcaaccagtgcgagaaggccctgagcgagcacagctgcctgaagacccacagaagaacctacttcagaaagaagacctgcgagtgcaaccagtgcgagaaggccttcagaaagcccagcatcttcaccctgcacaagaagaccgacatcggcgaggagctgcccaactgcaaccagtgcgagaccgccttcagccagcacctgcacctggtgtgcaagaagaccagccagaacctgcacctggtgtgcaagaagacccacacccaggagaagccctacaagtgcagcgactgcgagaagggcctgcccagcagcagccacctgagagagtgcgtgagaatctacggcggcgagagaccctacacccacaaggagtacgtggagaccttcagccacagcaccgccctgttcgtgcacatgcagacccaggacggcgagaagttctacgagtgcaaggcctgcggcaagcccttcaccgagagcagctacctgacccagcacctgagaacccacagcagagtgctgcccatcgagcacaagaagttcggcaaggccttcgccttcagccccgacctggccaagcacatcagactgagaaccagaggcaagcactacgtgtgcaacgagtgcggcaaggagttcacctgcttcagcaagctgaacatccacatcagagtgcacaccggcgagaagccctacgagtgcaacaagtgcggcaaggccttcaccgacagcagcggcctgatcaagcacagaagaacccacaccggcgagaagccctacgagtgcaaggagtgcggcaaggccttcgccaacagcagccacctgaccgtgcacatgagaacccacaccggcgagaagccctaccagtgcaaggagtgcggcaaggccttcatcaacagcagcagcttcaagagccacatgcagacccaccccggcgtgaagccctacgactgccagcagtgcggcaaggccttcatcagaagcagcttcctgatcagacacctgagaagccacagcgccgagagacccttcgagtgcgaggagtgcggcaaggccttcagatacagcagccacctgagccagcacaagagaatccacaccggcgagagaccctacaagtgccagaagtgcggccaggccttcagcatcagcagcggcctgaccgtgcacatgagaacccacaccggcgagagacccttcgagtgccaggagtgcggcaaggccttcaccagaagcacctacctgatcagacacctgagaagccacagcgtggagaagccctacaaggagtgcggccagaccttcagcaacagcagctgcctgaccgagtgcgtgtag

SEQ ID NO: 10677 - DNA, 1617 bp, Artificial Sequence; identical to SEQ ID NO: 10676
  Description of Artificial Sequence: Synthetic coding sequence

SEQ ID NO: 10678 - DNA, 1377 bp, Artificial Sequence
  Description of Artificial Sequence: Synthetic coding sequence
atggagagaaaccacttcggcgaggagctgttcgacttcaaccagtgcgagaaggccctgagcgagcacagctgcctgaagacccacagaagaacctacttcagaaagaagacctgcgagtgcaaccagtgcgagaaggccttcagaaagcccagcatcttcaccctgcacaagaagaccgacatcggcgaggagctgcccaactgcaaccagtgcgagaccgccttcagccagcacctgcacctggtgtgcaagaagaccagccagaacctgcacctggtgtgcaagaagacccacacccaggagaagccctacaagtgcagcgactgcgagaagggcctgcccagcagcagccacctgagagagtgcgtgagaatctacggcggcgagagaccctacacccacaaggagtacgtggagaccttcagccacagcaccgccctgttcgtgcacatgcagacccaggacggcgagaagttctacgagtgcaaggcctgcggcaagcccttcaccgagagcagctacctgacccagcacctgagaacccacagcagagtgctgcccatcgagcacaagaagttcggcaaggccttcgccttcagccccgacctggccaagcacatcagactgagaaccagaggcaagcactacgtgtgcaacgagtgcggcaaggagttcacctgcttcagcaagctgaacatccacatcagagtgcacaccggcgagaagccctacgagtgcaacaagtgcggcaaggccttcaccgacagcagcggcctgatcaagcacagaagaacccacaccggcgagaagccctacgagtgcaaggagtgcggcaaggccttcgccaacagcagccacctgaccgtgcacatgagaacccacaccggcgagaagccctaccagtgcaaggagtgcggcaaggccttcatcaacagcagcagcttcaagagccacatgcagacccaccccggcgtgaagccctacgactgccagcagtgcggcaaggccttcatcagaagcagcttcctgatcagacacctgagaagccacagcgccgagagacccttcgagtgcgaggagtgcggcaaggccttcagatacagcagccacctgagccagcacaagagaatccacaccggcgagagaccctacaagtgccagaagtgcggccaggccttcagcatcagcagcggcctgaccgtgcacatgagaacccacaccggcgagagacccttcgagtgccaggagtgcggcaaggccttcaccagaagcacctacctgatcagacacctgagaagccacagcgtggagaagccctacaaggagtgcggccagaccttcagcaacagcagctgcctgaccgagtgcgtgtag

SEQ ID NO: 10679 - DNA, 1617 bp, Artificial Sequence; identical to SEQ ID NO: 10676
  Description of Artificial Sequence: Synthetic coding sequence

SEQ ID NO: 10680 - DNA, 2373 bp, Artificial Sequence
  Description of Artificial Sequence: Synthetic coding sequence
atggcctactgcctgaccaactgctaccagtacagcgtgaccttcgaggacaccgccgtggacttcacccaggaggagtggatcctgctggaccccgtgcagagaaacctgtacagagacgtgatgctggagaactacgagaacgtggccaaggtgggcttccagctgttcaagcccagcgtgatcagctggctggaggaggaggagctgagaaccctgcagcagggcgtgctgcaggactgggccatcaagcaccagaccagcgtgagcgccctgcagcaggagttctggaagatccagaccagcaacggcatccagatggacctggtgaccttcgacagcgtggccgtggagttcacccaggaggagtggaccctgctggaccccgcccagagaaacctgtacagcgacgtgatgctggagaactacaagaacctgagcagcgtgggctaccagctgttcaagcccagcctgatcagctggctggaggaggaggaggagctgagcaccctgcccagagtgctgcaggagtggaagatgtgcctgaagaccaagggccccgccctgtggcaggacaacttctgcctgaagaccctgaacggcatccagctggccagaaaccagaacggcgaggagctgtacgactgcaagcagtgcgaggacgtgttctgcaagcacccctgcctgaagaccaacatgagcacccagaacagaggcaacaccagcgagtgcatccagtacgccaaggacctgctgagcctgtacaacaagaccagcaccatcagaaaggtgagcgtgttcagcaagcacggcaagagcttcagactgatcctgaacgtgcaggtgcagagaaagtgcacccaggacaagagcttcgagggcaccgactacggcaaggccttcatctaccagagctacctggaggcccacagaaagacccagagcggcgagaagctgaacgagtggaagcagtgcggcgaggccttcacccacagcaccagccacgccgtgaacgtggagacccacatcatcaagaacccctacgagtgcaaggagtgcggcaaggacttcagataccccacccacctgaacaaccacatgcagacccacatcggcatcaagccctacaagtgcaagcactgcggcaagaccttcaccgtgcccagcggcttcctggagcacgtgagaacccacaccggcgagaagccctacggctgcaaggagtgcggcaaggccttcggcaccagcgccggcctgatcgagcacatcagatgccacgccagagagaagaccttcaagtgcgaccactgcggcaaggccttcatcagctaccccagcctgttcggccacctgagagtgcacaacggcgagaagccctacgagcacaaggagtacggcaaggccttcggcaccagcagcggcgtgatcgaggacagaagaagcaacaccggccagaagagattcgactgcgaccagtgcggcaaggtgttcgtgagcttcagcagcctgttcgcccacctgagaacccacaccggcgagaagcccttcaagtgctacaagtgcggcaagcccttcaccagcagcgcctgcctgagaatccacatgagaacccacaccgaggagagactgtaccagtgcaagaagtgcggcaaggccttcaccaagtgcagctacctgaccaagcacctgagaacccacgccggcgagaagccctacgagtgcatgaagtgcggcaaggccttcaccgagagaagctacctgaccaagcacctgagaagacacagcggcgagaagccctacgagtgcaagaagtgcggcaaggccttcaccgagagaagcgacctgaccaagcacctgagaagacacaccggcgacaagccctacgagtacaaggactgcggcaaggccttcgtggtgagcagcagcctggtggaccacctgagaacccacaccggctacaagccctacaagtgcaacgcctgcgagaaggcctacagcagaagctgcgtgctgacccagcacctgaagacccacgccgccgagaagaccagcgagtgcaacgcctgcggcaacagcttcagaaacagcatgtgcttccacgacagactgaagaccctgaccaagatcaagccctacaagtgcaaggactgcggcaaggccttcacctgccacagcgacctgaccaaccacgtgagaatccacaccggcgagaagccctacaagtgcaaggagtgcggcaaggccttcagaaccagcagcggcagaatccagcacctgagaacccacatgggcgagaagcccttcgagtgcgaccagtgcggcaaggccttcgccagcttcagcgccagaatcgcccacctgaagacccactag

SEQ ID NO: 10681 - DNA, 1461 bp, Artificial Sequence
  Description of Artificial Sequence: Synthetic coding sequence
atggccgccatctacctgagcagaggcttcttcagcagagagcccatctgccccttcgaggagaagaccaaggtggagagaatggtggaggactacctggccagcggctaccaggacagcgtgaccttcgacgacgtggccgtggacttcacccccgaggagtgggccctgctggacaccaccgagaagtacctgtacagagacgtgatgctggagaactacatgaacctggccagcgtggagtgggagatccagcccagaaccaagagaagcagcctgcagcagggcttcctgaagaaccagatcttcagcggcatccagatgaccagaggctacagcggctggaagctgtgcgactgcaagaactgcggcgaggtgttcagagagcagttctgcctgaagacccacatgagagtgcagaacggcggcaacaccagcgagggcaactgctacggcaaggacaccctgagcgtgcacaaggaggccagcaccggccaggagctgagcaagttcaacccctgcggcaaggtgttcaccctgacccccggcctggccgtgcacctggaggtgctgaacgccagacagccctacaagtgcaaggagtgcggcaagggcttcaagtacttcgccagcctggacaaccacatgggcatccacaccgacgagaagctgtgcgagttccaggagtacggcagagccgtgaccgccagcagccacctgaagcagtgcgtggccgtgcacaccggcaagaagagcaagaagaccaagaagtgcggcaagagcttcaccaacttcagccagctgtacgcccccgtgaagacccacaagggcgagaagagcttcgagtgcaaggagtgcggcagaagcttcagaaacagcagctgcctgaacgaccacatccagatccacaccggcatcaagccccacaagtgcacctactgcggcaaggccttcaccagaagcacccagctgaccgagcacgtgagaacccacaccggcatcaagccctacgagtgcaaggagtgcggccaggccttcgcccagtacagcggcctgagcatccacatcagaagccacagcggcaagaagccctaccagtgcaaggagtgcggcaaggccttcaccaccagcaccagcctgatccagcacaccagaatccacaccggcgagaagccctacgagtgcgtggagtgcggcaagaccttcatcaccagcagcagaagaagcaagcacctgaagacccacagcggcgagaagcccttcgtgtgcaagatctgcggcaaggccttcctgtacagcagcagactgaacgtgcacctgagaacccacaccggcgagaagcccttcgtgtgcaaggagtgcggcaaggccttcgccgtgagcagcagactgagcagacacgagagaatccacaccggcgagaagccctacgagtgcaaggacatgagcgtgaccatctag

SEQ ID NO: 10682 - DNA, 1053 bp, Artificial Sequence
  Description of Artificial Sequence: Synthetic coding sequence
atgagagtgcagaacggcggcaacaccagcgagggcaactgctacggcaaggacaccctgagcgtgcacaaggaggccagcaccggccaggagctgagcaagttcaacccctgcggcaaggtgttcaccctgacccccggcctggccgtgcacctggaggtgctgaacgccagacagccctacaagtgcaaggagtgcggcaagggcttcaagtacttcgccagcctggacaaccacatgggcatccacaccgacgagaagctgtgcgagttccaggagtacggcagagccgtgaccgccagcagccacctgaagcagtgcgtggccgtgcacaccggcaagaagagcaagaagaccaagaagtgcggcaagagcttcaccaacttcagccagctgtacgcccccgtgaagacccacaagggcgagaagagcttcgagtgcaaggagtgcggcagaagcttcagaaacagcagctgcctgaacgaccacatccagatccacaccggcatcaagccccacaagtgcacctactgcggcaaggccttcaccagaagcacccagctgaccgagcacgtgagaacccacaccggcatcaagccctacgagtgcaaggagtgcggccaggccttcgcccagtacagcggcctgagcatccacatcagaagccacagcggcaagaagccctaccagtgcaaggagtgcggcaaggccttcaccaccagcaccagcctgatccagcacaccagaatccacaccggcgagaagccctacgagtgcgtggagtgcggcaagaccttcatcaccagcagcagaagaagcaagcacctgaagacccacagcggcgagaagcccttcgtgtgcaagatctgcggcaaggccttcctgtacagcagcagactgaacgtgcacctgagaacccacaccggcgagaagcccttcgtgtgcaaggagtgcggcaaggccttcgccgtgagcagcagactgagcagacacgagagaatccacaccggcgagaagccctacgagtgcaaggacatgagcgtgaccatctag

SEQ ID NO: 10683 - DNA, 231 bp, Artificial Sequence
  Description of Artificial Sequence: Synthetic coding sequence
atggccgccatctacctgagcagaggcttcttcagcagagagcccatctgccccttcgaggagaagaccaaggtggagagaatggtggaggactacctggccagcggctaccaggacagcgtgaccttcgacgacgtggccgtggacttcacccccgaggagtgggccctgctggacaccaccgagaagtacctgtacagagacgtgatgctggagaactacatgaactag

SEQ ID NO: 10684 - DNA, 1254 bp, Artificial Sequence
  Description of Artificial Sequence: Synthetic coding sequence
atgctggagaactacatgaacctggccagcgtggagtgggagatccagcccagaaccaagagaagcagcctgcagcagggcttcctgaagaaccagatcttcagcggcatccagatgaccagaggctacagcggctggaagctgtgcgactgcaagaactgcggcgaggtgttcagagagcagttctgcctgaagacccacatgagagtgcagaacggcggcaacaccagcgagggcaactgctacggcaaggacaccctgagcgtgcacaaggaggccagcaccggccaggagctgagcaagttcaacccctgcggcaaggtgttcaccctgacccccggcctggccgtgcacctggaggtgctgaacgccagacagccctacaagtgcaaggagtgcggcaagggcttcaagtacttcgccagcctggacaaccacatgggcatccacaccgacgagaagctgtgcgagttccaggagtacggcagagccgtgaccgccagcagccacctgaagcagtgcgtggccgtgcacaccggcaagaagagcaagaagaccaagaagtgcggcaagagcttcaccaacttcagccagctgtacgcccccgtgaagacccacaagggcgagaagagcttcgagtgcaaggagtgcggcagaagcttcagaaacagcagctgcctgaacgaccacatccagatccacaccggcatcaagccccacaagtgcacctactgcggcaaggccttcaccagaagcacccagctgaccgagcacgtgagaacccacaccggcatcaagccctacgagtgcaaggagtgcggccaggccttcgcccagtacagcggcctgagcatccacatcagaagccacagcggcaagaagccctaccagtgcaaggagtgcggcaaggccttcaccaccagcaccagcctgatccagcacaccagaatccacaccggcgagaagccctacgagtgcgtggagtgcggcaagaccttcatcaccagcagcagaagaagcaagcacctgaagacccacagcggcgagaagcccttcgtgtgcaagatctgcggcaaggccttcctgtacagcagcagactgaacgtgcacctgagaacccacaccggcgagaagcccttcgtgtgcaaggagtgcggcaaggccttcgccgtgagcagcagactgagcagacacgagagaatccacaccggcgagaagccctacgagtgcaaggacatgagcgtgaccatctag

SEQ ID NO: 10685 - DNA, 126 bp, Artificial Sequence
  Description of Artificial Sequence: Synthetic coding sequence
atggccgccatctacctgagcagaggcttcttcagcagagagcccatctgccccttcgaggagaagaccaaggtggagagaatggtggaggactacctggccagcggctaccaggacagcgtgtag

SEQ ID NO: 10686 - DNA, 1065 bp, Artificial Sequence
  Description of Artificial Sequence: Synthetic coding sequence
atgagcgccttcgacatgagccacgacttcttcttctgcctgaccagcgagtgggagatccagcccagaaccaagagaagcagcctgcagcagggcttcctgaagaaccagatcttcaccggcatccagatgcagaccagaagctacagcggctggaagctgtgcgagaactgcggcgaggtgttcagcgagcagttctgcctgaagacccacatgagagcccagaacggcggcaacaccttcgagggcaactgctacggcaaggacagcatcagcgtgcacaaggaggccagcatcggccaggagctgagcaagttcaacccctgcggcaaggtgttcaccctgacccccggcctggccgtgcacctggagatcctgaacggcagacagccctacaagtgcaaggagtgcggcaagggcttcaagtacttcgccagcctggacaaccacatgggcatccacatcggcgagaagctgtgcgagttccaggagtgcgagagagccatcaccaccagcagccacctgaagcagtgcgtggccgtgcacaccggcaagaagagcgagaagaccaagaactgcggcaagagcttcaccaacttcagccagctgagcgcccacgccaagacccacaagggcgagaagagcttcgagtgcaaggagtgcggcagaagcttcagaaacagcagcagcttcaacgtgcacatccagatccacaccggcatcaagccccacaagtgcaccgagtgcggcaaggccttcaccagaagcacccacctgacccagcacgtgagaacccacaccggcatcaagccctacgagtgcaaggagtgcggccaggccttcacccagtacaccggcctggccatccacatcagaaaccacaccggcgagaagccctaccagtgcaaggagtgcggcaaggccttcaacagaagcagcaccctgacccagcacagaagaatccacaccggcgagaagccctacgagtgcgtggagtgcggcaagaccttcatcaccagcagccacagaagcaagcacctgaagacccacagcggcgagagatag

SEQ ID NO: 10687 - DNA, 1281 bp, Artificial Sequence
  Description of Artificial Sequence: Synthetic coding sequence
atgagcgccttcgacatgagccacggcttcttccccagagagcccatctgccccttcgaggagaagaccaagatcggcaccatggtggaggaccacagaagcaacagctaccaggacagcgtgaccttcgacgacgtggccgtggagttcacccccgaggagtgggccctgctggacaccacccagaagtacctgtacagagacgtgatgctggagaactacatgaacctggccagcgtggacttcttcttctgcctgaccagcgagtgggagatccagcccagaaccaagagaagcagcctgcagcagggcttcctgaagaaccagatcttcaccggcatccagatgcagaccagaagctacagcggctggaagctgtgcgagaactgcggcgaggtgttcagcgagcagttctgcctgaagacccacatgagagcccagaacggcggcaacaccttcgagggcaactgctacggcaaggacagcatcagcgtgcacaaggaggccagcatcggccaggagctgagcaagttcaacccctgcggcaaggtgttcaccctgacccccggcctggccgtgcacctggagatcctgaacggcagacagccctacaagtgcaaggagtgcggcaagggcttcaagtacttcgccagcctggacaaccacatgggcatccacatcggcgagaagctgtgcgagttccaggagtgcgagagagccatcaccaccagcagccacctgaagcagtgcgtggccgtgcacaccggcaagaagagcgagaagaccaagaactgcggcaagagcttcaccaacttcagccagctgagcgcccacgccaagacccacaagggcgagaagagcttcgagtgcaaggagtgcggcagaagcttcagaaacagcagcagcttcaacgtgcacatccagatccacaccggcatcaagccccacaagtgcaccgagtgcggcaaggccttcaccagaagcacccacctgacccagcacgtgagaacccacaccggcatcaagccctacgagtgcaaggagtgcggccaggccttcacccagtacaccggcctggccatccacatcagaaaccacaccggcgagaagccctaccagtgcaaggagtgcggcaaggccttcaacagaagcagcaccctgacccagcacagaagaatccacaccggcgagaagccctacgagtgcgtggagtgcggcaagaccttcatcaccagcagccacagaagcaagcacctgaagacccacagcggcgagagatag

SEQ ID NO: 10688 - DNA, 1281 bp, Artificial Sequence; identical to SEQ ID NO: 10687
  Description of Artificial Sequence: Synthetic coding sequence

SEQ ID NO: 10689 - DNA, 1074 bp, Artificial Sequence
  Description of Artificial Sequence: Synthetic coding sequence
atgctggagaactacatgaacctggccagcgtggacttcttcttctgcctgaccagcgagtgggagatccagcccagaaccaagagaagcagcctgcagcagggcttcctgaagaaccagatcttcaccggcatccagatgcagaccagaagctacagcggctggaagctgtgcgagaactgcggcgaggtgttcagcgagcagttctgcctgaagacccacatgagagcccagaacggcggcaacaccttcgagggcaactgctacggcaaggacagcatcagcgtgcacaaggaggccagcatcggccaggagctgagcaagttcaacccctgcggcaaggtgttcaccctgacccccggcctggccgtgcacctggagatcctgaacggcagacagccctacaagtgcaaggagtgcggcaagggcttcaagtacttcgccagcctggacaaccacatgggcatccacatcggcgagaagctgtgcgagttccaggagtgcgagagagccatcaccaccagcagccacctgaagcagtgcgtggccgtgcacaccggcaagaagagcgagaagaccaagaactgcggcaagagcttcaccaacttcagccagctgagcgcccacgccaagacccacaagggcgagaagagcttcgagtgcaaggagtgcggcagaagcttcagaaacagcagcagcttcaacgtgcacatccagatccacaccggcatcaagccccacaagtgcaccgagtgcggcaaggccttcaccagaagcacccacctgacccagcacgtgagaacccacaccggcatcaagccctacgagtgcaaggagtgcggccaggccttcacccagtacaccggcctggccatccacatcagaaaccacaccggcgagaagccctaccagtgcaaggagtgcggcaaggccttcaacagaagcagcaccctgacccagcacagaagaatccacaccggcgagaagccctacgagtgcgtggagtgcggcaagaccttcatcaccagcagccacagaagcaagcacctgaagacccacagcggcgagagatag

SEQ ID NO: 10690 - DNA, 933 bp, Artificial Sequence
  Description of Artificial Sequence: Synthetic coding sequence
atgaccagaagctacagcggctggaagctgtgcgagaactgcggcgaggtgttcagcgagcagttctgcctgaagacccacatgagagcccagaacggcggcaacaccttcgagggcaactgctacggcaaggacagcatcagcgtgcacaaggaggccagcatcggccaggagctgagcaagttcaacccctgcggcaaggtgttcaccctgacccccggcctggccgtgcacctggagatcctgaacggcagacagccctacaagtgcaaggagtgcggcaagggcttcaagtacttcgccagcctggacaaccacatgggcatccacatcggcgagaagctgtgcgagttccaggagtgcgagagagccatcaccaccagcagccacctgaagcagtgcgtggccgtgcacaccggcaagaagagcgagaagaccaagaactgcggcaagagcttcaccaacttcagccagctgagcgcccacgccaagacccacaagggcgagaagagcttcgagtgcaaggagtgcggcagaagcttcagaaacagcagcagcttcaacgtgcacatccagatccacaccggcatcaagccccacaagtgcaccgagtgcggcaaggccttcaccagaagcacccacctgacccagcacgtgagaacccacaccggcatcaagccctacgagtgcaaggagtgcggccaggccttcacccagtacaccggcctggccatccacatcagaaaccacaccggcgagaagccctaccagtgcaaggagtgcggcaaggccttcaacagaagcagcaccctgacccagcacagaagaatccacaccggcgagaagccctacgagtgcgtggagtgcggcaagaccttcatcaccagcagccacagaagcaagcacctgaagacccacagcggcgagagatag

SEQ ID NO: 10691 - DNA, 1170 bp, Artificial Sequence
  Description of Artificial Sequence: Synthetic coding sequence
atggacagcgtgaccttcgacgacgtggccgtggagttcacccccgaggagtgggccctgctggacaccacccagaagtacctgtacagagacgtgatgctggagaactacatgaacctggccagcgtggacttcttcttctgcctgaccagcgagtgggagatccagcccagaaccaagagaagcagcctgcagcagggcttcctgaagaaccagatcttcaccggcatccagatgcagaccagaagctacagcggctggaagctgtgcgagaactgcggcgaggtgttcagcgagcagttctgcctgaagacccacatgagagcccagaacggcggcaacaccttcgagggcaactgctacggcaaggacagcatcagcgtgcacaaggaggccagcatcggccaggagctgagcaagttcaacccctgcggcaaggtgttcaccctgacccccggcctggccgtgcacctggagatcctgaacggcagacagccctacaagtgcaaggagtgcggcaagggcttcaagtacttcgccagcctggacaaccacatgggcatccacatcggcgagaagctgtgcgagttccaggagtgcgagagagccatcaccaccagcagccacctgaagcagtgcgtggccgtgcacaccggcaagaagagcgagaagaccaagaactgcggcaagagcttcaccaacttcagccagctgagcgcccacgccaagacccacaagggcgagaagagcttcgagtgcaaggagtgcggcagaagcttcagaaacagcagcagcttcaacgtgcacatccagatccacaccggcatcaagccccacaagtgcaccgagtgcggcaaggccttcaccagaagcacccacctgacccagcacgtgagaacccacaccggcatcaagccctacgagtgcaaggagtgcggccaggccttcacccagtacaccggcctggccatccacatcagaaaccacaccggcgagaagccctaccagtgcaaggagtgcggcaaggccttcaacagaagcagcaccctgacccagcacagaagaatccacaccggcgagaagccctacgagtgcgtggagtgcggcaagaccttcatcaccagcagccacagaagcaagcacctgaagacccacagcggcgagagatag

SEQ ID NO: 10692 - DNA, 1431 bp, Artificial Sequence
  Description of Artificial Sequence: Synthetic coding sequence
atggacgccgtggccttcgaggacgtggccgtgaacttcacccaggaggagtgggccctgctgggccccagccagaagaacctgtacagatacgtgatgcaggagaccatcagaaacctggactgcatcagaatgatctgggaggagcagaacaccgaggaccagtacaagaaccccagaagaaacctgagatgccacatggtggagagattcagcgagagcaaggacagcagccagtgcggcgagaccttcagcctgatcagagacagcatcgtgaacaacagcatctgccccggcgaggacccctgccagagcgccgagtgcgaggaggtgatcatgggccacctgagcctgaacagccacatcagagtggacagcggccacaagccccacgagtaccaggagtacggcgagaagccccacacccacaagcagagaggcaaggccttcagctaccaccacagcttccagagcagaggcagaccccacaccggcaagaagagatacgagtgcaaggagtgcggcaagaccttcagcagcagaagaaacctgagaagacacatggtggtgcagggcggcaacagaccctacaagtgcaagctgtgcggcaaggccttcttctggcccagcctgctgagaatgcacgagagaacccacaccggcgagaagccctacgagtgcaagcagtgcagcaaggccttccccttctacagcagctacagaagacacgagagaatgcacaccggcgagaagccctacgagtgcaagcagtgcagcaaggccctgcccgacagcagcagctacatcagacacgagagaacccacaccggcgagaagccctacacctgcaagcagtgcggcaaggccttcagcgtgagcagcagcctgagaagacacgagaccacccacagcgccgagaagccctacgagtgcaagcagtgcggcaagaccttccaccacctgggcagcttccagatccacatgaagagacacaccggcgacagaccccacaagtgcaagatctgcggcaagggcttcgacagacccagcctggtgagataccacgagagaatccacaccggcgagaagccctacgagtgcaagcagtgcggcaagaccctgagccacagcagcagcttcagaagacacatgatcatgcacaccggcggcggcccccacaagtgcaagatctgcggcaaggccttcgtgtaccccagcgtgtgccagagacacgagaagagccacagcggcgagaagccctacgagtgcaagcagtgcggcaaggccctgagccacagcagcagcttcagaagacacatggtgatgcacaccggcgacggccccaacaagtgcaaggtgtgcggcaaggccttcgtgtaccccagcgtgtgccagagacacgagaagacccactggagagagaccatctag

SEQ ID NO: 10693 - DNA, 690 bp, Artificial Sequence
  Description of Artificial Sequence: Synthetic coding sequence
atggacgccgtggccttcgaggacgtggccgtgaacttcacccaggaggagtgggccctgctgggccccagccagaagaacctgtacagatacgtgatgcaggagaccatcagaaacctggactgcatcagaatgatctgggaggagcagaacaccgaggaccagtacaagaaccccagaagaaacctgagatgccacatggtggagagattcagcgagagcaaggacagcagccagtgcggcgagaccttcagcctgatcagagacagcatcgtgaacaacagcatctgccccggcgaggacccctgccagagcgccgagtgcgaggaggtgatcatgggccacctgagcctgaacagccacatcagagtggacagcggccacaagccccacgagtaccaggagtacggcgagaagccccacacccacaagcagagaggcaaggccttcagctaccaccacagcttccagagcagaggcagaccccacaccggcaagaagagatacgagtgcaaggagtgcggcaagaccttcagcagcagaagaaacctgagaagacacatggtggtgcagggcggcaacagaccctacaagttccccatcgaggacatgagagagtgcaccctgggcagaaacagaatgaacgtgagcagcgtgctgaagccctgcctgatccccgtgcccatctag

SEQ ID NO: 10694 - DNA, 1662 bp, Artificial Sequence
  Description of Artificial Sequence: Synthetic coding sequence
atggacagcgtggccagcgaggacgtggccgtgaacttcaccctggaggagtgggccctgctggaccccagccagaagaagctgtacagagacgtgatgagagagaccttcagaaacctggcctgcgtgggcaagaagtgggaggaccagagcatcgaggactggtacaagaaccagggcagaatcctgagaaaccacatggaggagggcctgagcgagagcaaggagtacgaccagtgcggcgaggccttcagccagatcctgaacctgaacctgaacaagaagatccccaccatcgtgagaccctgcgagtgcagcctgtgcggcaaggtgttcatgcaccacagcagcctgagcagacacatcagaagccacctgggccacaagccctacgactaccaggagtacggcgagaagccctacaagtgcaagcagtgcggcaaggccttcagcagctgccagagcttcagaagacacgagagaacccacaccggcgagaagccctacgcctgccccgagtgcggcaaggccttcatcagcctgcccagcgtgagaagacacatgatcaagcacaccggcgacggcccctacaagtgccaggagtgcggcaaggccttcgacagacccagcctgttccagatccacgagagaacccacaccggcgagaagccctacgagtgccaggagtgcgccaaggccttcatcagcctgcccagcttccagagacacatgatcagacacaccggcgacggcccctacaagtgccaggagtgcggcaaggccttcgacagacccagcctgttcagaatccacgagagaacccacaccggcgagaagccccacgagtgcaagcagtgcggcaaggccttcatcagcttcaccaacttccagagccacatgatcagacacaccggcgacggcccctacaagtgcaaggtgtgcggcagagccttcatcttccccagctacgtgagaaagcacgagagaacccacaccggcgagaagccctacgagtgcaacaagtgcggcaagaccttcagcagcagcagcaacgtgagaacccacgagagaacccacaccggcgagaagccctacgagtgcaaggagtgcggcaaggccttcatcagcctgcccagcgtgagaagacacatgatcaagcacaccggcgacggcccctacaagtgccaggtgtgcggcagagccttcgactgccccagcagcttccagatccacgagagaacccacaccggcgagaagccctacgagtgccaggtgtgcggcaaggccttcatcagcctgaagagaatcagaaagcacatgatcctgcacaccggcgacggcccctacaagtgccaggtgtgcggcaaggccttcgactgccccagcagcgtgagaacccacgagagaacccacaccggcgagaagccctacgagtgcaaggagtgcggcaaggccttcaactacgccagcagcatcagaatccacgagagaacccacaccggcgagaagccctacgagtgcaagcagtgcggcaagaccttcagctacagcagcagcttccagagacacgagagagcccacaacggcgacaagccctacgtgaagaacgtgggcaagctgagcttcatcacccagcccagcaacacctgcgagaacgagtag

SEQ ID NO: 10695 - DNA, 1260 bp, Artificial Sequence
  Description of Artificial Sequence: Synthetic coding sequence
atggcccaggagagcgtgatgttcagcgacgtgagcgtggacttcagccaggaggagtgggagtgcctgaacgacgaccagagagacctgtacagagacgtgatgctggagaactacagcaacctggtgagcatggccggccacagcatcagcaagcccaacgtgatcagctacctggagcagggcaaggagccctggctggccgacagagagctgaccagaggccagtggcccgtgctggagagcagatgcgagaccaagaagctgttcctgaagaaggagatctacgagatcgagagcacccagtgggagatcatggagaagctgaccagaagagacttccagtgcagcagcttcagagacgactgggagtgcaacagacagttcaagaaggagctgggcagccagggcggccacttcaaccagctggtgttcacccacgaggacctgcccaccctgagccaccaccccagcttcaccctgcagcagatcatcaacagcaagaagaagttctgcgccagcaaggagtacagaaagaccttcagacacggcagccagttcgccacccacgagatcatccacaccatcgagaagccctacgagtgcaaggagtgcggcaagagcttcagacaccccagcagactgacccaccaccagaagatccacaccggcaagaagcccttcgagtgcaaggagtgcggcaagaccttcatctgcggcagcgacctgaccagacaccacagaatccacaccggcgagaagccctacgagtgcaaggagtgcggcaaggccttcagcagcggcagcaacttcaccagacaccagagaatccacaccggcgagaagccctacgagtgcaaggagtgcggcaaggccttcagcagcggcagcaacttcacccagcaccagagaatccacaccggcgagaagccctacgagtgcaaggagtgcggcaacgccttcagccagagcagccagctgatcaagcaccagagaatccacaccggcgagaagccctacgagtgcaaggagtgcgagaaggccttcagaagcggcagcgacctgaccagacaccagagaatccacaccggcgagaagccctacgagtgcaagatctgcggcaaggcctacagccagagcagccagctgatcagccaccacagaatccacaccagcgagaagccctacgagtacagagagtgcggcaagaacttcaactacgacccccagctgatccagcaccagaacctgtactggtag

SEQ ID NO: 10696 - DNA, 1257 bp, Artificial Sequence
  Description of Artificial Sequence: Synthetic coding sequence
atggcccaggagagcgtgatgttcagcgacgtgagcgtggacttcagccaggaggagtgggagtgcctgaacgacgaccagagagacctgtacagagacgtgatgctggagaactacagcaacctggtgagcatgggccacagcatcagcaagcccaacgtgatcagctacctggagcagggcaaggagccctggctggccgacagagagctgaccagaggccagtggcccgtgctggagagcagatgcgagaccaagaagctgttcctgaagaaggagatctacgagatcgagagcacccagtgggagatcatggagaagctgaccagaagagacttccagtgcagcagcttcagagacgactgggagtgcaacagacagttcaagaaggagctgggcagccagggcggccacttcaaccagctggtgttcacccacgaggacctgcccaccctgagccaccaccccagcttcaccctgcagcagatcatcaacagcaagaagaagttctgcgccagcaaggagtacagaaagaccttcagacacggcagccagttcgccacccacgagatcatccacaccatcgagaagccctacgagtgcaaggagtgcggcaagagcttcagacaccccagcagactgacccaccaccagaagatccacaccggcaagaagcccttcgagtgcaaggagtgcggcaagaccttcatctgcggcagcgacctgaccagacaccacagaatccacaccggcgagaagccctacgagtgcaaggagtgcggcaaggccttcagcagcggcagcaacttcaccagacaccagagaatccacaccggcgagaagccctacgagtgcaaggagtgcggcaaggccttcagcagcggcagcaacttcacccagcaccagagaatccacaccggcgagaagccctacgagtgcaaggagtgcggcaacgccttcagccagagcagccagctgatcaagcaccagagaatccacaccggcgagaagccctacgagtgcaaggagtgcgagaaggccttcagaagcggcagcgacctgaccagacaccagagaatccacaccggcgagaagccctacgagtgcaagatctgcggcaaggcctacagccagagcagccagctgatcagccaccacagaatccacaccagcgagaagccctacgagtacagagagtgcggcaagaacttcaactacgacccccagctgatccagcaccagaacctgtactggtag

SEQ ID NO: 10697 - DNA, 477 bp, Artificial Sequence
  Description of Artificial Sequence: Synthetic coding sequence
atggcccaggagagcgtgatgttcagcgacgtgagcgtggacttcagccaggaggagtgggagtgcctgaacgacgaccagagagacctgtacagagacgtgatgctggagaactacagcaacctggtgagcatggccggccacagcatcagcaagcccaacgtgatcagctacctggagcagggcaaggagccctggctggccgacagagagctgaccagaggccagtggcccgtgctggagagcagatgcgagaccaagaagctgttcctgaagaaggagatctacgagatcgagagcacccagtgggagatcatggagaagctgaccagaagagacttccagtgcagcagcttcagagacgactgggagtgcaacagacagttcaagaaggagctgggcagccagggcggccacttcaaccagctggtgttcacccacgaggacctgcccaccctgagccaccaccccagctag

SEQ ID NO: 10698 - DNA, 1257 bp, Artificial Sequence; identical to SEQ ID NO: 10696
  Description of Artificial Sequence: Synthetic coding sequence

SEQ ID NO: 10699 - DNA, 1260 bp, Artificial Sequence; identical to SEQ ID NO: 10695
  Description of Artificial Sequence: Synthetic coding sequence

SEQ ID NO: 10700 - DNA, 1935 bp, Artificial Sequence
  Description of Artificial Sequence: Synthetic coding sequence
atgaccagccagagcagcgtgatcagcaacagctgcgtgaccatggagagactgagccacatgatggagagaaaggcctggtgcagccaggagagcgccctgagcgaggaggaggaggacaccaccagacccctggagaccgtgaccttcaaggacgtggccgtggacctgacccaggaggagtgggagcagatgaagcccgcccagagaaacctgtacagagacgtgatgctggagaactacagcaacctggtgaccgtgggctgccaggtgaccaagcccgacgtgatcttcaagctggagcaggaggaggagccctgggtgatggaggaggagatgttcggcagacactgccccgaggtgtgggaggtggacgagcagatcaagaagcagcaggagaccctggtgagaaaggtgaccagcatcagcaagaagatcctgatcaaggagaaggtgatcgagtgcaagaaggtggccaagatcttccccctgagcagcgacatcgtgaccagcagacagagcttctacgactgcgacagcctggacaagggcctggagcacaacctggacctgctgagatacgagaagggctgcgtgagagagaagcagagcaacgagttcggcaagcccttctaccactgcgccagctacgtggtgacccccttcaagtgcaaccagtgcggccaggacttcagccacaagttcgacctgatcagacacgagagaatccacgccggcgagaagccctacgagtgcaaggagtgcggcaaggccttcagcagaaaggagaacctgatcacccaccagaagatccacaccggcgagaagccctacaagtgcaacgagtgcggcaaggccttcatccagatgagcaacctgatcagacaccacagaatccacaccggcgagaagccctacgcctgcaaggactgctggaaggccttcagccagaagagcaacctgatcgagcacgagagaatccacaccggcgagaagccctacgagtgcaaggagtgcggcaagagcttcagccagaagcagaacctgatcgagcacgagaagatccacaccggcgagaagccctacgcctgcaacgagtgcggcagagccttcagcagaatgagcagcgtgaccctgcacatgagaagccacaccggcgagaagccctacaagtgcaacaagtgcggcaaggccttcagccagtgcagcgtgttcatcatccacatgagaagccacaccggcgagaagccctacgtgtgcagcgagtgcggcaaggccttcagccagagcagcagcctgaccgtgcacatgagaaaccacaccgccgagaagccctacgagtgcaaggagtgcggcaaggccttcagcagaaaggagaacctgatcacccaccagaagatccacaccggcgagaagccctacgagtgcagcgagtgcggcaaggccttcatccagatgagcaacctgatcagacaccagagaatccacaccggcgagaagccctacgcctgcaccgtgtgcggcaaggccttcagccagaagagcaacctgaccgagcacgagaagatccacaccggcgagaagccctaccactgcaaccagtgcggcaaggccttcagccagagacagaacctgctggagcacgagaagatccacaccggcgagaagcccttcaagtgcaacgagtgcggcaaggccttcagcagaatcagcagcctgaccctgcacgtgagaagccacaccggcgagaagccctacgagtgcaacaagtgcggcaaggccttcagccagtgcagcctgctgatcatccacatgagaagccacaccggcgagaagcccttcgagtgcaacgagtgcggcaaggccttcagccagagagccagcctgagcatccacaagagaggccacaccggcgagagacaccaggtgtactag

SEQ ID NO: 10701 - DNA, 1743 bp, Artificial Sequence
  Description of Artificial Sequence: Synthetic coding sequence
atgaagcccgcccagagaaacctgtacagagacgtgatgctggagaactacagcaacctggtgaccgtgggctgccaggtgaccaagcccgacgtgatcttcaagctggagcaggaggaggagccctgggtgatggaggaggagatgttcggcagacactgccccgaggtgtgggaggtggacgagcagatcaagaagcagcaggagaccctggtgagaaaggtgaccagcatcagcaagaagatcctgatcaaggagaaggtgatcgagtgcaagaaggtggccaagatcttccccctgagcagcgacatcgtgaccagcagacagagcttctacgactgcgacagcctggacaagggcctggagcacaacctggacctgctgagatacgagaagggctgcgtgagagagaagcagagcaacgagttcggcaagcccttctaccactgcgccagctacgtggtgacccccttcaagtgcaaccagtgcggccaggacttcagccacaagttcgacctgatcagacacgagagaatccacgccggcgagaagccctacgagtgcaaggagtgcggcaaggccttcagcagaaaggagaacctgatcacccaccagaagatccacaccggcgagaagccctacaagtgcaacgagtgcggcaaggccttcatccagatgagcaacctgatcagacaccacagaatccacaccggcgagaagccctacgcctgcaaggactgctggaaggccttcagccagaagagcaacctgatcgagcacgagagaatccacaccggcgagaagccctacgagtgcaaggagtgcggcaagagcttcagccagaagcagaacctgatcgagcacgagaagatccacaccggcgagaagccctacgcctgcaacgagtgcggcagagccttcagcagaatgagcagcgtgaccctgcacatgagaagccacaccggcgagaagccctacaagtgcaacaagtgcggcaaggccttcagccagtgcagcgtgttcatcatccacatgagaagccacaccggcgagaagccctacgtgtgcagcgagtgcggcaaggccttcagccagagcagcagcctgaccgtgcacatgagaaaccacaccgccgagaagccctacgagtgcaaggagtgcggcaaggccttcagcagaaaggagaacctgatcacccaccagaagatccacaccggcgagaagccctacgagtgcagcgagtgcggcaaggccttcatccagatgagcaacctgatcagacaccagagaatccacaccggcgagaagccctacgcctgcaccgtgtgcggcaaggccttcagccagaagagcaacctgaccgagcacgagaagatccacaccggcgagaagccctaccactgcaaccagtgcggcaaggccttcagccagagacagaacctgctggagcacgagaagatccacaccggcgagaagcccttcaagtgcaacgagtgcggcaaggccttcagcagaatcagcagcctgaccctgcacgtgagaagccacaccggcgagaagccctacgagtgcaacaagtgcggcaaggccttcagccagtgcagcctgctgatcatccacatgagaagccacaccggcgagaagcccttcgagtgcaacgagtgcggcaaggccttcagccagagagccagcctgagcatccacaagagaggccacaccggcgagagacaccaggtgtactag

SEQ ID NO: 10702 - DNA, 1716 bp, Artificial Sequence
  Description of Artificial Sequence: Synthetic coding sequence
atgaagcccgcccagagaaacctgtacagagacgtgatgctggagaactacagcaacctggtgaccgtgggctgccaggtgaccaagcccgacgtgatcttcaagctggagcaggaggaggagccctgggtgatggaggaggagatgttcggcagacactgccccgagcccagaagaggcgagaactgctgcgccagcgaggtgatggccgagggcctgaagttcaaggacgtggtgatctacttcagccagaaggagtgggagtgcctgcacagcgcccagaaggacctgtacagagacgtgatgctggagaactacggcaacctggtgctgctgggcctgagcgacaccaagcccaacgtgatcagcctgctggagcagaagaaggagccctggatggtgaagagaaaggagaccaaggagtggtgccccgactgggagttcggcagagagaccaagaacctgagccccaaggagaacatctacgagatcagaagcccccagcaggagaaggccagagtgatcagagagatcagatgccaggtggagagacagcagggccaccaggagggccacttcagacccgccgtgatccccttcaccagcatgcagtgcaccgcccacagagagtaccagtggctgcacaccggcgagaagagctgcgagtgcagaaagtgcaagaacgccttcagataccagagctgccccatccagcacgagatcatccacaacaaggagaaggagcccgagtgcggcgagtgcagaaagatcttcaacagcggcagcgacctgatcaagcaccagaccctgcacgagagcaagaagcacagcgagaacaacaagtgcgccttcaaccacgacagcggcatcacccagccccagagcatcaacaccggcgagaagccccacaagtgcaaggagtgcggcaaggccttcagaagcagcagccagatcagccagcaccagagaatgcacctgggcgagaagccctacaagtgcagagagtgcggcaaggccttccccagcaccgcccagctgaacctgcaccagagaatccacaccgacgagaagtactacgagagcaaggcctgcggcaaggccttcaccagacccagccacctgttcagacaccagagaatccacaccggcgagaagccccacaagtgcaaggagtgcggcaaggccttcagatacgacacccagctgagcctgcaccagatcatccacaccggcgagagaagatacgagtgcagagagtgcggcaaggtgtacagctgcgccagccagctgagcctgcaccagagaatccacaccggcgagaagccccacgagtgcaaggagtgcggcaaggccttcatcagcgacagccacctgatcagacaccagagcgtgcacaccggcgagaagccctgcaagtgcaaggagtgcggcaagagcttcagaagaggcagcgagctgaccagacaccagagagcccacaccggcgagaagccctacgagtgcaaggagtgcgagaaggccttcacctgcagcaccgagctggtgagacaccagaaggtgcacaccggcgagagaccccacaagtgcaaggagtgcggcaaggccttcatcagaagaagcgagctgacccaccacgagagaagccacaccggcgagaagccctacgagtgcaaggagtgcggcaagcccttcggcggcggcagcgagctgagctag

SEQ ID NO: 10703 - DNA, 1752 bp, Artificial Sequence
  Description of Artificial Sequence: Synthetic coding sequence
atgaccagccagagcagcgtgatcagcaacagctgcgtgaccatggagagactgagccacatgatggagagaaaggcctggtgcagccaggagagcgccctgagcgaggaggaggaggacaccaccagacccctggagaccgtgaccttcaaggacgtggccgtggacctgacccaggaggagtgggagcagatgaagcccgcccagagaaacctgtacagagacgtgatgctggagaactacagcaacctggtgaccgtgggctgccaggtgaccaagcccgacgtgatcttcaagctggagcaggaggaggagccctgggtgatggaggaggagatgttcggcagacactgccccgagcccagaagaggcgagaactgctgcgccagcgaggtgatggccgagggcctgaagttcaaggacgtggtgatctacttcagccagaaggagtgggagtgcctgcacagcgcccagaaggacctgtacagagacgtgatgctggagaactacggcaacctggtgctgctgggcctgagcgacaccaagcccaacgtgatcagcctgctggagcagaagaaggagccctggatggtgaagagaaaggagaccaaggagtggtgccccgactgggagttcggcagagagaccaagaacctgagccccaaggagaacatctacgagatcagaagcccccagcaggagaaggccagagtgatcagagagatcagatgccaggtggagagacagcagggccaccaggagggccacttcagacccgccgtgatccccttcaccagcatgcagtgcaccgcccacagagagtaccagtggctgcacaccggcgagaagagctgcgagtgcagaaagtgcaagaacgccttcagataccagagctgccccatccagcacgagatcatccacaacaaggagaaggagcccgagtgcggcgagtgcagaaagatcttcaacagcggcagcgacctgatcaagcaccagaccctgcacgagagcaagaagcacagcgagaacaacaagtgcgccttcaaccacgacagcggcatcacccagccccagagcatcaacaccggcgagaagccccacaagtgcaaggagtgcggcaaggccttcagaagcagcagccagatcagccagcaccagagaatgcacctgggcgagaagccctacaagtgcagagagtgcggcaaggccttccccagcaccgcccagctgaacctgcaccagagaatccacaccgacgagaagtactacgagagcaaggcctgcggcaaggccttcaccagacccagccacctgttcagacaccagagaatccacaccggcgagaagccccacaagtgcaaggagtgcggcaaggccttcagatacgacacccagctgagcctgcaccagatcatccacaccggcgagagaagatacgagtgcagagagtgcggcaaggtgtacagctgcgccagccagctgagcctgcaccagagaatccacaccggcgagaagccccacgagtgcaaggagtgcggcaaggccttcatcagcgacagccacctgatcagacaccagagcgtgcacaccggcgagaagccctgcaagtgcaaggagtgcggcaagagcttcagaagaggcagcgagctgaccagacaccagagagcccacaccggcgagaagccctacgagtgcaaggagtgcgagaaggccttcacctgcagcaccgagctggtgagacaccagaagtag

SEQ ID NO: 10704 - DNA, 1668 bp, Artificial Sequence
  Description of Artificial Sequence: Synthetic coding sequence
atggacagcgtggtgttcgaggacgtggccgtggacttcaccctggaggagtgggccctgctggacagcgcccagagagacctgtacagagacgtgatgctggagaccttcagaaacctggccagcgtggacgacggcacccagttcaaggccaacggcagcgtgagcctgcaggacatgtacggccaggagaagagcaaggagcagaccatccccaacttcaccggcaacaacagctgcgcctacaccctggagaagaactgcgagggctacggcaccgaggaccaccacaagaacctgagaaaccacatggtggacagattctgcacccacaacgagggcaaccagtacggcgaggccatccaccagatgcccgacctgaccctgcacaagaaggtgagcgccggcgagaagccctacgagtgcaccaagtgcagaaccgtgttcacccacctgagcagcctgaagagacacgtgaagagccactgcggcagaaaggccccccccggcgaggagtgcaagcaggcctgcatctgccccagccacctgcacagccacggcagaaccgacaccgaggagaagccctacaagtgccaggcctgcggccagaccttccagcaccccagatacctgagccaccacgtgaagacccacaccgccgagaagacctacaagtgcgagcagtgcagaatggccttcaacggcttcgccagcttcaccagacacgtgagaacccacaccaaggacagaccctacaagtgccaggagtgcggcagagccttcatctaccccagcaccttccagagacacatgaccacccacaccggcgagaagccctacaagtgccagcactgcggcaaggccttcacctacccccaggccttccagagacacgagaagacccacaccggcgagaagccctacgagtgcaagcagtgcggcaagaccttcagctggagcgagaccctgagagtgcacatgagaatccacaccggcgacaagctgtacaagtgcgagcactgcggcaaggccttcaccagcagcagaagcttccagggccacctgagaacccacaccggcgagaagccctacgagtgcaagcagtgcggcaaggccttcacctggagcagcaccttcagagagcacgtgagaatccacacccaggagcagctgtacaagtgcgagcagtgcggcaaggccttcaccagcagcagaagcttcagaggccacctgagaacccacaccggcgagaagccctacgagtgcaagcagtgcggcaagaccttcacctggagcagcaccttcagagagcacgtgagaatccacacccaggagcagctgcacaagtgcgagcactgcggcaaggccttcaccagcagcagagccttccagggccacctgagaatgcacaccggcgagaagccctacgagtgcaagcagtgcggcaagaccttcacctggagcagcaccctgcacaaccacgtgagaatgcacaccggcgagaagccccacaagtgcaagcagtgcggcatgagcttcaagtggcacagcagcttcagaaaccacctgagaatgcacaccggccagaagagccacgagtgccagagctacagcaaggccttcagctgccaggtgatcctgagcaagaccagcgagagcacccactag

SEQ ID NO: 10705 - DNA, 1674 bp, Artificial Sequence
  Description of Artificial Sequence: Synthetic coding sequence
atggacagcgtggtgttcgaggacgtggccgtggacttcaccctggaggagtgggccctgctggacagcgcccagagagacctgtacagagacgtgatgctggagaccttcagaaacctggccagcgtgggctgcgagatgtgggagagaaccaacggcagcgtgagcctgcaggacatgtacggccaggagaagagcaaggagcagaccatccccaacttcaccggcaacaacagctgcgcctacaccctggagaagaagagaatcaccagaagcggcgaccagagccagctgcccgtgagaagaagaaaccacatggtggacagattctgcacccacaacgagggcaaccagtacggcgaggccatccaccagatgcccgacctgaccctgcacaagaaggtgagcgccggcgagaagccctacgagtgcaccaagtgcagaaccgtgttcacccacctgagcagcctgaagagacacgtgaagagccactgcggcagaaaggccccccccggcgaggagtgcaagcaggcctgcatctgccccagccacctgcacagccacggcagaaccgacaccgaggagaagccctacaagtgccaggcctgcggccagaccttccagcaccccagatacctgagccaccacgtgaagacccacaccgccgagaagacctacaagtgcgagcagtgcagaatggccttcaacggcttcgccagcttcaccagacacgtgagaacccacaccaaggacagaccctacaagtgccaggagtgcggcagagccttcatctaccccagcaccttccagagacacatgaccacccacaccggcgagaagccctacaagtgccagcactgcggcaaggccttcacctacccccaggccttccagagacacgagaagacccacaccggcgagaagccctacgagtgcaagcagtgcggcaagaccttcagctggagcgagaccctgagagtgcacatgagaatccacaccggcgacaagctgtacaagtgcgagcactgcggcaaggccttcaccagcagcagaagcttccagggccacctgagaacccacaccggcgagaagccctacgagtgcaagcagtgcggcaaggccttcacctggagcagcaccttcagagagcacgtgagaatccacacccaggagcagctgtacaagtgcgagcagtgcggcaaggccttcaccagcagcagaagcttcagaggccacctgagaacccacaccggcgagaagccctacgagtgcaagcagtgcggcaagaccttcacctggagcagcaccttcagagagcacgtgagaatccacacccaggagcagctgcacaagtgcgagcactgcggcaaggccttcaccagcagcagagccttccagggccacctgagaatgcacaccggcgagaagccctacgagtgcaagcagtgcggcaagaccttcacctggagcagcaccctgcacaaccacgtgagaatgcacaccggcgagaagccccacaagtgcaagcagtgcggcatgagcttcaagtggcacagcagcttcagaaaccacctgagaatgcacaccggccagaagagccacgagtgccagagctacagcaaggccttcagctgccaggtgatcctgagcaagaccagcgagagcacccactag

SEQ ID NO: 10706 - DNA, 1611 bp, Artificial Sequence
  Description of Artificial Sequence: Synthetic coding sequence
atggccgtgggcctgctgaaggccatgtaccaggagctggtgaccttcagagacgtggccgtggacttcagccaggaggagtgggactgcctggacagcagccagagacacctgtacagcaacgtgatgctggagaactacagaatcctggtgagcctgggcctgtgcttcagcaagcccagcgtgatcctgctgctggagcagggcaaggccccctggatggtgaagagagagctgaccaagggcctgtgcagcggctgggagcccatctgcgagaccgaggagctgacccccaagcaggacttctacgaggagcaccagagccagaagatcatcgagaccctgaccagctacaacctggagtacagcagcctgagagaggagtggaagtgcgagggctacttcgagagacagcccggcaaccagaaggcctgcttcaaggaggagatcatcacccacgaggagcccctgttcgacgagagagagcaggagtacaagagctggggcagcttccaccagaaccccctgctgtgcacccagaagatcatccccaaggaggagaaggtgcacaagcacgacacccagaagagaagcttcaagaagaacctgatggccatcaagcccaagagcgtgtgcgccgagaagaagctgctgaagtgcaacgactgcgagaaggtgttcagccagagcagcagcctgaccctgcaccagagaatccacaccggcgagaagccctacaagtgcatcgagtgcggcaaggccttcagccagagaagcaacctggtgcagcaccagagaatccacaccggcgagaagccctacgagtgcaaggagtgcagaaaggccttcagccagaacgcccacctggtgcagcacctgagagtgcacaccggcgagaagccctacgagtgcaaggtgtgcagaaaggccttcagccagttcgcctacctggcccagcaccagagagtgcacaccggcgagaagccctacgagtgcatcgagtgcggcaaggccttcagcaacagaagcagcatcgcccagcaccagagagtgcacaccggcgagaagccctacgagtgcaacgtgtgcggcaaggccttcagcctgagagcctacctgaccgtgcaccagagaatccacaccggcgagagaccctacgagtgcaaggagtgcggcaaggccttcagccagaacagccacctggcccagcaccagagaatccacaccggcgagaagccctacaagtgccaggagtgcagaaaggccttcagccagatcgcctacctggcccagcaccagagagtgcacaccggcgagaagccctacgagtgcatcgagtgcggcaaggccttcagcaacgacagcagcctgacccagcaccagagagtgcacaccggcgagaagccctacgagtgcaccgtgtgcggcaaggccttcagctactgcggcagcctggcccagcaccagagaatccacaccggcgagagaccctacgagtgcaaggagtgcaagaagaccttcagacagcacgcccacctggcccaccaccagagaatccacatcggcgagagcctgagcccccccaaccccgtgaaccaccaggtgctgtag

SEQ ID NO: 10707 - DNA, 1002 bp, Artificial Sequence
  Description of Artificial Sequence: Synthetic coding sequence
atggccatcaagcccaagagcgtgtgcgccgagaagaagctgctgaagtgcaacgactgcgagaaggtgttcagccagagcagcagcctgaccctgcaccagagaatccacaccggcgagaagccctacaagtgcatcgagtgcggcaaggccttcagccagagaagcaacctggtgcagcaccagagaatccacaccggcgagaagccctacgagtgcaaggagtgcagaaaggccttcagccagaacgcccacctggtgcagcacctgagagtgcacaccggcgagaagccctacgagtgcaaggtgtgcagaaaggccttcagccagttcgcctacctggcccagcaccagagagtgcacaccggcgagaagccctacgagtgcatcgagtgcggcaaggccttcagcaacagaagcagcatcgcccagcaccagagagtgcacaccggcgagaagccctacgagtgcaacgtgtgcggcaaggccttcagcctgagagcctacctgaccgtgcaccagagaatccacaccggcgagagaccctacgagtgcaaggagtgcggcaaggccttcagccagaacagccacctggcccagcaccagagaatccacaccggcgagaagccctacaagtgccaggagtgcagaaaggccttcagccagatcgcctacctggcccagcaccagagagtgcacaccggcgagaagccctacgagtgcatcgagtgcggcaaggccttcagcaacgacagcagcctgacccagcaccagagagtgcacaccggcgagaagccctacgagtgcaccgtgtgcggcaaggccttcagctactgcggcagcctggcccagcaccagagaatccacaccggcgagagaccctacgagtgcaaggagtgcaagaagaccttcagacagcacgcccacctggcccaccaccagagaatccacatcggcgagagcctgagcccccccaaccccgtgaaccaccaggtgctgtag

SEQ ID NO: 10708 - DNA, 1830 bp, Artificial Sequence
  Description of Artificial Sequence: Synthetic coding sequence
atgccccacctgctggtgaccttcagagacgtggccatcgacttcagccaggaggagtgggagtgcctggaccccgcccagagagacctgtacagagacgtgatgctggagaactacagcaacctgatcagcctggacctggagagcagctgcgtgaccaagaagctgagccccgagaaggagatctacgagatggagagcctgcagtgggagaacatgggcaagagaatcaaccaccacctgcagtacaacggcctgggcgacaacatggagtgcaagggcaacctggagggccaggaggccagccaggagggcctgtacatgtgcgtgaagatcacctgcgaggagaaggccaccgagagccacagcaccagcagcaccttccacagaatcatccccaccaaggagaagctgtacaagtgcaaggagtgcagacagggcttcagctacctgagctgcctgatccagcacgaggagaaccacaacatcgagaagtgcagcgaggtgaagaagcacagaaacaccttcagcaagaagcccagctacatccagcaccagagaatccagaccggcgagaagccctacgagtgcatggagtgcggcaaggccttcggcagaaccagcgacctgatccagcaccagaagatccacaccaacgagaagccctaccagtgcaacgcctgcggcaaggccttcatcagaggcagccagctgaccgagcaccagagagtgcacaccggcgagaagccctacgagtgcaagaagtgcggcaaggccttcagctactgcagccagtacaccctgcaccagagaatccacagcggcgagaagccctacgagtgcaaggactgcggcaaggccttcatcctgggcagccagctgacctaccaccagagaatccacagcggcgagaagccctacgagtgcaaggagtgcggcaaggccttcatcctgggcagccacctgacctaccaccagagagtgcacaccggcgagaagccctacatctgcaaggagtgcggcaaggccttcctgtgcgccagccagctgaacgagcaccagagaatccacaccggcgagaagccctacgagtgcaaggagtgcggcaagaccttcttcagaggcagccagctgacctaccacctgagagtgcacagcggcgagagaccctacaagtgcaaggagtgcggcaaggccttcatcagcaacagcaacctgatccagcaccagagaatccacaccggcgagaagccctacaagtgcaaggagtgcggcaaggccttcatctgcggcaagcagctgagcgagcaccagagaatccacaccggcgagaagcccttcgagtgcaaggagtgcggcaaggccttcatcagagtggcctacctgacccagcacgagaagatccacggcgagaagcactacgagtgcaaggagtgcggcaagaccttcgtgagagccacccagctgacctaccaccagagaatccacaccggcgagaagccctacaagtgcaaggagtgcgacaaggccttcatctacggcagccagctgagcgagcaccagagaatccacagaggcgagaagccctacgagtgcaagcagtgcggcaaggccttcatcagaggcagccacctgaccgagcacctgagaacccacaccggcgagaagccctacgagtgcaaggagtgcggcagagccttcagcagaggcagcgagctgaccctgcaccagagaatccacaccggcgagaagccctacacctgcgtgcagtgcggcaaggacttcagatgccccagccagctgacccagcacaccagactgcacaactag

SEQ ID NO: 10709 - DNA, 1830 bp, Artificial Sequence; identical to SEQ ID NO: 10708
  Description of Artificial Sequence: Synthetic coding sequence

SEQ ID NO: 10710 - DNA, 1830 bp, Artificial Sequence; identical to SEQ ID NO: 10708
  Description of Artificial Sequence: Synthetic coding sequence

SEQ ID NO: 10711 - DNA, 1590 bp, Artificial Sequence
  Description of Artificial Sequence: Synthetic coding sequence
atggagcaggagaagaagctgctggtgagcgacagcaacagcttcatggagagagagagcctgaagagccccttcaccggcgacaccagcatgaacaacctggagaccgtgcaccacaacaacagcaaggccgacaagctgaaggagaagcccagcgagtggagcaagagacacagaccccagcactacaagcacgaggacgccaaggagatgcccctgacctgggtgcaggacgagatctggtgccacgacagctacgagagcgacggcaagagcgagaactggggcaacttcatcgccaaggaggaggagaagcccaaccaccaggagtgggacagcggcgagcacaccaacgcctgcgtgcagcagaacagcagcttcgtggacagaccctacaagtgcagcgagtgctggaagagcttcagcaacagcagccacctgagaacccaccagagaacccacagcggcgagaagccctacaagtgcagcgagtgcgccaagtgcttctgcaacagcagccacctgatccagcacctgagaatgcacaccggcgagaagccctaccagtgcggcgagtgcggcaagagcttcagcaacaccagccacctgatcatccacgagagaacccacaccggcgagaagccctacaagtgccccgagtgcggcaagagattcagcagcagcagccacctgatccagcaccacagaagccacaccggcgagaagccctacgagtgcagcgtgtgcggcaagggcttcagccacagctacgtgctgatcgagcaccagagaacccacaccggcgagaagccctacaagtgccccgactgcggcaagagcttcagccagagcagcagcctgatcagacaccagagaacccacaccggcgagaagccctacaagtgcctggagtgcgagaagagcttcggctgcaacagcaccctgatcaagcaccagagaatccacaccggcgagaagccctaccagtgccccgagtgcggcaagaacttcagcagaagcagcaacctgatcacccaccagaagatgcacaccggcgagaagagctacgagagcagcgagtacgaggagagcctgggccagaactgcaacgtgatcgaggagtgcagaatccagctgggcgagaagccctacagatgctgcgagtgcggcaagagcttcggcctgagcagccacctgatcagacaccagagaacccacaccggcgagaagccctacagatgcagcgagtgctggaagaccttcagccagagcagcaccctggtgatccaccagagaacccacaccggcgagaagccctacaagtgccccgactgcggcgagagcttcagccagagcttcaacctgatcagacacagaagaacccacatcggcgagaagccctacaagtgcaccagctgcgagaagtgcttcagcagaagcgcctacctgagccagcacagaaagatccacgtggagaagcccttcgagagccccgacgtgggcgacttcccccacgagtggacctggaagaactgcagcggcgagatgcccttcatcagcagcttcagcgtgagcaacagcagcagctag

SEQ ID NO: 10712 - DNA, 1824 bp, Artificial Sequence
  Description of Artificial Sequence: Synthetic coding sequence
atggagagctgcagcgtggcccaggccggcgtgcagtggcccgacctgagcagcctgcagccccccccccccagattcaagcagttcagctgccacagcctgcaggtggccggcatcaccgacctggacctgcagtgcgagatcatcagctacatcgaggtgcccacctacgagaccgacatcagcagcacccagctgcagagcatctacaagagagagaagctgtacgagtgcaagaagtgccagaagaagttcagcagcggctaccagctgatcctgcaccacagattccacgtgatcgagagaccctacgagtgcaaggagtgcggcaagaacttcagaagcggctaccagctgaccctgcaccagagattccacaccggcgagaagccctacgagtgcaccgagtgcggcaagaacttcagaagcggctaccagctgaccgtgcaccagagattccacaccggcgagaagacctacgagtgcagacagtgcggcaaggccttcatctacgccagccacatcgtgcagcacgagagaatccacaccggcggcaagccctacgagtgccaggagtgcggcagagccttcagccagggcggccacctgagaatccaccagagagtgcacaccggcgagaagccctacaagtgcaaggagtgcggcaagaccttcagcagaagaagcaacctggtggagcacggccagttccacaccgacgagaagccctacatctgcgagaagtgcggcaaggccttcagaagaggccaccagctgaccgtgcaccagagagtgcacaccggcaagaagccctacgagtgcaaggagtgcggcaagggctacaccaccgccagctacttcctgctgcaccagagaatccacaagggcggcaagccctacgagtgcaaggagtgcaagaagaccttcaccctgtacagaaacctgaccagacaccagaacatccacaccggcgagaagctgttcgagtgcaagcagtgcggcaagacctacaccaccggcagcaagctgttccagcaccagaagacccacaccggcgagaagccctacgagtgcaaggagtgcggcaaggccttcagcctgtacggctacctgaagcagcaccagaagatccacaccggcatgaagcacttcgagtgcaaggagtgcaagaagaccttcaccctgtacagaaacctgaccagacaccagaacatccacaccggcaagaagctgttcgagtgccaggagtgcggcaaggcctacagcaccggcagcaacctgatccagcacagaaagacccacaccggcgagaagccctacaagtgcaaggagtgcggcaagaccttcagcctgcacggctacctgaaccagcaccagaagatccacaccggcatgaagccctacgagtgcaaggtgtgcagaaagaccttcaccttctacagaaacctgaccctgcaccagagcatccacaccgacgagaagcccttcgagtgcaaggagtgcggcaagaccttcagaagaagcagccacctgaccgcccaccagagcatccacgccgacaagaagccctacgagtgcaaggagtgcggcaaggccttcaagatgtacggctacctgacccagcaccagaagatccacaccggcggcaagccctacgagtgcaaggagtgcggcaaggccttcagcagagccagcaacctggtgcagcacgagagaatccacaccggcgagaagccctacgtgtgcaagcagtgcggcaagaccttcagatacggcagcgccctgaaggcccaccagagaatccacagaagcatcaaggtgtag

SEQ ID NO: 10713 - DNA, 1734 bp, Artificial Sequence
  Description of Artificial Sequence: Synthetic coding sequence
atgatcctgagagaggagacccagttcaccgacctggacctgcagtgcgagatcatcagctacatcgaggtgcccacctacgagaccgacatcagcagcacccagctgcagagcatctacaagagagagaagctgtacgagtgcaagaagtgccagaagaagttcagcagcggctaccagctgatcctgcaccacagattccacgtgatcgagagaccctacgagtgcaaggagtgcggcaagaacttcagaagcggctaccagctgaccctgcaccagagattccacaccggcgagaagccctacgagtgcaccgagtgcggcaagaacttcagaagcggctaccagctgaccgtgcaccagagattccacaccggcgagaagacctacgagtgcagacagtgcggcaaggccttcatctacgccagccacatcgtgcagcacgagagaatccacaccggcggcaagccctacgagtgccaggagtgcggcagagccttcagccagggcggccacctgagaatccaccagagagtgcacaccggcgagaagccctacaagtgcaaggagtgcggcaagaccttcagcagaagaagcaacctggtggagcacggccagttccacaccgacgagaagccctacatctgcgagaagtgcggcaaggccttcagaagaggccaccagctgaccgtgcaccagagagtgcacaccggcaagaagccctacgagtgcaaggagtgcggcaagggctacaccaccgccagctacttcctgctgcaccagagaatccacaagggcggcaagccctacgagtgcaaggagtgcaagaagaccttcaccctgtacagaaacctgaccagacaccagaacatccacaccggcgagaagctgttcgagtgcaagcagtgcggcaagacctacaccaccggcagcaagctgttccagcaccagaagacccacaccggcgagaagccctacgagtgcaaggagtgcggcaaggccttcagcctgtacggctacctgaagcagcaccagaagatccacaccggcatgaagcacttcgagtgcaaggagtgcaagaagaccttcaccctgtacagaaacctgaccagacaccagaacatccacaccggcaagaagctgttcgagtgccaggagtgcggcaaggcctacagcaccggcagcaacctgatccagcacagaaagacccacaccggcgagaagccctacaagtgcaaggagtgcggcaagaccttcagcctgcacggctacctgaaccagcaccagaagatccacaccggcatgaagccctacgagtgcaaggtgtgcagaaagaccttcaccttctacagaaacctgaccctgcaccagagcatccacaccgacgagaagcccttcgagtgcaaggagtgcggcaagaccttcagaagaagcagccacctgaccgcccaccagagcatccacgccgacaagaagccctacgagtgcaaggagtgcggcaaggccttcaagatgtacggctacctgacccagcaccagaagatccacaccggcggcaagccctacgagtgcaaggagtgcggcaaggccttcagcagagccagcaacctggtgcagcacgagagaatccacaccggcgagaagccctacgtgtgcaagcagtgcggcaagaccttcagatacggcagcgccctgaaggcccaccagagaatccacagaagcatcaaggtgtag

SEQ ID NO: 10714 - DNA, 129 bp, Artificial Sequence
  Description of Artificial Sequence: Synthetic coding sequence
atgctggagaactacagaaacctggtgagcctgggcggccacagcatcagcaagcccgtggtggtggacctgctggagagaggcaaggagccctggatgatcctgagagaggagacccagttcacctag

SEQ ID NO: 10715 - DNA, 1737 bp, Artificial Sequence
  Description of Artificial Sequence: Synthetic coding sequence
atgctggagaactacagaaacctggtgagcctggacctggacctgcagtgcgagatcatcagctacatcgaggtgcccacctacgagaccgacatcagcagcacccagctgcagagcatctacaagagagagaagctgtacgagtgcaagaagtgccagaagaagttcagcagcggctaccagctgatcctgcaccacagattccacgtgatcgagagaccctacgagtgcaaggagtgcggcaagaacttcagaagcggctaccagctgaccctgcaccagagattccacaccggcgagaagccctacgagtgcaccgagtgcggcaagaacttcagaagcggctaccagctgaccgtgcaccagagattccacaccggcgagaagacctacgagtgcagacagtgcggcaaggccttcatctacgccagccacatcgtgcagcacgagagaatccacaccggcggcaagccctacgagtgccaggagtgcggcagagccttcagccagggcggccacctgagaatccaccagagagtgcacaccggcgagaagccctacaagtgcaaggagtgcggcaagaccttcagcagaagaagcaacctggtggagcacggccagttccacaccgacgagaagccctacatctgcgagaagtgcggcaaggccttcagaagaggccaccagctgaccgtgcaccagagagtgcacaccggcaagaagccctacgagtgcaaggagtgcggcaagggctacaccaccgccagctacttcctgctgcaccagagaatccacaagggcggcaagccctacgagtgcaaggagtgcaagaagaccttcaccctgtacagaaacctgaccagacaccagaacatccacaccggcgagaagctgttcgagtgcaagcagtgcggcaagacctacaccaccggcagcaagctgttccagcaccagaagacccacaccggcgagaagccctacgagtgcaaggagtgcggcaaggccttcagcctgtacggctacctgaagcagcaccagaagatccacaccggcatgaagcacttcgagtgcaaggagtgcaagaagaccttcaccctgtacagaaacctgaccagacaccagaacatccacaccggcaagaagctgttcgagtgccaggagtgcggcaaggcctacagcaccggcagcaacctgatccagcacagaaagacccacaccggcgagaagccctacaagtgcaaggagtgcggcaagaccttcagcctgcacggctacctgaaccagcaccagaagatccacaccggcatgaagccctacgagtgcaaggtgtgcagaaagaccttcaccttctacagaaacctgaccctgcaccagagcatccacaccgacgagaagcccttcgagtgcaaggagtgcggcaagaccttcagaagaagcagccacctgaccgcccaccagagcatccacgccgacaagaagccctacgagtgcaaggagtgcggcaaggccttcaagatgtacggctacctgacccagcaccagaagatccacaccggcggcaagccctacgagtgcaaggagtgcggcaaggccttcagcagagccagcaacctggtgcagcacgagagaatccacaccggcgagaagccctacgtgtgcaagcagtgcggcaagaccttcagatacggcagcgccctgaaggcccaccagagaatccacagaagcatcaaggtgtag

SEQ ID NO: 10716 - DNA, 1734 bp, Artificial Sequence
  Description of Artificial Sequence: Synthetic coding sequence
ttcatcctgagaaccagcagcttcgtgagcgacctggacctgcagtgcgagatcatcagctacatcgaggtgcccacctacgagaccgacatcagcagcacccagctgcagagcatctacaagagagagaagctgtacgagtgcaagaagtgccagaagaagttcagcagcggctaccagctgatcctgcaccacagattccacgtgatcgagagaccctacgagtgcaaggagtgcggcaagaacttcagaagcggctaccagctgaccctgcaccagagattccacaccggcgagaagccctacgagtgcaccgagtgcggcaagaacttcagaagcggctaccagctgaccgtgcaccagagattccacaccggcgagaagacctacgagtgcagacagtgcggcaaggccttcatctacgccagccacatcgtgcagcacgagagaatccacaccggcggcaagccctacgagtgccaggagtgcggcagagccttcagccagggcggccacctgagaatccaccagagagtgcacaccggcgagaagccctacaagtgcaaggagtgcggcaagaccttcagcagaagaagcaacctggtggagcacggccagttccacaccgacgagaagccctacatctgcgagaagtgcggcaaggccttcagaagaggccaccagctgaccgtgcaccagagagtgcacaccggcaagaagccctacgagtgcaaggagtgcggcaagggctacaccaccgccagctacttcctgctgcaccagagaatccacaagggcggcaagccctacgagtgcaaggagtgcaagaagaccttcaccctgtacagaaacctgaccagacaccagaacatccacaccggcgagaagctgttcgagtgcaagcagtgcggcaagacctacaccaccggcagcaagctgttccagcaccagaagacccacaccggcgagaagccctacgagtgcaaggagtgcggcaaggccttcagcctgtacggctacctgaagcagcaccagaagatccacaccggcatgaagcacttcgagtgcaaggagtgcaagaagaccttcaccctgtacagaaacctgaccagacaccagaacatccacaccggcaagaagctgttcgagtgccaggagtgcggcaaggcctacagcaccggcagcaacctgatccagcacagaaagacccacaccggcgagaagccctacaagtgcaaggagtgcggcaagaccttcagcctgcacggctacctgaaccagcaccagaagatccacaccggcatgaagccctacgagtgcaaggtgtgcagaaagaccttcaccttctacagaaacctgaccctgcaccagagcatccacaccgacgagaagcccttcgagtgcaaggagtgcggcaagaccttcagaagaagcagccacctgaccgcccaccagagcatccacgccgacaagaagccctacgagtgcaaggagtgcggcaaggccttcaagatgtacggctacctgacccagcaccagaagatccacaccggcggcaagccctacgagtgcaaggagtgcggcaaggccttcagcagagccagcaacctggtgcagcacgagagaatccacaccggcgagaagccctacgtgtgcaagcagtgcggcaagaccttcagatacggcagcgccctgaaggcccaccagagaatccacagaagcatcaaggtgtag

SEQ ID NO: 10717 - DNA, 1734 bp, Artificial Sequence; identical to SEQ ID NO: 10713
  Description of Artificial Sequence: Synthetic coding sequence

SEQ ID NO: 10718 - DNA, 1998 bp, Artificial Sequence
  Description of Artificial Sequence: Synthetic coding sequence
atgttccccgtgctggagccccaccaggtgggcctgatcagaagctacaacagcaagaccatgacctgcttccaggagctggtgaccttcagagacgtggccatcgacttcagcagacaggagtgggagtacctggaccccaaccagagagacctgtacagagacgtgatgctggagaactacagaaacctggtgagcctgggcggccacagcatcagcaagcccgtggtggtggacctgctggagagaggcaaggagccctggatgatcctgagagaggagacccagttcaccgacctggacctgcagtgcgagatcatcagctacatcgaggtgcccacctacgagaccgacatcagcagcacccagctgcagagcatctacaagagagagaagctgtacgagtgcaagaagtgccagaagaagttcagcagcggctaccagctgatcctgcaccacagattccacgtgatcgagagaccctacgagtgcaaggagtgcggcaagaacttcagaagcggctaccagctgaccctgcaccagagattccacaccggcgagaagccctacgagtgcaccgagtgcggcaagaacttcagaagcggctaccagctgaccgtgcaccagagattccacaccggcgagaagacctacgagtgcagacagtgcggcaaggccttcatctacgccagccacatcgtgcagcacgagagaatccacaccggcggcaagccctacgagtgccaggagtgcggcagagccttcagccagggcggccacctgagaatccaccagagagtgcacaccggcgagaagccctacaagtgcaaggagtgcggcaagaccttcagcagaagaagcaacctggtggagcacggccagttccacaccgacgagaagccctacatctgcgagaagtgcggcaaggccttcagaagaggccaccagctgaccgtgcaccagagagtgcacaccggcaagaagccctacgagtgcaaggagtgcggcaagggctacaccaccgccagctacttcctgctgcaccagagaatccacaagggcggcaagccctacgagtgcaaggagtgcaagaagaccttcaccctgtacagaaacctgaccagacaccagaacatccacaccggcgagaagctgttcgagtgcaagcagtgcggcaagacctacaccaccggcagcaagctgttccagcaccagaagacccacaccggcgagaagccctacgagtgcaaggagtgcggcaaggccttcagcctgtacggctacctgaagcagcaccagaagatccacaccggcatgaagcacttcgagtgcaaggagtgcaagaagaccttcaccctgtacagaaacctgaccagacaccagaacatccacaccggcaagaagctgttcgagtgccaggagtgcggcaaggcctacagcaccggcagcaacctgatccagcacagaaagacccacaccggcgagaagccctacaagtgcaaggagtgcggcaagaccttcagcctgcacggctacctgaaccagcaccagaagatccacaccggcatgaagccctacgagtgcaaggtgtgcagaaagaccttcaccttctacagaaacctgaccctgcaccagagcatccacaccgacgagaagcccttcgagtgcaaggagtgcggcaagaccttcagaagaagcagccacctgaccgcccaccagagcatccacgccgacaagaagccctacgagtgcaaggagtgcggcaaggccttcaagatgtacggctacctgacccagcaccagaagatccacaccggcggcaagccctacgagtgcaaggagtgcggcaaggccttcagcagagccagcaacctggtgcagcacgagagaatccacaccggcgagaagccctacgtgtgcaagcagtgcggcaagaccttcagatacggcagcgccctgaaggcccaccagagaatccacagaagcatcaaggtgtag

SEQ ID NO: 10719 - DNA, 1452 bp, Artificial Sequence
  Description of Artificial Sequence: Synthetic coding sequence
atgagcggcggcggccccagcggcggcggccccggcggcagcggcagagccagaaccagcagcttcgccgagcccggcggcggcggcggcggcggcggcggcggccccggcggcagcgccagcggccccggcggcaccggcggcggcaaggccagcgtgggcgccatgggcggcggcgtgggcgccagcagcagcggcggcggccccggcggcagcggcggcggcggcagcggcggccccggcgccggcaccagcttccccccccccggcgtgaagctgggcagagacagcggcaaggtgaccaccgtggtggccaccctgggccagggccccgagagaagccaggaggtggcctacaccgacatcaaggtgatcggcaacggcagcttcggcgtggtgtaccaggccagactggccgagaccagagagctggtggccatcaagaaggtgctgcaggacaagagattcaagaacagagagctgcagatcatgagaaagctggaccactgcaacatcgtgagactgagatacttcttctacagcagcggcgagaagaaggacgagctgtacctgaacctggtgctggagtacgtgcccgagaccgtgtacagagtggccagacacttcaccaaggccaagctgaccatccccatcctgtacgtgaaggtgtacatgtaccagctgttcagaagcctggcctacatccacagccagggcgtgtgccacagagacatcaagccccagaacctgctggtggaccccgacaccgccgtgctgaagctgtgcgacttcggcagcgccaagcagctggtgagaggcgagcccaacgtgagctacatctgcagcagatactacagagcccccgagctgatcttcggcgccaccgactacaccagcagcatcgacgtgtggagcgccggctgcgtgctggccgagctgctgctgggccagcccatcttccccggcgacagcggcgtggaccagctggtggagatcatcaaggtgctgggcacccccaccagagagcagatcagagagatgaaccccaactacaccgagttcaagttcccccagatcaaggcccacccctggaccaaggtgttcaagagcagaaccccccccgaggccatcgccctgtgcagcagcctgctggagtacacccccagcagcagactgagccccctggaggcctgcgcccacagcttcttcgacgagctgagatgcctgggcacccagctgcccaacaacagacccctgccccccctgttcaacttcagcgccggcgagctgagcatccagcccagcctgaacgccatcctgatccccccccacctgagaagccccgccggcaccaccaccctgacccccagcagccaggccctgaccgagacccccaccagcagcgactggcagagcaccgacgccacccccaccctgaccaacagcagctag

SEQ ID NO: 10720 - DNA, 2691 bp, Artificial Sequence
  Description of Artificial Sequence: Synthetic coding sequence
atgaccgaggagagcgaggagaccgtgctgtacatcgagcacagatacgtgtgcagcgagtgcaaccagctgtacggcagcctggaggaggtgctgatgcaccagaacagccacgtgccccagcagcacttcgagctggtgggcgtggccgaccccggcgtgaccgtggccaccgacaccgccagcggcaccggcctgtaccagaccctggtgcaggagagccagtaccagtgcctggagtgcggccagctgctgatgagccccagccagctgctggagcaccaggagctgcacctgaagatgatggccccccaggaggccgtgcccgccgagcccagccccaaggccccccccctgagcagcagcaccatccactacgagtgcgtggactgcaaggccctgttcgccagccaggagctgtggctgaaccacagacagacccacctgagagccacccccaccaaggcccccgcccccgtggtgctgggcagccccgtggtgctgggcccccccgtgggccaggccagagtggccgtggagcacagctacagaaaggccgaggagggcggcgagggcgccaccgtgcccagcgccgccgccaccaccaccgaggtggtgaccgaggtggagctgctgctgtacaagtgcagcgagtgcagccagctgttccagctgcccgccgacttcctggagcaccaggccacccacttccccgcccccgtgcccgagagccaggagcccgccctgcagcaggaggtgcaggccagcagccccgccgaggtgcccgtgagccagcccgaccccctgcccgccagcgaccacagctacgagctgagaaacggcgaggccatcggcagagacagaagaggcagaagagccagaagaaacaacagcggcgaggccggcggcgccgccacccaggagctgttctgcagcgcctgcgaccagctgttcctgagcccccaccagctgcagcagcacctgagaagccacagagagggcgtgttcaagtgccccctgtgcagcagagtgttccccagccccagcagcctggaccagcacctgggcgaccacagcagcgagagccacttcctgtgcgtggactgcggcctggccttcggcaccgaggccctgctgctggcccacagaagagcccacacccccaaccccctgcacagctgcccctgcggcaagaccttcgtgaacctgaccaagttcctgtaccacagaagaacccacggcgtgggcggcgtgcccctgcccaccacccccgtgccccccgaggagcccgtgatcggcttccccgagcccgcccccgccgagaccggcgagcccgaggcccccgagccccccgtgagcgaggagaccagcgccggccccgccgcccccggcacctacagatgcctgctgtgcagcagagagttcggcaaggccctgcagctgaccagacaccagagattcgtgcacagactggagagaagacacaagtgcagcatctgcggcaagatgttcaagaagaagagccacgtgagaaaccacctgagaacccacaccggcgagagacccttcccctgccccgactgcagcaagcccttcaacagccccgccaacctggccagacacagactgacccacaccggcgagagaccctacagatgcggcgactgcggcaaggccttcacccagagcagcaccctgagacagcacagactggtgcacgcccagcacttcccctacagatgccaggagtgcggcgtgagattccacagaccctacagactgctgatgcacagataccaccacaccggcgagtacccctacaagtgcagagagtgccccagaagcttcctgctgagaagactgctggaggtgcaccagctggtggtgcacgccggcagacagccccacagatgccccagctgcggcgccgccttccccagcagcctgagactgagagagcacagatgcgccgccgccgccgcccaggcccccagaagattcgagtgcggcacctgcggcaagaaggtgggcagcgccgccagactgcaggcccacgaggccgcccacgccgccgccggccccggcgaggtgctggccaaggagccccccgcccccagagcccccagagccaccagagcccccgtggccagccccgccgccctgggcagcaccgccaccgccagccccgccgcccccgccagaagaagaggcctggagtgcagcgagtgcaagaagctgttcagcaccgagaccagcctgcaggtgcacagaagaatccacaccggcgagagaccctacccctgccccgactgcggcaaggccttcagacagagcacccacctgaaggaccacagaagactgcacaccggcgagagacccttcgcctgcgaggtgtgcggcaaggccttcgccatcagcatgagactggccgagcacagaagaatccacaccggcgagagaccctacagctgccccgactgcggcaagagctacagaagcttcagcaacctgtggaagcacagaaagacccaccagcagcagcaccaggccgccgtgagacagcagctggccgaggccgaggccgccgtgggcctggccgtgatggagaccgccgtggaggccctgcccctggtggaggccatcgagatctaccccctggccgaggccgagggcgtgcagatcagcggctag

SEQ ID NO: 10721 - DNA, 1635 bp, Artificial Sequence
  Description of Artificial Sequence: Synthetic coding sequence
atgagcatgtgggaggacctgtgccagccctaccaggtgcccctgagccccgcctacagctggggcagaggctgccccctgcccaccacccccgtgccccccgaggagcccgtgatcggcttccccgagcccgcccccgccgagaccggcgagcccgaggcccccgagccccccgtgagcgaggagaccagcgccggccccgccgcccccggcacctacagatgcctgctgtgcagcagagagttcggcaaggccctgcagctgaccagacaccagagattcgtgcacagactggagagaagacacaagtgcagcatctgcggcaagatgttcaagaagaagagccacgtgagaaaccacctgagaacccacaccggcgagagacccttcccctgccccgactgcagcaagcccttcaacagccccgccaacctggccagacacagactgacccacaccggcgagagaccctacagatgcggcgactgcggcaaggccttcacccagagcagcaccctgagacagcacagactggtgcacgcccagcacttcccctacagatgccaggagtgcggcgtgagattccacagaccctacagactgctgatgcacagataccaccacaccggcgagtacccctacaagtgcagagagtgccccagaagcttcctgctgagaagactgctggaggtgcaccagctggtggtgcacgccggcagacagccccacagatgccccagctgcggcgccgccttccccagcagcctgagactgagagagcacagatgcgccgccgccgccgcccaggcccccagaagattcgagtgcggcacctgcggcaagaaggtgggcagcgccgccagactgcaggcccacgaggccgcccacgccgccgccggccccggcgaggtgctggccaaggagccccccgcccccagagcccccagagccaccagagcccccgtggccagccccgccgccctgggcagcaccgccaccgccagccccgccgcccccgccagaagaagaggcctggagtgcagcgagtgcaagaagctgttcagcaccgagaccagcctgcaggtgcacagaagaatccacaccggcgagagaccctacccctgccccgactgcggcaaggccttcagacagagcacccacctgaaggacaccggcgcctgcacccaggtgagcggccccctgcccgtgaagtgcgtggccagacccctgcccagcccctgcgcctggcagaacatcgccgccagcacccaggccaacgaccccacccccgccctgaccgtggccagagccaccgcccccagccccaccagcggcagcaccgccagacccatcagcagcagcatcagacagctgtgcggcagcagctggcagagaagaagactgcccctggcctggcccagctggagactgctgtggagaagatacccctggtggaagcccctgagaagcaccctgtggcccagactgagaggcagcagaagcgtggccgacagcgccagactgcccctgtggcacctgcacagcctgctgctgaaggccctgcagcaccccctgaagcacctgtacatcctgtgccccttcctgttccccagcccccccccctgcaagttctag

SEQ ID NO: 10722 - DNA, 2691 bp, Artificial Sequence; identical to SEQ ID NO: 10720
  Description of Artificial Sequence: Synthetic coding sequence

SEQ ID NO: 10723 - DNA, 738 bp, Artificial Sequence
  Description of Artificial Sequence: Synthetic coding sequence
atgctggagagaggcgccgagagcgccgccggcgccaccgaccccagccccaccggcaaggagcccgtgaccaaggaggccccccaccagggccccccccagaagcccagccagagcgcccccggccccaccgccagcgccggcagcccccccagacccagaagaagaccccccccccagagaccccacagatgccccgactgcgacaaggccttcagctaccccagcaagctggccacccacagactggcccacggcggcgccagaccccacccctgccccgactgccccaaggccttcagctaccccagcaagctggccgcccacagactgacccacagcggcgccagaccccacccctgcccccactgccccaagagcttcggccacagaagcaagctggccgcccacctgtggacccacgcccccaccagaccctacccctgccccgactgccccaagagcttctgctaccccagcaagctggccgcccacagacacacccaccacgccaccgacgccagaccctacccctgcccccactgccccaaggccttcagcttccccagcaagctggccgcccacagactgtgccacgacccccccaccgcccccggcagccaggccaccgcctggcacagatgcagcagctgcggccaggccttcggccagagaagactgctgctgctgcaccagagaagccaccaccaggtggagcacaagggcgagagagactag

SEQ ID NO: 10724 - DNA, 1035 bp, Artificial Sequence
  Description of Artificial Sequence: Synthetic coding sequence
atgagcctggtgcccggcctgaccagcatcgagcagccccagccccagctgctggaccagctgggcatccccagaagatgcttccaggactgggtggaccagaacggcctgcccggcctgagcgtgacccagcagatcagaggcatcaccctgctgagaagactggagtgcagcaacaccatcatcgcccactgcagacacgagctgctgggcccccccaccctgagccccagcgcctggagcagccccgccagccccccccccagagccctgcccctgggcagctgcgccagcaagatgctggagagaggcgccgagagcgccgccggcgccaccgaccccagccccaccggcaaggagcccgtgaccaaggaggccccccaccagggccccccccagaagcccagccagagcgcccccggccccaccgccagcgccggcagcccccccagacccagaagaagaccccccccccagagaccccacagatgccccgactgcgacaaggccttcagctaccccagcaagctggccacccacagactggcccacggcggcgccagaccccacccctgccccgactgccccaaggccttcagctaccccagcaagctggccgcccacagactgacccacagcggcgccagaccccacccctgcccccactgccccaagagcttcggccacagaagcaagctggccgcccacctgtggacccacgcccccaccagaccctacccctgccccgactgccccaagagcttctgctaccccagcaagctggccgcccacagacacacccaccacgccaccgacgccagaccctacccctgcccccactgccccaaggccttcagcttccccagcaagctggccgcccacagactgtgccacgacccccccaccgcccccggcagccaggccaccgcctggcacagatgcagcagctgcggccaggccttcggccagagaagactgctgctgctgcaccagagaagccaccaccaggtggagcacaagggcgagagagactag

SEQ ID NO: 10725 - DNA, 513 bp, Artificial Sequence
  Description of Artificial Sequence: Synthetic coding sequence
atggaggaccccaaccccgaggagaacatgaagcagcaggacagccccaaggagagaagcccccagagccccggcggcaacatctgccacctgggcgcccccaagtgcaccagatgcctgatcaccttcgccgacagcaagttccaggagagacacatgaagagagagcaccccgccgacttcgtggcccagaagctgcagggcgtgctgttcatctgcttcacctgcgccagaagcttccccagcagcaaggccctgatcacccaccagagaagccacggccccgccgccaagcccaccctgcccgtggccaccaccaccgcccagcccaccttcccctgccccgactgcggcaagaccttcggccaggccgtgagcctgagaagacacagacagatgcacgaggtgagagccccccccggcaccttcgcctgcaccgagtgcggccaggacttcgcccaggaggccggcctgcaccagcactacatcagacacgccagaggcgagctgtag

SEQ ID NO: 10726 - DNA, 513 bp, Artificial Sequence; identical to SEQ ID NO: 10725
  Description of Artificial Sequence: Synthetic coding sequence

SEQ ID NO: 10727 - DNA, 513 bp, Artificial Sequence; identical to SEQ ID NO: 10725
  Description of Artificial Sequence: Synthetic coding sequence

SEQ ID NO: 10728 - DNA, 513 bp, Artificial Sequence; identical to SEQ ID NO: 10725
  Description of Artificial Sequence: Synthetic coding sequence

SEQ ID NO: 10729 - DNA, 513 bp, Artificial Sequence; identical to SEQ ID NO: 10725
  Description of Artificial Sequence: Synthetic coding sequence

SEQ ID NO: 10730 - DNA, 513 bp, Artificial Sequence; identical to SEQ ID NO: 10725
  Description of Artificial Sequence: Synthetic coding sequence

SEQ ID NO: 10731 - DNA, 1458 bp, Artificial Sequence
  Description of Artificial Sequence: Synthetic coding sequence
atgaagaacgccaccatcgtgatgagcgtgagaagagagcagggcagcagcagcggcgagggcagcctgagcttcgaggacgtggccgtgggcttcaccagagaggagtggcagttcctggaccagagccagaaggtgctgtacaaggaggtgatgctggagaactacatcaacctggtgagcatcggctacagaggcaccaagcccgacagcctgttcaagctggagcagggcgagccccccggcatcgccgagggcgccgcccacagccagatctgccccggcttcgtgatccagagcagaagatacgccggcaaggacagcgacgccttcggcggctacggcagaagctgcctgcacatcaagagagacaagaccctgaccggcgtgaagtaccacagatgcgtgaagcccagcagccccaagagccagctgaacgacctgcagaagatctgcgccggcggcaagccccacgagtgcagcgtgtgcggcagagccttcagcagaaaggcccagctgatccagcaccagagaaccgagagaggcgagaagccccacggctgcggcgagtgcggcaagaccttcatgagaaagatccagctgaccgagcaccagagaacccacaccggcgagaagccccacgagtgcagcgagtgcggcaaggccttcagcagaaagagccagctgatggtgcaccagagaacccacaccggcgagaagccctacagatgcagcaagtgcggcaaggccttcagcagaaagtgcagactgaacagacaccagagaagccacaccggcgagaagctgtacggctgcagcgtgtgcggcaaggccttcagccagaaggcctacctgaccgcccaccagagactgcacaccggcgacaagccctacaagtgcagcgactgcggcagaaccttctacttcaagagcgacctgaccagacaccagagaatccacaccggcgagaagccctacgagtgcagcgagtgcgagaaggccttcagaagcaagagcaagctgatccagcaccagagaacccacaccggcgagagaccctacagctgcagagagtgcggcaaggccttcgcccacatgagcgtgctgatcaagcacgagaagacccacatcagagagaccgccatcaacagcctgaccgtggagaagcccagcagcagaagccacaccagcctgtacatgagcgagctgatccaggagcagaagaccgtgaacaccgtgcccatcgagatgcccagcagcggcaccccccccctgctgaacaagagcgagagactggtgggcagaaacgtggtgatcgtggagcagcccttccccagaaaccaggccttcgtggtgaaccaggagttcgagcagagaatcagcctgaccaacgaggtgaacgtggcccccagcgtgatcaactacatcctgtacctgaccgacatcgtgagcgagtag

SEQ ID NO: 10732 - DNA, 135 bp, Artificial Sequence
  Description of Artificial Sequence: Synthetic coding sequence
atgaagaacgccaccatcgtgatgagcgtgagaagagagcagggcagcagcagcggcgagggcagcctgagcttcgaggacgtggccgtgggcttcaccagagaggagtggcagttcctggaccagagccagtag

SEQ ID NO: 10733 - DNA, 177 bp, Artificial Sequence
  Description of Artificial Sequence: Synthetic coding sequence
atgaagaacgccaccatcgtgatgagcgtgagaagagagcagggcagcagcagcggcgagggcagcctgagcttcgaggacgtggccgtgggcttcaccagagaggagtggcagttcctggaccagagccagaaggtgctgtacaaggaggtgatgctggagaactacatcaactag

SEQ ID NO: 10734 - DNA, 189 bp, Artificial Sequence
  Description of Artificial Sequence: Synthetic coding sequence
atgaagaacgccaccatcgtgatgagcgtgagaagagagcagggcagcagcagcggcgagggcagcctgagcttcgaggacgtggccgtgggcttcaccagagaggagtggcagttcctggaccagagccagaaggtgctgtacaaggaggtgatgctggagaactacatcaacctggtgagcatctag

SEQ ID NO: 10735 - DNA, 1443 bp, Artificial Sequence
  Description of Artificial Sequence: Synthetic coding sequence
atgaagaacgccaccatcgtgatgagcgtgagaagagagcagggcagcagcagcggcgagggcagcctgagcttcgaggacgtggccgtgggcttcaccagagaggagtggcagttcctggaccagagccagaaggtgctgtacaaggaggtgatgctggagaactacatcaacctggtgagcatcggctacagaggcaccaagcccgacagcctgttcaagctggagcagggcgagccccccggcatcgccgagggcgccgcccacagccagatctgccccggcttcgtgatccagagcagaagatacgccggcaaggacagcgacgccttcggcggctacggcagaagctgcctgcacatcaagagagacaagaccctgaccggcgtgaagtaccacagatgcgtgaagcccagcagccccaagagccagctgaacgacctgcagaagatctgcgccggcggcaagccccacgagtgcagcgtgtgcggcagagccttcagcagaaaggcccagctgatccagcaccagagaaccgagagaggcgagaagccccacggctgcggcgagtgcggcaagaccttcatgagaaagatccagctgaccgagcaccagagaacccacaccggcgagaagccccacgagtgcagcgagtgcggcaaggccttcagcagaaagagccagctgatggtgcaccagagaacccacaccggcgagaagccctacagatgcagcaagtgcggcaaggccttcagcagaaagtgcagactgaacagacaccagagaagccacaccggcgagaagctgtacggctgcagcgtgtgcggcaaggccttcagccagaaggcctacctgaccgcccaccagagactgcacaccggcgacaagccctacaagtgcagcgactgcggcagaaccttctacttcaagagcgacctgaccagacaccagagaatccacaccggcgagaagccctacgagtgcagcgagtgcgagaaggccttcagaagcaagagcaagctgatccagcaccagagaacccacaccggcgagagaccctacagctgcagagagtgcggcaaggccttcgcccacatgagcgtgctgatcaagcacgagaagacccacatcagagagaccgccatcaacagcctgaccgtggagaagcccagcagcagaagccacaccagcctgtacatgagcgagctgatccaggagcagaagaccgtgaacaccgtgcccatcgagatgcccagcagcggcaccccccccctgctgaacaagagcgagagactggtgggcagaaacgtggtgatcgtggagcagcccttccccagaaaccaggccttcgtggtgaaccaggagttcgagcagagaatcagcctgaccaacgaggtgaacgtggcccccagcgtgatcaactacatcctgtacctgacctag

SEQ ID NO: 10736 - DNA, 1689 bp, Artificial Sequence
  Description of Artificial Sequence: Synthetic coding sequence
atggacccccagccccccccccccgcccagggcagccccccccacagaggcagaggcagaggcagaggcagaggcagaggcagaggcagaggcagaggcagaggcggcgccggcgcccccagagcccccctgccctgccccacctgcggcagactgttcagattcccctactacctgagcagacacagactgagccacagcggcctgagaccccacgcctgccccctgtgccccaaggccttcagaagacccgcccacctgagcagacacctgagaggccacggcccccagccccccctgagatgcgccgcctgccccagaaccttccccgagcccgcccagctgagaagacacctggcccaggagcacgccggcggcgaggtggagctggccatcgagagagtggccaaggagaccgccgagcccagctggggcccccaggacgagggcagcgagccccccaccaccgccgccgccggcgccaccgaggaggaggccgtggccgcctggcccgagacctggcccgccggcgagcccagcaccctggccgcccccaccagcgccgccgagcccagagagagcgagagcgaggaggccgaggccggcgccgccgagctgagagccgagctggccctggccgccggcagacaggaggagaagcaggtgctgctgcaggccgactggaccctgctgtgcctgagatgcagagaggccttcgccaccaagggcgagctgaaggcccacccctgcctgagacccgagggcgagcaggagggcgagggcggccccccccccagacccaagagacaccagtgcagcatctgcctgaaggccttcgccagaccctggagcctgagcagacacagactggtgcacagcaccgacagacccttcgtgtgccccgactgcggcctggccttcagactggccagctacctgagacagcacagaagagtgcacggccccctgagcctgctggcccccctgcccgccgccggcaagaaggacgacaaggccagcggcgccagaaacagcgccaagggccccgagggcggcgagggcgccgagtgcggcggcgccagcgagggcggcgagggccagaacggcggcgacgccgcccccgccagaccccccgccggcgagcccagattctggtgccccgagtgcggcaagggcttcagaagaagagcccacctgagacagcacggcgtgacccacagcggcgccagacccttccagtgcgtgagatgccagagagagttcaagagactggccgacctggccagacacgcccaggtgcacgccggcggccccgccccccacccctgccccagatgccccagaagattcagcagagcctacagcctgctgagacaccagagatgccacagagccgagctggagagagccgccgccctgcaggccctgcaggcccaggcccccaccagccccccccccccccccccccccctgaaggccgagcaggaggaggagggcctgcccctgcccctggccaacatcaaggaggagccccccagccccggcacccccccccagagcccccccgccccccccgtgttcctgagcgccagctgcttcgacagccaggaccacagcgccttcgagatggaggaggaggaggtggacagcaaggcccacctgagaggcctgggcggcctggccagctag

SEQ ID NO: 10737 - DNA, 519 bp, Artificial Sequence
  Description of Artificial Sequence: Synthetic coding sequence
atgctgctgctgccccccagacccccccaccccagaagcagcagccccgaggccatggacccccccccccccaaggccccccccttccccaaggccgagggccccagcagcacccccagcagcgccgccggccccagaccccccagactgggcagacacctgctgatcgacgccaacggcgtgccctacacctacaccgtgcagctggaggaggagcccagaggccccccccagagagaggccccccccggcgagcccggccccagaaagggctacagctgccccgagtgcgccagagtgttcgccagccccctgagactgcagagccacagagtgagccacagcgacctgaagcccttcacctgcggcgcctgcggcaaggccttcaagagaagcagccacctgagcagacacagagccacccacagagccagagccggccccccccacacctgccccctgtgccccagaagattccaggacgccgccgagctggcccagcacgtgagactgcactag

SEQ ID NO: 10738 - DNA, 519 bp, Artificial Sequence; identical to SEQ ID NO: 10737
  Description of Artificial Sequence: Synthetic coding sequence

SEQ ID NO: 10739 - DNA, 519 bp, Artificial Sequence; identical to SEQ ID NO: 10737
  Description of Artificial Sequence: Synthetic coding sequence

SEQ ID NO: 10740 - DNA, 594 bp, Artificial Sequence
  Description of Artificial Sequence: Synthetic coding sequence
atgctggtgctgcccagcccctgcccccagcccctggccttcagcagcgtggagaccatggagggcccccccagaagaacctgcagaagccccgagcccggccccagcagcagcatcggcagcccccaggccagcagcccccccagacccaaccactacctgctgatcgacacccagggcgtgccctacaccgtgctggtggacgaggagagccagagagagcccggcgccagcggcgcccccggccagaagaagtgctacagctgccccgtgtgcagcagagtgttcgagtacatgagctacctgcagagacacagcatcacccacagcgaggtgaagcccttcgagtgcgacatctgcggcaaggccttcaagagagccagccacctggccagacaccacagcatccacctggccggcggcggcagaccccacggctgccccctgtgccccagaagattcagagacgccggcgagctggcccagcacagcagagtgcacagcggcgagagacccttccagtgcccccactgccccagaagattcatggagcagaacaccctgcagaagcacaccagatggaagcacccctag

SEQ ID NO: 10741 - DNA, 1554 bp, Artificial Sequence
  Description of Artificial Sequence: Synthetic coding sequence
atgagcctgggcagcgagctgttcagagacgtggccatcgtgttcagccaggaggagtggcagtggctggcccccgcccagagagacctgtacagagacgtgatgctggagacctacagcaacctggtgagcctgggcctggccgtgagcaagcccgacgtgatcagcttcctggagcagggcaaggagccctggatggtggagagagtggtgagcggcggcctgtgccccgtgctggagagcagatacgacaccaaggagctgttccccaagcagcacgtgtacgaggtggagagcccccagtgggagatcatggagagcctgaccagctacggcctggagtgcagcagcttccaggacgactgggagtgcagaaaccagttcgacagacagcagggcaaccccgacagacacttccaccagatgatcatcagacacgaggagatgcccaccttcgaccagcacgccagcctgaccttctaccagaagatccacaccagagagaagcccttcggctacaacaagtgcagaaaggacttctggcagaaggagctgctgatcaaccaccagggcatctacaccaacgagaagccctacaagtgcaaggagtgcggcaaggccttcaagtacggcagcagactgatccagcacgagaacatccacagcggcaagaagccctacgagtgcaaggagtgcggcaaggccttcaacagcggcagcaacttcatccagcaccagagagtgcacaccggcgagaagccctacgagtgcaaggactgcgagaaggccttcagcagaagcagccagctgatcgagcaccagagaacccacaccggcgagaagccctaccagtgcaaggagtgcggcaaggccttcaacagaatcagccacctgaaggtgcactacagaatccacaccggcgagaagccctacgcctgcaaggagtgcggcaagaccttcagccacagaagccagctgatccagcaccagaccgtgcacaccggcagaaagctgtacgagtgcaaggagtgcggcaaggccttcaaccagggcagcaccctgatcagacaccagagaatccacaccggcgagaagccctacgagtgcaaggtgtgcggcaaggccttcagagtgagcagccagctgaagcagcaccagagaatccacaccggcgagaagccctaccagtgcaaggtgtgcggcagagccttcaagagagtgagccacctgaccgtgcactacagaatccacaccggcgagaagccctacgagtgcaaggagtgcggcaaggccttcagccactgcagccagctgatccaccaccaggtgatccacaccgagaagaagccctacgagtacaaggagtgcgagaagaccctgagccacgacagcaccaccgtgcagccccagagaatgcacaacagagagacccacgtgaacatcatcaacgtggagaagcccagcatcagcagctaccccctgctgatcatcagagagttcatgctggccagcaaccacatgaacggcagcaacggcgagagccccctggcctag

SEQ ID NO: 10742 - DNA, 1710 bp, Artificial Sequence
  Description of Artificial Sequence: Synthetic coding sequence
atgagcaaggacctggtgaccttcggcgacgtggccgtgaacttcagccaggaggagtgggagtggctgaaccccgcccagagaaacctgtacagaaaggtgatgctggagaactacagaagcctggtgagcctgggcgtgagcgtgagcaagcccgacgtgatcagcctgctggagcagggcaaggagccctggatggtgaagaaggagggcaccagaggcccctgccccgactgggagtacgtgttcaagaacagcgagttcagcagcaagcaggagacctacgaggagagcagcaaggtggtgaccgtgggcgccagacacctgagctacagcctggactaccccagcctgagagaggactgccagagcgaggactggtacaagaaccagctgggcagccaggaggtgcacctgagccagctgatcatcacccacaaggagatcctgcccgaggtgcagaacaaggagtacaacaagagctggcagaccttccaccaggacaccatcttcgacatccagcagagcttccccaccaaggagaaggcccacaagcacgagccccagaagaagagctacagaaagaagagcgtggagatgaagcacagaaaggtgtacgtggagaagaagctgctgaagtgcaacgactgcgagaaggtgttcaaccagagcagcagcctgaccctgcaccagagaatccacaccggcgagaagccctacgcctgcgtggagtgcggcaagaccttcagccagagcgccaacctggcccagcacaagagaatccacaccggcgagaagccctacgagtgcaaggagtgcagaaaggccttcagccagaacgcccacctggcccagcaccagagagtgcacaccggcgagaagccctaccagtgcaaggagtgcaagaaggccttcagccagatcgcccacctgacccagcaccagagagtgcacaccggcgagagacccttcgagtgcatcgagtgcggcaaggccttcagcaacggcagcttcctggcccagcaccagagaatccacaccggcgagaagccctacgtgtgcaacgtgtgcggcaaggccttcagccacagaggctacctgatcgtgcaccagagaatccacaccggcgagagaccctacgagtgcaaggagtgcagaaaggccttcagccagtacgcccacctggcccagcaccagagagtgcacaccggcgagaagccctacgagtgcaaggtgtgcagaaaggccttcagccagatcgcctacctggaccagcaccagagagtgcacaccggcgagaagccctacgagtgcatcgagtgcggcaaggccttcagcaacagcagcagcctggcccagcaccagagaagccacaccggcgagaagccctacatgtgcaaggagtgcagaaagaccttcagccagaacgccggcctggcccagcaccagagaatccacaccggcgagaagccctacgagtgcaacgtgtgcggcaaggccttcagctacagcggcagcctgaccctgcaccagagaatccacaccggcgagagaccctacgagtgcaaggactgcagaaagagcttcagacagagagcccacctggcccaccacgagagaatccacaccatggagagcttcctgaccctgagcagccccagccccagcaccagcaaccagctgcccagacccgtgggcttcatcagctag

SEQ ID NO: 10743 - DNA, 1710 bp, Artificial Sequence; identical to SEQ ID NO: 10742
  Description of Artificial Sequence: Synthetic coding sequence

SEQ ID NO: 10744 - DNA, 414 bp, Artificial Sequence
  Description of Artificial Sequence: Synthetic coding sequence
atgagcaaggacctggtgaccttcggcgacgtggccgtgaacttcagccaggaggagtgggagtggctgaaccccgcccagagaaacctgtacagaaaggtgatgctggagaactacagaagcctggtgagcctgggcgtgagcgtgagcaagcccgacgtgatcagcctgctggagcagggcaaggagccctggatggtgaagaaggagggcaccagaggcccctgccccgactgggagtacgtgttcaagaacagcgagttcagcagcaagcaggagacctacgaggagagcagcaaggtggtgaccgtgggcgccagacacctgagctacagcctggactaccccagcctgagagaggactgccagagcgaggactggtacaagaaccagctgggcagccaggaggtgtag

SEQ ID NO: 10745 - DNA, 390 bp, Artificial Sequence
  Description of Artificial Sequence: Synthetic coding sequence
atgagcaaggacctggtgaccttcggcgacgtggccgtgaacttcagccaggaggagtgggagtggctgaaccccgcccagagaaacctgtacagaaaggtgatgctggagaactacagaagcctggtgagcctgggcgtgagcgtgagcaagcccgacgtgatcagcctgctggagcagggcaaggagccctggatggtgaagaaggagggcaccagaggcccctgccccgactgggagtacgtgttcaagaacagcgagttcagcagcaagcaggagacctacgaggagagcagcaaggtggtgaccgtgggcgccagacacctgagctacagcctggactaccccagcctgagagaggactgccagagcgaggactggtacaagtag

SEQ ID NO: 10746 - DNA, 1266 bp, Artificial Sequence
  Description of Artificial Sequence: Synthetic coding sequence
atggccggcgaggccgaggcccagctggaccccagcctgcagggcctggtgatgttcgaggacgtgaccgtgtacttcagcagagaggagtggggcctgctgaacgtgacccagaagggcctgtacagagacgtgatgctggagaacttcgccctggtgagcagcctgggcctggcccccagcagaagccccgtgttcacccagctggaggacgacgagcagagctgggtgcccagctgggtggacgtgacccccgtgagcagagccgaggccagaagaggcttcggcctggacggcctgtgcagagtggaggacgagagagcccaccccgagcacctgaagagctacagagtgatccagcaccaggacacccacagcgagggcaagcccagaagacacaccgagcacggcgccgccttcccccccggcagcagctgcggccagcagcaggaggtgcacgtggccgagaagctgttcaagtgcagcgactgcggcaaggtgttcctgaaggccttcgccctgctggaccacctgatcacccacagcgaggagagacccttcagatgccccaccggcagaagcgccttcaagaagagcgcccacatcaaccccagaaagatccacaccggcgagaccgcccacgtgtgcaacgagtgcggcaaggccttcagctaccccagcaagctgagaaagcaccagaaggtgcacaccggcatcaagcccttcaagtgcagcgactgcggcaagaccttcaacagaaaggacgccctggtgctgcaccagagaatccacaccggcgagagaccctacgagtgcagcaagtgcggcaagaccttcagcgtgctgagcaccctgatcagacacagaaaggtgcacatcggcgagagaccctacgagtgcaccgagtgcggcaagttcttcaagtacaacaacagcttcatcctgcaccagagagtgcacaccggcgagagacccttcgagtgcaagcagtgcggcaagggctacgtgaccagaagcggcctgtaccagcactggaaggtgcacaccggcgagagaccctacgagtgcagcctgtgcggcaagaccttcaccaccagaagctacagaaacagacaccagcagttccacaccgaggagagaagctacgagtgcaccgagtgcggcaaggccttcaagcacagcagcaccctgctgcagcacaagaaggtgcacacccccgagagaagacaggaggacagagcccacggcaaggtggtgagctgctag

SEQ ID NO: 10747 - DNA, 438 bp, Artificial Sequence
  Description of Artificial Sequence: Synthetic coding sequence
atggccggcgaggccgagggcctggtgatgttcgaggacgtgaccgtgtacttcagcagagaggagtggggcctgctgaacgtgacccagaagggcctgtacagagacgtgatgctggagaacttcgccctggtgagcagcctgggcctggcccccagcagaagccccgtgttcacccagctggaggacgacgagcagagctgggtgcccagctgggtggacgtgacccccgtgagcagagccgaggccagaagaggcttcggcctgggccccgcctgcagctgcctgagcggcctgagactgctgatcgccctgctgtgcatctgcgccgagctgagcaccgtgggcgacagcgtgagagtgctgaagtgcgcccacatcctgaagcagatggtgtgcgtggagtggagaatgagagagcccatcctgagcatctag

SEQ ID NO: 10748 - DNA, 924 bp, Artificial Sequence
  Description of Artificial Sequence: Synthetic coding sequence
cccggcagcagctgcggccagcagcaggaggtgcacgtggccgagaagctgttcaagtgcagcgactgcggcaaggtgttcctgaaggccttcgccctgctggaccacctgatcacccacagcgaggagagacccttcagatgccccaccggcagaagcgccttcaagaagagcgcccacatcaaccccagaaagatccacaccggcgagaccgcccacgtgtgcaacgagtgcggcaaggccttcagctaccccagcaagctgagaaagcaccagaaggtgcacaccggcatcaagcccttcaagtgcagcgactgcggcaagaccttcaacagaaaggacgccctggtgctgcaccagagaatccacaccggcgagagaccctacgagtgcagcaagtgcggcaagaccttcagcgtgctgagcaccctgatcagacacagaaaggtgcacatcggcgagagaccctacgagtgcaccgagtgcggcaagttcttcaagtacaacaacagcttcatcctgcaccagagagtgcacaccggcgagagacccttcgagtgcaagcagtgcggcaagggctacgtgaccagaagcggcctgtaccagcactggaaggtgcacaccggcgagagaccctacgagtgcagcctgtgcggcaagaccttcaccaccagaagctacagaaacagacaccagcagttccacaccgaggagagaagctacgagtgcaccgagtgcggcaaggccttcaagcacagcagcaccctgctgcagcacaagaaggtgcacacccccgagagacccttcatctgcttcaactgcggcaagaacttcaacatgagcagctgcctggcctggcaccagaagctgcaccccggcgagaagcccttcgactacagcaagtgcagaaaggtgttcacctag

SEQ ID NO: 10749 - DNA, 2145 bp, Artificial Sequence
  Description of Artificial Sequence: Synthetic coding sequence
atgctggagacctacagccacctgctgagcgtgggctaccaggtgcccgaggccgaggtggtgatgctggagcagggcaaggagccctgggccctgcagggcgagagacccagacagagctgccccggcgagaagctgtgggaccacaaccagtgcagaaagatcctgagctacaagcaggtgagcagccagccccagaagatgtaccccggcgagaaggcctacgagtgcgccaagttcgagaagatcttcacccagaagagccagctgaaggtgcacctgaaggtgctggccggcgagaagctgtacgtgtgcatcgagtgcggcaaggccttcgtgcagaagcccgagttcatcatccaccagaagacccacatgagagagaagcccttcaagtgcaacgagtgcggcaagagcttcttccaggtgagcagcctgttcagacaccagagaatccacaccggcgagaagctgtacgagtgcagccagtgcggcaagggcttcagctacaacagcgacctgagcatccacgagaagatccacaccggcgagagacaccacgagtgcaccgactgcggcaaggccttcacccagaagagcaccctgaagatgcaccagaagatccacaccggcgagagaagctacatctgcatcgagtgcggccaggccttcatccagaagacccacctgatcgcccacagaagaatccacaccggcgagaagccctacgagtgcagcaactgcggcaagagcttcatcagcaagagccagctgcaggtgcaccagagagtgcacaccagagtgaagccctacatctgcaccgagtacggcaaggtgttcagcaacaacagcaacctggtgacccacaagaaggtgcagagcagagagaagagcagcatctgcaccgagtgcggcaaggccttcacctacagaagcgagctgatcatccaccagagaatccacaccggcgagaagccctacgagtgcagcgactgcggcaaggccttcacccagaagagcgccctgaccgtgcaccagagaatccacaccggcgagaagagctacatctgcatgaagtgcggcctggccttcatccagaaggcccacctgatcgcccaccagatcatccacaccggcgagaagccccacaagtgcggccactgcggcaagctgttcaccagcaagagccagctgcacgtgcacaagagaatccacaccggcgagaagccctacatgtgcaacaagtgcggcaaggccttcaccaacagaagcaacctgatcacccaccagaagacccacaccggcgagaagagctacatctgcagcaagtgcggcaaggccttcacccagagaagcgacctgatcacccaccagagaatccacaccggcgagaagccctacgagtgcaacacctgcggcaaggccttcacccagaagagccacctgaacatccaccagaagatccacaccggcgagagacagtacgagtgccacgagtgcggcaaggccttcaaccagaagagcatcctgatcgtgcaccagaagatccacaccggcgagaagccctacgtgtgcaccgagtgcggcagagccttcatcagaaagagcaacttcatcacccaccagagaatccacaccggcgagaagccctacgagtgcagcgactgcggcaagagcttcaccagcaagagccagctgctggtgcaccagcccgtgcacaccggcgagaagccctacgtgtgcgccgagtgcggcaaggccttcagcggcagaagcaacctgagcaagcaccagaagacccacaccggcgagaagccctacatctgcagcgagtgcggcaagaccttcagacagaagagcgagctgatcacccaccacagaatccacaccggcgagaagccctacgagtgcagcgactgcggcaagagcttcaccaagaagagccagctgcaggtgcaccagagaatccacaccggcgagaagccctacgtgtgcgccgagtgcggcaaggccttcaccgacagaagcaacctgaacaagcaccagaccacccacaccggcgacaagccctacaagtgcggcatctgcggcaagggcttcgtgcagaagagcgtgttcagcgtgcaccagagcagccacgcctag

SEQ ID NO: 10750 - DNA, 1221 bp, Artificial Sequence
  Description of Artificial Sequence: Synthetic coding sequence
atgctggagacctacagccacctgctgagcgtgggctaccaggtgcccgaggccgaggtggtgatgctggagcagggcaaggagccctgggccctgcagggcgagagacccagacagagctgccccggcgagaagctgtgggaccacaaccagtgcagaaagatcctgagctacaagcaggtgagcagccagccccagaagatgtaccccggcgagaaggcctacgagtgcgccaagttcgagaagatcttcacccagaagagccagctgaaggtgcacctgaaggtgctggccggcgagaagctgtacgtgtgcatcgagtgcggcaaggccttcgtgcagaagcccgagttcatcatccaccagaagacccacatgagagagaagcccttcaagtgcaacgagtgcggcaagagcttcttccaggtgagcagcctgttcagacaccagagaatccacaccggcgagaagctgtacgagtgcagccagtgcggcaagggcttcagctacaacagcgacctgagcatccacgagaagatccacaccggcgagagacaccacgagtgcaccgactgcggcaaggccttcacccagaagagcaccctgaagatgcaccagaagatccacaccggcgagagaagctacatctgcatcgagtgcggccaggccttcatccagaagacccacctgatcgcccacagaagaatccacaccggcgagaagccctacgagtgcagcaactgcggcaagagcttcatcagcaagagccagctgcaggtgcaccagagagtgcacaccagagtgaagccctacatctgcaccgagtacggcaaggtgttcagcaacaacagcaacctggtgacccacaagaaggtgcagagcagagagaagagcagcatctgcaccgagtgcggcaaggccttcacctacagaagcgacctgatcacccaccacagaatccacaccggcgagaagccctacgagtgcagcgactgcggcaagagcttcaccaagaagagccagctgcaggtgcaccagagaatccacaccggcgagaagccctacgtgtgcgccgagtgcggcaaggccttcaccgacagaagcaacctgaacaagcaccagaccacccacaccggcgacaagccctacaagtgcggcatctgcggcaagggcttcgtgcagaagagcgtgttcagcgtgcaccagagcagccacgcctag

SEQ ID NO: 10751 - DNA, 2310 bp, Artificial Sequence
  Description of Artificial Sequence: Synthetic coding sequence
atgcccgccaactggaccagcccccagaagagcagcgccctggcccccgaggaccacggcagcagctacgagggcagcgtgagcttcagagacgtggccatcgacttcagcagagaggagtggagacacctggaccccagccagagaaacctgtacagagacgtgatgctggagacctacagccacctgctgagcgtgggctaccaggtgcccgaggccgaggtggtgatgctggagcagggcaaggagccctgggccctgcagggcgagagacccagacagagctgccccggcgagaagctgtgggaccacaaccagtgcagaaagatcctgagctacaagcaggtgagcagccagccccagaagatgtaccccggcgagaaggcctacgagtgcgccaagttcgagaagatcttcacccagaagagccagctgaaggtgcacctgaaggtgctggccggcgagaagctgtacgtgtgcatcgagtgcggcaaggccttcgtgcagaagcccgagttcatcatccaccagaagacccacatgagagagaagcccttcaagtgcaacgagtgcggcaagagcttcttccaggtgagcagcctgttcagacaccagagaatccacaccggcgagaagctgtacgagtgcagccagtgcggcaagggcttcagctacaacagcgacctgagcatccacgagaagatccacaccggcgagagacaccacgagtgcaccgactgcggcaaggccttcacccagaagagcaccctgaagatgcaccagaagatccacaccggcgagagaagctacatctgcatcgagtgcggccaggccttcatccagaagacccacctgatcgcccacagaagaatccacaccggcgagaagccctacgagtgcagcaactgcggcaagagcttcatcagcaagagccagctgcaggtgcaccagagagtgcacaccagagtgaagccctacatctgcaccgagtacggcaaggtgttcagcaacaacagcaacctggtgacccacaagaaggtgcagagcagagagaagagcagcatctgcaccgagtgcggcaaggccttcacctacagaagcgagctgatcatccaccagagaatccacaccggcgagaagccctacgagtgcagcgactgcggcaaggccttcacccagaagagcgccctgaccgtgcaccagagaatccacaccggcgagaagagctacatctgcatgaagtgcggcctggccttcatccagaaggcccacctgatcgcccaccagatcatccacaccggcgagaagccccacaagtgcggccactgcggcaagctgttcaccagcaagagccagctgcacgtgcacaagagaatccacaccggcgagaagccctacatgtgcaacaagtgcggcaaggccttcaccaacagaagcaacctgatcacccaccagaagacccacaccggcgagaagagctacatctgcagcaagtgcggcaaggccttcacccagagaagcgacctgatcacccaccagagaatccacaccggcgagaagccctacgagtgcaacacctgcggcaaggccttcacccagaagagccacctgaacatccaccagaagatccacaccggcgagagacagtacgagtgccacgagtgcggcaaggccttcaaccagaagagcatcctgatcgtgcaccagaagatccacaccggcgagaagccctacgtgtgcaccgagtgcggcagagccttcatcagaaagagcaacttcatcacccaccagagaatccacaccggcgagaagccctacgagtgcagcgactgcggcaagagcttcaccagcaagagccagctgctggtgcaccagcccgtgcacaccggcgagaagccctacgtgtgcgccgagtgcggcaaggccttcagcggcagaagcaacctgagcaagcaccagaagacccacaccggcgagaagccctacatctgcagcgagtgcggcaagaccttcagacagaagagcgagctgatcacccaccacagaatccacaccggcgagaagccctacgagtgcagcgactgcggcaagagcttcaccaagaagagccagctgcaggtgcaccagagaatccacaccggcgagaagccctacgtgtgcgccgagtgcggcaaggccttcaccgacagaagcaacctgaacaagcaccagaccacccacaccggcgacaagccctacaagtgcggcatctgcggcaagggcttcgtgcagaagagcgtgttcagcgtgcaccagagcagccacgcctag

SEQ ID NO: 10752 - DNA, 2145 bp, Artificial Sequence; identical to SEQ ID NO: 10749
  Description of Artificial Sequence: Synthetic coding sequence

SEQ ID NO: 10753 - DNA, 1074 bp, Artificial Sequence
  Description of Artificial Sequence: Synthetic coding sequence
atgaagtgcggcctggccttcatcagaaaggcccacctgatcacccaccagatcatccacaccggcgagaagccctacaagtgcggccactgcggcaagctgttcaccagcaagagccagctgcacgtgcacaagagaatccacaccggcgagaagccctacgtgtgcaacaagtgcggcaaggccttcaccaacagaagcaacctgatcacccaccagaagacccacaccggcgagaagagctacatctgcagcaagtgcggcaaggccttcacccagagaagcgacctgatcacccaccagagaatccacaccggcgagaagccctacgagtgcaacacctgcggcaaggccttcacccagaagagcaacctgaacatccaccagaagatccacaccggcgagagacagtacgagtgccacgagtgcggcaaggccttcaaccagaagagcatcctgatcgtgcaccagaagatccacaccggcgagaagccctacgtgtgcaccgagtgcggcagagccttcatcagaaagagcaacttcatcacccaccagagaatccacaccggcgagaagccctacgagtgcagcgactgcggcaagagcttcaccagcaagagccagctgctggtgcaccagcccgtgcacaccggcgagaagccctacgtgtgcgccgagtgcggcaaggccttcagcggcagaagcaacctgagcaagcaccagaagacccacaccggcgagaagccctacatctgcagcgagtgcggcaagaccttcagacagaagagcgagctgatcacccaccacagaatccacaccggcgagaagccctacgagtgcagcgactgcggcaagagcttcaccaagaagagccagctgcaggtgcaccagagaatccacaccggcgagaagccctacgtgtgcgccgagtgcggcaaggccttcagcaacagaagcaacctgaacaagcaccagaccacccacaccggcgacaagccctacaagtgcggcatctgcggcaagggcttcgtgcagaagagcgtgttcagcgtgcaccagagcagccacgcctag

SEQ ID NO: 10754 - DNA, 2145 bp, Artificial Sequence
  Description of Artificial Sequence: Synthetic coding sequence
atgctggagacctacagccacctgctgagcgtgggctaccaggtgcccaagcccgaggtggtgatgctggagcagggcaaggagccctgggccctgcagggcgagagacccagacacagctgccccggcgagaagctgtgggaccacaaccagcacagaaagatcatcggctacaagcccgccagcagccaggaccagaagatctacagcggcgagaagagctacgagtgcgccgagttcggcaagagcttcacctggaagagccagttcaaggtgcacctgaaggtgcccaccggcgagaagctgtacgtgtgcatcgagtgcggcagagccttcgtgcagaagcccgagttcatcacccaccagaagacccacatgagagagaagccctacaagtgcaacgagtgcggcaagagcttcttccaggtgagcagcctgttcagacaccacagaatccacaccggcgagaagctgtacgagtgcagcgagtgcggcaagggcttcccctacaacagcgacctgagcatccacgagaagatccacaccggcgagagacaccacgagtgcaccgactgcggcaaggccttcacccagaagagcaccctgaagatccaccagaagatccacaccggcgagagaagctacatctgcatcgagtgcggccaggccttcatccagaagacccagctgatcgcccacagaagaatccacagcggcgagaagccctacgagtgcaacaactgcggcaagagcttcatcagcaagagccagctgcaggtgcaccagagagtgcacaccagagtgaagccctacatctgcaccgagtacggcaaggtgttcagcaacaacagcaacctgatcacccacgagaagatccagagcagagagaagagcagcatctgcaccgagtgcggcaaggccttcacctacagaagcgagctgatcatccaccagagaatccacaccggcgagaagccctacgagtgcagcgactgcggcagagccttcacccagaagagcgccctgaccgtgcaccagagaatccacaccggcgagaagagctacatctgcatgaagtgcggcctggccttcatcagaaaggcccacctgatcacccaccagatcatccacaccggcgagaagccctacaagtgcggccactgcggcaagctgttcaccagcaagagccagctgcacgtgcacaagagaatccacaccggcgagaagccctacgtgtgcaacaagtgcggcaaggccttcaccaacagaagcaacctgatcacccaccagaagacccacaccggcgagaagagctacatctgcagcaagtgcggcaaggccttcacccagagaagcgacctgatcacccaccagagaatccacaccggcgagaagccctacgagtgcaacacctgcggcaaggccttcacccagaagagcaacctgaacatccaccagaagatccacaccggcgagagacagtacgagtgccacgagtgcggcaaggccttcaaccagaagagcatcctgatcgtgcaccagaagatccacaccggcgagaagccctacgtgtgcaccgagtgcggcagagccttcatcagaaagagcaacttcatcacccaccagagaatccacaccggcgagaagccctacgagtgcagcgactgcggcaagagcttcaccagcaagagccagctgctggtgcaccagcccgtgcacaccggcgagaagccctacgtgtgcgccgagtgcggcaaggccttcagcggcagaagcaacctgagcaagcaccagaagacccacaccggcgagaagccctacatctgcagcgagtgcggcaagaccttcagacagaagagcgagctgatcacccaccacagaatccacaccggcgagaagccctacgagtgcagcgactgcggcaagagcttcaccaagaagagccagctgcaggtgcaccagagaatccacaccggcgagaagccctacgtgtgcgccgagtgcggcaaggccttcagcaacagaagcaacctgaacaagcaccagaccacccacaccggcgacaagccctacaagtgcggcatctgcggcaagggcttcgtgcagaagagcgtgttcagcgtgcaccagagcagccacgcctag

SEQ ID NO: 10755 - DNA, 2310 bp, Artificial Sequence
  Description of Artificial Sequence: Synthetic coding sequence
atgcccgccagctggaccagcccccagaagagcagcgccctggcccccgaggaccacggcagcagctacgagggcagcgtgagcttcagagacgtggccatcgacttcagcagagaggagtggagacacctggacctgagccagagaaacctgtacagagacgtgatgctggagacctacagccacctgctgagcgtgggctaccaggtgcccaagcccgaggtggtgatgctggagcagggcaaggagccctgggccctgcagggcgagagacccagacacagctgccccggcgagaagctgtgggaccacaaccagcacagaaagatcatcggctacaagcccgccagcagccaggaccagaagatctacagcggcgagaagagctacgagtgcgccgagttcggcaagagcttcacctggaagagccagttcaaggtgcacctgaaggtgcccaccggcgagaagctgtacgtgtgcatcgagtgcggcagagccttcgtgcagaagcccgagttcatcacccaccagaagacccacatgagagagaagccctacaagtgcaacgagtgcggcaagagcttcttccaggtgagcagcctgttcagacaccacagaatccacaccggcgagaagctgtacgagtgcagcgagtgcggcaagggcttcccctacaacagcgacctgagcatccacgagaagatccacaccggcgagagacaccacgagtgcaccgactgcggcaaggccttcacccagaagagcaccctgaagatccaccagaagatccacaccggcgagagaagctacatctgcatcgagtgcggccaggccttcatccagaagacccagctgatcgcccacagaagaatccacagcggcgagaagccctacgagtgcaacaactgcggcaagagcttcatcagcaagagccagctgcaggtgcaccagagagtgcacaccagagtgaagccctacatctgcaccgagtacggcaaggtgttcagcaacaacagcaacctgatcacccacgagaagatccagagcagagagaagagcagcatctgcaccgagtgcggcaaggccttcacctacagaagcgagctgatcatccaccagagaatccacaccggcgagaagccctacgagtgcagcgactgcggcagagccttcacccagaagagcgccctgaccgtgcaccagagaatccacaccggcgagaagagctacatctgcatgaagtgcggcctggccttcatcagaaaggcccacctgatcacccaccagatcatccacaccggcgagaagccctacaagtgcggccactgcggcaagctgttcaccagcaagagccagctgcacgtgcacaagagaatccacaccggcgagaagccctacgtgtgcaacaagtgcggcaaggccttcaccaacagaagcaacctgatcacccaccagaagacccacaccggcgagaagagctacatctgcagcaagtgcggcaaggccttcacccagagaagcgacctgatcacccaccagagaatccacaccggcgagaagccctacgagtgcaacacctgcggcaaggccttcacccagaagagcaacctgaacatccaccagaagatccacaccggcgagagacagtacgagtgccacgagtgcggcaaggccttcaaccagaagagcatcctgatcgtgcaccagaagatccacaccggcgagaagccctacgtgtgcaccgagtgcggcagagccttcatcagaaagagcaacttcatcacccaccagagaatccacaccggcgagaagccctacgagtgcagcgactgcggcaagagcttcaccagcaagagccagctgctggtgcaccagcccgtgcacaccggcgagaagccctacgtgtgcgccgagtgcggcaaggccttcagcggcagaagcaacctgagcaagcaccagaagacccacaccggcgagaagccctacatctgcagcgagtgcggcaagaccttcagacagaagagcgagctgatcacccaccacagaatccacaccggcgagaagccctacgagtgcagcgactgcggcaagagcttcaccaagaagagccagctgcaggtgcaccagagaatccacaccggcgagaagccctacgtgtgcgccgagtgcggcaaggccttcagcaacagaagcaacctgaacaagcaccagaccacccacaccggcgacaagccctacaagtgcggcatctgcggcaagggcttcgtgcagaagagcgtgttcagcgtgcaccagagcagccacgcctag

SEQ ID NO: 10756 - DNA, 195 bp, Artificial Sequence
  Description of Artificial Sequence: Synthetic coding sequence
atggccgccgccgccgccctgagagcccccgcccagagcagcgtgaccttcgaggacgtggccgtgaacttcagcctggaggagtggagcctgctgaacgaggcccagggctgcctgtaccacgacgtgatgctggagaccctgaccctgatcagcagcctgggctgctggctgcaggtggaggacggcgcctag

SEQ ID NO: 10757 - DNA, 1080 bp, Artificial Sequence
  Description of Artificial Sequence: Synthetic coding sequence
atgctggagaccctgaccctgatcagcagcctgggctgctggcacggcggcgaggacgaggccgcccccagcaagcagagcacctgcatccacatctacaaggaccagggcggccacagcggcgagagaccctacgagtgcggcgagtacagaaagctgttcaagaacaagagctgcctgaccgagcccagaagagaccacaagcacagaaacgtgagaaccggcgagagaccctacgagtgcagcaagtacggcaagctgttccaccagaagcccaccctgcacatccacgagagattccacaccggccagaagacctacgagtgcagcgagtgcggcaagagcttccaccagagcagcagcctgctgcagagacagaccctgcacaccagagagagaccctacgagtgcatcgagtgcggcaaggccttcgccgagaagagcagcctgatcaaccacagaaaggtgcacagcggcgccaagagatacgagtgcaacgagtgcggcaagagcttcgcctacaccagcagcctgatcaagcacagaagaatccacaccggcgagagaccctacgagtgcagcgagtgcggcagaagcttcgccgagaacagcagcctgatcaagcacctgagagtgcacaccggcgagagaccctacgagtgcgtggagtgcggcaagagcttcagaagaagcagcagcctgctgcagcaccagagagtgcacaccagagagagaccctacgagtgcagcgagtgcggcaagagcttcagcctgagaagcaacctgatccaccaccagagagtgcacaccggcgagagacacgagtgcggccagtgcggcaagagcttcagcagaaagagcagcctgatcatccacctgagagtgcacaccggcgagagaccctacgagtgcagcgactgcggcaagagcttcgccgagaacagcagcctgatcaagcacctgagagtgcacaccggcgagagaccctacgagtgcatcgactgcggcaagagcttcagacacagcagcagcttcagaagacaccagagagtgcacaccggcatgagaccctacaagtag

SEQ ID NO: 10758 - DNA, 633 bp, Artificial Sequence
  Description of Artificial Sequence: Synthetic coding sequence
atggccgccgccgccgccctgagagcccccgcccaggtggtgggcatggagggcaagatgagacagcacctgctgagcagagccagagtgtacatctacaccaagaccagagaggtgatcgtggagaagggcctgatgagcgtgggcaacatcggcaactacctgagaaccagccccgccagcctgaaccccgaggagatcaccaacaccggcatgttcgccctggagaagggcctgatgagcgccgccaacatgggcaactacttcaccaagagcctgcacagcatcttcatgagagacttcatcctgggcaagagacccatgagcgccgtgagcgtggagaaccacttcaccaaggccctgcacagctgcagcgtgagacacttcaccctggagaagggcctgatgagcgtgctgaacgtgggcaagcccctgctgaagagccccgtgagcctgaccaccggcaagttcaccctggagcagagcgtgatgaacgccatgaacgtgggcagccccctgctgatccacctggtgagcctgaacaccggcggcttcaccctggagagaggcctgatgagcgccgtgaacgtgggcgaccccctgctgaagacccccgtgctgctgaacacctag

SEQ ID NO: 10759 - DNA, 1209 bp, Artificial Sequence
  Description of Artificial Sequence: Synthetic coding sequence
atggccgccgccgccgccctgagagcccccgcccagagcagcgtgaccttcgaggacgtggccgtgaacttcagcctggaggagtggagcctgctgaacgaggcccagagatgcctgtacagagacgtgatgctggagaccctgaccctgatcagcagcctgggctgctggcacggcggcgaggacgaggccgcccccagcaagcagagcacctgcatccacatctacaaggaccagggcggccacagcggcgagagaccctacgagtgcggcgagtacagaaagctgttcaagaacaagagctgcctgaccgagcccagaagagaccacaagcacagaaacgtgagaaccggcgagagaccctacgagtgcagcaagtacggcaagctgttccaccagaagcccaccctgcacatccacgagagattccacaccggccagaagacctacgagtgcagcgagtgcggcaagagcttccaccagagcagcagcctgctgcagagacagaccctgcacaccagagagagaccctacgagtgcatcgagtgcggcaaggccttcgccgagaagagcagcctgatcaaccacagaaaggtgcacagcggcgccaagagatacgagtgcaacgagtgcggcaagagcttcgcctacaccagcagcctgatcaagcacagaagaatccacaccggcgagagaccctacgagtgcagcgagtgcggcagaagcttcgccgagaacagcagcctgatcaagcacctgagagtgcacaccggcgagagaccctacgagtgcgtggagtgcggcaagagcttcagaagaagcagcagcctgctgcagcaccagagagtgcacaccagagagagaccctacgagtgcagcgagtgcggcaagagcttcagcctgagaagcaacctgatccaccaccagagagtgcacaccggcgagagacacgagtgcggccagtgcggcaagagcttcagcagaaagagcagcctgatcatccacctgagagtgcacaccggcgagagaccctacgagtgcagcgactgcggcaagagcttcgccgagaacagcagcctgatcaagcacctgagagtgcacaccggcgagagaccctacgagtgcatcgactgcggcaagagcttcagacacagcagcagcttcagaagacaccagagagtgcacaccggcatgagaccctacaagtag

SEQ ID NO: 10760 - DNA, 300 bp, Artificial Sequence
  Description of Artificial Sequence: Synthetic coding sequence
atggccgccgccgccgccctgagagcccccgcccagagcagcgtgaccttcgaggacgtggccgtgaacttcagcctggaggagtggagcctgctgaacgaggcccagggctgcctgtaccacgacgtgatgctggagaccctgaccctgatcagcagcctgaagggctgcaccagacagcagttctgcaacagaagcaccctgaacaaggaggacagagtgatctacaacctgagaagaagccccagctgcagattccccctgcccggcaccggcccccacatcctgtacgtgagctag

SEQ ID NO: 10761 - DNA, 1209 bp, Artificial Sequence; identical to SEQ ID NO: 10759
  Description of Artificial Sequence: Synthetic coding sequence

SEQ ID NO: 10762 - DNA, 498 bp, Artificial Sequence
  Description of Artificial Sequence: Synthetic coding sequence
atggccgccgccgcccccagaagacccacccagggcaccgtgaccttcgaggacgtggccgtgaagttcacccaggaggagtggaacctgctgagcgaggcccagagatgcctgtacagagacgtgaccctggagaacctggccctgatgagcagcctgggctgctggtgcggcgtggaggacgaggccgcccccagcaagcagagcatctacatccagagagagacccaggtgagaacccccgtgaccggcgtgagccccaagaaggcccacccctgcgagatgtgcggccccatcctgggcgacatcctgcacgtggccgaccaccagggcacccaccacaagcagaagctgcacagatgcgaggcctggggcaacaagctgtacgacagcggcaacttccaccagcaccagaacgagcacatcggcgagaagccctacagaggcagcgtggaggaggccctgttcgtgaagagaagcggccactgcgacctgtag

SEQ ID NO: 10763 - DNA, 1728 bp, Artificial Sequence
  Description of Artificial Sequence: Synthetic coding sequence
atggccgccgccgtgcccagaagacccacccagcagggcaccgtgaccttcgaggacgtggccgtgaacttcagccaggaggagtggtgcctgctgagcgaggcccagagatgcctgtacagagacgtgatgctggagaacctggccctgatcagcagcctgggctgctggtgcggcagcaaggacgaggaggccccctgcaagcagagaatcagcgtgcagagagagagccagagcagaacccccagagccggcgtgagccccaagaaggcccacccctgcgagatgtgcggcctgatcctggaggacgtgttccacttcgccgaccaccaggagacccaccacaagcagaagctgaacagaagcggcgcctgcggcaagaacctggacgacaccgcctacctgcaccagcaccagaagcagcacatcggcgagaagttctacagaaagagcgtgagagaggccagcttcgtgaagaagagaaagctgagagtgagccaggagcccttcgtgttcagagagttcggcaaggacgtgctgcccagcagcggcctgtgccaggaggaggccgccgtggagaagaccgacagcgagaccatgcacggcccccccttccaggagggcaagaccaactacagctgcggcaagagaaccaaggccttcagcaccaagcacagcgtgatcccccaccagaagctgttcaccagagacggctgctacgtgtgcagcgactgcggcaagagcttcagcagatacgtgagcttcagcaaccaccagagagaccacaccgccaagggcccctacgactgcggcgagtgcggcaagagctacagcagaaagagcagcctgatccagcaccagagagtgcacaccggccagaccgcctacccctgcgaggagtgcggcaagagcttcagccagaagggcagcctgatcagccaccagctggtgcacaccggcgagggcccctacgagtgcagagagtgcggcaagagcttcggccagaagggcaacctgatccagcaccagcagggccacaccggcgagagagcctaccactgcggcgagtgcggcaagagcttcagacagaagttctgcttcatcaaccaccagagagtgcacaccggcgagagaccctacaagtgcggcgagtgcggcaagagcttcggccagaagggcaacctggtgcaccaccagagaggccacaccggcgagagaccctacgagtgcaaggagtgcggcaagagcttcagatacagaagccacctgaccgagcaccagagactgcacaccggcgagagaccctacaactgcagagagtgcggcaagctgttcaacagaaagtaccacctgctggtgcacgagagagtgcacaccggcgagagaccctacgcctgcgaggtgtgcggcaagctgttcggcaacaagcacagcgtgaccatccaccagagaatccacaccggcgagagaccctacgagtgcagcgagtgcggcaagagcttcctgagcagcagcgccctgcacgtgcacaagagagtgcacagcggccagaagccctacaagtgcagcgagtgcggcaagagcttcagcgagtgcagcagcctgatcaagcacagaagaatccacaccggcgagagaccctacgagtgcaccaagtgcggcaagaccttccagagaagcagcaccctgctgcaccaccagagcagccacagaagaaaggccctgtag

SEQ ID NO: 10764 - DNA, 1599 bp, Artificial Sequence
  Description of Artificial Sequence: Synthetic coding sequence
atgctggagaacctggccctgatcagcagcctgggctgctggtgcggcagcaaggacgaggaggccccctgcaagcagagaatcagcgtgcagagagagagccagagcagaacccccagagccggcgtgagccccaagaaggcccacccctgcgagatgtgcggcctgatcctggaggacgtgttccacttcgccgaccaccaggagacccaccacaagcagaagctgaacagaagcggcgcctgcggcaagaacctggacgacaccgcctacctgcaccagcaccagaagcagcacatcggcgagaagttctacagaaagagcgtgagagaggccagcttcgtgaagaagagaaagctgagagtgagccaggagcccttcgtgttcagagagttcggcaaggacgtgctgcccagcagcggcctgtgccaggaggaggccgccgtggagaagaccgacagcgagaccatgcacggcccccccttccaggagggcaagaccaactacagctgcggcaagagaaccaaggccttcagcaccaagcacagcgtgatcccccaccagaagctgttcaccagagacggctgctacgtgtgcagcgactgcggcaagagcttcagcagatacgtgagcttcagcaaccaccagagagaccacaccgccaagggcccctacgactgcggcgagtgcggcaagagctacagcagaaagagcagcctgatccagcaccagagagtgcacaccggccagaccgcctacccctgcgaggagtgcggcaagagcttcagccagaagggcagcctgatcagccaccagctggtgcacaccggcgagggcccctacgagtgcagagagtgcggcaagagcttcggccagaagggcaacctgatccagcaccagcagggccacaccggcgagagagcctaccactgcggcgagtgcggcaagagcttcagacagaagttctgcttcatcaaccaccagagagtgcacaccggcgagagaccctacaagtgcggcgagtgcggcaagagcttcggccagaagggcaacctggtgcaccaccagagaggccacaccggcgagagaccctacgagtgcaaggagtgcggcaagagcttcagatacagaagccacctgaccgagcaccagagactgcacaccggcgagagaccctacaactgcagagagtgcggcaagctgttcaacagaaagtaccacctgctggtgcacgagagagtgcacaccggcgagagaccctacgcctgcgaggtgtgcggcaagctgttcggcaacaagcacagcgtgaccatccaccagagaatccacaccggcgagagaccctacgagtgcagcgagtgcggcaagagcttcctgagcagcagcgccctgcacgtgcacaagagagtgcacagcggccagaagccctacaagtgcagcgagtgcggcaagagcttcagcgagtgcagcagcctgatcaagcacagaagaatccacaccggcgagagaccctacgagtgcaccaagtgcggcaagaccttccagagaagcagcaccctgctgcaccaccagagcagccacagaagaaaggccctgtag

SEQ ID NO: 10765 - DNA, 1209 bp, Artificial Sequence
  Description of Artificial Sequence: Synthetic coding sequence
atggccgtggtggccaccctgagactgagcgcccagggcaccgtgaccttcgaggacgtggccgtgaagttcacccaggaggagtggaacctgctgagcgaggcccagagatgcctgtacagagacgtgaccctggagaacctggccctgatgagcagcctgggctgctggtgcggcgtggaggacgaggccgcccccagcaagcagagcatctacatccagagagagacccaggtgagaacccccgtgaccggcgtgagccccaagaaggcccacccctgcgagatgtgcggccccatcctgggcgacatcctgcacgtggccgaccaccagggcacccaccacaagcagaagctgcacagatgcgaggcctggggcaacaagctgtacgacagcggcaacttccaccagcaccagaacgagcacatcggcgagaagccctacagaggcagcgtggaggaggccctgttcgtgaagagatgcaagctgcacgtgagcggcgagagcagcgtgttcagcgagagcggcaaggacttcctgcccagaagcggcctgctgcagcaggaggccagccacaccggcgagaagagcaacagcaagaccgagtgcgtgagccccttccagtgcggcggcgcccactacagccacggcgacagcatgaagcacttcagcaccaagcacatcctgagccagcaccagagactgctgcccagagaggagtgctacgtgtgctgcgagtgcggcaagagcttcagcaagtacgtgagcttcagcaaccaccagagagtgcacagcggcaagagaccctacgagtgcggcgagtgcgagaagagcttcagccagaagagcagcctgatccagcaccagcagttccacaccggcggcaagccctacggctgcgaggagtgcggcaagtacttcagcctggagggctacctgagaagacaccagaaggtgcacgccggcaagggcccctacgagtgcggcgagtgcggcaagagcttcagcagcaacgtgaacctgaagagccaccagagaatccacaccggcgagagaccctacaagtgcggcgagtgcgagaagagcttcagcagaaagcccagcctgagctaccaccagagattcggcagacccagatgggtggaccacaaggacagaaaggagttcaagaccagcctgggcaacatcgtgaagagctgcctgttctag

SEQ ID NO: 10766 - DNA, 1860 bp, Artificial Sequence
  Description of Artificial Sequence: Synthetic coding sequence
atggccgccgccgtgcccagaagacccacccagcagggcaccgtgaccttcgaggacgtggccgtgaacttcagccaggaggagtggtgcctgctgagcgaggcccagagatgcctgtacagagacgtgatgctggagaacctggccctgatcagcagcctgggctgctggtgcggcagcaaggacgaggaggccccctgcaagcagagaatcagcgtgcagagagagagccagagcagaacccccagagccggcgtgagccccaagaaggcccacccctgcgagatgtgcggcctgatcctggaggacgtgttccacttcgccgaccaccaggagacccaccacaagcagaagctgaacagaagcggcgcctgcggcaagaacctggacgacaccgcctacctgcaccagcaccagaagcagcacatcggcgagaagttctacagaaagagcgtgagagaggccagcttcgtgaagaagagaaagctgagagtgagccaggagcccttcgtgttcagagagttcggcaaggacgtgctgcccagcagcggcctgtgccaggaggaggccgccgtggagaagaccgacagcgagaccatgcacggcccccccttccaggagggcaagaccaactacagctgcggcaagagaaccaaggccttcagcaccaagcacagcgtgatcccccaccagaagctgttcaccagagacggctgctacgtgtgcagcgactgcggcaagagcttcagcagatacgtgagcttcagcaaccaccagagagaccacaccgccaagggcccctacgactgcggcgagtgcggcaagagctacagcagaaagagcagcctgatccagcaccagagagtgcacaccggccagaccgcctacccctgcgaggagtgcggcaagagcttcagccagaagggcagcctgatcagccaccagctggtgcacaccggcgagggcccctacgagtgcagagagtgcggcaagagcttcggccagaagggcaacctgatccagcaccagcagggccacaccggcgagagagcctaccactgcggcgagtgcggcaagagcttcagacagaagttctgcttcatcaaccaccagagagtgcacaccggcgagagaccctacaagtgcggcgagtgcggcaagagcttcggccagaagggcaacctggtgcaccaccagagaggccacaccggcgagagaccctacgagtgcaaggagtgcggcaagagcttcagatacagaagccacctgaccgagcaccagagactgcacaccggcgagagaccctacaactgcagagagtgcggcaagctgttcaacagaaagtaccacctgctggtgcacgagagagtgcacaccggcgagagaccctacgcctgcgaggtgtgcggcaagctgttcggcaacaagcacagcgtgaccatccaccagagaatccacaccggcgagagaccctacgagtgcagcgagtgcggcaagagcttcctgagcagcagcgccctgcacgtgcacaagagagtgcacagcggccagaagccctacaagtgcagcgagtgcggcaagagcttcagcgagtgcagcagcctgatcaagcacagaagaatccacaccggcgagagaccctacgagtgcaccaagtgcggcaagaccttccagagaagcagcaccctgctgcaccacagagtgcacaccggcgagagaccctacgagtgcagcgagtacggcaagagcttcgccgaggccagcagactggtgaagcacagaagagtgcacaccggcgagagaccctacgagtgctgccagtgcggcaagcaccagaacgtgtgctgccccagaagctag

SEQ ID NO: 10767 - DNA, 1269 bp, Artificial Sequence
  Description of Artificial Sequence: Synthetic coding sequence
atgatcgacttccagatgctgaaccagctgtgcagaaccatcatcaaccccagcgtgatcccctgcctgaagtactgcggcgaccagatcggccccgtgaccttcgaggacgtggccgtgctgttcaccgaggccgagtggaagagactgagcctggagcagagaaacctgtacaaggaggtgatgctggagaacctgagaaacctggtgagcctggagagcaagcccgaggtgcacacctgccccagctgccccctggccttcggcagccagcagttcctgagccaggacgagctgcacaaccaccccatccccggcttccacgccggcaaccagctgcaccccggcaacccctgccccgaggaccagccccagagccagcaccccagcgacaagaaccacagaggcgccgaggccgaggaccagagagtggagggcggcgtgagacccctgttctggagcaccaacgagagaggcgccctggtgggcttcagcagcctgttccagagaccccccatcagcagctggggcggcaacagaatcctggagatccagctgagccccgcccagaacgccagcagcgaggaggtggacagaatcagcaagagagccgagacccccggcttcggcgccgtgaccttcggcgagtgcgccctggccttcaaccagaagagcaacctgttcagacagaaggccgtgaccgccgagaagagcagcgacaagagacagagccaggtgtgcagagagtgcggcagaggcttcagcagaaagagccagctgatcatccaccagagaacccacaccggcgagaagccctacgtgtgcggcgagtgcggcagaggcttcatcgtggagagcgtgctgagaaaccacctgagcacccacagcggcgagaagccctacgtgtgcagccactgcggcagaggcttcagctgcaagccctacctgatcagacaccagagaacccacaccagagagaagagcttcatgtgcaccgtgtgcggcagaggcttcagagagaagagcgagctgatcaagcaccagcagagatgccaggtgaccgtgcccctggaggagtggagcctgcacctgaccaccagcttctgcaactgcgtgctgcccctggccagcatgaccctgagctgcttcatcttcttctacatcagcagcctgtgctgcttcctgagctaccccaccttcagattctacagcgagttcagcctgcagccctacaacctgagagacaccttcaccagaagccccagctag

SEQ ID NO: 10768 - DNA, 1095 bp, Artificial Sequence
  Description of Artificial Sequence: Synthetic coding sequence
atgtgggcccccagagagcagctgctgggctggaccgccgaggccctgcccgccaaggacagcgcctggccctgggaggagaagcccagatacctgggccccgtgaccttcgaggacgtggccgtgctgttcaccgaggccgagtggaagagactgagcctggagcagagaaacctgtacaaggaggtgatgctggagaacctgagaaacctggtgagcctggccgagagcaagcccgaggtgcacacctgccccagctgccccctggccttcggcagccagcagttcctgagccaggacgagctgcacaaccaccccatccccggcttccacgccggcaaccagctgcaccccggcaacccctgccccgaggaccagccccagagccagcaccccagcgacaagaaccacagaggcgccgaggccgaggaccagagagtggagggcggcgtgagacccctgttctggagcaccaacgagagaggcgccctggtgggcttcagcagcctgttccagagaccccccatcagcagctggggcggcaacagaatcctggagatccagctgagccccgcccagaacgccagcagcgaggaggtggacagaatcagcaagagagccgagacccccggcttcggcgccgtgaccttcggcgagtgcgccctggccttcaaccagaagagcaacctgttcagacagaaggccgtgaccgccgagaagagcagcgacaagagacagagccaggtgtgcagagagtgcggcagaggcttcagcagaaagagccagctgatcatccaccagagaacccacaccggcgagaagccctacgtgtgcggcgagtgcggcagaggcttcatcgtggagagcgtgctgagaaaccacctgagcacccacagcggcgagaagccctacgtgtgcagccactgcggcagaggcttcagctgcaagccctacctgatcagacaccagagaacccacaccagagagaagagcttcatgtgcaccgtgtgcggcagaggcttcagagagaagagcgagctgatcaagcaccagagaatccacaccggcgacaagccctacgtgtgcagagactag

SEQ ID NO: 10769 - DNA, 534 bp, Artificial Sequence
  Description of Artificial Sequence: Synthetic coding sequence
atgtgggcccccagagagcagctgctgggctggaccgccgaggccctgcccgccaaggacagcgcctggccctgggaggagaagcccagatacctgggccccgtgaccttcgaggacgtggccgtgctgttcaccgaggccgagtggaagagactgagcctggagcagagaaacctgtacaaggaggtgatgctggagaacctgagaaacctggtgagcctggagagcaagcccgaggtgcacacctgccccagctgccccctggccttcggcagccagcagttcctgagccaggacgagctgcacaaccaccccatccccggcttccacgccggcaaccagctgcaccccggcaacccctgccccgaggaccagccccagagccagcaccccagcgacaagaaccacagaggcgccgaggccgaggaccagagagtggagggcggcgtgagacccctgttctggatcctggagctgggcagccccagaagcggcctgctgcccctggacctgaacctggacctgtggctgtag

SEQ ID NO: 10770 - DNA, 1095 bp, Artificial Sequence; identical to SEQ ID NO: 10768
  Description of Artificial Sequence: Synthetic coding sequence

SEQ ID NO: 10771 - DNA, 471 bp, Artificial Sequence
  Description of Artificial Sequence: Synthetic coding sequence
atgggcagaagcagaagaaccggcgcccacagagcccacagcctggccagacagatgaaggccaagagaagaagacccgacctggacgagatccacagagagctgagaccccagggcagcgccagaccccagcccgaccccaacgccgagttcgaccccgacctgcccggcggcggcctgcacagatgcctggcctgcgccagatacttcatcgacagcaccaacctgaagacccacttcagaagcaaggaccacaagaagagatacgagggcgtgagaagaggcctgatggacggctgcagcgccgacagagccctgacctggagcgcccccaacagctgcttcagcttcagccaggccgaggccgccgagagaagagccctgcagagcggcagaggcggcgagggcagcggctacggcatcctgtgcgccccccaggccgccggcagcgcccacggcagcgtgcactag

SEQ ID NO: 10772 - DNA, 405 bp, Artificial Sequence
  Description of Artificial Sequence: Synthetic coding sequence
atgggcagaagcagaagaaccggcgcccacagagcccacagcctggccagacagatgaaggccaagagaagaagacccgacctggacgagatccacagagagctgagaccccagggcagcgccagaccccagcccgaccccaacgccgagttcgaccccgacctgcccggcggcggcctgcacagatgcctggcctgcgccagatacttcatcgacagcaccaacctgaagacccacttcagaagcaaggaccacaagaagagactgaagcagctgagcgtggagccctacagccaggaggaggccgagagagccgccggcatgggcagctacgtgccccccagaagactggccgtgcccaccgaggtgagcaccgaggtgcccgagatggacaccagcacctag

SEQ ID NO: 10773 - DNA, 996 bp, Artificial Sequence
  Description of Artificial Sequence: Synthetic coding sequence
atgaacgtgaagaacgtgggcaagctgaaccagagcagcgacctgctgagacaccacagaatccacagcggcgagaagccctacgtgtgcaacaagtgcggcgagagcttcagaagcagcagcgacctgatcaagcaccacagagtgcacaccggcgagaagccccacgagtgcagcgagtgcggcaaggtgttcagccagagaagccacctggtgacccaccagaagatccacaccggcgagaagccctaccagtgcaccgagtgcgagaaggccttcagaagaagaagcctgctgatccagagaagaagaatccacagcggcgagaagccctacgagtgcaaggagtgcggcaagctgttcatgtggcacaccgccttcctgaagcaccagagactgcacgccggcgagaagctggaggagagagagaagaccttcagcaaggacgaggagctgagaggcgagcagaagatccaccaggaggagaaggcctactggtgcaaccagtgcggcagagccttccagggcagcagcgacctgatcggccaccaggtgacccacaccggcgagaagccctacgagtgcaaggagtgcggcaagaccttcaaccagagcagcgacctgctgagacaccacagaatccacagcggcgagaagccctacgtgtgcaacaagtgcggcaagagcttcagaggcagcagcgacctgatcagacaccacagagtgcacaccggcgagaagccctacgagtgccccgagtgctggaaggccttcagccagaacagccacctggtgagccaccagagaatccacaccagagagaagcccttcgagtgcagcaactgcggcaaggccttcagcggctggaccgccttcctgaagcaccagaagctgcacatcggcaaggagttcgaggactgcaagagcctgcagaccggccccatcctgatcggcagcagaaacctgatgaacgccgtgaagctgggcaaggtgtag

SEQ ID NO: 10774 - DNA, 918 bp, Artificial Sequence
  Description of Artificial Sequence: Synthetic coding sequence
atgaacgtgaagaacgtgggcaagaaccagagcagcgacctgctgagacaccacagaatccacagcggcgagaagccctgcgtgtgcagcaagtgcggcaagagcttcagaggcagcagcgacctgatcagacaccacagagtgcacaccggcgagaagccctacgagtgcagcgagtgcggcaaggccttcagccagagaagccacctggtgacccaccagaagatccacaccggcgagaagccctaccagtgcaccgagtgcggcaaggccttcagaagaagaagcctgctgatccagcacagaagaatccacagcggcgagaagccctacgagtgcaaggagtgcggcaagctgttcatctggagaaccgccttcctgaagcaccagagcctgcacaccggcgagaagctggagtgcgagaagaccttcagccaggacgaggagctgagaggcgagcagaagatccaccaggaggccaaggcctactggtgcaaccagtgcggcagagccttccagggcagcagcgacctgatcagacaccaggtgacccacaccagagagaagccctacgagtgcaaggagtgcggcaagaccttcaaccagagcagcgacctgctgagacaccacagaatccacagcggcgagaagccctacgtgtgcaacaagtgcggcaagagcttcagaggcagcagcgacctgatcaagcaccacagaatccacaccggcgagaagccctacgagtgcagcgagtgcggcaaggccttcagccagagaagccacctggccacccaccagaagatccacaccggcgagaagccctaccagtgcatggagtgcggcaagctgttcatgtggcacaccgccttcctgaagcaccagagactgcacgccggcgagaagctggaggagtgctag

SEQ ID NO: 10775 - DNA, 2424 bp, Artificial Sequence
  Description of Artificial Sequence: Synthetic coding sequence
atgaaggagtggaagagcaagatggagatcagcgaggagaagaagagcgccagagccgccagcgagaagctgcagagacagatcacccaggagtgcgagctggtggagaccagcaacagcgaggacagactgctgaagcactgggtgagccccctgaaggacgccatgagacacctgcccagccaggagagcggcatcagagagatgcacatcatcccccagaaggccatcgtgggcgagatcggccacggctgcaacgagggcgagaagatcctgagcgccggcgagagcagccacagatacgaggtgagcggccagaacttcaagcagaagagcggcctgaccgagcaccagaagatccacaacatcaacaagacctacgagtgcaaggagtgcgagaagaccttcaacagaagcagcaacctgatcatccaccagagaatccacaccggcaacaagccctacgtgtgcaacgagtgcggcaaggacagcaaccagagcagcaacctgatcatccaccagagaatccacaccggcaagaagccctacatctgccacgagtgcggcaaggacttcaaccagagcagcaacctggtgagacacaagcagatccacagcggcggcaacccctacgagtgcaaggagtgcggcaaggccttcaagggcagcagcaacctggtgctgcaccagagaatccacagcagaggcaagccctacctgtgcaacaagtgcggcaaggccttcagccagagcaccgacctgatcatccaccacagaatccacaccggcgagaagccctacgagtgctacgactgcggccagatgttcagccagagcagccacctggtgccccaccagagaatccacaccggcgagaagcccctgaagtgcaacgagtgcgagaaggccttcagacagcacagccacctgaccgagcaccagagactgcacagcggcgagaagccctacgagtgccacagatgcggcaagaccttcagcggcagaaccgccttcctgaagcaccagagactgcacgccggcgagaagatcgaggagtgcgagaagaccttcagcaaggacgaggagctgagagaggagcagagaatccaccaggaggagaaggcctactggtgcaaccagtgcggcagaaacttccagggcaccagcgacctgatcagacaccaggtgacccacaccggcgagaagccctacgagtgcaaggagtgcggcaagaccttcaaccagagcagcgacctgctgagacaccacagaatccacagcggcgagaagccctgcgtgtgcagcaagtgcggcaagagcttcagaggcagcagcgacctgatcagacaccacagagtgcacaccggcgagaagccctacgagtgcagcgagtgcggcaaggccttcagccagagaagccacctggtgacccaccagaagatccacaccggcgagaagccctaccagtgcaccgagtgcggcaaggccttcagaagaagaagcctgctgatccagcacagaagaatccacagcggcgagaagccctacgagtgcaaggagtgcggcaagctgttcatctggagaaccgccttcctgaagcaccagagcctgcacaccggcgagaagctggagtgcgagaagaccttcagccaggacgaggagctgagaggcgagcagaagatccaccaggaggccaaggcctactggtgcaaccagtgcggcagagccttccagggcagcagcgacctgatcagacaccaggtgacccacaccagagagaagccctacgagtgcaaggagtgcggcaagaccttcaaccagagcagcgacctgctgagacaccacagaatccacagcggcgagaagccctacgtgtgcaacaagtgcggcaagagcttcagaggcagcagcgacctgatcaagcaccacagaatccacaccggcgagaagccctacgagtgcagcgagtgcggcaaggccttcagccagagaagccacctggccacccaccagaagatccacaccggcgagaagccctaccagtgcagcgagtgcggcaacgccttcagaagaagaagcctgctgatccagcacagaagactgcacagcggcgagaagccctacgagtgcaaggagtgcggcaagctgttcatgtggcacaccgccttcctgaagcaccagagactgcacgccggcgagaagctggaggagtgcgagaagaccttcagcaaggacgaggagctgagaaaggagcagagaacccaccaggagaagaaggtgtactggtgcaaccagtgcagcagaaccttccagggcagcagcgacctgatcagacaccaggtgacccacaccagagagaagccctacgagtgcaaggagtgcggcaagacccagagcgagctgagacccagcgagaccagctag

SEQ ID NO: 10776 - DNA, 1515 bp, Artificial Sequence
  Description of Artificial Sequence: Synthetic coding sequence
atgcccagccccgacagcatgaccttcgaggacatcatcgtggacttcacccaggaggagtgggccctgctggacaccagccagagaaagctgttccaggacgtgatgctggagaacatcagccacctggtgagcatcggcaagcagctgtgcaagagcgtggtgctgagccagctggagcaggtggagaagctgagcacccagagaatcagcctgctgcagggcagagaggtgggcatcaagcaccaggagatccccttcatccagcacatctaccagaagggcaccagcaccatcagcaccatgagaagccacacccaggaggaccccttcctgtgcaacgacctgggcgaggacttcacccagcacatcgccctgacccagaacgtgatcacctacatgagaaccaagcacttcgtgagcaagaagttcggcaagatcttcagcgactggctgagcttcaaccagcacaaggagatccacaccaagtgcaagagctacggcagccacctgttcgactacgccttcatccagaacagcgccctgagaccccacagcgtgacccacaccagagagatcaccctggagtgcagagtgtgcggcaagaccttcagcaagaacagcaacctgagaagacacgagatgatccacaccggcgagaagccccacggctgccacctgtgcggcaaggccttcacccactgcagcgacctgagaaagcacgagagaacccacaccggcgagaagccctacggctgccacctgtgcggcaaggccttcagcaagagcagcaacctgagaagacacgagatgatccacaccagagagaaggcccagatctgccacctgtgcggcaaggccttcacccactgcagcgacctgagaaagcacgagagaacccacctgggcgacaagccctacggctgcctgctgtgcggcaaggccttcagcaagtgcagctacctgagacagcacgagagaacccacaacggcgagaagccctacgagtgccacctgtgcggcaaggccttcagccactgcagccacctgagacagcacgagagaagccacaacggcgagaagccccacggctgccacctgtgcggcaaggccttcaccgagagcagcgtgctgaagagacacgagagaatccacaccggcgagaagccctacgagtgccacgtgtgcggcaaggccttcaccgagagcagcgacctgagaagacacgagagaacccacaccggcgagaagccctacgagtgccacctgtgcggcaaggccttcaaccacagcagcgtgctgagaagacacgagagaacccacaccggcgagaagccctacgagtgcaacatctgcggcaaggccttcaacagaagctacaacttcagactgcacagaagagtgcacaccggcgagaagccctacgtgtgccccctgtgcggcaaggccttcagcaagttcttcaacctgagacagcacgagagaacccacaccaagaaggccatgaacatgtag

SEQ ID NO: 10777 - DNA, 1305 bp, Artificial Sequence
  Description of Artificial Sequence: Synthetic coding sequence
atgcccagccccgacagcatgaccttcgaggacatcatcgtggacttcacccaggaggagtgggccctgctggacaccagccagagaaagctgttccaggacgtgatgctggagaacatcagccacctggtgagcatcggcgaggacttcacccagcacatcgccctgacccagaacgtgatcacctacatgagaaccaagcacttcgtgagcaagaagttcggcaagatcttcagcgactggctgagcttcaaccagcacaaggagatccacaccaagtgcaagagctacggcagccacctgttcgactacgccttcatccagaacagcgccctgagaccccacagcgtgacccacaccagagagatcaccctggagtgcagagtgtgcggcaagaccttcagcaagaacagcaacctgagaagacacgagatgatccacaccggcgagaagccccacggctgccacctgtgcggcaaggccttcacccactgcagcgacctgagaaagcacgagagaacccacaccggcgagaagccctacggctgccacctgtgcggcaaggccttcagcaagagcagcaacctgagaagacacgagatgatccacaccagagagaaggcccagatctgccacctgtgcggcaaggccttcacccactgcagcgacctgagaaagcacgagagaacccacctgggcgacaagccctacggctgcctgctgtgcggcaaggccttcagcaagtgcagctacctgagacagcacgagagaacccacaacggcgagaagccctacgagtgccacctgtgcggcaaggccttcagccactgcagccacctgagacagcacgagagaagccacaacggcgagaagccccacggctgccacctgtgcggcaaggccttcaccgagagcagcgtgctgaagagacacgagagaatccacaccggcgagaagccctacgagtgccacgtgtgcggcaaggccttcaccgagagcagcgacctgagaagacacgagagaacccacaccggcgagaagccctacgagtgccacctgtgcggcaaggccttcaaccacagcagcgtgctgagaagacacgagagaacccacaccggcgagaagccctacgagtgcaacatctgcggcaaggccttcaacagaagctacaacttcagactgcacagaagagtgcacaccggcgagaagccctacgtgtgccccctgtgcggcaaggccttcagcaagttcttcaacctgagacagcacgagagaacccacaccaagaaggccatgaacatgtag

SEQ ID NO: 10778 - DNA, 1515 bp, Artificial Sequence; identical to SEQ ID NO: 10776
  Description of Artificial Sequence: Synthetic coding sequence

SEQ ID NO: 10779 - DNA, 1275 bp, Artificial Sequence
  Description of Artificial Sequence: Synthetic coding sequence
atggccagcatgccccccacccccgaggcccagggccccatcctgttcgaggacctggccgtgtacttcagccaggaggagtgcgtgaccctgcaccccgcccagagaagcctgagcaaggacggcaccaaggagagcctggaggacgccgccctgatgggcgaggagggcaagcccgagatcaaccagcagctgagcctggagagcatggagctggacgagctggccctggagaagtaccccatcgccgcccccctggtgccctaccccgagaagagcagcgaggacggcgtgggcaaccccgaggccaagatcctgagcggcacccccacctacaagagaagagtgatcagcctgctggtgaccatcgagaaccacacccccctggtggagctgagcgagtacctgggcaccaacaccctgagcgagatcctggacagcccctgggagggcgccaagaacgtgtacaagtgccccgagtgcgaccagaacttcagcgaccacagctacctggtgctgcaccagaagatccacagcggcgagaagaagcacaagtgcggcgactgcggcaagatcttcaaccacagagccaacctgagaacccacagaagaatccacaccggcgagaagccctacaagtgcgccaagtgcagcgccagcttcagacagcacagccacctgagcagacacatgaacagccacgtgaaggagaagccctacacctgcagcatctgcggcagaggcttcatgtggctgcccggcctggcccagcaccagaagagccacagcgccgagaacacctacgagagcaccaactgcgacaagcacttcaacgagaagcccaacctggccctgcccgaggagaccttcgtgagcggcccccagtaccagcacaccaagtgcatgaagagcttcagacagagcctgtaccccgccctgagcgagaagagccacgacgaggacagcgagagatgcagcgacgacggcgacaacttcttcagcttcagcaagttcaagcccctgcagtgccccgactgcgacatgaccttcccctgcttcagcgagctgatcagccaccagaacatccacaccgaggagagaccccacaagtgcaagacctgcgaggagagcttcgccctggacagcgagctggcctgccaccagaagagccacatgctggccgagcccttcaagtgcaccgtgtgcggcaagaccttcaagagcaacctgcacctgatcacccacaagagaacccacatcaagaacaccacctag

SEQ ID NO: 10780 - DNA, 1767 bp, Artificial Sequence
  Description of Artificial Sequence: Synthetic coding sequence
atggccgcccccgccctggccctggtgagcttcgaggacgtggtggtgaccttcaccggcgaggagtggggccacctggacctggcccagagaaccctgtaccaggaggtgatgctggagacctgcagactgctggtgagcctgggccaccccgtgcccaagcccgagctgatctacctgctggagcacggccaggagctgtggaccgtgaagagaggcctgagccagagcacctgcgccggcgagaaggccaagcccaagatcaccgagcccaccgccagccagctggccttcagcgaggagagcagcttccaggagctgctggcccagagaagcagcagagacagcagactgggccaggccagagacgaggagaagctgatcaagatccaggagggcaacctgagacccggcaccaacccccacaaggagatctgccccgagaagctgagctacaagcacgacgacctggagcccgacgacagcctgggcctgagagtgctgcaggagagagtgaccccccaggacgccctgcacgagtgcgacagccagggccccggcaaggaccccatgaccgacgccagaaacaacccctacacctgcaccgagtgcggcaagggcttcagcaagaagtgggccctggtgagacaccagcagatccacgccggcgtgaagccctacgagtgcaacgagtgcggcaaggcctgcagatacatggccgacgtgatcagacacatgagactgcacaccggcgagaagccctacaagtgcatcgagtgcggcaaggccttcaagagaagattccacctgaccgagcaccagagaatccacaccggcgacaagccctacgagtgcaaggagtgcggcaaggccttcacccacagaagcagcttcatccagcacaacatgacccacaccagagagaagcccttcctgtgcaaggagtgcggcaaggccttctactacagcagcagcttcgcccagcacatgagaatccacaccggcaagaagctgtacgagtgcggcgagtgcggcaaggccttcacccacagaagcaccttcatccagcacaacgtgacccacaccggcgagaagcccttcctgtgcaaggagtgcggcaagaccttctgcctgaacagcagcttcacccagcacatgagaatccacaccggcgagaagccctacgagtgcggcgagtgcggcaaggccttcacccacagaagcaccttcatcagacacaagagaacccacaccggcgagaagcccttcgagtgcaaggagtgcggcaaggccttctgcgacagcagcagcctgatccagcacatgagaatccacaccggcgagaagccctacgagtgcagcgagtgcggcaaggccttcacccaccacagcgtgttcatcagacacaacagaacccacagcggccagaagcccctggagtgcaaggagtgcgccaaggccttctactacagcagcagcttcaccagacacatgagaatccacaccggcgagaagccctacgtgtgcagagagtgcggcaaggccttcacccagcccgccaacttcgtgagacacaacagaatccacaccggcgagaagcccttcgagtgcaaggagtgcgagaaggccttctgcgacaacttcgccctgacccagcacatgagaacccacaccggcgagaagcccttcgagtgcaacgagtgcggcaagaccttcagccacagcagcagcttcacccaccacagaaagatccacaccagagtgtag

SEQ ID NO: 10781 - DNA, 270 bp, Artificial Sequence
  Description of Artificial Sequence: Synthetic coding sequence
gccctggtgagcttcgaggacgtggtggtgaccttcaccggcgaggagtggggccacctggacctggcccagagaaccctgtaccaggaggtgatgctggagacctgcagactgctggtgagcctgggccaccccgtgcccaagcccgagctgatctacctgctggagcacggccaggagctgtggaccgtgaagagaggcctgagccagagcacctgcgccgccagcttcagcctgctgtggaagagctaccaccccggccacggctag

SEQ ID NO: 10782 - DNA, 927 bp, Artificial Sequence
  Description of Artificial Sequence: Synthetic coding sequence
tacacctgcaccgagtgcggcaagggcttcagcaagaagtgggccctggtgagacaccagcagatccacgccggcgtgaagccctacgagtgcaacgagtgcggcaaggcctgcagatacatggccgacgtgatcagacacatgagactgcacaccggcgagaagccctacaagtgcatcgagtgcggcaaggccttcaagagaagattccacctgaccgagcaccagagaatccacaccggcgacaagccctacgagtgcaaggagtgcggcaaggccttcacccacagaagcagcttcgcccagcacatgagaatccacaccggcaagaagctgtacgagtgcggcgagtgcggcaaggccttcacccacagaagcaccttcatccagcacaacgtgacccacaccggcgagaagcccttcctgtgcaaggagtgcggcaagaccttctgcctgaacagcagcttcacccagcacatgagaatccacaccggcgagaagccctacgagtgcggcgagtgcggcaaggccttcacccacagaagcaccttcatcagacacaagagaacccacaccggcgagaagcccttcgagtgcaaggagtgcggcaaggccttctgcgacagcagcagcctgatccagcacatgagaatccacaccggcgagaagccctacgagtgcagcgagtgcggcaaggccttcacccaccacagcgtgttcatcagacacaacagaacccacagcggccagaagcccctggagtgcaaggagtgcgccaaggccttctactacagcagcagcttcaccagacacatgagaatccacaccggcgagaagccctacgtgtgcagagagtgcggcaaggccttcacccagcccgccaacttcgtgagacacaacagaatccacaccggcgagaagccctag

SEQ ID NO: 10783 - DNA, 1764 bp, Artificial Sequence
  Description of Artificial Sequence: Synthetic coding sequence
aaggcccccgccagcgccctggtgagcttcgaggacgtggtggtgaccttcaccggcgaggagtggggccacctggacctggcccagagaaccctgtaccaggaggtgatgctggagacctgcagactgctggtgagcctgggccaccccgtgcccaagcccgagctgatctacctgctggagcacggccaggagctgtggaccgtgaagagaggcctgagccagagcacctgcgccggcgagaaggccaagcccaagatcaccgagcccaccgccagccagctggccttcagcgaggagagcagcttccaggagctgctggcccagagaagcagcagagacagcagactgggccaggccagagacgaggagaagctgatcaagatccaggagggcaacctgagacccggcaccaacccccacaaggagatctgccccgagaagctgagctacaagcacgacgacctggagcccgacgacagcctgggcctgagagtgctgcaggagagagtgaccccccaggacgccctgcacgagtgcgacagccagggccccggcaaggaccccatgaccgacgccagaaacaacccctacacctgcaccgagtgcggcaagggcttcagcaagaagtgggccctggtgagacaccagcagatccacgccggcgtgaagccctacgagtgcaacgagtgcggcaaggcctgcagatacatggccgacgtgatcagacacatgagactgcacaccggcgagaagccctacaagtgcatcgagtgcggcaaggccttcaagagaagattccacctgaccgagcaccagagaatccacaccggcgacaagccctacgagtgcaaggagtgcggcaaggccttcacccacagaagcagcttcatccagcacaacatgacccacaccagagagaagcccttcctgtgcaaggagtgcggcaaggccttctactacagcagcagcttcgcccagcacatgagaatccacaccggcaagaagctgtacgagtgcggcgagtgcggcaaggccttcacccacagaagcaccttcatccagcacaacgtgacccacaccggcgagaagcccttcctgtgcaaggagtgcggcaagaccttctgcctgaacagcagcttcacccagcacatgagaatccacaccggcgagaagccctacgagtgcggcgagtgcggcaaggccttcacccacagaagcaccttcatcagacacaagagaacccacaccggcgagaagcccttcgagtgcaaggagtgcggcaaggccttctgcgacagcagcagcctgatccagcacatgagaatccacaccggcgagaagccctacgagtgcagcgagtgcggcaaggccttcacccaccacagcgtgttcatcagacacaacagaacccacagcggccagaagcccctggagtgcaaggagtgcgccaaggccttctactacagcagcagcttcaccagacacatgagaatccacaccggcgagaagccctacgtgtgcagagagtgcggcaaggccttcacccagcccgccaacttcgtgagacacaacagaatccacaccggcgagaagcccttcgagtgcaaggagtgcgagaaggccttctgcgacaacttcgccctgacccagcacatgagaacccacaccggcgagaagcccttcgagtgcaacgagtgcggcaagaccttcagccacagcagcagcttcacccaccacagaaagatccacaccagagtgtag

SEQ ID NO: 10784 - DNA, 2169 bp, Artificial Sequence
  Description of Artificial Sequence: Synthetic coding sequence
atgatgaaggaggtgctgagcaccggccagggcaacaccgaggtgatccacaccggcaccctgcagagataccagagctaccacatcggcgacttctgcttccaggagatcgagaaggagatccacgacatcgagttccagtgccaggaggacgagagaaacggccacgaggcccccatgaccaagatcaagaagctgaccggcagcaccgaccagcacgaccacagacacgccggcaacaagcccatcaaggaccagctgggcagcagcttctacagccacctgcccgagctgcacatcatccagatcaagggcaagatcggcaaccagttcgagaagagcaccagcgacgcccccagcgtgagcaccagccagagaatcagccccagaccccagatccacatcagcaacaactacggcaacaacagccccaacagcagcctgctgccccagaagcaggaggtgtacatgagagagaagagcttccagtgcaacgagagcggcaaggccttcaactgcagcagcctgctgagaaagcaccagatcccccacctgggcgacaagcagtacaagtgcgacgtgtgcggcaagctgttcaaccacaagcagtacctgacctgccactgcagatgccacaccggcgagaagccctacaagtgcaacgagtgcggcaagagcttcagccaggtgagcagcctgacctgccacagaagactgcacaccgccgtgaagagccacaagtgcaacgagtgcggcaagatcttcggccagaacagcgccctggtgatccacaaggccatccacaccggcgagaagccctacaagtgcaacgagtgcgacaaggccttcaaccagcagagcaacctggccagacacagaagaatccacaccggcgagaagccctacaagtgcgaggagtgcgacaaggtgttcagcagaaagagcaccctggagagccacaagagaatccacaccggcgagaagccctacaagtgcaaggtgtgcgacaccgccttcacctggaacagccagctggccagacacaagagaatccacaccggcgagaagacctacaagtgcaacgagtgcggcaagaccttcagccacaagagcagcctggtgtgccaccacagactgcacggcggcgagaagagctacaagtgcaaggtgtgcgacaaggccttcgcctggaacagccacctggtgagacacaccagaatccacagcggcggcaagccctacaagtgcaacgagtgcggcaagaccttcggccagaacagcgacctgctgatccacaagagcatccacaccggcgagcagccctacaagtacgaggagtgcgagaaggtgttcagctgcggcagcaccctggagacccacaagatcatccacaccggcgagaagccctacaagtgcaaggtgtgcgacaaggccttcgcctgccacagctacctggccaagcacaccagaatccacagcggcgagaagccctacaagtgcaacgagtgcagcaagaccttcagactgagaagctacctggccagccacagaagagtgcacagcggcgagaagccctacaagtgcaacgagtgcagcaagaccttcagccagagaagctacctgcactgccacagaagactgcacagcggcgagaagccctacaagtgcaacgagtgcggcaagaccttcagccacaagcccagcctggtgcaccacagaagactgcacaccggcgagaagagctacaagtgcaccgtgtgcgacaaggccttcgtgagaaacagctacctggccagacacaccagaatccacaccgccgagaagccctacaagtgcaacgagtgcggcaaggccttcaaccagcagagccagctgagcctgcaccacagaatccacgccggcgagaagctgtacaagtgcgagacctgcgacaaggtgttcagcagaaagagccacctgaagagacacagaagaatccaccccggcaagaagccctacaagtgcaaggtgtgcgacaagaccttcggcagcgacagccacctgaagcagcacaccggcctgcacaccggcgagaagccctacaagtgcaacgagtgcggcaaggccttcagcaagcagagcaccctgatccaccaccaggccgtgcacggcgtgggcaagctggactag

SEQ ID NO: 10785 - DNA, 1926 bp, Artificial Sequence
  Description of Artificial Sequence: Synthetic coding sequence
atgatccagagccagatcagcttcgaggacgtggccgtggacttcaccctggaggagtggcagctgctgaaccccacccagaagaacctgtacagagacgtgatgctggagaactacagcaacctggtgttcctggaggtgtggctggacaaccccaagatgtggctgagagacaaccaggacaacctgaagagcatggagagaggccacaagtacgacgtgttcggcaagatcttcaacagcagcatcaacatcgtgcacgtgggcctgagaagccacaagtgcggcaccggcgagaagagcctgaagtgccccttcgacctgctgatccccaagaacaactgcgagagaaagaagatcgacgagctgaacaagaagctgctgttctgcatcaagcccggcagaacccacggcggcatcaagtactgcgactgcagcacctgcagaaagagcagcaacgaggagccctggctgaccgccaaccacatcacccacaccggcgtgtacctgtgcatggagtgcggcagattcttcaacaagaagagccagctggtgatccaccagagaacccacaccggcgagaagccctaccagtgcagcgagtgcggcaaggccttcagccagaagagcctgctgaccgtgcaccagagaacccacagcggcgagaagccccacggctgcagcgagtgccagaaggccttcagcagaaagagcctgctgatcctgcaccagagaatccacaccggcgagaagccctacggctgcagcgagtgcggcaaggccttcagcagaaagagccagctgaagagacaccagatcacccacaccatcgagaagccctacagctgcagcgagtgcggcaaggccttcagccagaagctgaagctgatcacccaccagagagcccacaccggcgagaagccctacccctgcagccactgcggcaaggccttcttctggaagagccagctgatcacccaccagagaacccacaccggcaagaagccctacggctgcggcgagtgccagaaggccttcagcagaaacagcctgctgatcagacaccagagaatccacaccggcgagaagccctacgagtgcaacgagtgcggcgaggccttcatcagaaagccccagctgatcaagcaccagatcacccacaccggcgagaagaactacagatgcagcgactgcgaggaggccttcttcaagaagagcgagctgatcagacaccagaagatccacctgggcgagaagccctacggctgcatccagtgcggcaagaccttcttcggcaagagccagctgctgacccaccacagaacccacaccggcgagaagccctacgagtgcagcgagtgcggcaaggccttcacccagaagagcagcctgatcagccaccagagaacccacaccggcgagaagccctacgagtgcagcgagtgcagaaagaccttcagcgagaagagcagcctgatccaccaccagagaacccacaccggcgagaagcccttcgagtgcagcgagtgcagaaaggccttcgcctggaagccccagctgctgagacaccagagaatccacaccggcgagaagccctacgagtgcagcgagtgcggcaaggccttcgtgcagaaggtgcagctgatcaagcaccagagaaaccacaccggcgagaagacctacggctgcagcgactgcgccaaggccttcttcgagaaggcccagctgatcatccaccagagaatccacaccggcgagagaccctacaagtgcggcgagtgcggcaagagcttcaccagaaagagccacctgatgagacaccagagaatccacaccggcgacaagtactacggctgcaacgagtgcggcaccaccttcaacagaaagagccagctgatgatccaccagagaaaccacatcatctag

SEQ ID NO: 10786 - DNA, 2019 bp, Artificial Sequence
  Description of Artificial Sequence: Synthetic coding sequence
atgatccagagccagatcagcttcgaggacgtggccgtggacttcaccctggaggagtggcagctgctgaaccccacccagaagaacctgtacagagacgtgatgctggagaactacagcaacctggtgttcctgggcttccagatcctgaagcccgacgccatgttcaagctggagcagcaggacccctggatcatcggccaggagatcctgaaccagaacttcagcgaggtgtggctggacaaccccaagatgtggctgagagacaaccaggacaacctgaagagcatggagagaggccacaagtacgacgtgttcggcaagatcttcaacagcagcatcaacatcgtgcacgtgggcctgagaagccacaagtgcggcaccggcgagaagagcctgaagtgccccttcgacctgctgatccccaagaacaactgcgagagaaagaagatcgacgagctgaacaagaagctgctgttctgcatcaagcccggcagaacccacggcggcatcaagtactgcgactgcagcacctgcagaaagagcagcaacgaggagccctggctgaccgccaaccacatcacccacaccggcgtgtacctgtgcatggagtgcggcagattcttcaacaagaagagccagctggtgatccaccagagaacccacaccggcgagaagccctaccagtgcagcgagtgcggcaaggccttcagccagaagagcctgctgaccgtgcaccagagaacccacagcggcgagaagccccacggctgcagcgagtgccagaaggccttcagcagaaagagcctgctgatcctgcaccagagaatccacaccggcgagaagccctacggctgcagcgagtgcggcaaggccttcagcagaaagagccagctgaagagacaccagatcacccacaccatcgagaagccctacagctgcagcgagtgcggcaaggccttcagccagaagctgaagctgatcacccaccagagagcccacaccggcgagaagccctacccctgcagccactgcggcaaggccttcttctggaagagccagctgatcacccaccagagaacccacaccggcaagaagccctacggctgcggcgagtgccagaaggccttcagcagaaacagcctgctgatcagacaccagagaatccacaccggcgagaagccctacgagtgcaacgagtgcggcgaggccttcatcagaaagccccagctgatcaagcaccagatcacccacaccggcgagaagaactacagatgcagcgactgcgaggaggccttcttcaagaagagcgagctgatcagacaccagaagatccacctgggcgagaagccctacggctgcatccagtgcggcaagaccttcttcggcaagagccagctgctgacccaccacagaacccacaccggcgagaagccctacgagtgcagcgagtgcggcaaggccttcacccagaagagcagcctgatcagccaccagagaacccacaccggcgagaagccctacgagtgcagcgagtgcagaaagaccttcagcgagaagagcagcctgatccaccaccagagaacccacaccggcgagaagcccttcgagtgcagcgagtgcagaaaggccttcgcctggaagccccagctgctgagacaccagagaatccacaccggcgagaagccctacgagtgcagcgagtgcggcaaggccttcgtgcagaaggtgcagctgatcaagcaccagagaaaccacaccggcgagaagacctacggctgcagcgactgcgccaaggccttcttcgagaaggcccagctgatcatccaccagagaatccacaccggcgagagaccctacaagtgcggcgagtgcggcaagagcttcaccagaaagagccacctgatgagacaccagagaatccacaccggcgacaagtactacggctgcaacgagtgcggcaccaccttcaacagaaagagccagctgatgatccaccagagaaaccacatcatctag

SEQ ID NO: 10787 - DNA, 2091 bp, Artificial Sequence
  Description of Artificial Sequence: Synthetic coding sequence
atgagctacggcagcatcaccttcggcgacgtggccatcgacttcagccaccaggagtgggagtacctgagcctggtgcagaagaccctgtaccaggaggtgatgatggagaactacgacaacctggtgagcctggccggccacagcgtgagcaagcccgacctgatcaccctgctggagcagggcaaggagccctggatgatcgtgagagaggagaccagaggcgagtgcaccgacctggacagcagatgcgagatcatcagcgacggcaagatgcagctgtacagaaagcacagctgcgtgaccctgcaccagagaatccacaacggccagaagccctacgagtgcaagcagtgccagaagagcttcagccacctgaccgagctgatggtgcaccagaccatccacaccagcgaggagcccgaccagtgcgagaagttcagaaaggccttcagccacctgaccgacctgagaaagcaccagaagatcaacgccagagagaagccctacgagtgcgaggagtgcggcaaggtgttcagctaccccgccaacctggcccagcacggcaaggtgcacgtggagaagccctacgagtgcaaggagtgcggcgaggccttcagaaccagcagacagctgaccgtgcaccacagattccactacggcgagaagccctacgagtgcaaggagtgcggcaaggccttcagcgtgtacggcagactgagcagacaccagagcatccacaccggcgagaagcccttcgagtgcaacaagtgcggcaagagcttcagactgaaggccggcctgaaggtgcaccagagcatccacaccggcgagaagccccacgagtgcaaggagtgcggcaaggccttcagacagttcagccacctggtgggccacaagagaatccacaccggcgagaagccctacgagtgcaaggagtgcggcaagggcttcacctgcagataccagctgaccatgcaccagagaatctacagcggcgagaagcactacgagtgcaaggagaacggcgaggccttcagcagcggccaccagctgaccgccccccacaccttcgagagcgtggagaagccctacaagtgcgaggagtgcggcaaggccttcagcgtgcacggcagactgaccagacaccagggcatccacagcggcaagaagccctacgagtgcaacaagtgcggcaagagcttcagactgaacagcagcctgaagatccaccagaacatccacaccggcgagaagccctacaagtgcaaggagtgcggcaaggccttcagccagagagcccacctggcccaccacaacagaatccacaccggctacaagcccttcgagtgcaaggagtgcggcaagagcttcagatgcgccagctacctggtgatccacgagagaatccacaccggcgagaagccctacgtgtgccaggagtgcggcaagggcttcagctacagccacaagctgaccatccacagaagagtgcacaccggcgagaagccctacgagtgcaaggagtgcggcaaggccttcagcgtgagcggccagctgacccagcacctgagcatccacagcggcaagaagcccttcgagtgcaacaagtgcggcaagagcttcagattcatcagcgtgctgaaggcccaccagaacatccacagcgccgagaagccctacgagtgcaaggagtgcggcaaggccttcagacacgccaccagcctgatctaccacgacagaacccacgccggcgagaagagctacgagtgcaaggagtgcggcgagaccttcagccacgccagccacctgatcatccacgagagaatccacaccagcgacaagccctacgagtgcaagagatgcggcaaggccttccactgcgccagctacctggtgagacacgagagcgtgcacgccgacggcaacccctacatgtgcgaggagtgcggcaaggccttcaacagcagccacgagctgagcatccaccacagagtgcacaccggcgagaagcccttcaagtgcaacaagtgcagaagaagcttcagactgagaagcatcctggaggtgcaccagagaatccacatctag

SEQ ID NO: 10788 - DNA, 2088 bp, Artificial Sequence
  Description of Artificial Sequence: Synthetic coding sequence
atgagctacggcagcatcaccttcggcgacgtggccatcgacttcagccaccaggagtgggagtacctgagcctggtgcagaagaccctgtaccaggaggtgatgatggagaactacgacaacctggtgagcctgggccacagcgtgagcaagcccgacctgatcaccctgctggagcagggcaaggagccctggatgatcgtgagagaggagaccagaggcgagtgcaccgacctggacagcagatgcgagatcatcagcgacggcaagatgcagctgtacagaaagcacagctgcgtgaccctgcaccagagaatccacaacggccagaagccctacgagtgcaagcagtgccagaagagcttcagccacctgaccgagctgatggtgcaccagaccatccacaccagcgaggagcccgaccagtgcgagaagttcagaaaggccttcagccacctgaccgacctgagaaagcaccagaagatcaacgccagagagaagccctacgagtgcgaggagtgcggcaaggtgttcagctaccccgccaacctggcccagcacggcaaggtgcacgtggagaagccctacgagtgcaaggagtgcggcgaggccttcagaaccagcagacagctgaccgtgcaccacagattccactacggcgagaagccctacgagtgcaaggagtgcggcaaggccttcagcgtgtacggcagactgagcagacaccagagcatccacaccggcgagaagcccttcgagtgcaacaagtgcggcaagagcttcagactgaaggccggcctgaaggtgcaccagagcatccacaccggcgagaagccccacgagtgcaaggagtgcggcaaggccttcagacagttcagccacctggtgggccacaagagaatccacaccggcgagaagccctacgagtgcaaggagtgcggcaagggcttcacctgcagataccagctgaccatgcaccagagaatctacagcggcgagaagcactacgagtgcaaggagaacggcgaggccttcagcagcggccaccagctgaccgccccccacaccttcgagagcgtggagaagccctacaagtgcgaggagtgcggcaaggccttcagcgtgcacggcagactgaccagacaccagggcatccacagcggcaagaagccctacgagtgcaacaagtgcggcaagagcttcagactgaacagcagcctgaagatccaccagaacatccacaccggcgagaagccctacaagtgcaaggagtgcggcaaggccttcagccagagagcccacctggcccaccacaacagaatccacaccggctacaagcccttcgagtgcaaggagtgcggcaagagcttcagatgcgccagctacctggtgatccacgagagaatccacaccggcgagaagccctacgtgtgccaggagtgcggcaagggcttcagctacagccacaagctgaccatccacagaagagtgcacaccggcgagaagccctacgagtgcaaggagtgcggcaaggccttcagcgtgagcggccagctgacccagcacctgagcatccacagcggcaagaagcccttcgagtgcaacaagtgcggcaagagcttcagattcatcagcgtgctgaaggcccaccagaacatccacagcgccgagaagccctacgagtgcaaggagtgcggcaaggccttcagacacgccaccagcctgatctaccacgacagaacccacgccggcgagaagagctacgagtgcaaggagtgcggcgagaccttcagccacgccagccacctgatcatccacgagagaatccacaccagcgacaagccctacgagtgcaagagatgcggcaaggccttccactgcgccagctacctggtgagacacgagagcgtgcacgccgacggcaacccctacatgtgcgaggagtgcggcaaggccttcaacagcagccacgagctgagcatccaccacagagtgcacaccggcgagaagcccttcaagtgcaacaagtgcagaagaagcttcagactgagaagcatcctggaggtgcaccagagaatccacatctag

SEQ ID NO: 10789 - DNA, 4236 bp, Artificial Sequence
  Description of Artificial Sequence: Synthetic coding sequence
atgagcctgagcagcggcgccagcggcggcaagggcgtggacgccaaccccgtggagacctacgacagcggcgacgagtgggacatcggcgtgggcaacctgatcatcgacctggacgccgacctggagaaggaccagcagaagctggagatgagcggcagcaaggaggtgggcatccccgcccccaacgccgtggccaccctgcccgacaacatcaagttcgtgacccccgtgcccggcccccagggcaaggagggcaagagcaagagcaagagaagcaagagcggcaaggacaccagcaagcccacccccggcaccagcctgttcacccccagcgagggcgccgccagcaagaaggaggtgcagggcagaagcggcgacggcgccaacgccggcggcctggtggccgccatcgcccccaagggcagcgagaaggccgccaaggccagcagaagcgtggccggcagcaagaaggagaaggagaacagcagcagcaagagcaagaaggagagaagcgagggcgtgggcacctgcagcgagaaggaccccggcgtgctgcagcccgtgcccctgggcggcagaggcggccagtacgacggcagcgccggcgtggacaccggcgccgtggagcccctgggcagcatcgccatcgagcccggcgccgccctgaaccccctgggcaccaagcccgagcccgaggagggcgagaacgagtgcagactgctgaagaaggtgaagagcgagaagatggagagccccgtgagcacccccgccgtgctgcccatccacctgctggtgcccgtggtgaacaacgacatcagcagcccctgcgagcagatcatggtgagaaccagaagcgtgggcgtgaacacctgcgacgtggccctggccaccgagcccgagtgcctgggcccctgcgagcccggcaccagcgtgaacctggagggcatcgtgtggcaggagaccgaggacggcatgctggtggtgaacgtgacctggagaaacaagacctacgtgggcaccctgctggactgcaccagacacgactgggccccccccagattctgcgacagccccaccagcgacctggagatgagaaacggcagaggcagaggcaagagaatgagacccaacagcaacacccccgtgaacgagaccgccaccgccagcgacagcaagggcaccagcaacagcagcaagaccagagccggcgccaacagcaagggcagaagaggcagccagaacagcagcgagcacagaccccccgccagcagcaccagcgaggacgtgaaggccagccccagcagcgccaacaagagaaagaacaagcccctgagcgacatggagctgaacagcagcagcgaggacagcaagggcagcaagagagtgagaaccaacagcatgggcagcgccaccggccccctgcccggcaccaaggtggagcccaccgtgctggacagaaactgccccagccccgtgctgatcgactgcccccaccccaactgcaacaagaagtacaagcacatcaacggcctgaagtaccaccaggcccacgcccacaccgacgacgacagcaagcccgaggccgacggcgacagcgagtacggcgaggagcccatcctgcacgccgacctgggcagctgcaacggcgccagcgtgagccagaagggcagcctgagccccgccagaagcgccacccccaaggtgagactggtggagccccacagccccagccccagcagcaagttcagcaccaagggcctgtgcaagaagaagctgagcggcgagggcgacaccgacctgggcgccctgagcaacgacggcagcgacgacggccccagcgtgatggacgagaccagcaacgacgccttcgacagcctggagagaaagtgcatggagaaggagaagtgcaagaagcccagcagcctgaagcccgagaagatccccagcaagagcctgaagagcgccagacccatcgcccccgccatccccccccagcagatctacaccttccagaccgccaccttcaccgccgccagccccggcagcagcagcggcctgaccgccaccgtggcccaggccatgcccaacagcccccagctgaagcccatccagcccaagcccaccgtgatgggcgagcccttcaccgtgaaccccgccctgacccccgccaaggacaagaagaagaaggacaagaagaagaaggagagcagcaaggagctggagagccccctgacccccggcaaggtgtgcagagccgaggagggcaagagccccttcagagagagcagcggcgacggcatgaagatggagggcctgctgaacggcagcagcgacccccaccagagcagactggccagcatcaaggccgaggccgacaagatctacagcttcaccgacaacgcccccagccccagcatcggcggcagcagcagactggagaacaccacccccacccagcccctgacccccctgcacgtggtgacccagaacggcgccgaggccagcagcgtgaagaccaacagccccgcctacagcgacatcagcgacgccggcgaggacggcgagggcaaggtggacagcgtgaagagcaaggacgccgagcagctggtgaaggagggcgccaagaagaccctgttccccccccagccccagagcaaggacagcccctactaccagggcttcgagagctactacagccccagctacgcccagagcagccccggcgccctgaaccccagcagccaggccggcgtggagagccaggccctgaagaccaagagagacgaggagcccgagagcatcgagggcaaggtgaagaacgacatctgcgaggagaagaagcccgagctgagcagcagcagccagcagcccagcgtgatccagcagagacccaacatgtacatgcagagcctgtactacaaccagtacgcctacgtgcccccctacggctacagcgaccagagctaccacacccacctgctgagcaccaacaccgcctacagacagcagtacgaggagcagcagaagagacagagcctggagcagcagcagagaggcgtggacaagaaggccgagatgggcctgaaggagagagaggccgccctgaaggaggagtggaagcagaagcccagcatcccccccaccctgaccaaggcccccagcctgaccgacctggtgaagagcggccccggcaaggccaaggagcccggcgccgaccccgccaagagcgtgatcatccccaagctggacgacagcagcaagctgcccggccaggcccccgagggcctgaaggtgaagctgagcgacgccagccacctgagcaaggaggccagcgaggccaagaccggcgccgagtgcggcagacaggccgagatggaccccatcctgtggtacagacaggaggccgagcccagaatgtggacctacgtgtaccccgccaagtacagcgacatcaagagcgaggacgagagatggaaggaggagagagacagaaagctgaaggaggagagaagcagaagcaaggacagcgtgcccaaggaggacggcaaggagagcaccagcagcgactgcaagctgcccaccagcgaggagagcagactgggcagcaaggagcccagacccagcgtgcacgtgcccgtgagcagccccctgacccagcaccagagctacatcccctacatgcacggctacagctacagccagagctacgaccccaaccaccccagctacagaagcatgcccgccgtgatgatgcagaactaccccggcagctacctgcccagcagctacagcttcagcccctacggcagcaaggtgagcggcggcgaggacgccgacaaggccagagccagccccagcgtgacctgcaagagcagcagcgagagcaaggccctggacatcctgcagcagcacgccagccactacaagagcaagagccccaccatcagcgacaagaccagccaggagagagacagaggcggctgcggcgtggtgggcggcggcggcagctgcagcagcgtgggcggcgccagcggcggcgagagaagcgtggacagacccagaaccagccccagccagagactgatgagcacccaccaccaccaccaccacctgggctacagcctgctgcccgcccagtacaacctgccctacgccgccggcctgagcagcaccgccatcgtggccagccagcagggcagcacccccagcctgtaccccccccccagaagatag

SEQ ID NO: 10790 - DNA, 1260 bp, Artificial Sequence
  Description of Artificial Sequence: Synthetic coding sequence
atgctgtgcgacgaggaggcccagaagagaaaggccaaggagagcggcatggccctgccccagggcagactgaccttcatggacgtggccatcgagttcagccaggaggagtggaagagcctggaccccggccagagagccctgtacagagacgtgatgctggagaactacagaaacctggtgttcctgggcagaagctgcgtgctgggcagcaacgccgagaacaagcccatcaagaaccagctgggcctgaccctggaggcccacctgagcgagctgcagctgttccaggccggcagaaagatctacagaagcaaccaggtggagaagttcaccaaccacagaagcagcgtgagccccctgcagaagatcagcagcagcttcaccacccacatcttcaacaagtacagaaacgacctgatcgacttccccctgctgccccaggaggagaaggcctacatcagaggcaagagctacgagtacgagtgcagcgaggacggcgaggtgttcagagtgagagccagcctgaccaaccaccaggtgatccacaccgccgagaagccctacaagtgcaccgagtgcggcaaggtgttcagcagaaacagccacctggtggagcactggagaatccacaccggccagaagccctacaagtgcagcgagtgcgacaaggtgttcaacagaaacagcaacctggccagacaccagagaatccacaccggcgagaagccccacaagtgcaacgagtgcggcaaggccttcagagagtgcagcggcctgaccacccacctggtgatccacaccggcgagaagccctacaagtgcaacgagtgcggcaagaacttcagacacaagttcagcctgaccaaccaccagagaagccacaccgccgagaagccctacaagtgcaacgagtgcggcaaggtgttcagcctgctgagctacctggccagacaccagatcatccacagcaccgagaagccctacaagtgcaacgagtgcggcagagccttccacaagagacccggcctgatggcccacctgctgatccacaccggcgagaagccctacaagtgcaacgagtgcgacaaggtgttcggcagaaagctgtacctgaccaaccaccagagaatccacaccggcgagagaccctacaagtgcaacgcctgcggcaaggtgttcaaccagaacccccacctgagcagacacagaaagatccacgccggcgagaacagcctgagaaccctgcagatggagtag

SEQ ID NO: 10791 - DNA, 1389 bp, Artificial Sequence
  Description of Artificial Sequence: Synthetic coding sequence
atgctgtgcgacgaggaggcccagaagagaaaggccaaggagagcggcatggccctgccccagggcagactgaccttcatggacgtggccatcgagttcagccaggaggagtggaagagcctggaccccggccagagagccctgtacagagacgtgatgctggagaactacagaaacctggtgttcctgggcatctgcctgcccgacctgagcatcatcagcatgctgaagcagagaagagagcccctgatcctgcagagccaggtgaagatcgtgaagaacaccgacggcagagagtgcgtgagaagcgtgaacaccggcagaagctgcgtgctgggcagcaacgccgagaacaagcccatcaagaaccagctgggcctgaccctggaggcccacctgagcgagctgcagctgttccaggccggcagaaagatctacagaagcaaccaggtggagaagttcaccaaccacagaagcagcgtgagccccctgcagaagatcagcagcagcttcaccacccacatcttcaacaagtacagaaacgacctgatcgacttccccctgctgccccaggaggagaaggcctacatcagaggcaagagctacgagtacgagtgcagcgaggacggcgaggtgttcagagtgagagccagcctgaccaaccaccaggtgatccacaccgccgagaagccctacaagtgcaccgagtgcggcaaggtgttcagcagaaacagccacctggtggagcactggagaatccacaccggccagaagccctacaagtgcagcgagtgcgacaaggtgttcaacagaaacagcaacctggccagacaccagagaatccacaccggcgagaagccccacaagtgcaacgagtgcggcaaggccttcagagagtgcagcggcctgaccacccacctggtgatccacaccggcgagaagccctacaagtgcaacgagtgcggcaagaacttcagacacaagttcagcctgaccaaccaccagagaagccacaccgccgagaagccctacaagtgcaacgagtgcggcaaggtgttcagcctgctgagctacctggccagacaccagatcatccacagcaccgagaagccctacaagtgcaacgagtgcggcagagccttccacaagagacccggcctgatggcccacctgctgatccacaccggcgagaagccctacaagtgcaacgagtgcgacaaggtgttcggcagaaagctgtacctgaccaaccaccagagaatccacaccggcgagagaccctacaagtgcaacgcctgcggcaaggtgttcaaccagaacccccacctgagcagacacagaaagatccacgccggcgagaacagcctgagaaccctgcagatggagtag

SEQ ID NO: 10792 - DNA, 1389 bp, Artificial Sequence; identical to SEQ ID NO: 10791
  Description of Artificial Sequence: Synthetic coding sequence

SEQ ID NO: 10793 - DNA, 1260 bp, Artificial Sequence; identical to SEQ ID NO: 10790
  Description of Artificial Sequence: Synthetic coding sequence

SEQ ID NO: 10794 - DNA, 2118 bp, Artificial Sequence
  Description of Artificial Sequence: Synthetic coding sequence
atgctgagagaggaggccgcccagaagagaaagggcaaggagcccggcatggccctgccccagggcagactgaccttcagagacgtggccatcgagttcagcctggccgagtggaagtgcctgaaccccagccagagagccctgtacagagaggtgatgctggagaactacagaaacctggaggccgtggacatcagcagcaagtgcatgatgaaggaggtgctgagcaccggccagggcaacaccgaggtgatccacaccggcaccctgcagagacacgagagccaccacatcggcgacttctgcttccaggagatcgagaaggagatccacgacatcgagttccagtgccaggaggacgagagaaacggcctggaggcccccatgaccaagatcaagaagctgaccggcagcaccgaccagcacgaccacagacacgccggcaacaagcccatcaaggaccagctgggcagcagcttctacagccacctgcccgagctgcacatcttccagatcaagggcgagatcggcaaccagctggagaagagcaccaacgacgcccccagcgtgagcaccttccagagaatcagctgcagaccccagacccagatcagcaacaactacggcaacaaccccctgaacagcagcctgctgccccagaagcaggaggtgcacatgagagagaagagcttccagtgcaacaagagcggcaaggccttcaactgcagcagcctgctgagaaagcaccagatcccccacctgggcgacaagcagtacaagtgcgacgtgtgcggcaagctgttcaaccacgagcagtacctggcctgccacgacagatgccacaccgtggagaagccctacaagtgcaaggagtgcggcaagaccttcagccaggagagcagcctgacctgccacagaagactgcacaccggcgtgaagagatacaactgcaacgagtgcggcaagatcttcggccagaacagcgccctgctgatcgacaaggccatcgacaccggcgagaacccctacaagtgcaacgagtgcgacaaggccttcaaccagcagagccagctgagccaccacagaatccacaccggcgagaagccctacaagtgcgaggagtgcgacaaggtgttcagcagaaagagcaccatcgagacccacaagagaatccacaccggcgagaagccctacagatgcaaggtgtgcgacaccgccttcacctggcacagccagctggccagacacagaagaatccacaccgccaagaagacctacaagtgcaacgagtgcggcaagaccttcagccacaagagcagcctggtgtgccaccacagactgcacggcggcgagaagagctacaagtgcaaggtgtgcgacaaggccttcgtgtggagcagccagctggccaagcacaccagaatcgactgcggcgagaagccctacaagtgcaacgagtgcggcaagaccttcggccagaacagcgacctgctgatccacaagagcatccacaccggcgagcagccctacaagtgcgacgagtgcgagaaggtgttcagcagaaagagcagcctggagacccacaagatcggccacaccggcgagaagccctacaagtgcaaggtgtgcgacaaggccttcgcctgccacagctacctggccaagcacaccagaatccacagcggcgagaagccctacaagtgcaacgagtgcagcaagaccttcagccacagaagctacctggtgtgccaccacagagtgcacagcggcgagaagccctacaagtgcaacgagtgcagcaagaccttcagcagaagaagcagcctgcactgccacagaagactgcacagcggcgagaagccctacaagtgcaacgagtgcggcaacaccttcagacactgcagcagcctgatctaccacagaagactgcacaccggcgagaagagctacaagtgcaccatctgcgacaaggccttcgtgagaaacagcctgctgagcagacacaccagaatccacaccgccgagaagccctacaagtgcaacgagtgcggcaaggccttcaaccagcagagccacctgagcagacaccacagaatccacaccggcgagaagccctag

SEQ ID NO: 10795 - DNA, 1911 bp, Artificial Sequence
  Description of Artificial Sequence: Synthetic coding sequence
atgatgaaggaggtgctgagcaccggccagggcaacaccgaggtgatccacaccggcaccctgcagagacacgagagccaccacatcggcgacttctgcttccaggagatcgagaaggagatccacgacatcgagttccagtgccaggaggacgagagaaacggcctggaggcccccatgaccaagatcaagaagctgaccggcagcaccgaccagcacgaccacagacacgccggcaacaagcccatcaaggaccagctgggcagcagcttctacagccacctgcccgagctgcacatcttccagatcaagggcgagatcggcaaccagctggagaagagcaccaacgacgcccccagcgtgagcaccttccagagaatcagctgcagaccccagacccagatcagcaacaactacggcaacaaccccctgaacagcagcctgctgccccagaagcaggaggtgcacatgagagagaagagcttccagtgcaacaagagcggcaaggccttcaactgcagcagcctgctgagaaagcaccagatcccccacctgggcgacaagcagtacaagtgcgacgtgtgcggcaagctgttcaaccacgagcagtacctggcctgccacgacagatgccacaccgtggagaagccctacaagtgcaaggagtgcggcaagaccttcagccaggagagcagcctgacctgccacagaagactgcacaccggcgtgaagagatacaactgcaacgagtgcggcaagatcttcggccagaacagcgccctgctgatcgacaaggccatcgacaccggcgagaacccctacaagtgcaacgagtgcgacaaggccttcaaccagcagagccagctgagccaccacagaatccacaccggcgagaagccctacaagtgcgaggagtgcgacaaggtgttcagcagaaagagcaccatcgagacccacaagagaatccacaccggcgagaagccctacagatgcaaggtgtgcgacaccgccttcacctggcacagccagctggccagacacagaagaatccacaccgccaagaagacctacaagtgcaacgagtgcggcaagaccttcagccacaagagcagcctggtgtgccaccacagactgcacggcggcgagaagagctacaagtgcaaggtgtgcgacaaggccttcgtgtggagcagccagctggccaagcacaccagaatcgactgcggcgagaagccctacaagtgcaacgagtgcggcaagaccttcggccagaacagcgacctgctgatccacaagagcatccacaccggcgagcagccctacaagtgcgacgagtgcgagaaggtgttcagcagaaagagcagcctggagacccacaagatcggccacaccggcgagaagccctacaagtgcaaggtgtgcgacaaggccttcgcctgccacagctacctggccaagcacaccagaatccacagcggcgagaagccctacaagtgcaacgagtgcagcaagaccttcagccacagaagctacctggtgtgccaccacagagtgcacagcggcgagaagccctacaagtgcaacgagtgcagcaagaccttcagcagaagaagcagcctgcactgccacagaagactgcacagcggcgagaagccctacaagtgcaacgagtgcggcaacaccttcagacactgcagcagcctgatctaccacagaagactgcacaccggcgagaagagctacaagtgcaccatctgcgacaaggccttcgtgagaaacagcctgctgagcagacacaccagaatccacaccgccgagaagccctacaagtgcaacgagtgcggcaaggccttcaaccagcagagccacctgagcagacaccacagaatccacaccggcgagaagccctag

SEQ ID NO: 10796 - DNA, 2118 bp, Artificial Sequence; identical to SEQ ID NO: 10794
  Description of Artificial Sequence: Synthetic coding sequence

SEQ ID NO: 10797 - DNA, 2118 bp, Artificial Sequence; identical to SEQ ID NO: 10794
  Description of Artificial Sequence: Synthetic coding sequence

SEQ ID NO: 10798 - DNA, 1854 bp, Artificial Sequence
  Description of Artificial Sequence: Synthetic coding sequence
atgatcaagagccaggagagcctgaccctggaggacgtggccgtggagttcacctgggaggagtggcagctgctgggccccgcccagaaggacctgtacagagacgtgatgctggagaactacagcaacctggtgagcgtgggctaccaggccagcaagcccgacgccctgttcaagctggagcagggcgagccctggaccgtggagaacgagatccacagccagatctgccccgagatcaagaaggtggacaaccacctgcagatgcacagccagaagcagagatgcctgaagagagtggagcagtgccacaagcacaacgccttcggcaacatcatccaccagagaaagagcgacttccccctgagacagaaccacgacaccttcgacctgcacggcaagatcctgaagagcaacctgagcctggtgaaccagaacaagagatacgagatcaagaacagcgtgggcgtgaacggcgacggcaagagcttcctgcacgccaagcacgagcagttccacaacgagatgaacttccccgagggcggcaacagcgtgaacaccaacagccagttcatcaagcaccagagaacccagaacatcgacaagccccacgtgtgcaccgagtgcggcaaggccttcctgaagaagagcagactgatctaccaccagagagtgcacaccggcgagaagccccacggctgcagcatctgcggcaaggccttcagcagaaagagcggcctgaccgagcaccagagaaaccacaccggcgagaagccctacgagtgcaccgagtgcgacaaggccttcagatggaagagccagctgaacgcccaccagaagatccacaccggcgagaagagctacatctgcagcgactgcggcaagggcttcatcaagaagagcagactgatcaaccaccagagagtgcacaccggcgagaagccccacggctgcagcctgtgcggcaaggccttcagcaagagaagcagactgaccgagcaccagagaacccacaccggcgagaagccctacgagtgcaccgagtgcgacaaggccttcagatggaagagccagctgaacgcccaccagaaggcccacaccggcgagaagagctacatctgcagagactgcggcaagggcttcatccagaagggcaacctgatcgtgcaccagagaatccacaccggcgagaagccctacatctgcaacgagtgcggcaagggcttcatccagaagggcaacctgctgatccacagaagaacccacaccggcgagaagccctacgtgtgcaacgagtgcggcaagggcttcagccagaagacctgcctgatcagccaccagagattccacaccggcaagacccccttcgtgtgcaccgagtgcggcaagagctgcagccacaagagcggcctgatcaaccaccagagaatccacaccggcgagaagccctacacctgcagcgactgcggcaaggccttcagagacaagagctgcctgaacagacacagaagaacccacaccggcgagagaccctacggctgcagcgactgcggcaaggccttcagccacctgagctgcctggtgtaccacaagggcatgctgcacgccagagagaagtgcgtgggcagcgtgaagctggagaacccctgcagcgagagccacagcctgagccacaccagagacctgatccaggacaaggacagcgtgaacatggtgaccctgcagatgcccagcgtggccgcccagaccagcctgaccaacagcgccttccaggccgagagcaaggtggccatcgtgagccagcccgtggccagaagcagcgtgagcgccgacagcagaatctgcaccgagtag

SEQ ID NO: 10799 - DNA, 1746 bp, Artificial Sequence
  Description of Artificial Sequence: Synthetic coding sequence
atgctggagaactacagcaacctggtgagcgtgggctaccaggccagcaagcccgacgccctgttcaagctggagcagggcgagccctggaccgtggagaacgagatccacagccagatctgccccgagatcaagaaggtggacaaccacctgcagatgcacagccagaagcagagatgcctgaagagagtggagcagtgccacaagcacaacgccttcggcaacatcatccaccagagaaagagcgacttccccctgagacagaaccacgacaccttcgacctgcacggcaagatcctgaagagcaacctgagcctggtgaaccagaacaagagatacgagatcaagaacagcgtgggcgtgaacggcgacggcaagagcttcctgcacgccaagcacgagcagttccacaacgagatgaacttccccgagggcggcaacagcgtgaacaccaacagccagttcatcaagcaccagagaacccagaacatcgacaagccccacgtgtgcaccgagtgcggcaaggccttcctgaagaagagcagactgatctaccaccagagagtgcacaccggcgagaagccccacggctgcagcatctgcggcaaggccttcagcagaaagagcggcctgaccgagcaccagagaaaccacaccggcgagaagccctacgagtgcaccgagtgcgacaaggccttcagatggaagagccagctgaacgcccaccagaagatccacaccggcgagaagagctacatctgcagcgactgcggcaagggcttcatcaagaagagcagactgatcaaccaccagagagtgcacaccggcgagaagccccacggctgcagcctgtgcggcaaggccttcagcaagagaagcagactgaccgagcaccagagaacccacaccggcgagaagccctacgagtgcaccgagtgcgacaaggccttcagatggaagagccagctgaacgcccaccagaaggcccacaccggcgagaagagctacatctgcagagactgcggcaagggcttcatccagaagggcaacctgatcgtgcaccagagaatccacaccggcgagaagccctacatctgcaacgagtgcggcaagggcttcatccagaagggcaacctgctgatccacagaagaacccacaccggcgagaagccctacgtgtgcaacgagtgcggcaagggcttcagccagaagacctgcctgatcagccaccagagattccacaccggcaagacccccttcgtgtgcaccgagtgcggcaagagctgcagccacaagagcggcctgatcaaccaccagagaatccacaccggcgagaagccctacacctgcagcgactgcggcaaggccttcagagacaagagctgcctgaacagacacagaagaacccacaccggcgagagaccctacggctgcagcgactgcggcaaggccttcagccacctgagctgcctggtgtaccacaagggcatgctgcacgccagagagaagtgcgtgggcagcgtgaagctggagaacccctgcagcgagagccacagcctgagccacaccagagacctgatccaggacaaggacagcgtgaacatggtgaccctgcagatgcccagcgtggccgcccagaccagcctgaccaacagcgccttccaggccgagagcaaggtggccatcgtgagccagcccgtggccagaagcagcgtgagcgccgacagcagaatctgcaccgagtag

SEQ ID NO: 10800 - DNA, 933 bp, Artificial Sequence
  Description of Artificial Sequence: Synthetic coding sequence
aagagaagcagactgaccgagcaccagagaacccacaccggcgagaagccctacgagtgcaccgagtgcgacaaggccttcagatggaagagccagctgaacgcccaccagaaggcccacaccggcgagaagagctacatctgcagagactgcggcaagggcttcatccagaagggcaacctgatcgtgcaccagagaatccacaccggcgagaagccctacatctgcaacgagtgcggcaagggcttcatccagaagggcaacctgctgatccacagaagaacccacaccggcgagaagccctacgtgtgcaacgagtgcggcaagggcttcagccagaagacctgcctgatcagccaccagagattccacaccggcaagacccccttcgtgtgcaccgagtgcggcaagagctgcagccacaagagcggcctgatcaaccaccagagaatccacaccggcgagaagccctacacctgcagcgactgcggcaaggccttcagagacaagagctgcctgaacagacacagaagaacccacaccggcgagagaccctacggctgcagcgactgcggcaaggccttcagccacctgagctgcctggtgtaccacaagggcatgctgcacgccagagagaagtgcgtgggcagcgtgaagctggagaacccctgcagcgagagccacagcctgagccacaccagagacctgatccaggacaaggacagcgtgaacatggtgaccctgcagatgcccagcgtggccgcccagaccagcctgaccaacagcgccttccaggccgagagcaaggtggccatcgtgagccagcccgtggccagaagcagcgtgagcgccgacagcagattcgcccagaacaagaaccacatgaacgccgtgaacgtggtggtgctgagcgtgatcaactacatcatctag

SEQ ID NO: 10801 - DNA, 1758 bp, Artificial Sequence
  Description of Artificial Sequence: Synthetic coding sequence
atgatcaagacccaggagagcctgaccctggaggacgtggccgtggagttcagctgggaggagtggcagctgctggacaccgcccagaagaacctgtacagagacgtgatggtggagaactacaaccacctggtgagcctgggctaccagaccagcaagcccgacgtgctgagcaagctggcccacggccaggagccctggaccaccgacgccaagatccagaacaagaactgccccggcatcggcaaggtggacagccacctgcaggagcacagccccaaccagagactgctgaagagcgtgcagcagtgcaacggccagaacaccctgagaaacatcgtgcacctgagcaagacccacttccccatcgtgcagaaccacgacaccttcgacctgtacagaaagaacctgaagagcagcctgagcctgatcaaccagaagagaagacacggcatcaacaaccccgtggagttcatcggcggcgagaagaccctgctgcacggcaagcacgagagaacccacaccaagaccagattcagcgagaacgccaagtgcatccacaccaagttccaggtgttcaagcaccagagaacccagaagatcgagaagccccacgcctgcatcgagtgcgagcagaccttcctgagaaagagccagctgatctaccacgagaacatctgcatccaggagaaccccggcagcggccagtgcgagaagctgagcagaagcgtgctgttcaccaagcacctgaagaccaacaccaccgacaagatctgcatccccaacgagtacagaaagggcagcaccgtgaagagcagcctgatcacccaccagcagacccacaccgaggagaagagctacatgtgcagcgagtgcggcaagggcttcaccatgaagagatacctgatcgcccaccagagaacccacagcggcgagaagccctacgtgtgcaaggagtgcggcaagggcttcaccgtgaagagcaacctgatcgtgcaccagagaacccacaccggcgagaagccctacatctgcagcgagtgcggcaagggcttcaccatgaagagatacctggtggtgcaccagagaacccacaccggcgagaagccctacatgtgcagcgagtgcggcaagggcttcaccgtgaagagcaacctgatcgtgcaccagagaagccacaccggcgagaagagctacatctgcagcgagtgcggcaagggcttcaccgtgaagagaaccctggtgatccaccagagaacccacaccggcgagaagagctacatctgcaacgagtgcggcaagggcttcaccaccaagagaaccctgatcatccaccagagaacccacaccggcgagaagccctacgagtgcaacgagtgcggcaaggccttcagccagaagatctgcctgatccagcacgagagatgccacaccggcaagacccccttcgtgtgcaccgagtgcggcaagagctacagccacaagtacggcctgatcacccaccagagaatccacaccggcgagaagccctacgagtgcaacgagtgcggcaaggccttcaccaccaagagcgtgctgaacgtgcaccagagaacccacaccggcgagagaccctacggctgcagcgactgcgagaaggccttcagccacctgagcaacctggtgaagcacaagaagatgcacaccagagagatgggcagaatcagccaggtggagaacagctgcaacggcgagagccagctgctgccctacaagtag

SEQ ID NO: 10802 - DNA, 597 bp, Artificial Sequence
  Description of Artificial Sequence: Synthetic coding sequence
atgatcaagacccaggagagcctgaccctggaggacgtggccgtggagttcagctgggaggagtggcagctgctggacaccgcccagaagaacctgtacagagacgtgatggtggagaactacaaccacctggtgagcctgggctaccagaccagcaagcccgacgtgctgagcaagctggcccacggccaggagccctggaccaccgacgccaagatccagaacaagaactgccccggcatcggcaaggtggacagccacctgcaggagcacagccccaaccagagactgctgaagagcgtgcagcagtgcaacggccagaacaccctgagaaacatcgtgcacctgagcaagacccacttccccatcgtgcagaaccacgacaccttcgacctgtacagaaagaacctgaagagcagcctgagcctgatcaaccagaagagaagacacggcatcaacaaccccgtggagttcatcggcgagaccggcagcctggagagacccagacaggccgaccacctgagaagcgaggtgcaggaccagcccggccagagaggcgagaccctgtgcctgctgaagatccacaccaagaactag

SEQ ID NO: 10803 - DNA, 2226 bp, Artificial Sequence
  Description of Artificial Sequence: Synthetic coding sequence
atgaccgcccaggagagcctgaccctggaggacgtggccgtggacttcacctgggaggagtggcagttcctgagccccgcccagaaggacctgtacagagacgtgatgctggagaactacagcaacctggtggccgtgggctaccaggccagcaagcccgacgccctgagcaagctggagagaggcgaggagacctgcaccaccgaggacgagatctacagcagaatctgcagcgacagcggcggcgccagcggcggcgcctacgccgagatcagaaagatcgacgaccccctgcagcaccacctgcagaaccagagcatccagaagagcgtgaagcagtgccacgagcagaacatgttcggcaacatcgtgaaccagaacaagggccacttcctgctgaagcaggactgcgacaccttcgacctgcacgagaagcccctgaagagcaacctgagcttcgagaaccagaagagaagcagcggcctgaagaacagcgccgagttcaacagagacggcaagagcctgttccacgccaaccacaagcagttctacaccgagatgaagttccccgccatcgccaagcccatcaacaagagccagttcatcaagcagcagagaacccacaacatcgagaacgcccacgtgtgcagcgagtgcggcaaggccttcctgaagctgagccagttcatcgaccaccagagagtgcacaccggcgagaagccccacgtgtgcagcatgtgcggcaaggccttcagcagaaagagcagactgatggaccaccagagaacccacaccgagctgaagcactacgagtgcaccgagtgcgacaagaccttcctgaagaagagccagctgaacatccaccagaagacccacatgggcggcaagccctacacctgcagccagtgcggcaaggccttcatcaagaagtgcagactgatctaccaccagagaacccacaccggcgagaagccccacggctgcagcgtgtgcggcaaggccttcagcaccaagttcagcctgaccacccaccagaagacccacaccggcgagaagccctacatctgcagcgagtgcggcaagggcttcatcgagaagagaagactgaccgcccaccacagaacccacaccggcgagaagcccttcatctgcaacaagtgcggcaagggcttcaccctgaagaacagcctgatcacccaccagcagacccacaccggcgagaagctgtacacctgcagcgagtgcggcaagggcttcagcatgaagcactgcctgatggtgcaccagagaacccacaccggcgagaagccctacaagtgcaacgagtgcggcaagggcttcgccctgaagagccccctgatcagacaccagagaacccacaccggcgagaagccctacgtgtgcaccgagtgcagaaagggcttcaccatgaagagcgacctgatcgtgcaccagagaacccacaccgccgagaagccctacatctgcaacgactgcggcaagggcttcaccgtgaagagcagactgatcgtgcaccagagaacccacaccggcgagaagccctacgtgtgcggcgagtgcggcaagggcttccccgccaagatcagactgatgggccaccagagaacccacaccggcgagaagccctacatctgcaacgagtgcggcaagggcttcaccgagaagagccacctgaacgtgcacagaagaacccacaccggcgagaagccctacgtgtgcagcgagtgcggcaagggcctgaccggcaagagcatgctgatcgcccaccagagaacccacaccggcgagaagccctacatctgcaacgagtgcggcaagggcttcaccatgaagagcaccctgagcatccaccagcagacccacaccggcgagaagccctacaagtgcaacgagtgcgacaagaccttcagaaagaagacctgcctgatccagcaccagagattccacaccggcaagaccagcttcgcctgcaccgagtgcggcaagttcagcctgagaaagaacgacctgatcacccaccagagaatccacaccggcgagaagccctacaagtgcagcgactgcggcaaggccttcaccaccaagagcggcctgaacgtgcaccagagaaagcacaccggcgagagaccctacggctgcagcgactgcggcaaggccttcgcccacctgagcatcctggtgaagcacagaagaatccacagatag

SEQ ID NO: 10804 - DNA, 2196 bp, Artificial Sequence
  Description of Artificial Sequence: Synthetic coding sequence
atgatgcaggcccaggagagcctgaccctggaggacgtggccgtggacttcacctgggaggagtggcagttcctgagccccgcccagaaggacctgtacagagacgtgatgctggagaactacagcaacctggtggccgtgggctaccaggccagcaagcccgacgccctgagcaagctggagagaggcgaggagacctgcaccaccgaggacgagatctacagcagaatctgcagcgagatcagaaagatcgacgaccccctgcagcaccacctgcagaaccagagcatccagaagagcgtgaagcagtgccacgagcagaacatgttcggcaacatcgtgaaccagaacaagggccacttcctgctgaagcaggactgcgacaccttcgacctgcacgagaagcccctgaagagcaacctgagcttcgagaaccagaagagaagcagcggcctgaagaacagcgccgagttcaacagagacggcaagagcctgttccacgccaaccacaagcagttctacaccgagatgaagttccccgccatcgccaagcccatcaacaagagccagttcatcaagcagcagagaacccacaacatcgagaacgcccacgtgtgcagcgagtgcggcaaggccttcctgaagctgagccagttcatcgaccaccagagagtgcacaccggcgagaagccccacgtgtgcagcatgtgcggcaaggccttcagcagaaagagcagactgatggaccaccagagaacccacaccgagctgaagcactacgagtgcaccgagtgcgacaagaccttcctgaagaagagccagctgaacatccaccagaagacccacatgggcggcaagccctacacctgcagccagtgcggcaaggccttcatcaagaagtgcagactgatctaccaccagagaacccacaccggcgagaagccccacggctgcagcgtgtgcggcaaggccttcagcaccaagttcagcctgaccacccaccagaagacccacaccggcgagaagccctacatctgcagcgagtgcggcaagggcttcatcgagaagagaagactgaccgcccaccacagaacccacaccggcgagaagcccttcatctgcaacaagtgcggcaagggcttcaccctgaagaacagcctgatcacccaccagcagacccacaccggcgagaagctgtacacctgcagcgagtgcggcaagggcttcagcatgaagcactgcctgatggtgcaccagagaacccacaccggcgagaagccctacaagtgcaacgagtgcggcaagggcttcgccctgaagagccccctgatcagacaccagagaacccacaccggcgagaagccctacgtgtgcaccgagtgcagaaagggcttcaccatgaagagcgacctgatcgtgcaccagagaacccacaccgccgagaagccctacatctgcaacgactgcggcaagggcttcaccgtgaagagcagactgatcgtgcaccagagaacccacaccggcgagaagccctacgtgtgcggcgagtgcggcaagggcttccccgccaagatcagactgatgggccaccagagaacccacaccggcgagaagccctacatctgcaacgagtgcggcaagggcttcaccgagaagagccacctgaacgtgcacagaagaacccacaccggcgagaagccctacgtgtgcagcgagtgcggcaagggcctgaccggcaagagcatgctgatcgcccaccagagaacccacaccggcgagaagccctacatctgcaacgagtgcggcaagggcttcaccatgaagagcaccctgagcatccaccagcagacccacaccggcgagaagccctacaagtgcaacgagtgcgacaagaccttcagaaagaagacctgcctgatccagcaccagagattccacaccggcaagaccagcttcgcctgcaccgagtgcggcaagttcagcctgagaaagaacgacctgatcacccaccagagaatccacaccggcgagaagccctacaagtgcagcgactgcggcaaggccttcaccaccaagagcggcctgaacgtgcaccagagaaagcacaccggcgagagaccctacggctgcagcgactgcggcaaggccttcgcccacctgagcatcctggtgaagcacagaagaatccacagatag

SEQ ID NO: 10805 - DNA, 2058 bp, Artificial Sequence
  Description of Artificial Sequence: Synthetic coding sequence
atgaccgcccaggagagcctgaccctggaggacgtggccgtggacttcacctgggaggagtggcagttcctgagccccgcccagaaggacctgtacagagacgtgatgctggagaactacagcaacctggtggccgtgggctaccaggccagcaagcccgacgccctgagcaagctggagagaggcgaggagacctgcaccaccgaggacgagatctacagcagaatctgcagcgacagcggcggcgccagcggcggcgcctacgccgagatcagaaagatcgacgaccccctgcagcaccacctgcagaaccagagcatccagaagagcgtgaagcagtgccacgagcagaacatgttcggcaacatcgtgaaccagaacaagggccacttcctgctgaagcaggactgcgacaccttcgacctgcacgagaagcccctgaagagcaacctgagcttcgagaaccagaagagaagcagcggcctgaagaacagcgccgagttcaacagagacggcaagagcctgttccacgccaaccacaagcagttctacaccgagatgaagttccccgccatcgccaagcccatcaacaagagccagttcatcaagcagcagagaacccacaacatcgagaacgcccacgtgtgcagcgagtgcggcaaggccttcctgaagctgagccagttcatcgaccaccagagagtgcacaccggcgagaagccccacgtgtgcagcatgtgcggcaaggccttcagcagaaagagcagactgatggaccaccagagaacccacaccgagctgaagcactacgagtgcaccgagtgcgacaagaccttcctgaagaagagccagctgaacatccaccagaagacccacatgggcggcaagccctacacctgcagccagtgcggcaaggccttcatcaagaagtgcagactgatctaccaccagagaacccacaccggcgagaagccccacggctgcagcgtgtgcggcaaggccttcagcaccaagttcagcctgaccacccaccagaagacccacaccggcgagaagccctacatctgcagcgagtgcggcaagggcttcatcgagaagagaagactgaccgcccaccacagaacccacaccggcgagaagcccttcatctgcaacaagtgcggcaagggcttcaccctgaagaacagcctgatcacccaccagcagacccacaccggcgagaagctgtacacctgcagcgagtgcggcaagggcttcagcatgaagcactgcctgatggtgcaccagagaacccacaccggcgagaagccctacaagtgcaacgagtgcggcaagggcttcgccctgaagagccccctgatcagacaccagagaacccacaccggcgagaagccctacgtgtgcaccgagtgcagaaagggcttcaccatgaagagcgacctgatcgtgcaccagagaacccacaccgccgagaagccctacatctgcaacgactgcggcaagggcttcaccgtgaagagcagactgatcgtgcaccagagaacccacaccggcgagaagccctacgtgtgcggcgagtgcggcaagggcttccccgccaagatcagactgatgggccaccagagaacccacaccggcgagaagccctacatctgcaacgagtgcggcaagggcttcaccatgaagagcaccctgagcatccaccagcagacccacaccggcgagaagccctacaagtgcaacgagtgcgacaagaccttcagaaagaagacctgcctgatccagcaccagagattccacaccggcaagaccagcttcgcctgcaccgagtgcggcaagttcagcctgagaaagaacgacctgatcacccaccagagaatccacaccggcgagaagccctacaagtgcagcgactgcggcaaggccttcaccaccaagagcggcctgaacgtgcaccagagaaagcacaccggcgagagaccctacggctgcagcgactgcggcaaggccttcgcccacctgagcatcctggtgaagcacagaagaatccacagatag

SEQ ID NO: 10806 - DNA, 2211 bp, Artificial Sequence
  Description of Artificial Sequence: Synthetic coding sequence
atgagacccgagcccaccaagttctgggaggagagcctgaccctggaggacgtggccgtggacttcacctgggaggagtggcagttcctgagccccgcccagaaggacctgtacagagacgtgatgctggagaactacagcaacctggtggccgtgggctaccaggccagcaagcccgacgccctgagcaagctggagagaggcgaggagacctgcaccaccgaggacgagatctacagcagaatctgcagcgagatcagaaagatcgacgaccccctgcagcaccacctgcagaaccagagcatccagaagagcgtgaagcagtgccacgagcagaacatgttcggcaacatcgtgaaccagaacaagggccacttcctgctgaagcaggactgcgacaccttcgacctgcacgagaagcccctgaagagcaacctgagcttcgagaaccagaagagaagcagcggcctgaagaacagcgccgagttcaacagagacggcaagagcctgttccacgccaaccacaagcagttctacaccgagatgaagttccccgccatcgccaagcccatcaacaagagccagttcatcaagcagcagagaacccacaacatcgagaacgcccacgtgtgcagcgagtgcggcaaggccttcctgaagctgagccagttcatcgaccaccagagagtgcacaccggcgagaagccccacgtgtgcagcatgtgcggcaaggccttcagcagaaagagcagactgatggaccaccagagaacccacaccgagctgaagcactacgagtgcaccgagtgcgacaagaccttcctgaagaagagccagctgaacatccaccagaagacccacatgggcggcaagccctacacctgcagccagtgcggcaaggccttcatcaagaagtgcagactgatctaccaccagagaacccacaccggcgagaagccccacggctgcagcgtgtgcggcaaggccttcagcaccaagttcagcctgaccacccaccagaagacccacaccggcgagaagccctacatctgcagcgagtgcggcaagggcttcatcgagaagagaagactgaccgcccaccacagaacccacaccggcgagaagcccttcatctgcaacaagtgcggcaagggcttcaccctgaagaacagcctgatcacccaccagcagacccacaccggcgagaagctgtacacctgcagcgagtgcggcaagggcttcagcatgaagcactgcctgatggtgcaccagagaacccacaccggcgagaagccctacaagtgcaacgagtgcggcaagggcttcgccctgaagagccccctgatcagacaccagagaacccacaccggcgagaagccctacgtgtgcaccgagtgcagaaagggcttcaccatgaagagcgacctgatcgtgcaccagagaacccacaccgccgagaagccctacatctgcaacgactgcggcaagggcttcaccgtgaagagcagactgatcgtgcaccagagaacccacaccggcgagaagccctacgtgtgcggcgagtgcggcaagggcttccccgccaagatcagactgatgggccaccagagaacccacaccggcgagaagccctacatctgcaacgagtgcggcaagggcttcaccgagaagagccacctgaacgtgcacagaagaacccacaccggcgagaagccctacgtgtgcagcgagtgcggcaagggcctgaccggcaagagcatgctgatcgcccaccagagaacccacaccggcgagaagccctacatctgcaacgagtgcggcaagggcttcaccatgaagagcaccctgagcatccaccagcagacccacaccggcgagaagccctacaagtgcaacgagtgcgacaagaccttcagaaagaagacctgcctgatccagcaccagagattccacaccggcaagaccagcttcgcctgcaccgagtgcggcaagttcagcctgagaaagaacgacctgatcacccaccagagaatccacaccggcgagaagccctacaagtgcagcgactgcggcaaggccttcaccaccaagagcggcctgaacgtgcaccagagaaagcacaccggcgagagaccctacggctgcagcgactgcggcaaggccttcgcccacctgagcatcctggtgaagcacagaagaatccacagatag

SEQ ID NO: 10807 - DNA, 2229 bp, Artificial Sequence
  Description of Artificial Sequence: Synthetic coding sequence
atgatgcaggcccaggagagcctgaccctggaggacgtggccgtggacttcacctgggaggagtggcagttcctgagccccgcccagaaggacctgtacagagacgtgatgctggagaactacagcaacctggtggccgtgggctaccaggccagcaagcccgacgccctgagcaagctggagagaggcgaggagacctgcaccaccgaggacgagatctacagcagaatctgcagcgacagcggcggcgccagcggcggcgcctacgccgagatcagaaagatcgacgaccccctgcagcaccacctgcagaaccagagcatccagaagagcgtgaagcagtgccacgagcagaacatgttcggcaacatcgtgaaccagaacaagggccacttcctgctgaagcaggactgcgacaccttcgacctgcacgagaagcccctgaagagcaacctgagcttcgagaaccagaagagaagcagcggcctgaagaacagcgccgagttcaacagagacggcaagagcctgttccacgccaaccacaagcagttctacaccgagatgaagttccccgccatcgccaagcccatcaacaagagccagttcatcaagcagcagagaacccacaacatcgagaacgcccacgtgtgcagcgagtgcggcaaggccttcctgaagctgagccagttcatcgaccaccagagagtgcacaccggcgagaagccccacgtgtgcagcatgtgcggcaaggccttcagcagaaagagcagactgatggaccaccagagaacccacaccgagctgaagcactacgagtgcaccgagtgcgacaagaccttcctgaagaagagccagctgaacatccaccagaagacccacatgggcggcaagccctacacctgcagccagtgcggcaaggccttcatcaagaagtgcagactgatctaccaccagagaacccacaccggcgagaagccccacggctgcagcgtgtgcggcaaggccttcagcaccaagttcagcctgaccacccaccagaagacccacaccggcgagaagccctacatctgcagcgagtgcggcaagggcttcatcgagaagagaagactgaccgcccaccacagaacccacaccggcgagaagcccttcatctgcaacaagtgcggcaagggcttcaccctgaagaacagcctgatcacccaccagcagacccacaccggcgagaagctgtacacctgcagcgagtgcggcaagggcttcagcatgaagcactgcctgatggtgcaccagagaacccacaccggcgagaagccctacaagtgcaacgagtgcggcaagggcttcgccctgaagagccccctgatcagacaccagagaacccacaccggcgagaagccctacgtgtgcaccgagtgcagaaagggcttcaccatgaagagcgacctgatcgtgcaccagagaacccacaccgccgagaagccctacatctgcaacgactgcggcaagggcttcaccgtgaagagcagactgatcgtgcaccagagaacccacaccggcgagaagccctacgtgtgcggcgagtgcggcaagggcttccccgccaagatcagactgatgggccaccagagaacccacaccggcgagaagccctacatctgcaacgagtgcggcaagggcttcaccgagaagagccacctgaacgtgcacagaagaacccacaccggcgagaagccctacgtgtgcagcgagtgcggcaagggcctgaccggcaagagcatgctgatcgcccaccagagaacccacaccggcgagaagccctacatctgcaacgagtgcggcaagggcttcaccatgaagagcaccctgagcatccaccagcagacccacaccggcgagaagccctacaagtgcaacgagtgcgacaagaccttcagaaagaagacctgcctgatccagcaccagagattccacaccggcaagaccagcttcgcctgcaccgagtgcggcaagttcagcctgagaaagaacgacctgatcacccaccagagaatccacaccggcgagaagccctacaagtgcagcgactgcggcaaggccttcaccaccaagagcggcctgaacgtgcaccagagaaagcacaccggcgagagaccctacggctgcagcgactgcggcaaggccttcgcccacctgagcatcctggtgaagcacagaagaatccacagatag

SEQ ID NO: 10808 - DNA, 2346 bp, Artificial Sequence
  Description of Artificial Sequence: Synthetic coding sequence
atggccacccagggccacctgaccttcaaggacgtggccatcgagttcagccaggaggagtggaagtgcctggagcccgtgcagaaggccctgtacaaggacgtgatgctggagaactacagaaacctggtgttcctgggcatcagccccaagtgcgtgatcaaggagctgccccccaccgagaacagcaacaccggcgagagattccagaccgtggccctggagagacaccagagctacgacatcgagaacctgtacttcagagagatccagaagcacctgcacgacctggagttccagtggaaggacggcgagaccaacgacaaggaggtgcccgtgccccacgagaacaacctgaccggcaagagagaccagcacagccagggcgacgtggagaacaaccacatcgagaaccagctgaccagcaacttcgagagcagactggccgagctgcagaaggtgcagaccgagggcagactgtacgagtgcaacgagaccgagaagaccggcaacaacggctgcctggtgagcccccacatcagagagaagacctacgtgtgcaacgagtgcggcaaggccttcaaggccagcagcagcctgatcaaccaccagagaatccacaccaccgagaagccctacaagtgcaacgagtgcggcaaggccttccacagagccagcctgctgaccgtgcacaaggtggtgcacaccagaggcaagagctaccagtgcgacgtgtgcggcaagatcttcagaaagaacagctacttcgtgagacaccagagaagccacaccggccagaagccctacatctgcaacgagtgcggcaagagcttcagcaagagcagccacctggccgtgcaccagagaatccacaccggcgagaagccctacaagtgcaacctgtgcggcaagagcttcagccagagagtgcacctgagactgcaccagaccgtgcacaccggcgagagacccttcaagtgcaacgagtgcggcaagaccttcaagagaagcagcaacctgaccgtgcaccaggtgatccacgccggcaagaagccctacaagtgcgacgtgtgcggcaaggccttcagacacagaagcaacctggtgtgccacagaagaatccacagcggcgagaagcagtacaagtgcaacgagtgcggcaaggtgttcagcaagagaagcagcctggccgtgcacagaagaatccacaccgtggagaagccctgcaagtgcaacgagtgcggcaaggtgttcagcaagagaagcagcctggccgtgcaccagagaatccacaccggccagaagacctacaagtgcaacaagtgcggcaaggtgtacagcaagcacagccacctggccgtgcactggagaatccacaccggcgagaaggcctacaagtgcaacgagtgcggcaaggtgttcagcatccacagcagactggccgcccaccagagaatccacaccggcgagaagccctacaagtgcaacgagtgcggcaaggtgttcagccagcacagcagactggccgtgcacagaagaatccacaccggcgagaagccctacaagtgcaaggagtgcggcaaggtgttcagcgacagaagcgccttcgccagacacagaagaatccacaccggcgagaagccctacaagtgcaaggagtgcggcaaggtgttcagccagtgcagcagactgaccgtgcacagaagaatccacagcggcgagaagccctacaagtgcaacgagtgcggcaaggtgtacagccagtacagccacctggtgggccacagaagagtgcacaccggcgagaagccctacaagtgccacgagtgcggcaaggccttcaaccagggcagcaccctgaacagacaccagagaatccacaccggcgagaagccctacaagtgcaaccagtgcggcaacagcttcagccagagagtgcacctgagactgcaccagaccgtgcacaccggcgacagaccctacaagtgcaacgagtgcggcaagaccttcaagagaagcagcaacctgaccgcccaccagatcatccacgccggcaagaagccctacaagtgcgacgagtgcggcaaggtgttcagacacagcagccacctggtgagccaccagagaatccacaccggcgagaagagatacaagtgcatcgagtgcggcaaggccttcggcagactgttcagcctgagcaagcaccagagaatccacagcggcaagaagccctacaagtgcaacgagtgcggcaagagcttcatctgcagaagcggcctgaccaagcacagaatcagacacaccggcgagagcctgaccaccaagctgaacgtgaccagaccctag

SEQ ID NO: 10809 - DNA, 2346 bp, Artificial Sequence; identical to SEQ ID NO: 10808
  Description of Artificial Sequence: Synthetic coding sequence

SEQ ID NO: 10810 - DNA, 2586 bp, Artificial Sequence
  Description of Artificial Sequence: Synthetic coding sequence
atgaaccagcccggcggcgccgccgccccccaggccgacggcgccagcgccgccggcagaaagagcaccgccagcagagagagactgaagagaagccagaagagcaccaaggtggagggccccgagcccgtgcccgccgaggccagcctgagcgccgagcagggcaccatgaccgaggtgaaggtgaagaccgagctgcccgacgactacatccaggaggtgatctggcagggcgaggccaaggaggagaagaaggccgtgagcaaggacggcaccagcgacgtgcccgccgagatctgcgtggtgatcggcggcgtgagaaaccagcagaccctgggcagctacgagtgcggcatctgcggcaagaagtacaagtactacaactgcttccagacccacgtgagagcccacagagacaccgaggccaccagcggcgagggcgccagccagagcaacaacttcagatacacctgcgacatctgcggcaagaagtacaagtactacagctgcttccaggagcacagagacctgcacgccgtggacgtgttcagcgtggagggcgcccccgagaacagagccgaccccttcgaccagggcgtggtggccaccgacgaggtgaaggaggagccccccgagcccttccagaagatcggccccatgaacaacatcaccagcgacatcttcaagaagaaggaggtgagacagtgccagaagagagagaccggcaactacacctgcgagttctgcggcaagcagtacaagtactacaccccctaccaggagcacgtggccctgcacgcccccatcaagagcgccttcagcagaagagtggagggcaaggcccagaaccacttcgaggagaccaacagcagcagccagaacagcagcgagccctacacctgcggcgcctgcggcatccagttccagttctacaacaacctgctggagcacatgcagagccacgccgccgacaacgagaacaacatcgccagcaaccagagcagaagcccccccgccgtggtggaggagaagtggaagccccaggcccagagaaacagcgccaacaacaccaccaccagcggcctgacccccaacagcatgatccccgagaaggagagacagaacatcgccgagagactgctgagagtgatgtgcgccgacctgggcgccctgagcgtggtgagcggcaaggagttcctgaagctggcccagaccctggtggacagcggcgccagatacggcgccttcagcgtgaccgagatcctgggcaacttcaacaccctggccctgaagcacctgcccagaatgtacaaccaggtgaaggtgaaggtgacctgcgccctgggcagcaacgcctgcctgggcatcggcgtgacctgccacagccagagcgtgggccccgacagctgctacatcctgaccgcctaccaggccgagggcaaccacatcaagagctacgtgctgggcgtgaagggcgccgacatcagagacagcggcgacctggtgcaccactgggtgcagaacgtgctgagcgagttcgtgatgagcgagatcagaaccgtgtacgtgaccgactgcagagtgagcaccagcgccttcagcaaggccggcatgtgcctgagatgcagcgcctgcgccctgaacagcgtggtgcagagcgtgctgagcaagagaaccctgcaggccagaagcatgcacgaggtgatcgagctgctgaacgtgtgcgaggacctggccggcagcaccggcctggccaaggagaccttcggcagcctggaggagaccagcccccccccctgctggaacagcgtgaccgacagcctgctgctggtgcacgagagatacgagcagatctgcgagttctacagcagagccaagaagatgaacctgatccagagcctgaacaagcacctgctgagcaacctggccgccatcctgacccccgtgaagcaggccgtgatcgagctgagcaacgagagccagcccaccctgcagctggtgctgcccacctacgtgagactggagaagctgttcaccgccaaggccaacgacgccggcaccgtgagcaagctgtgccacctgttcctggaggccctgaaggagaacttcaaggtgcaccccgcccacaaggtggccatgatcctggacccccagcagaagctgagacccgtgcccccctaccagcacgaggagatcatcggcaaggtgtgcgagctgatcaacgaggtgaaggagagctgggccgaggaggccgacttcgagcccgccgccaagaagcccagaagcgccgccgtggagaaccccgccgcccaggaggacgacagactgggcaagaacgaggtgtacgactacctgcaggagcccctgttccaggccacccccgacctgttccagtactggagctgcgtgacccagaagcacaccaagctggccaagctggccttctggctgctggccgtgcccgccgtgggcgccagaagcggctgcgtgaacatgtgcgagcaggccctgctgatcaagagaagaagactgctgagccccgaggacatgaacaagctgatgttcctgaagagcaacatgctgtag

SEQ ID NO: 10811 - DNA, 1128 bp, Artificial Sequence
  Description of Artificial Sequence: Synthetic coding sequence
atgaaccagcccggcggcgccgccgccccccaggccgacggcgccagcgccgccggcagaaagagcaccgccagcagagagagactgaagagaagccagaagagcaccaaggtggagggccccgagcccgtgcccgccgaggccagcctgagcgccgagcagggcaccatgaccgaggtgaaggtgaagaccgagctgcccgacgactacatccaggaggtgatctggcagggcgaggccaaggaggagaagaaggccgtgagcaaggacggcaccagcgacgtgcccgccgagatctgcgtggtgatcggcggcgtgagaaaccagcagaccctgggcagctacgagtgcggcatctgcggcaagaagtacaagtactacaactgcttccagacccacgtgagagcccacagagacaccgaggccaccagcggcgagggcgccagccagagcaacaacttcagatacacctgcgacatctgcggcaagaagtacaagtactacagctgcttccaggagcacagagacctgcacgccgtggacgtgttcagcgtggagggcgcccccgagaacagagccgaccccttcgaccagggcgtggtggccaccgacgaggtgaaggaggagccccccgagcccttccagaagatcggccccatgaacaacatcaccagcgacatcttcaagaagaaggaggtgagacagtgccagaagagagagaccggcaactacacctgcgagttctgcggcaagcagtacaagtactacaccccctaccaggagcacgtggccctgcacgcccccatcagcaccgcccccggctgggagccccccgacgaccccgacaccggcagcgagtgcagccaccccgaggtgagccccagccccagattcgtggccgccaagacccagaccaaccagagcggcaagaaggcccccgccagcgtggtgagatgcgccaccctgctgcacagaaccccccccgccacccagacccagaccttcagaacccccaacagcggcagccccgccagcaaggccaccgccgagagcgccttcagcagaagagtggagggcaaggcccagaaccacttcgaggagaccaacagcagcagccagaacagctag

SEQ ID NO: 10812 - DNA, 2865 bp, Artificial Sequence
  Description of Artificial Sequence: Synthetic coding sequence
atgaaccagcccggcggcgccgccgccccccaggccgacggcgccagcgccgccggcagaaagagcaccgccagcagagagagactgaagagaagccagaagagcaccaaggtggagggccccgagcccgtgcccgccgaggccagcctgagcgccgagcagggcaccatgaccgaggtgaaggtgaagaccgagctgcccgacgactacatccaggaggtgatctggcagggcgaggccaaggaggagaagaaggccgtgagcaaggacggcaccagcgacgtgcccgccgagatctgcgtggtgatcggcggcgtgagaaaccagcagaccctggacggcaaggcccccgagggcagcccccacggcggcagcgtgagaagcagatacagcggcacctggatcttcgaccaggccctgagatacgccagcggcagctacgagtgcggcatctgcggcaagaagtacaagtactacaactgcttccagacccacgtgagagcccacagagacaccgaggccaccagcggcgagggcgccagccagagcaacaacttcagatacacctgcgacatctgcggcaagaagtacaagtactacagctgcttccaggagcacagagacctgcacgccgtggacgtgttcagcgtggagggcgcccccgagaacagagccgaccccttcgaccagggcgtggtggccaccgacgaggtgaaggaggagccccccgagcccttccagaagatcggccccaagaccggcaactacacctgcgagttctgcggcaagcagtacaagtactacaccccctaccaggagcacgtggccctgcacgcccccatcagcaccgcccccggctgggagccccccgacgaccccgacaccggcagcgagtgcagccaccccgaggtgagccccagccccagattcgtggccgccaagacccagaccaaccagagcggcaagaaggcccccgccagcgtggtgagatgcgccaccctgctgcacagaaccccccccgccacccagacccagaccttcagaacccccaacagcggcagccccgccagcaaggccaccgccgccgagagcgccttcagcagaagagtggagggcaaggcccagaaccacttcgaggagaccaacagcagcagccagaacagcagcgagccctacacctgcggcgcctgcggcatccagttccagttctacaacaacctgctggagcacatgcagagccacgccgccgacaacgagaacaacatcgccagcaaccagagcagaagcccccccgccgtggtggaggagaagtggaagccccaggcccagagaaacagcgccaacaacaccaccaccagcggcctgacccccaacagcatgatccccgagaaggagagacagaacatcgccgagagactgctgagagtgatgtgcgccgacctgggcgccctgagcgtggtgagcggcaaggagttcctgaagctggcccagaccctggtggacagcggcgccagatacggcgccttcagcgtgaccgagatcctgggcaacttcaacaccctggccctgaagcacctgcccagaatgtacaaccaggtgaaggtgaaggtgacctgcgccctgggcagcaacgcctgcctgggcatcggcgtgacctgccacagccagagcgtgggccccgacagctgctacatcctgaccgcctaccaggccgagggcaaccacatcaagagctacgtgctgggcgtgaagggcgccgacatcagagacagcggcgacctggtgcaccactgggtgcagaacgtgctgagcgagttcgtgatgagcgagatcagaaccgtgtacgtgaccgactgcagagtgagcaccagcgccttcagcaaggccggcatgtgcctgagatgcagcgcctgcgccctgaacagcgtggtgcagagcgtgctgagcaagagaaccctgcaggccagaagcatgcacgaggtgatcgagctgctgaacgtgtgcgaggacctggccggcagcaccggcctggccaaggagaccttcggcagcctggaggagaccagcccccccccctgctggaacagcgtgaccgacagcctgctgctggtgcacgagagatacgagcagatctgcgagttctacagcagagccaagaagatgaacctgatccagagcctgaacaagcacctgctgagcaacctggccgccatcctgacccccgtgaagcaggccgtgatcgagctgagcaacgagagccagcccaccctgcagctggtgctgcccacctacgtgagactggagaagctgttcaccgccaaggccaacgacgccggcaccgtgagcaagctgtgccacctgttcctggaggccctgaaggagaacttcaaggtgcaccccgcccacaaggtggccatgatcctggacccccagcagaagctgagacccgtgcccccctaccagcacgaggagatcatcggcaaggtgtgcgagctgatcaacgaggtgaaggagagctgggccgaggaggccgacttcgagcccgccgccaagaagcccagaagcgccgccgtggagaaccccgccgcccaggaggacgacagactgggcaagaacgaggtgtacgactacctgcaggagcccctgttccaggccacccccgacctgttccagtactggagctgcgtgacccagaagcacaccaagctggccaagctggccttctggctgctggccgtgcccgccgtgggcgccagaagcggctgcgtgaacatgtgcgagcaggccctgctgatcaagagaagaagactgctgagccccgaggacatgaacaagctgatgttcctgaagagcaacatgctgtag

SEQ ID NO: 10813 - DNA, 915 bp, Artificial Sequence
  Description of Artificial Sequence: Synthetic coding sequence
atgaaccagcccggcggcgccgccgccccccaggccgacggcgccagcgccgccggcagaaagagcaccgccagcagagagagactgaagagaagccagaagagcaccaaggtggagggccccgagcccgtgcccgccgaggccagcctgagcgccgagcagggcaccatgaccgaggtgaaggtgaagaccgagctgcccgacgactacatccaggaggtgatctggcagggcgaggccaaggaggagaagaaggccgtgagcaaggacggcaccagcgacgtgcccgccgagatctgcgtggtgatcggcggcgtgagaaaccagcagaccctgggcagctacgagtgcggcatctgcggcaagaagtacaagtactacaactgcttccagacccacgtgagagcccacagagacaccgaggccaccagcggcgagggcgccagccagagcaacaacttcagatacacctgcgacatctgcggcaagaagtacaagtactacagctgcttccaggagcacagagacctgcacgccgtggacgaccccttcgaccagggcgtggtggccaccgacgaggtgaaggaggagccccccgagcccttccagaagatcggccccatgaacaacatcaccagcgacatcttcaagaagaaggaggtgagacagtgccagaagagagagaccggcaactacacctgcgagttctgcggcaagcagtacaagtactacaccccctaccaggagcacgtggccctgcacgcccccatcaccacccagacccagaccttcagaacccccaacagcggcagccccgccagcaaggccaccgccgagagcgccttcagcagaagagtggagggcaaggcccagaaccacttcgaggagaccaacagcagcagccagaacagctag

SEQ ID NO: 10814 - DNA, 1683 bp, Artificial Sequence
  Description of Artificial Sequence: Synthetic coding sequence
atgggccagcccgccccctacgccgagggccccatccagggcggcgacgccggcgagctgtgcaagtgcgacttcctggtgagcatcagcatcccccagaccagaagcgacatccccgccggcgccagaagaagcagcatgggccccagaagcctggacacctgctggggcagaggccccgagagacacgtgcacagactggagtgcaacggcgtgatcttcacccacagaaacctgtgcctgcccggcggcaagaccaagaccgagaacgaggagaagaccgcccagctgaacatcagcaaggagagcgagagccacagactgatcgtggagggcctgctgatggacgtgccccagcaccccgacttcaaggacagactggagaagagccagctgcacgacaccggcaacaagaccaagatcggcgactgcaccgacctgaccgtgcaggaccacgagagcagcaccaccgagagagaggagatcgccagaaagctggaggagagcagcgtgagcacccacctgatcaccaagcagggcttcgccaaggagcaggtgttctacaagtgcggcgagtgcggcagctactacaacccccacagcgacttccacctgcaccagagagtgcacaccaacgagaagccctacacctgcaaggagtgcggcaagaccttcagatacaacagcaagctgagcagacaccagaagatccacaccggcgagaagccctacagctgcgaggagtgcggccaggccttcagccagaacagccacctgctgcagcaccagaagctgcacggcggccagagaccctacgagtgcaccgactgcggcaagaccttcagctacaacagcaagctgatcagacaccagagaatccacaccggcgagaagcccttcaagtgcaaggagtgcggcaaggccttcagctgcagctacgactgcatcatccacgagagaatccacaacggcgagaagccctacgagtgcaaggagtgcggcaagagcctgagcagcaacagcgtgctgatccagcaccagagaatccacaccggcgagaagccctacgagtgcaaggagtgcggcaaggccttccacagaagcagcgtgttcctgcagcaccagagattccacaccggcgagcagctgtacaagtgcaacgagtgctggaagaccttcagctgcagcagcagattcatcgtgcaccagagaatccacaacggcgagaagccctacgagtgccaggagtgcggcaagaccttcagccagaagatcaccctggtgcagcaccagagagtgcacaccggcgagaagccctacgagtgcaaggagtgcggcaaggccttcagatggaacgccagcttcatccagcaccagaagtggcacaccagaaagaagctgatcaacggcaccggcctgagcgccgtgaagccctactgcccctgcgccatcctgagccccctgcccccccagcacacctgcagcgccctggccccccccggcccccccctgagcagcagccacgccgtggtgctgccccccagcgtgcccttcttcctgctgctgcccagcagcgagaaggccaaccccagccccgtgcagatcgcccacttcttccaggacctggccttccccggcaagagcagcctgcagagccccaaccccctgagccacagcctgtag

SEQ ID NO: 10815 - DNA, 1731 bp, Artificial Sequence
  Description of Artificial Sequence: Synthetic coding sequence
atgctgcagaccgtgtggttccagggcctgggcagaaacctgctgttccaggagcccgtgaccttcgaggacgtggccgtgtacttcacccagaacgagtgggccagcctgcaccccacccagagagccctgtacagagaggtgatgctggagaactacgccaacgtgaccagcctgagcgccttccccttccccaagcccgacctgatcttccagctggagcagggcgaggccgcctggggccccgacccctggaccctggccggcggcgaggccctgagaggcatgtgcaccggcggcaagaccaagaccgagaacgaggagaagaccgcccagctgaacatcagcaaggagagcgagagccacagactgatcgtggagggcctgctgatggacgtgccccagcaccccgacttcaaggacagactggagaagagccagctgcacgacaccggcaacaagaccaagatcggcgactgcaccgacctgaccgtgcaggaccacgagagcagcaccaccgagagagaggagatcgccagaaagctggaggagagcagcgtgagcacccacctgatcaccaagcagggcttcgccaaggagcaggtgttctacaagtgcggcgagtgcggcagctactacaacccccacagcgacttccacctgcaccagagagtgcacaccaacgagaagccctacacctgcaaggagtgcggcaagaccttcagatacaacagcaagctgagcagacaccagaagatccacaccggcgagaagccctacagctgcgaggagtgcggccaggccttcagccagaacagccacctgctgcagcaccagaagctgcacggcggccagagaccctacgagtgcaccgactgcggcaagaccttcagctacaacagcaagctgatcagacaccagagaatccacaccggcgagaagcccttcaagtgcaaggagtgcggcaaggccttcagctgcagctacgactgcatcatccacgagagaatccacaacggcgagaagccctacgagtgcaaggagtgcggcaagagcctgagcagcaacagcgtgctgatccagcaccagagaatccacaccggcgagaagccctacgagtgcaaggagtgcggcaaggccttccacagaagcagcgtgttcctgcagcaccagagattccacaccggcgagcagctgtacaagtgcaacgagtgctggaagaccttcagctgcagcagcagattcatcgtgcaccagagaatccacaacggcgagaagccctacgagtgccaggagtgcggcaagaccttcagccagaagatcaccctggtgcagcaccagagagtgcacaccggcgagaagccctacgagtgcaaggagtgcggcaaggccttcagatggaacgccagcttcatccagcaccagaagtggcacaccagaaagaagctgatcaacggcaccggcctgagcgccgtgaagccctactgcccctgcgccatcctgagccccctgcccccccagcacacctgcagcgccctggccccccccggcccccccctgagcagcagccacgccgtggtgctgccccccagcgtgcccttcttcctgctgctgcccagcagcgagaaggccaaccccagccccgtgcagatcgcccacttcttccaggacctggccttccccggcaagagcagcctgcagagccccaaccccctgagccacagcctgtag

SEQ ID NO: 10816 - DNA, 1731 bp, Artificial Sequence; identical to SEQ ID NO: 10815
  Description of Artificial Sequence: Synthetic coding sequence

SEQ ID NO: 10817 - DNA, 594 bp, Artificial Sequence
  Description of Artificial Sequence: Synthetic coding sequence
atgggccagcccgccccctacgccgagggccccatccagggcggcgacgccggcgagctgtgcaagtgcaacgagtgctggaagaccttcagctgcagcagcagattcatcgtgcaccagagaatccacaacggcgagaagccctacgagtgccaggagtgcggcaagaccttcagccagaagatcaccctggtgcagcaccagagagtgcacaccggcgagaagccctacgagtgcaaggagtgcggcaaggccttcagatggaacgccagcttcatccagcaccagaagtggcacaccagaaagaagctgatcaacggcaccggcctgagcgccgtgaagccctactgcccctgcgccatcctgagccccctgcccccccagcacacctgcagcgccctggccccccccggcccccccctgagcagcagccacgccgtggtgctgccccccagcgtgcccttcttcctgctgctgcccagcagcgagaaggccaaccccagccccgtgcagatcgcccacttcttccaggacctggccttccccggcaagagcagcctgcagagccccaaccccctgagccacagcctgtag

SEQ ID NO: 10818 - DNA, 1851 bp, Artificial Sequence
  Description of Artificial Sequence: Synthetic coding sequence
atgctgcagaccgtgtggttccagggcctgggcagaaacctgctgttccaggagcccgtgaccttcgaggacgtggccgtgtacttcacccagaacgagtgggccagcctgcaccccacccagagagccctgtacagagaggtgatgctggagaactacgccaacgtgaccagcctgtaccccaccgccggcggcttccccctggacaccgagagaaccgagaaggtgcccggcgccctgagcagcttcctgcccagcagcagcagcctggagctgatcctggccctgctgcccatgagcgccttccccttccccaagcccgacctgatcttccagctggagcagggcgaggccgcctggggccccgacccctggaccctggccggcggcgaggccctgagaggcatgtgcaccggcggcaagaccaagaccgagaacgaggagaagaccgcccagctgaacatcagcaaggagagcgagagccacagactgatcgtggagggcctgctgatggacgtgccccagcaccccgacttcaaggacagactggagaagagccagctgcacgacaccggcaacaagaccaagatcggcgactgcaccgacctgaccgtgcaggaccacgagagcagcaccaccgagagagaggagatcgccagaaagctggaggagagcagcgtgagcacccacctgatcaccaagcagggcttcgccaaggagcaggtgttctacaagtgcggcgagtgcggcagctactacaacccccacagcgacttccacctgcaccagagagtgcacaccaacgagaagccctacacctgcaaggagtgcggcaagaccttcagatacaacagcaagctgagcagacaccagaagatccacaccggcgagaagccctacagctgcgaggagtgcggccaggccttcagccagaacagccacctgctgcagcaccagaagctgcacggcggccagagaccctacgagtgcaccgactgcggcaagaccttcagctacaacagcaagctgatcagacaccagagaatccacaccggcgagaagcccttcaagtgcaaggagtgcggcaaggccttcagctgcagctacgactgcatcatccacgagagaatccacaacggcgagaagccctacgagtgcaaggagtgcggcaagagcctgagcagcaacagcgtgctgatccagcaccagagaatccacaccggcgagaagccctacgagtgcaaggagtgcggcaaggccttccacagaagcagcgtgttcctgcagcaccagagattccacaccggcgagcagctgtacaagtgcaacgagtgctggaagaccttcagctgcagcagcagattcatcgtgcaccagagaatccacaacggcgagaagccctacgagtgccaggagtgcggcaagaccttcagccagaagatcaccctggtgcagcaccagagagtgcacaccggcgagaagccctacgagtgcaaggagtgcggcaaggccttcagatggaacgccagcttcatccagcaccagaagtggcacaccagaaagaagctgatcaacggcaccggcctgagcgccgtgaagccctactgcccctgcgccatcctgagccccctgcccccccagcacacctgcagcgccctggccccccccggcccccccctgagcagcagccacgccgtggtgctgccccccagcgtgcccttcttcctgctgctgcccagcagcgagaaggccaaccccagccccgtgcagatcgcccacttcttccaggacctggccttccccggcaagagcagcctgcagagccccaaccccctgagccacagcctgtag

SEQ ID NO: 10819 - DNA, 1599 bp, Artificial Sequence
  Description of Artificial Sequence: Synthetic coding sequence
atgaagcccggcgtgatcagccacgcccccgacagcgtggtgcccgccgccttccccttccccaagcccgacctgatcttccagctggagcagggcgaggccgcctggggccccgacccctggaccctggccggcggcgaggccctgagaggcatgtgcaccggcggcaagaccaagaccgagaacgaggagaagaccgcccagctgaacatcagcaaggagagcgagagccacagactgatcgtggagggcctgctgatggacgtgccccagcaccccgacttcaaggacagactggagaagagccagctgcacgacaccggcaacaagaccaagatcggcgactgcaccgacctgaccgtgcaggaccacgagagcagcaccaccgagagagaggagatcgccagaaagctggaggagagcagcgtgagcacccacctgatcaccaagcagggcttcgccaaggagcaggtgttctacaagtgcggcgagtgcggcagctactacaacccccacagcgacttccacctgcaccagagagtgcacaccaacgagaagccctacacctgcaaggagtgcggcaagaccttcagatacaacagcaagctgagcagacaccagaagatccacaccggcgagaagccctacagctgcgaggagtgcggccaggccttcagccagaacagccacctgctgcagcaccagaagctgcacggcggccagagaccctacgagtgcaccgactgcggcaagaccttcagctacaacagcaagctgatcagacaccagagaatccacaccggcgagaagcccttcaagtgcaaggagtgcggcaaggccttcagctgcagctacgactgcatcatccacgagagaatccacaacggcgagaagccctacgagtgcaaggagtgcggcaagagcctgagcagcaacagcgtgctgatccagcaccagagaatccacaccggcgagaagccctacgagtgcaaggagtgcggcaaggccttccacagaagcagcgtgttcctgcagcaccagagattccacaccggcgagcagctgtacaagtgcaacgagtgctggaagaccttcagctgcagcagcagattcatcgtgcaccagagaatccacaacggcgagaagccctacgagtgccaggagtgcggcaagaccttcagccagaagatcaccctggtgcagcaccagagagtgcacaccggcgagaagccctacgagtgcaaggagtgcggcaaggccttcagatggaacgccagcttcatccagcaccagaagtggcacaccagaaagaagctgatcaacggcaccggcctgagcgccgtgaagccctactgcccctgcgccatcctgagccccctgcccccccagcacacctgcagcgccctggccccccccggcccccccctgagcagcagccacgccgtggtgctgccccccagcgtgcccttcttcctgctgctgcccagcagcgagaaggccaaccccagccccgtgcagatcgcccacttcttccaggacctggccttccccggcaagagcagcctgcagagccccaaccccctgagccacagcctgtag

SEQ ID NO: 10820 - DNA, 1851 bp, Artificial Sequence; identical to SEQ ID NO: 10818
  Description of Artificial Sequence: Synthetic coding sequence

SEQ ID NO: 10821 - DNA, 1704 bp, Artificial Sequence
  Description of Artificial Sequence: Synthetic coding sequence
atgggccagcccgccccctacgccgagggccccatccagggcggcgacgccggcgagctgtgcaagtgcgacttcctggtgagcatcagcatcccccagaccagaagcgacatccccgccggcgccagaagaagcagcatgggccccagaagcctggacacctgctggggcagaggccccgagagacacgtgcacagagtgagcctgctgctgcccagactggagtgcaacggcgtgatcttcacccacagaaacctgtgcctgcccggcggcaagaccaagaccgagaacgaggagaagaccgcccagctgaacatcagcaaggagagcgagagccacagactgatcgtggagggcctgctgatggacgtgccccagcaccccgacttcaaggacagactggagaagagccagctgcacgacaccggcaacaagaccaagatcggcgactgcaccgacctgaccgtgcaggaccacgagagcagcaccaccgagagagaggagatcgccagaaagctggaggagagcagcgtgagcacccacctgatcaccaagcagggcttcgccaaggagcaggtgttctacaagtgcggcgagtgcggcagctactacaacccccacagcgacttccacctgcaccagagagtgcacaccaacgagaagccctacacctgcaaggagtgcggcaagaccttcagatacaacagcaagctgagcagacaccagaagatccacaccggcgagaagccctacagctgcgaggagtgcggccaggccttcagccagaacagccacctgctgcagcaccagaagctgcacggcggccagagaccctacgagtgcaccgactgcggcaagaccttcagctacaacagcaagctgatcagacaccagagaatccacaccggcgagaagcccttcaagtgcaaggagtgcggcaaggccttcagctgcagctacgactgcatcatccacgagagaatccacaacggcgagaagccctacgagtgcaaggagtgcggcaagagcctgagcagcaacagcgtgctgatccagcaccagagaatccacaccggcgagaagccctacgagtgcaaggagtgcggcaaggccttccacagaagcagcgtgttcctgcagcaccagagattccacaccggcgagcagctgtacaagtgcaacgagtgctggaagaccttcagctgcagcagcagattcatcgtgcaccagagaatccacaacggcgagaagccctacgagtgccaggagtgcggcaagaccttcagccagaagatcaccctggtgcagcaccagagagtgcacaccggcgagaagccctacgagtgcaaggagtgcggcaaggccttcagatggaacgccagcttcatccagcaccagaagtggcacaccagaaagaagctgatcaacggcaccggcctgagcgccgtgaagccctactgcccctgcgccatcctgagccccctgcccccccagcacacctgcagcgccctggccccccccggcccccccctgagcagcagccacgccgtggtgctgccccccagcgtgcccttcttcctgctgctgcccagcagcgagaaggccaaccccagccccgtgcagatcgcccacttcttccaggacctggccttccccggcaagagcagcctgcagagccccaaccccctgagccacagcctgtag

SEQ ID NO: 10822 - DNA, 474 bp, Artificial Sequence
  Description of Artificial Sequence: Synthetic coding sequence
atgctgcagaccacctggccccaggagagcgtgaccttcgaggacgtggccgtgtacttcacccagaaccagtgggccagcctggaccccgcccagagagccctgtacggcgaggtgatgctggagaactacgccaacgtggccagcctggtggccttccccttccccaagcccgccctgatcagccacctggagagaggcgaggccccctggggccccgacccctgggacaccgagatcctgagaggcatcagccagggcggcgagagctggatcaagaacgagggcctggtgatcaagcaggaggccagcgaggagaccgagctgcacagaatgcccgtgggcggcctgctgagaaacgtgagccagcacttcgacttcaagagaaaggccctgaagcagaccttcaacctgaaccccaacctgatcctgagaggcggcagcgtggaggtgagaagcctgagacccgcctag

SEQ ID NO: 10823 - DNA, 1320 bp, Artificial Sequence
  Description of Artificial Sequence: Synthetic coding sequence
atgctgcagaccacctggccccaggagagcgtgaccttcgaggacgtggccgtgtacttcacccagaaccagtgggccagcctggaccccgcccagagagccctgtacggcgaggtgatgctggagaactacgccaacgtggccagcctggtggccttccccttccccaagcccgccctgatcagccacctggagagaggcgaggccccctggggccccgacccctgggacaccgagatcctgagaggcatcagccagggcggcgagagctggatcaagaacgagggcctggtgatcaagcaggaggccagcgaggagaccgagctgcacagaatgcccgtgggcggcctgctgagaaacgtgagccagcacttcgacttcaagagaaaggccctgaagcagaccttcaacctgaaccccaacctgatcctgagaggcggcatgaagttctacgagtgcaaggagtgcggcaagatcttcagatacaacagcaagctgatcagacaccagatgagccacaccggcgagaagcccttcaagtgcaaggagtgcggcaaggccttcaagagcagctacgactgcatcgtgcacgagaagaaccacatcggcgagggcccctacgagtgcaaggagtgcggcaagggcctgagcagcaacaccgccctgacccagcaccagagaatccacaccggcgagaagccctacgagtgcaaggagtgcggcaaggccttcagaagaagcgccgcctacctgcagcaccagagactgcacaccggcgagaagctgtacaagtgcaaggagtgctggaaggccttcggctgcagaagcctgttcatcgtgcaccagagaatccacaccggcgagaagccctaccagtgcaaggagtgcggcaaggccttcacccagaagatcgccagcatccagcaccagagagtgcacaccggcgagaagccctacgagtgcaaggtgtgcggcaaggccttcaagtggtacggcagcttcgtgcagcaccagaagctgcaccccgtggagaagaagcccgtgaaggtgctgggccccagcctggtgagcccccagtgcagcagccccgccatcccccccgtgctgctgcagggcagctgcagcgccagcgccgtggccgtgcccagcctgaccttcccccacgccgtgctgatccccaccagcggcaacttcttcatgctgctgcccaccagcggcatccccagcagcagcgcccagatcgtgagagtgttccagggcctgacccccaccgtgaagcccagccccgtgatcctgacccccagcagccacagcagctag

SEQ ID NO: 10824 - DNA, 1320 bp, Artificial Sequence; identical to SEQ ID NO: 10823
  Description of Artificial Sequence: Synthetic coding sequence

SEQ ID NO: 10825 - DNA, 459 bp, Artificial Sequence
  Description of Artificial Sequence: Synthetic coding sequence
atgctgcagaccacctggccccaggagagcgtgaccttcgaggacgtggccgtgtacttcacccagaaccagtgggccagcctggaccccgcccagagagccctgtacggcgaggtgatgctggagaactacgccaacgtggccagcctggtggccttccccttccccaagcccgccctgatcagccacctggagagaggcgaggccccctggggccccgacccctgggacaccgagatcctgagaggcatcagccagggcggcgagagctggatcaagaacgagggcctggtgatcaagcaggaggccagcgaggagaccgagctgcacagaatgcccgtgggcggcctgctgagaaacgtgagccagcacttcgacttcaagagaaaggccctgaagcagaccttcaacctgaaccccaacctgatcctgagaggcggcatgaagttctacgagtag

SEQ ID NO: 10826 - DNA, 1425 bp, Artificial Sequence
  Description of Artificial Sequence: Synthetic coding sequence
atggagctgcccagccccgagagcgaggaggtgcacgagcccagactgggcgagctgctgggcaaccccgagggccagagcctgggcagcagccccagccaggacagaggctgcaagcaggtgaccgtgacccactggaagatccagaccggcgagaccgcccaggtgtgcaccaagagcggcagaaaccacatcctgaacagcgacctgctgctgctgcagagagagctgatcgagggcgaggccaacccctgcaacatctgcggcaagaccttcaccttcaacagcgacctggtgagacacagaatcagccacgccggcgagaagccctacacctgcgaccagtgcggcaagggcttcggccagagcagccacctgatggagcaccagagaatccacaccggcgagagactgtacgtgtgcaacgtgtgcggcaaggacttcatccactacagcggcctgatcgagcaccagagagtgcacagcggcgagaagcccttcaagtgcgcccagtgcggcaaggccttctgccacagcagcgacctgatcagacaccagagagtgcacaccagagagagacccttcgagtgcaaggagtgcggcaagggcttcagccagagcagcctgctgatcagacaccagagaatccacaccggcgagagaccctacgagtgcaacgagtgcggcaagagcttcatcagaagcagcagcctgatcagacactaccagatccacaccgaggtgaagcagtacgagtgcaaggagtgcggcaaggccttcagacacagaagcgacctgatcgagcaccagagaatccacaccggcgagagacccttcgagtgcaacgagtgcggcaaggccttcatcagaagcagcaagctgatccagcaccagagaatccacaccggcgagagaccctacgtgtgcaacgagtgcggcaagagattcagccagaccagcaacttcacccagcaccagagaatccacaccggcgagaagctgtacgagtgcaacgagtgcggcaaggccttcttcctgagcagctacctgatcagacaccagaagatccacaccggcgagagagtgtacgagtgcaaggagtgcggcaaggccttcctgcagaaggcccacctgaccgagcaccagaagatccacagcggcgacagacccttcgagtgcaaggactgcggcaaggccttcatccagagcagcaagctgctgctgcaccagatcatccacaccggcgagaagccctacgtgtgcagctactgcggcaaggccctgttcagaggccagaccagcttcaacaccagaaagttcatcctgaagagaagcagcatgaacgtggtgagcatgggcgagatcctgacccagctgcagaccctgaagatcatcaagggcttcaccaagagagacagcccctag

SEQ ID NO: 10827 - DNA, 1491 bp, Artificial Sequence
  Description of Artificial Sequence: Synthetic coding sequence
atggagctgcccagccccgagagcgaggaggtgcacgagcccagactgggcgagctgctgggcaaccccgagggccagagcctgggcagcagccccagccaggacagaggctgcaagcaggtgaccgtgacccactggaagatccagaccggcgagaccgcccaggtgtgcaccaagagcggcagaaaccacatcctgaacagcgacctgctgctgctgcagagagagctgatcgagggcgaggccaacccctgcaacatctgcggcaagaccttcaccttcaacagcgacctggtgagacacagaatcagccacgccggcgagaagccctacacctgcgaccagtgcggcaagggcttcggccagagcagccacctgatggagcaccagagaatccacaccggcgagagactgtacgtgtgcaacgtgtgcggcaaggacttcatccactacagcggcctgatcgagcaccagagagtgcacagcggcgagaagcccttcaagtgcgcccagtgcggcaaggccttctgccacagcagcgacctgatcagacaccagagagtgcacaccagagagagacccttcgagtgcaaggagtgcggcaagggcttcagccagagcagcctgctgatcagacaccagagaatccacaccggcgagagaccctacgagtgcaacgagtgcggcaagagcttcatcagaagcagcagcctgatcagacactaccagatccacaccgaggtgaagcagtacgagtgcaaggagtgcggcaaggccttcagacacagaagcgacctgatcgagcaccagagaatccacaccggcgagagacccttcgagtgcaacgagtgcggcaaggccttcatcagaagcagcaagctgatccagcaccagagaatccacaccggcgagagaccctacgtgtgcaacgagtgcggcaagagattcagccagaccagcaacttcacccagcaccagagaatccacaccggcgagaagctgtacgagtgcaacgagtgcggcaaggccttcttcctgagcagctacctgatcagacaccagaagatccacaccggcgagagagtgtacgagtgcaaggagtgcggcaaggccttcctgcagaaggcccacctgaccgagcaccagaagatccacagcggcgacagacccttcgagtgcaaggactgcggcaaggccttcatccagagcagcaagctgctgctgcaccagatcatccacaccggcgagaagccctacgtgtgcagctactgcggcaagggcttcatccagagaagcaacttcctgcagcaccagaagatccacaccgaggagaagctgtacgagtgcagccagtacggcagagacttcaacagcaccaccaacgtgaagaacaaccagagagtgcaccaggagggcctgagcctgagcaaggcccccatccacctgggcgagagaagcgtggacaagggcgagcacaccggcaacctgtag

SEQ ID NO: 10828 - DNA, 1611 bp, Artificial Sequence
  Description of Artificial Sequence: Synthetic coding sequence
atgatcctgctgagcttcgtgagcgacagcaacgtgggcaccggcgagaagaaggtgaccgaggcctggatcagcgaggacgagaacagccacagaaccaccagcgacagactgaccgtgatggagctgcccagccccgagagcgaggaggtgcacgagcccagactgggcgagctgctgggcaaccccgagggccagagcctgggcagcagccccagccaggacagaggctgcaagcaggtgaccgtgacccactggaagatccagaccggcgagaccgcccaggtgtgcaccaagagcggcagaaaccacatcctgaacagcgacctgctgctgctgcagagagagctgatcgagggcgaggccaacccctgcaacatctgcggcaagaccttcaccttcaacagcgacctggtgagacacagaatcagccacgccggcgagaagccctacacctgcgaccagtgcggcaagggcttcggccagagcagccacctgatggagcaccagagaatccacaccggcgagagactgtacgtgtgcaacgtgtgcggcaaggacttcatccactacagcggcctgatcgagcaccagagagtgcacagcggcgagaagcccttcaagtgcgcccagtgcggcaaggccttctgccacagcagcgacctgatcagacaccagagagtgcacaccagagagagacccttcgagtgcaaggagtgcggcaagggcttcagccagagcagcctgctgatcagacaccagagaatccacaccggcgagagaccctacgagtgcaacgagtgcggcaagagcttcatcagaagcagcagcctgatcagacactaccagatccacaccgaggtgaagcagtacgagtgcaaggagtgcggcaaggccttcagacacagaagcgacctgatcgagcaccagagaatccacaccggcgagagacccttcgagtgcaacgagtgcggcaaggccttcatcagaagcagcaagctgatccagcaccagagaatccacaccggcgagagaccctacgtgtgcaacgagtgcggcaagagattcagccagaccagcaacttcacccagcaccagagaatccacaccggcgagaagctgtacgagtgcaacgagtgcggcaaggccttcttcctgagcagctacctgatcagacaccagaagatccacaccggcgagagagtgtacgagtgcaaggagtgcggcaaggccttcctgcagaaggcccacctgaccgagcaccagaagatccacagcggcgacagacccttcgagtgcaaggactgcggcaaggccttcatccagagcagcaagctgctgctgcaccagatcatccacaccggcgagaagccctacgtgtgcagctactgcggcaagggcttcatccagagaagcaacttcctgcagcaccagaagatccacaccgaggagaagctgtacgagtgcagccagtacggcagagacttcaacagcaccaccaacgtgaagaacaaccagagagtgcaccaggagggcctgagcctgagcaaggcccccatccacctgggcgagagaagcgtggacaagggcgagcacaccggcaacctgtag

SEQ ID NO: 10829 - DNA, 1491 bp, Artificial Sequence; identical to SEQ ID NO: 10827
  Description of Artificial Sequence: Synthetic coding sequence

SEQ ID NO: 10830 - DNA, 1611 bp, Artificial Sequence; identical to SEQ ID NO: 10828
  Description of Artificial Sequence: Synthetic coding sequence

SEQ ID NO: 10831 - DNA, 2598 bp, Artificial Sequence
  Description of Artificial Sequence: Synthetic coding sequence
atgagcctgcaggacagcaccctgagcagagagggcaagcccgagggcgagatcatggccgccgtgttcttcagcgtgggcagactgagccccgaggtgacccagcccgacgaggacctgcacctgcaggccgaggagacccagctggtgaaggagagcgtgaccttcaaggacgtggccatcgacttcaccctggaggagtggagactgatggaccccacccagagaaacctgcacaaggacgtgatgctggagaactacagaaacctggtgagcctgggcctggccgtgagcaagcccgacatgatcagccacctggagaacggcaagggcccctgggtgaccgtgagagagatcagcagaatcccctaccccgacatggagcccaagcccgccaccaagaaggccaccagaaccaaggccatcagcgaggacctgagccaggaggccatcctggagaagctgaccgagaacggcctgtgggacagcagaatggagggcctgtggaagtggaacgacagaatcctgagactgcagaacaaccaggagaaccacctgagccagagaatcatccccctgaagaagacccccaccagccagagaggcttcagattcgagagcatcctgatccccgagcccggcatcgccaccgaggagctgcacagcagatgccagacccaggaggagaacttcaccgagaacctgaacctgatcaccgacacccacctgggcaagatcatctgcaaggagatgaagggcagcaaggccatcagacagaccagcgagctgaccctgggcaagaagagcaacaacaaggagaagccctacaagtgcagcacctgcgagaaggccttccactacagaagcctgctgatccagcaccagagaacccacaccaaggagaagccctacgagtgcaacgagtgcggcaagaccttcagccagcccagctacctgagccagcacaagaagatccacaccggcgagaagccctacaagtgcaacgagtgcggcaaggccttcatcgccagcagcagcctgatggtgcaccagagaatccacaccaaggagaagccctaccagtgcaacgtgtgcggcaagagcttcagccagtgcgccagactgaaccagcaccagagaatccagaccggcgagaagccctacaagtgcagcgagtgcggcaaggccttcagcgacaagagcaagctggccagacaccaggagacccacaacggcgagaagccctacaagtgcgacgactgcggcaaggccttcagaaacaagagctacctgagcgtgcaccagaagacccacaccgaggagaagccctaccagtgcaacgagtgcggcaagagcttcaagaacaccaccatcttcaacgtgcaccagagaatccacaccggcgagaagcccttcagatgcaacgagtgcggcaaggcctacagaagcaacagcagcctgatcgtgcacatcagaacccacaccggcgagaagccctacgagtgcaacgagtgcggcaaggccttcaacagaatcgccaacttcaccgagcaccagagaatccacaccggcgagaagccctacaagtgcaacgagtgcggcaaggccttcatcaactacagctgcctgaccgtgcaccacagaatgcacaccggcgagaagccctacaagtgcaccgagtgcggcaaggccttcatgagaagcagcagcctgatcatccaccagagaatccacaccgaggagaagccctacctgtgcaacgagtgcggcgagagcttcagaatcaagagccacctgaccgtgcaccagagaatccacaccggcgagaagccctacaagtgcaccgactgcgagagagccttcaccaagatggtgaacctgaaggagcaccagaagatccacaccggcgtgaagccctacaagtgctacgactgcggcaagagcttcagaaccaagagctacctgatcgtgcaccagagaacccacaccggcgagaagccctacaagtgcaacgagtgcgagaaggccttcaccaacaccagccagctgaccgtgcaccagagaagacacaccggcgagaagccctacaagtgcaacgagtgcggcaaggtgttcaccagcaacagcggcttcaacacccaccagagaacccacaccggcgagaagcccttcaagtgcaacgactgcggcaaggccttcagccagatggtgcacgtgaccgagcaccagaagatccacagcggcgagaagccctacaagtgcgacgtgtgcggcaaggccttcagaagaggcagctacctgaccgtgcactggagaacccacaccggcgagaagccctacacctgcaaggagtgcggcaagggctgcatcaccctgagccagctgaccctgcaccagagaatccacaccggcgagagaccctacaagtgcgaggagtgcggcaaggccttcagaaccaacagcgacttcaccgtgcacctgagaatgcacaccggcgagaagccctacaagtgcaacgagtgcggcaaggccttcagaagcagcagcagcctgaccgtgcaccagagaatccaccagagagagacccagctgatctag

SEQ ID NO: 10832 - DNA, 336 bp, Artificial Sequence
  Description of Artificial Sequence: Synthetic coding sequence
atgagcctgcaggacagcaccctgagcagagagggcaagcccgagggcgagatcatggccgccgtgttcttcagcgtgggcagactgagccccgaggtgacccagcccgacgaggacctgcacctgcaggccgaggagacccagctggtgaaggagagcgtgaccttcaaggacgtggccatcgacttcaccctggaggagtggagactgatggaccccacccagagaaacctgcacaaggacgtgatgctggagaactacagaaacctggtgagcctgggcctggccgtgagcaagcccgacatgatcagccacctggagaacggcaagggctag

SEQ ID NO: 10833 - DNA, 921 bp, Artificial Sequence
  Description of Artificial Sequence: Synthetic coding sequence
atgggcgagagactgctggagagcaagaaggaccaccagcacggcgagatcctgacccaggtgcccgacgacatgctgaagaagaagacccccagagtgaagagctgcggcgaggtgagcgtgggccacgccagcctgaacagacaccacagagccgacaccggccacaagccctacgagtaccaggagtacggccagaagccctacaagtgcacctactgcaagaaggccttcagcgacctgccctacttcagaacccacgagtgggcccacaccggcggcaagccctacgactgcgaggagtgcggcaagagcttcatcagcagaagcagcatcagaagacacagaatcatgcacagcggcgacggcccctacaagtgcaacttctgcggcaaggccctgatgtgcctgagcctgtacctgatccacaagagaacccacaccggcgagaagccctacgagtgcaagcagtgcggcaaggccttcagccacagcggcagcctgagaatccacgagagaacccacaccggcgagaagccctacgagtgcagcgagtgcggcaaggccttccacagcagcacctgcctgcacgcccacaagatcacccacaccggcgagaagccctacgagtgcaagcagtgcggcaaggccttcgtgagcttcaacagcgtgagataccacgagagaacccacaccggcgagaagccctacgagtgcaagcagtgcggcaaggccttcagaagcgccagccacctgagaacccacggcagaacccacaccggcgagaagccctacgagtgcaagcagtgcggcaaggccttcggctgcgccagcagcgtgaagatccacgagagaacccacaccggcgagaagccctgcagcagcaacaccagcaagggccagggcgagaagatcgcctag

SEQ ID NO: 10834 - DNA, 1119 bp, Artificial Sequence
  Description of Artificial Sequence: Synthetic coding sequence
atggacagcgtggtgttcgaggacgtggacgtgaacttcacccaggaggagtgggccctgctggaccccagccagaagaacctgtacagagacgtgatgcaggagaccttcagaaacctggccagcgtgggcaagaagtggaaggaccagaagatcgaggacgagtacaagaaccccagaagaaacctgagaggcctgatgggcgagagactgctggagagcaagaaggaccaccagcacggcgagatcctgacccaggtgcccgacgacatgctgaagaagaagacccccagagtgaagagctgcggcgaggtgagcgtgggccacgccagcctgaacagacaccacagagccgacaccggccacaagccctacgagtaccaggagtacggccagaagccctacaagtgcacctactgcaagaaggccttcagcgacctgccctacttcagaacccacgagtgggcccacaccggcggcaagccctacgactgcgaggagtgcggcaagagcttcatcagcagaagcagcatcagaagacacagaatcatgcacagcggcgacggcccctacaagtgcaacttctgcggcaaggccctgatgtgcctgagcctgtacctgatccacaagagaacccacaccggcgagaagccctacgagtgcaagcagtgcggcaaggccttcagccacagcggcagcctgagaatccacgagagaacccacaccggcgagaagccctacgagtgcagcgagtgcggcaaggccttccacagcagcacctgcctgcacgcccacaagatcacccacaccggcgagaagccctacgagtgcaagcagtgcggcaaggccttcgtgagcttcaacagcgtgagataccacgagagaacccacaccggcgagaagccctacgagtgcaagcagtgcggcaaggccttcagaagcgccagccacctgagaacccacggcagaacccacaccggcgagaagccctacgagtgcaagcagtgcggcaaggccttcggctgcgccagcagcgtgaagatccacgagagaacccacaccggcgagaagccctgcagcagcaacaccagcaagggccagggcgagaagatcgcctag

SEQ ID NO: 10835 - DNA, 921 bp, Artificial Sequence; identical to SEQ ID NO: 10833
  Description of Artificial Sequence: Synthetic coding sequence

SEQ ID NO: 10836 - DNA, 279 bp, Artificial Sequence
  Description of Artificial Sequence: Synthetic coding sequence
atgggccccctgcagttcagagacgtggccatcgagttcagcctggaggagtggcactgcctggacaccgcccagagaaacctgtacagaaacgtgatgctggagaactacagcaacctggtgttcctgggcatcaccgtgagcaagcccgacctgatcacctgcctggagcagggcagaaagcccctgaccatgaagagaaacgagatgatcgccaagcccagcgtgagcttcctgcaggtgcacagcgagagccagagccccctgcacgacatctag

SEQ ID NO: 10837 - DNA, 1623 bp, Artificial Sequence
  Description of Artificial Sequence: Synthetic coding sequence
atgggccccctgcagttcagagacgtggccatcgagttcagcctggaggagtggcactgcctggacaccgcccagagaaacctgtacagaaacgtgatgctggagaactacagcaacctggtgttcctgggcatcaccgtgagcaagcccgacctgatcacctgcctggagcagggcagaaagcccctgaccatgaagagaaacgagatgatcgccaagcccagcgtgatgtgcagccacttcgcccaggacctgtggcccgagcagagcatgaaggacagcttccagaaggtggtgctgagaagatacgagaagtgcgagcacgacaacctgcagctgaagaagggctgcatcagcgtggacgagtgcaaggtgcacaaggagggctacaacgagctgaaccagtgcctgaccaccacccccagaaagatctgccagtgcgacaagtacgtgaaggtgctgcaccagttccccaacagcaacggccagaagagaggccacaccggcaagaagcccttcaagtacatcgagtgcggcaaggccttcaagcagttcagcaccctgaccacccacaagaagatccacaccggcggcaagccctacaagtgcgaggagtgcggcaaggccttcaaccacagctgcagcctgaccagacacaagaagatccacaccggcgagaagccctacaagtgcgaggagtgcggcaaggccttcaagcacagcagcaccctgaccacccacaagagaaaccacaccggcgagaagccctacaagtgcgacaagtgcggcaaggccttcatgagcagcagcaccctgagcaagcacgagatcatccacaccgagaagaagccctacaagtgcgaggagtgcggcaaggccttcaacagaagcagcaccctgaccacccacaagatcatccacaccggcgagaagccctacaagtgcgaggagtgcgacaaggccttcaagtacagctacaccctgaccacccacaagagaatccacaccgaggacaagccctacaagtgcgaggagtgcggcaaggccttcaagtacagcagcaccctgaccacccacaagagaatccacaccggcgagaagccctacaagtgcgaggagtgcggcaaggccttcaagagaagcagcgacctgaccacccacaagatcatccacaccggcgagaagccctacaagtgcgaggagtgcggcaaggccttcaagtacagcagcaacctgaccacccacaagaagatccacaccggcgagagaccctacaagtgcgaggagtgcggcaaggccttcaaccagagcagcatcctgaccacccacagaagaatccacaccggcgagaagttctacaagtgcgaggagtgcggcaaggccttcaagagaagcagccacctgaccacccacaagatcatccacaccggcgagaagttctacaagtgcgaggagtgcgacaaggccttcaagcacttcagcaacctgaccacccacaagaagatccacaccggcaagaagccctacagatgcgaggagtgcggcaaggccttcaagcacagcagcaagctgaccacccacaagagattccacaccggcgagaagccctacagatgcgagtag

SEQ ID NO: 10838 - DNA, 1587 bp, Artificial Sequence
  Description of Artificial Sequence: Synthetic coding sequence
atgggccccctgcagttcagagacgtggccatcgagttcagcctggaggagtggcactgcctggacaccgcccagagaaacctgtacagaaacgtgatgctggagaactacagcaacctggtgttcctgggcatcaccgtgagcaagcccgacctgatcacctgcctggagcagggcagaaagcccctgaccatgaagagaaacgagatgatcgccaagcccagcgtgatgtgcagccacttcgcccaggacctgtggcccgagcagagcatgaaggacagcttccagaaggtggtgctgagaagatacgagaagtgcgagcacgacaacctgcagctgaagaagggctgcatcagcgtggacgagtgcaaggtgcacaaggagggctacaacgagctgaaccagtgcctgaccaccacccccagaaagatctgccagtgcgacaagtacgtgaaggtgctgcaccagttccccaacagcaacggccagaagagaggccacaccggcaagaagcccttcaagtacatcgagtgcggcaaggccttcaagcagttcagcaccctgaccacccacaagaagatccacaccggcggcaagccctacaagtgcgaggagtgcggcaaggccttcaaccacagctgcagcctgaccagacacaagaagatccacaccggcgagaagccctacaagtgcgaggagtgcggcaaggccttcaagcacagcagcaccctgaccacccacaagagaaaccacaccggcgagaagccctacaagtgcgacaagtgcggcaaggccttcatgagcagcagcaccctgagcaagcacgagatcatccacaccgagaagaagccctacaagtgcgaggagtgcggcaaggccttcaacagaagcagcaccctgaccacccacaagatcatccacaccggcgagaagccctacaagtgcgaggagtgcgacaaggccttcaagtacagctacaccctgaccacccacaagagaatccacaccgaggacaagccctacaagtgcgaggagtgcggcaaggccttcaagtacagcagcaccctgaccacccacaagagaatccacaccggcgagaagccctacaagtgcgaggagtgcggcaaggccttcaagagaagcagcgacctgaccacccacaagatcatccacaccggcgagaagccctacaagtgcgaggagtgcggcaaggccttcaagtacagcagcaacctgaccacccacaagaagatccacaccggcgagagaccctacaagtgcgaggagtgcggcaaggccttcaaccagagcagcatcctgaccacccacagaagaatccacaccggcgagaagttctacaagtgcgaggagtgcggcaaggccttcaagtgcagcagcaacctgaccacccacaagaagatccacaccggcgagagaccctacaagtgcgaggagtgcggcaaggccttcaaccagagcagcatcctgaccacccacgagagaatcatcctggagagaaacagcaccaacgtgaagaacgtggccaagcccagcagcggcccccacaccctgctgcacatcagatag

SEQ ID NO: 10839 - DNA, 1359 bp, Artificial Sequence
  Description of Artificial Sequence: Synthetic coding sequence
atgtgcagccacttcgcccaggacctgtggcccgagcagagcatgaaggacagcttccagaaggtggtgctgagaagatacgagaagtgcgagcacgacaacctgcagctgaagaagggctgcatcagcgtggacgagtgcaaggtgcacaaggagggctacaacgagctgaaccagtgcctgaccaccacccccagaaagatctgccagtgcgacaagtacgtgaaggtgctgcaccagttccccaacagcaacggccagaagagaggccacaccggcaagaagcccttcaagtacatcgagtgcggcaaggccttcaagcagttcagcaccctgaccacccacaagaagatccacaccggcggcaagccctacaagtgcgaggagtgcggcaaggccttcaaccacagctgcagcctgaccagacacaagaagatccacaccggcgagaagccctacaagtgcgaggagtgcggcaaggccttcaagcacagcagcaccctgaccacccacaagagaaaccacaccggcgagaagccctacaagtgcgacaagtgcggcaaggccttcatgagcagcagcaccctgagcaagcacgagatcatccacaccgagaagaagccctacaagtgcgaggagtgcggcaaggccttcaacagaagcagcaccctgaccacccacaagatcatccacaccggcgagaagccctacaagtgcgaggagtgcgacaaggccttcaagtacagctacaccctgaccacccacaagagaatccacaccgaggacaagccctacaagtgcgaggagtgcggcaaggccttcaagtacagcagcaccctgaccacccacaagagaatccacaccggcgagaagccctacaagtgcgaggagtgcggcaaggccttcaagagaagcagcgacctgaccacccacaagatcatccacaccggcgagaagccctacaagtgcgaggagtgcggcaaggccttcaagtacagcagcaacctgaccacccacaagaagatccacaccggcgagagaccctacaagtgcgaggagtgcggcaaggccttcaaccagagcagcatcctgaccacccacagaagaatccacaccggcgagaagttctacaagtgcgaggagtgcggcaaggccttcaagtgcagcagcaacctgaccacccacaagaagatccacaccggcgagagaccctacaagtgcgaggagtgcggcaaggccttcaaccagagcagcatcctgaccacccacgagagaatcatcctggagagaaacagcaccaacgtgaagaacgtggccaagcccagcagcggcccccacaccctgctgcacatcagatag

SEQ ID NO: 10840 - DNA, 1587 bp, Artificial Sequence; identical to SEQ ID NO: 10838
  Description of Artificial Sequence: Synthetic coding sequence

SEQ ID NO: 10841 - DNA, 2610 bp, Artificial Sequence
  Description of Artificial Sequence: Synthetic coding sequence
atggagcccgagaccgccctgtggggccccgacctgcagggccccgagcagagccccaacgacgcccacagaggcgccgagagcgagaacgaggaggagagccccagacaggagagcagcggcgaggagatcatcatgggcgaccccgcccagagccccgagagcaaggacagcaccgagatgagcctggagagaagcagccaggaccccagcgtgccccagaacccccccacccccctgggccacagcaaccccctggaccaccagatccccctggacccccccgcccccgaggtggtgcccacccccagcgactggaccaaggcctgcgaggccagctggcagtggggcgccctgaccacctggaacagcccccccgtggtgcccgccaacgagcccagcctgagagagctggtgcagggcagacccgccggcgccgagaagccctacatctgcaacgagtgcggcaagagcttcagccagtggagcaagctgctgagacaccagagaatccacaccggcgagagacccaacacctgcagcgagtgcggcaagagcttcacccagagcagccacctggtgcagcaccagagaacccacaccggcgagaagccctacaagtgccccgactgcggcaagtgcttcagctggagcagcaacctggtgcagcaccagagaacccacaccggcgagaagccctacaagtgcaccgagtgcgagaaggccttcacccagagcaccaacctgatcaagcaccagagaagccacaccggcgagaagccctacaagtgcggcgagtgcagaagagccttctacagaagcagcgacctgatccagcaccaggccacccacaccggcgagaagccctacaagtgccccgagtgcggcaagagattcggccagaaccacaacctgctgaagcaccagaagatccacgccggcgagaagccctacagatgcaccgagtgcggcaagagcttcatccagagcagcgagctgacccagcaccagagaacccacaccggcgagaagccctacgagtgcctggagtgcggcaagagcttcggccacagcagcaccctgatcaagcaccagagaacccacctgagagaggaccccttcaagtgccccgtgtgcggcaagaccttcaccctgagcgccaccctgctgagacaccagagaacccacaccggcgagagaccctacaagtgccccgagtgcggcaagagcttcagcgtgagcagcaacctgatcaaccaccagagaatccacagaggcgagagaccctacatctgcgccgactgcggcaagagcttcatcatgagcagcaccctgatcagacaccagagaatccacaccggcgagaagccctacaagtgcagcgactgcggcaagagcttcatcagaagcagccacctgatccagcacagaagaacccacaccggcgagaagccctacaagtgccccgagtgcggcaagagcttcagccagagcagcaacctgatcacccacgtgagaacccacatggacgagaacctgttcgtgtgcagcgactgcggcaaggccttcctggaggcccacgagctggagcagcacagagtgatccacgagagaggcaagacccccgccagaagagcccagggcgacagcctgctgggcctgggcgaccccagcctgctgacccccccccccggcgccaagccccacaagtgcctggtgtgcggcaagggcttcaacgacgagggcatcttcatgcagcaccagagaatccacatcggcgagaacccctacaagaacgccgacggcctgatcgcccacgccgcccccaagcccccccagctgagaagccccagactgcccttcagaggcaacagctaccccggcgccgccgagggcagagccgaggcccccggccagcccctgaagccccccgagggccaggagggcttcagccagagaagaggcctgctgagcagcaagacctacatctgcagccactgcggcgagagcttcctggacagaagcgtgctgctgcagcaccagctgacccacggcaacgagaagcccttcctgttccccgactacagaatcggcctgggcgagggcgccggccccagccccttcctgagcggcaagcccttcaagtgccccgagtgcaagcagagcttcggcctgagcagcgagctgctgctgcaccagaaggtgcacgccggcggcaagagcagccagaagagccccgagctgggcaagagcagcagcgtgctgctggagcacctgagaagccccctgggcgccagaccctacagatgcagcgactgcagagccagcttcctggacagagtggccctgaccagacaccaggagacccacacccaggagaagccccccaaccccgaggaccccccccccgaggccgtgaccctgagcaccgaccaggagggcgagggcgagacccccacccccaccgagagcagcagccacggcgagggccagaaccccaagaccctggtggaggagaagccctacctgtgccccgagtgcggcgccggcttcaccgaggtggccgccctgctgctgcacagaagctgccaccccggcgtgagcctgtag

SEQ ID NO: 10842 - DNA, 1458 bp, Artificial Sequence
  Description of Artificial Sequence: Synthetic coding sequence
atgaacgagtaccccaagaagagaaagagaaagaccctgcaccccagcagatacagcgacagcagcggcatcagcagaatcgccgacggcttcaacggcatcttcagcgaccactgctacagcgtgtgcagcatgagacagcccgacctgaagtacttcgacaacaaggacgacgacagcgacaccgagaccagcaacgacctgcccaagttcgccgacggcatcaaggccagaaacagaaaccagaactacctggtgcccagccccgtgctgagaatcctggaccacaccgccttcagcaccgagaagagcgccgacatcgtgatctgcgacgaggagtgcgacagccccgagagcgtgaaccagcagacccaggaggagagccccatcgaggtgcacaccgccgaggacgtgcccatcgccgtggaggtgcacgccatcagcgaggactacgacatcgagaccgagaacaacagcagcgagagcctgcaggaccagaccgacgaggagccccccgccaagctgtgcaagatcctggacaagagccaggccctgaacgtgaccgcccagcagaagtggcccctgctgagagccaacagcagcggcctgtacaagtgcgagctgtgcgagttcaacagcaagtacttcagcgacctgaagcagcacatgatcctgaagcacaagagaaccgacagcaacgtgtgcagagtgtgcaaggagagcttcagcaccaacatgctgctgatcgagcacgccaagctgcacgaggaggacccctacatctgcaagtactgcgactacaagaccgtgatcttcgagaacctgagccagcacatcgccgacacccacttcagcgaccacctgtactggtgcgagcagtgcgacgtgcagttcagcagcagcagcgagctgtacctgcacttccaggagcacagctgcgacgagcagtacctgtgccagttctgcgagcacgagaccaacgaccccgaggacctgcacagccacgtggtgaacgagcacgcctgcaagctgatcgagctgagcgacaagtacaacaacggcgagcacggccagtacagcctgctgagcaagatcaccttcgacaagtgcaagaacttcttcgtgtgccaggtgtgcggcttcagaagcagactgcacaccaacgtgaacagacacgtggccatcgagcacaccaagatcttcccccacgtgtgcgacgactgcggcaagggcttcagcagcatgctggagtactgcaagcacctgaacagccacctgagcgagggcatctacctgtgccagtactgcgagtacagcaccggccagatcgaggacctgaagatccacctggacttcaagcacagcgccgacctgccccacaagtgcagcgactgcctgatgagattcggcaacgagagagagctgatcagccacctgcccgtgcacgagaccacctag

SEQ ID NO: 10843 - DNA, 867 bp, Artificial Sequence
  Description of Artificial Sequence: Synthetic coding sequence
atgaacgagtaccccaagaagagaaagagaaagaccctgcaccccagcagatacagcgacagcagcggcatcagcagaatcgccgacggcttcaacggcatcttcagcgaccactgctacagcgtgtgcagcatgagacagcccgacctgaagtacttcgacaacaaggacgacgacagcgacaccgagaccagcaacgacctgcccaagttcgccgacggcatcaaggccagaaacagaaaccagaactacctggtgcccagccccgtgctgagaatcctggaccacaccgccttcagcaccgagaagagcgccgacatcgtgatctgcgacgaggagtgcgacagccccgagagcgtgaaccagcagacccaggaggagagccccatcgaggtgcacaccgccgaggacgtgcccatcgccgtggaggtgcacgccatcagcgaggactacgacatcgagaccgagaacaacagcagcgagagcctgcaggaccagaccgacgaggagccccccgccaagctgtgcaagatcctggacaagagccaggccctgaacgtgaccgcccagcagaagtggcccctgctgagagccaacagcagcggcctgtacaagtgcgagctgtgcgagttcaacagcaagtacttcagcgacctgaagcagcacatgatcctgaagcacaagagaaccgacagcaacgtgtgcagagtgtgcaaggagagcttcagcaccaacatgctgctgatcgagcacgccaagctgcacgaggaggacccctacatctgcaagtactgcgactacaagaccgtgatcttcgagaacctgagccagcacatcgccgacacccacttcagcgaccacctgtag

SEQ ID NO: 10844 - DNA, 414 bp, Artificial Sequence
  Description of Artificial Sequence: Synthetic coding sequence
atgaacgagtaccccaagaagagaaagagaaagaccctgcaccccagcagatacagcgacagcagcggcatcagcagaatcgccgacggcttcaacggcatcttcagcgaccactgctacagcgtgtgcagcatgagacagcccgacctgaagtacttcgacaacaaggacgacgacagcgacaccgagaccagcaacgacctgcccaagttcgccgacggcatcaaggccagaaacagaaaccagaactacctggtgcccagccccgtgctgagaatcctggaccacaccgccttcagcaccgagaagagcgccgacatcgtgatctgcgacgaggagtgcgacagccccgagagcgtgaaccagcagacccaggaggagagccccatcgaggtgcacaccgccgaggactag

SEQ ID NO: 10845 - DNA, 1458 bp, Artificial Sequence; identical to SEQ ID NO: 10842
  Description of Artificial Sequence: Synthetic coding sequence

SEQ ID NO: 10846 - DNA, 651 bp, Artificial Sequence
  Description of Artificial Sequence: Synthetic coding sequence
atgaacgagtaccccaagaagagaaagagaaagaccctgcaccccagcagatacagcgacagcagcggcatcagcagaatcgccgacggcttcaacggcatcttcagcgaccactgctacagcgtgtgcagcatgagacagcccgacctgaagtacttcgacaacaaggacgacgacagcgacaccgagaccagcaacgacctgcccaagttcgccgacggcatcaaggccagaaacagaaaccagaactacctggtgcccagccccgtgctgagaatcctggaccacaccgccttcagcaccgagaagagcgccgacatcgtgatctgcgacgaggagtgcgacagccccgagagcgtgaaccagcagacccaggaggagagccccatcgaggtgcacaccgccgaggacgtgcccatcgccgtggaggtgcacgccatcagcgaggactacgacatcgagaccgagaacaacagcagcgagagcctgcaggaccagaccgacgaggagccccccgccaagctgtgcaagatcctggacaagagccaggccctgaacgtgaccgcccagcagaagtggcccctgctgagagccaacagcagcggcctgtacaagtgcgagctgtgcgagttcaacagcaagtacttctag

SEQ ID NO: 10847 - DNA, 393 bp, Artificial Sequence
  Description of Artificial Sequence: Synthetic coding sequence
atgaacgagtaccccaagaagagaaagagaaagaccctgcaccccagcagatacagcgacagcagcggcatcagcagaatcgccgacggcttcaacggcatcttcagcgaccactgctacagcgtgtgcagcatgagacagcccgacctgaagtacttcgacaacaaggacgacgacagcgacaccgagaccagcaacgacctgcccaagttcgccgacggcatcaaggccagaaacagaaaccagaactacctggtgcccagccccgtgctgagaatcctggaccacaccgccttcagcaccgagaagagcgccgacatcgtgatctgcgacgaggagtgcgacagccccgagagcgtgaaccagcagacccaggaggagagccccatctag

SEQ ID NO: 10848 - DNA, 1458 bp, Artificial Sequence; identical to SEQ ID NO: 10842
  Description of Artificial Sequence: Synthetic coding sequence

SEQ ID NO: 10849 - DNA, 1113 bp, Artificial Sequence
  Description of Artificial Sequence: Synthetic coding sequence
atggccgccgagagacaggaggccctgagagagttcgtggccgtgaccggcgccgaggaggacagagccagattcttcctggagagcgccggctgggacctgcagatcgccctggccagcttctacgaggacggcggcgacgaggacatcgtgaccatcagccaggccacccccagcagcgtgagcagaggcaccgcccccagcgacaacagagtgaccagcttcagagacctgatccacgaccaggacgaggacgaggaggaggaggagggccagagattctacgccggcggcagcgagagaagcggccagcagatcgtgggcccccccagaaagaagagccccaacgagctggtggacgacctgttcaagggcgccaaggagcacggcgccgtggccgtggagagagtgaccaagagccccggcgagaccagcaagcccagacccttcgccggcggcggctacagactgggcgccgcccccgaggaggagagcgcctacgtggccggcgagaagagacagcacagcagccaggacgtgcacgtggtgctgaagctgtggaagagcggcttcagcctggacaacggcgagctgagaagctaccaggaccccagcaacgcccagttcctggagagcatcagaagaggcgaggtgcccgccgagctgagaagactggcccacggcggccaggtgaacctggacatggaggaccacagagacgaggacttcgtgaagcccaagggcgccttcaaggccttcaccggcgagggccagaagctgggcagcaccgccccccaggtgctgagcaccagcagccccgcccagcaggccgagaacgaggccaaggccagcagcagcatcctgatcgacgagagcgagcccaccaccaacatccagatcagactggccgacggcggcagactggtgcagaagttcaaccacagccacagaatcagcgacatcagactgttcatcgtggacgccagacccgccatggccgccaccagcttcatcctgatgaccaccttccccaacaaggagctggccgacgagagccagaccctgaaggaggccaacctgctgaacgccgtgatcgtgcagagactgacctag

SEQ ID NO: 10850 - DNA, 1884 bp, Artificial Sequence
  Description of Artificial Sequence: Synthetic coding sequence
atgaacgccagcagcgagggcgagagcttcgccggcagcgtgcagatccccggcggcaccaccgtgctggtggagctgacccccgacatccacatctgcggcatctgcaagcagcagttcaacaacctggacgccttcgtggcccacaagcagagcggctgccagctgaccggcaccagcgccgccgcccccagcaccgtgcagttcgtgagcgaggagaccgtgcccgccacccagacccagaccaccaccagaaccatcaccagcgagacccagaccatcaccggctgccagttcaagaccgcctacggcatgaaggacatggagagacacctgaagatccacaccggcgacaagccccacaagtgcgaggtgtgcggcaagtgcttcagcagaaaggacaagctgaagacccacatgagatgccacaccggcgtgaagccctacaagtgcaagacctgcgactacgccgccgccgacagcagcagcctgaacaagcacctgagaatccacagcgacgagagacccttcaagtgccagatctgcccctacgccagcagaaacagcagccagctgaccgtgcacctgagaagccacaccggcgacgcccccttccagtgctggctgtgcagcgccaagttcaagatcagcagcgacctgaagagacacatgagagtgcacagcggcgagaagcccttcaagtgcgagttctgcaacgtgagatgcaccatgaagggcaacctgaagagccacatcagaatcaagcacagcggcaacaacttcaagtgcccccactgcgacttcctgggcgacagcaaggccaccctgagaaagcacagcagagtgcaccagagcgagcaccccgagaagtgcagcgagtgcagctacagctgcagcagcaaggccgccctgagaatccacgagagaatccactgcaccgacagacccttcaagtgcaactactgcagcttcgacaccaagcagcccagcaacctgagcaagcacatgaagaagttccacggcgacatggtgaagaccgaggccctggagagaaaggacaccggcagacagagcagcagacaggtggccaagctggacgccaagaagagcttccactgcgacatctgcgacgccagcttcatgagagaggacagcctgagaagccacaagagacagcacagcgagtacagcgagagcaagaacagcgacgtgaccgtgctgcagttccagatcgaccccagcaagcagcccgccacccccctgaccgtgggccacctgcaggtgcccctgcagcccagccaggtgccccagttcagcgagggcagagtgaagatcatcgtgggccaccaggtgccccaggccaacaccatcgtgcaggccgccgccgccgccgtgaacatcgtgccccccgccctggtggcccagaaccccgaggagctgcccggcaacagcagactgcagatcctgagacaggtgagcctgatcgcccccccccagagcagcagatgccccagcgaggccggcgccatgacccagcccgccgtgctgctgaccacccacgagcagaccgacggcgccaccctgcaccagaccctgatccccaccgccagcggcggcccccaggagggcagcggcaaccagaccttcatcaccagcagcggcatcacctgcaccgacttcgagggcctgaacgccctgatccaggagggcaccgccgaggtgaccgtggtgagcgacggcggccagaacatcgccgtggccaccaccgccccccccgtgttcagcagcagcagccagcaggagctgcccaagcagacctacagcatcatccagggcgccgcccaccccgccctgctgtgccccgccgacagcatccccgactag

SEQ ID NO: 10851 - DNA, 1938 bp, Artificial Sequence
  Description of Artificial Sequence: Synthetic coding sequence
atgaacgccagcagcgagggcgagagcttcgccggcagcgtgcagatccccggcggcaccaccgtgctggtggagctgacccccgacatccacatctgcggcatctgcaagcagcagttcaacaacctggacgccttcgtggcccacaagcagagcggctgccagctgaccggcaccagcgccgccgcccccagcaccgtgcagttcgtgagcgaggagaccgtgcccgccacccagacccagaccaccaccagaaccatcaccagcgagacccagaccatcaccgtgagcgcccccgagttcgtgttcgagcacggctaccagacctacctgcccaccgagagcaacgagaaccagaccgccaccgtgatcagcctgcccgccaagagcagaaccaagaagcccaccaccccccccgcccagaagagactgaactgctgctaccccggctgccagttcaagaccgcctacggcatgaaggacatggagagacacctgaagatccacaccggcgacaagccccacaagtgcgaggtgtgcggcaagtgcttcagcagaaaggacaagctgaagacccacatgagatgccacaccggcgtgaagccctacaagtgcaagacctgcgactacgccgccgccgacagcagcagcctgaacaagcacctgagaatccacagcgacgagagacccttcaagtgccagatctgcccctacgccagcagaaacagcagccagctgaccgtgcacctgagaagccacaccgccagcgagctggacgacgacgtgcccaaggccaactgcctgagcaccgagagcaccgacacccccaaggcccccgtgatcaccctgcccagcgaggccagagagcagatggccaccctgggcgagagaaccttcaactgctgctaccccggctgccacttcaagaccgtgcacggcatgaaggacctggacagacacctgagaatccacaccggcgacaagccccacaagtgcgagttctgcgacaagtgcttcagcagaaaggacaacctgaccatgcacatgagatgccacaccagcgtgaagccccacaagtgccacctgtgcgactacgccgccgtggacagcagcagcctgaagaagcacctgagaatccacagcgacgagagaccctacaagtgccagctgtgcccctacgccagcagaaacagcagccagctgaccgtgcacctgagaagccacaccggcgacacccccttccagtgctggctgtgcagcgccaagttcaagatcagcagcgacctgaagagacacatgatcgtgcacagcggcgagaagcccttcaagtgcgagttctgcgacgtgagatgcaccatgaaggccaacctgaagagccacatcagaatcaagcacaccttcaagtgcctgcactgcgccttccagggcagagacagagccgacctgctggagcacagcagactgcaccaggccgaccaccccgagaagtgccccgagtgcagctacagctgcagcagcgccgccgccctgagagtgcacagcagagtgcactgcaaggacagacccttcaagtgcgacttctgcagcttcgacaccaagagacccagcagcctggccaagcacgtggacaaggtgcacagagacgaggccaagaccgagaacagagcccccctgggcaaggagggcctgagagagggcagcagccagcacgtggccaagatcgtgacccagagagccttcagatgcgagacctgcggcgccagcttcgtgagagacgacagcctgagatgccacaagaagcagcacagcgaccagagcgagaacaagaacagcgacctggtgaccttcccccccgagagcggcgccagcggccagctgagcaccctggtgagcgtgggccagctggaggcccccctggagcccagccaggacctgtag

SEQ ID NO: 10852 - DNA, 2040 bp, Artificial Sequence
  Description of Artificial Sequence: Synthetic coding sequence
atgaacgccagcagcgagggcgagagcttcgccggcagcgtgcagagcggcaccaccgtgctggtggagctgacccccgacatccacatctgcggcatctgcaagcagcagttcaacaacctggacgccttcgtggcccacaagcagagcggctgccagctgaccggcaccagcgccgccgcccccagcaccgtgcagttcgtgagcgaggagaccgtgcccgccacccagacccagaccaccaccagaaccatcaccagcgagacccagaccatcaccgtgagcgcccccgagttcgtgttcgagcacggctaccagacctacctgcccaccgagagcaacgagaaccagaccgccaccgtgatcagcctgcccgccaagagcagaaccaagaagcccaccaccccccccgcccagaagagactgaactgctgctaccccggctgccagttcaagaccgcctacggcatgaaggacatggagagacacctgaagatccacaccggcgacaagccccacaagtgcgaggtgtgcggcaagtgcttcagcagaaaggacaagctgaagacccacatgagatgccacaccggcgtgaagccctacaagtgcaagacctgcgactacgccgccgccgacagcagcagcctgaacaagcacctgagaatccacagcgacgagagacccttcaagtgccagatctgcccctacgccagcagaaacagcagccagctgaccgtgcacctgagaagccacaccggcgacgcccccttccagtgctggctgtgcagcgccaagttcaagatcagcagcgacctgaagagacacatgagagtgcacagcggcgagaagcccttcaagtgcgagttctgcaacgtgagatgcaccatgaagggcaacctgaagagccacatcagaatcaagcacagcggcaacaacttcaagtgcccccactgcgacttcctgggcgacagcaaggccaccctgagaaagcacagcagagtgcaccagagcgagcaccccgagaagtgcagcgagtgcagctacagctgcagcagcaaggccgccctgagaatccacgagagaatccactgcaccgacagacccttcaagtgcaactactgcagcttcgacaccaagcagcccagcaacctgagcaagcacatgaagaagttccacggcgacatggtgaagaccgaggccctggagagaaaggacaccggcagacagagcagcagacaggtggccaagctggacgccaagaagagcttccactgcgacatctgcgacgccagcttcatgagagaggacagcctgagaagccacaagagacagcacagcgagtacagcgagagcaagaacagcgacgtgaccgtgctgcagttccagatcgaccccagcaagcagcccgccacccccctgaccgtgggccacctgcaggtgcccctgcagcccagccaggtgccccagttcagcgagggcagagtgaagatcatcgtgggccaccaggtgccccaggccaacaccatcgtgcaggccgccgccgccgccgtgaacatcgtgccccccgccctggtggcccagaaccccgaggagctgcccggcaacagcagactgcagatcctgagacaggtgagcctgatcgcccccccccagagcagcagatgccccagcgaggccggcgccatgacccagcccgccgtgctgctgaccacccacgagcagaccgacggcgccaccctgcaccagaccctgatccccaccgccagcggcggcccccaggagggcagcggcaaccagaccttcatcaccagcagcggcatcacctgcaccgacttcgagggcctgaacgccctgatccaggagggcaccgccgaggtgaccgtggtgagcgacggcggccagaacatcgccgtggccaccaccgccccccccgtgttcagcagcagcagccagcaggagctgcccaagcagacctacagcatcatccagggcgccgcccaccccgccctgctgtgccccgccgacagcatccccgactag

SEQ ID NO: 10853 - DNA, 1932 bp, Artificial Sequence
  Description of Artificial Sequence: Synthetic coding sequence
atgaacgccagcagcgagggcgagagcttcgccggcagcgtgcagatccccggcggcaccaccgtgctggtggagctgacccccgacatccacatctgcggcatctgcaagcagcagttcaacaacctggacgccttcgtggcccacaagcagagcggctgccagctgaccggcaccagcgccgccgcccccagcaccgtgcagttcgtgagcgaggagaccgtgcccgccacccagacccagaccaccaccagaaccatcaccagcgagacccagaccatcaccgtgagcgcccccgagttcgtgttcgagcacggctaccagacctacctgcccaccgagagcaacgagaaccagaccgccaccgtgatcagcctgcccgccaagagcagaaccaagaagcccaccaccccccccgcccagaagagactgaactgctgctaccccggcaagggcagcatcatgagctacctgtgcagaggcctgggcagataccccagcgagatcatcagcgacgtgcagaagagctgcaagaactgcaccaagaagaacagccccaacgtgaccatcctgctgtacctgctgtgccacagcctgtacatctacaagctgctgcagtgcgtgttccccaagaaccagaacatcctgctgaacaaccacagaaccatcatcaagagcgacttcgtgatcaagtgccacttcatgagcttcatcagcagcaaccaggagcagctgagcatctacctgagcttcagactgtgcagcttcggcagaaaccacaagatgaccgtgtgcttcagcagaagcagccacatcttccccatcaccgtggtgctgaccctggtgacctggctgagaatgttcctgcccgtgttcagcatgctgaagctgagcttcttcttcctgggctgccagttcaagaccgcctacggcatgaaggacatggagagacacctgaagatccacaccggcgacaagccccacaagtgcgaggtgtgcggcaagtgcttcagcagaaaggacaagctgaagacccacatgagatgccacaccggcgtgaagccctacaagtgcaagacctgcgactacgccgccgccgacagcagcagcctgaacaagcacctgagaatccacagcgacgagagacccttcaagtgccagatctgcccctacgccagcagaaacagcagccagctgaccgtgcacctgagaagccacaccggcgacgcccccttccagtgctggctgtgcagcgccaagttcaagatcagcagcgacctgaagagacacatgagagtgcacagcggcgagaagcccttcaagtgcgagttctgcaacgtgagatgcaccatgaagggcaacctgaagagccacatcagaatcaagcacagcggcaacaacttcaagtgcccccactgcgacttcctgggcgacagcaaggccaccctgagaaagcacagcagagtgcaccagagcgagcaccccgagaagtgcagcgagtgcagctacagctgcagcagcaaggccgccctgagaatccacgagagaatccactgcaccgacagacccttcaagtgcaactactgcagcttcgacaccaagcagcccagcaacctgagcaagcacatgaagaagttccacggcgacatggtgaagaccgaggccctggagagaaaggacaccggcagacagagcagcagacaggtggccaagctggacgccaagaagagcttccactgcgacatctgcgacgccagcttcatgagagaggacagcctgagaagccacaagagacagcacagcgagtacagcgagagcaagaacagcgacgtgaccgtgctgcagttccagatcgaccccagcaagcagcccgccacccccctgaccgtgggccacctgcaggtgcccctgcagcccagccaggtgccctag

SEQ ID NO: 10854 - DNA, 1281 bp, Artificial Sequence
  Description of Artificial Sequence: Synthetic coding sequence
atgagcagaagaaagcaggccaagccccagcacctgaacagcgaggagcccagacccgccagaagagagtgcgccgaggtggccccccaggtggccggcgagcccgccagcgagctggacgacgacgtgcccaaggccaactgcctgagcaccgagagcaccgacacccccaaggcccccgtgatcaccctgcccagcgaggccagagagcagatggccaccctgggcgagagaaccttcaactgctgctaccccggctgccacttcaagaccgtgcacggcatgaaggacctggacagacacctgagaatccacaccggcgacaagccccacaagtgcgagttctgcgacaagtgcttcagcagaaaggacaacctgaccatgcacatgagatgccacaccagcgtgaagccccacaagtgccacctgtgcgactacgccgccgtggacagcagcagcctgaagaagcacctgagaatccacagcgacgagagaccctacaagtgccagctgtgcccctacgccagcagaaacagcagccagctgaccgtgcacctgagaagccacaccggcgacacccccttccagtgctggctgtgcagcgccaagttcaagatcagcagcgacctgaagagacacatgatcgtgcacagcggcgagaagcccttcaagtgcgagttctgcgacgtgagatgcaccatgaaggccaacctgaagagccacatcagaatcaagcacaccttcaagtgcctgcactgcgccttccagggcagagacagagccgacctgctggagcacagcagactgcaccaggccgaccaccccgagaagtgccccgagtgcagctacagctgcagcagcgccgccgccctgagagtgcacagcagagtgcactgcaaggacagacccttcaagtgcgacttctgcagcttcgacaccaagagacccagcagcctggccaagcacgtggacaaggtgcacagagacgaggccaagaccgagaacagagcccccctgggcaaggagggcctgagagagggcagcagccagcacgtggccaagatcgtgacccagagagccttcagatgcgagacctgcggcgccagcttcgtgagagacgacagcctgagatgccacaagaagcagcacagcgaccagagcgagaacaagaacagcgacctggtgaccttcccccccgagagcggcgccagcggccagctgagcaccctggtgagcgtgggccagctggaggcccccctggagcccagccaggacctgtag

SEQ ID NO: 10855 - DNA, 396 bp, Artificial Sequence
  Description of Artificial Sequence: Synthetic coding sequence
atgagaggccaccccagcctgagacccccctggcactgggccagcgccgccagactggagggcggcttcctgccctggggctacgtgagcaacgccctgagcagagagggcctgaccgaggagagaaccttcgagagaagacccgagggctgggagggcgccagctgcgccgccagcgagctggacgacgacgtgcccaaggccaactgcctgagcaccgagagcaccgacacccccaaggcccccgtgatcaccctgcccagcgaggccagagagcagatggccaccctgggcgagagaaccttcaactgctgctaccccggctgccacttcaagaccgtgcacggcatgaaggacctggacagacacctgagaatccacaccgccagctgctag

SEQ ID NO: 10856 - DNA, 666 bp, Artificial Sequence
  Description of Artificial Sequence: Synthetic coding sequence
atgagaggccaccccagcctgagacccccctggcactgggccagcgccgccagactggagggcggcttcctgccctggggctacgtgagcaacgccctgagcagagagggcctgaccgaggagagaaccttcgagagaagacccgagggctgggagggcgccagctgcgccgccagcgagctggacgacgacgtgcccaaggccaactgcctgagcaccgagagcaccgacacccccaaggcccccgtgatcaccctgcccagcgaggccagagagcagatggccaccctgggcgagagaaccttcaactgctgctaccccggctgccacttcaagaccgtgcacggcatgaaggacctggacagacacctgagaatccacaccggcgacaagccccacaagtgcgagttctgcgacaagtgcttcagcagaaaggacaacctgaccatgcacatgagatgccacaccagcgtgaagccccacaagtgccacctgtgcgactacgccgccgtggacagcagcagcctgaagaagcacctgagaatccacagcgacgagagaccctacaagtgccagctgtgcccctacgccagcagaaacagcagccagctgaccgtgcacctgagaagccacaccggcgacacccccttccagtgctggctgtag

SEQ ID NO: 10857 - DNA, 363 bp, Artificial Sequence
  Description of Artificial Sequence: Synthetic coding sequence
tgagagagaaccttcaactgctgctaccccggctgccacttcaagaccgtgcacggcatgaaggacctggacagacacctgagaatccacaccggcgacaagccccacaagtgcgagttctgcgacaagtgcttcagcagaaaggacaacctgaccatgcacatgagatgccacaccagcgtgaagccccacaagtgccacctgtgcgactacgccgccgtggacagcagcagcctgaagaagcacctgagaatccacagcgacgagagaccctacaagtgccagctgtgcccctacgccagcagaaacagcagccagctgaccgtgcacctgagaagccacaccggccccggccccggctag

SEQ ID NO: 10858 - DNA, 1572 bp, Artificial Sequence
  Description of Artificial Sequence: Synthetic coding sequence
atgaaggacatggagagacacctgaagatccacaccggcgacaagccccacaagtgcgaggtgtgcggcaagtgcttcagcagaaaggacaagctgaagacccacatgagatgccacaccggcgtgaagccctacaagtgcaagacctgcgactacgccgccgccgacagcagcagcctgaacaagcacctgagaatccacagcgacgagagacccttcaagtgccagatctgcccctacgccagcagaaacagcagccagctgaccgtgcacctgagaagccacaccggcgacgcccccttccagtgctggctgtgcagcgccaagttcaagatcagcagcgacctgaagagacacatgagagtgcacagcggcgagaagcccttcaagtgcgagttctgcaacgtgagatgcaccatgaagggcaacctgaagagccacatcagaatcaagcacagcggcaacaacttcaagtgcccccactgcgacttcctgggcgacagcaaggccaccctgagaaagcacagcagagtgcaccagagcgagcaccccgagaagtgcagcgagtgcagctacagctgcagcagcaaggccgccctgagaatccacgagagaatccactgcaccgacagacccttcaagtgcaactactgcagcttcgacaccaagcagcccagcaacctgagcaagcacatgaagaagttccacggcgacatggtgaagaccgaggccctggagagaaaggacaccggcagacagagcagcagacaggtggccaagctggacgccaagaagagcttccactgcgacatctgcgacgccagcttcatgagagaggacagcctgagaagccacaagagacagcacagcgagtacagcgagagcaagaacagcgacgtgaccgtgctgcagttccagatcgaccccagcaagcagcccgccacccccctgaccgtgggccacctgcaggtgcccctgcagcccagccaggtgccccagttcagcgagggcagagtgaagatcatcgtgggccaccaggtgccccaggccaacaccatcgtgcaggccgccgccgccgccgtgaacatcgtgccccccgccctggtggcccagaaccccgaggagctgcccggcaacagcagactgcagatcctgagacaggtgagcctgatcgcccccccccagagcagcagatgccccagcgaggccggcgccatgacccagcccgccgtgctgctgaccacccacgagcagaccgacggcgccaccctgcaccagaccctgatccccaccgccagcggcggcccccaggagggcagcggcaaccagaccttcatcaccagcagcggcatcacctgcaccgacttcgagggcctgaacgccctgatccaggagggcaccgccgaggtgaccgtggtgagcgacggcggccagaacatcgccgtggccaccaccgccccccccgtgttcagcagcagcagccagcaggagctgcccaagcagacctacagcatcatccagggcgccgcccaccccgccctgctgtgccccgccgacagcatccccgactag

SEQ ID NO: 10859 - DNA, 1581 bp, Artificial Sequence
  Description of Artificial Sequence: Synthetic coding sequence
atgccccagcagctgctgatcaccctgcccaccgaggccagcacctgggtgaagctgcagcaccccaagaaggccgtggagggcgcccccctgtgggaggacgtgaccaagatgttcgagggcgaggccctgctgagccaggacgccgaggacgtgaagacccagagagagagcctggaggacgaggtgacccccggcctgcccaccgccgagagccaggagctgctgaccttcaaggacatcagcatcgacttcacccaggaggagtggggccagctggcccccgcccaccagaacctgtacagagaggtgatgctggagaactacagcaacctggtgagcgtgggctaccagctgagcaagcccagcgtgatcagccagctggagaagggcgaggagccctggatggccgagaaggagggccccggcgaccccagcagcgacctgaagagcaagatcgagaccatcgagagcaccgccaagagcaccatcagccaggagagactgtaccacggcatcatgatggagagcttcatgagagacgacatcatctacagcaccctgagaaaggtgagcacctacgacgacgtgctggagagacaccaggagacctgcatgagagacgtgagacaggccatcctgacccacaagaagagagtgcaggagaccaacaagttcggcgagaacatcatcgtgcacagcaacgtgatcatcgagcagagacaccacaagtacgacacccccaccaagagaaacacctacaagctggacctgatcaaccaccccaccagctacatcagaaccaagacctacgagtgcaacatctgcgagaagatcttcaagcagcccatccacctgaccgagcacatgagaatccacaccggcgagaagcccttcagatgcaaggagtgcggcagagccttcagccagagcgccagcctgagcacccaccagagaatccacaccggcgagaagcccttcgagtgcgaggagtgcggcaaggccttcagacacagaagcagcctgaaccagcaccacagaacccacaccggcgagaagccctacgtgtgcgacaagtgccagaaggccttcagccagaacatcagcctggtgcagcacctgagaacccacagcggcgagaagcccttcacctgcaacgagtgcggcaagaccttcagacagatcagacacctgagcgagcacatcagaatccacaccggcgagaagccctacgcctgcaccgcctgctgcaagaccttcagccacagagcctacctgacccaccaccagagaatccacaccggcgagagaccctacaagtgcaaggagtgcggcaaggccttcagacagagaatccacctgagcaaccacaagaccgtgcacaccggcgtgaaggcctacgagtgcaacagatgcggcaaggcctacagacacgacagcagcttcaagaagcaccagagacaccacaccggcgagaagccctacgagtgcaacgagtgcggcaaggccttcagctacaacagcagcctgagcagacaccacgagatccacagaagaaacgccttcagaaacaaggtgtag

SEQ ID NO: 10860 - DNA, 1581 bp, Artificial Sequence; identical to SEQ ID NO: 10859
  Description of Artificial Sequence: Synthetic coding sequence

SEQ ID NO: 10861 - DNA, 1299 bp, Artificial Sequence
  Description of Artificial Sequence: Synthetic coding sequence
atgctggagaactacggcaacctggtgagcgtgggctgccagctgagcaagcccggcgtgatcagccagctggagaagggcgaggagccctggctgatggagagagacatcagcggcgtgcccagcagcgacctgaagagcaagaccaagaccaaggagagcgccctgcagaacgacatcagctgggaggagctgcactgcggcctgatgatggagagattcaccaagggcagcagcatgtacagcaccctgggcagaatcagcaagtgcaacaagctggagagccagcaggagaaccagagaatgggcaagggccagatccccctgatgtgcaagaagaccttcacccaggagagaggccaggagagcaacagattcgagaagagaatcaacgtgaagagcgaggtgatgcccggccccatcggcctgcccagaaagagagacagaaagtacgacacccccggcaagagaagcagatacaacatcgacctggtgaaccacagcagaagctacaccaagatgaagaccttcgagtgcaacatctgcgagaagatcttcaagcagctgatccacctgaccgagcacatgagaatccacaccggcgagaagcccttcagatgcaaggagtgcggcaaggccttcagccagagcagcagcctgatcccccaccagagaatccacaccggcgagaagccctacgagtgcaaggagtgcggcaagaccttcagacaccccagcagcctgacccagcacgtgagaatccacaccggcgagaagccctacgagtgcagagtgtgcgagaaggccttcagccagagcatcggcctgatccagcacctgagaacccacgtgagagagaagcccttcacctgcaaggactgcggcaaggccttcttccagatcagacacctgagacagcacgagatcatccacaccggcgtgaagccctacatctgcaacgtgtgcagcaagaccttcagccacagcacctacctgacccagcaccagagaacccacaccggcgagagaccctacaagtgcaaggagtgcggcaaggccttcagccagagaatccacctgagcatccaccagagagtgcacaccggcgtgaagccctacgagtgcagccactgcggcaaggccttcagacacgacagcagcttcgccaagcaccagagaatccacaccggcgagaagccctacgactgcaacgagtgcggcaaggccttcagctgcagcagcagcctgatcagacactgcaagacccacctgagaaacaccttcagcaacgtggtgtag

SEQ ID NO: 10862 - DNA, 1605 bp, Artificial Sequence
  Description of Artificial Sequence: Synthetic coding sequence
atgctgcagcagctgctgatcaccctgcccaccgaggccagcacctgggtgaagctgagacaccccaaggccgccaccgagagagtggccctgtgggaggacgtgaccaagatgttcaaggccgaggccctgctgagccaggacgccgacgagacccagggcgagagcctggagagcagagtgaccctgggcagcctgaccgccgagagccaggagctgctgaccttcaaggacgtgagcgtggacttcacccaggaggagtggggccagctggcccccgcccacagaaacctgtacagagaggtgatgctggagaactacggcaacctggtgagcgtgggctgccagctgagcaagcccggcgtgatcagccagctggagaagggcgaggagccctggctgatggagagagacatcagcggcgtgcccagcagcgacctgaagagcaagaccaagaccaaggagagcgccctgcagaacgacatcagctgggaggagctgcactgcggcctgatgatggagagattcaccaagggcagcagcatgtacagcaccctgggcagaatcagcaagtgcaacaagctggagagccagcaggagaaccagagaatgggcaagggccagatccccctgatgtgcaagaagaccttcacccaggagagaggccaggagagcaacagattcgagaagagaatcaacgtgaagagcgaggtgatgcccggccccatcggcctgcccagaaagagagacagaaagtacgacacccccggcaagagaagcagatacaacatcgacctggtgaaccacagcagaagctacaccaagatgaagaccttcgagtgcaacatctgcgagaagatcttcaagcagctgatccacctgaccgagcacatgagaatccacaccggcgagaagcccttcagatgcaaggagtgcggcaaggccttcagccagagcagcagcctgatcccccaccagagaatccacaccggcgagaagccctacgagtgcaaggagtgcggcaagaccttcagacaccccagcagcctgacccagcacgtgagaatccacaccggcgagaagccctacgagtgcagagtgtgcgagaaggccttcagccagagcatcggcctgatccagcacctgagaacccacgtgagagagaagcccttcacctgcaaggactgcggcaaggccttcttccagatcagacacctgagacagcacgagatcatccacaccggcgtgaagccctacatctgcaacgtgtgcagcaagaccttcagccacagcacctacctgacccagcaccagagaacccacaccggcgagagaccctacaagtgcaaggagtgcggcaaggccttcagccagagaatccacctgagcatccaccagagagtgcacaccggcgtgaagccctacgagtgcagccactgcggcaaggccttcagacacgacagcagcttcgccaagcaccagagaatccacaccggcgagaagccctacgactgcaacgagtgcggcaaggccttcagctgcagcagcagcctgatcagacactgcaagacccacctgagaaacaccttcagcaacgtggtgtag

SEQ ID NO: 10863 - DNA, 1398 bp, Artificial Sequence
  Description of Artificial Sequence: Synthetic coding sequence
atgctgttcagcgccctgttcttcctgctgtacagcgccttcttcagaagacccgagtaccagagaaccatcttcaagttcctgggctggctgtgcgacctgagcatctacagcctgttcttccccatcagcagaatgagcgccttccagacctggagagacttccccgtgggcgagagaagaagaccctggctgatggagagagacatcagcggcgtgcccagcagcgacctgaagagcaagaccaagaccaaggagagcgccctgcagaacgacatcagctgggaggagctgcactgcggcctgatgatggagagattcaccaagggcagcagcatgtacagcaccctgggcagaatcagcaagtgcaacaagctggagagccagcaggagaaccagagaatgggcaagggccagatccccctgatgtgcaagaagaccttcacccaggagagaggccaggagagcaacagattcgagaagagaatcaacgtgaagagcgaggtgatgcccggccccatcggcctgcccagaaagagagacagaaagtacgacacccccggcaagagaagcagatacaacatcgacctggtgaaccacagcagaagctacaccaagatgaagaccttcgagtgcaacatctgcgagaagatcttcaagcagctgatccacctgaccgagcacatgagaatccacaccggcgagaagcccttcagatgcaaggagtgcggcaaggccttcagccagagcagcagcctgatcccccaccagagaatccacaccggcgagaagccctacgagtgcaaggagtgcggcaagaccttcagacaccccagcagcctgacccagcacgtgagaatccacaccggcgagaagccctacgagtgcagagtgtgcgagaaggccttcagccagagcatcggcctgatccagcacctgagaacccacgtgagagagaagcccttcacctgcaaggactgcggcaaggccttcttccagatcagacacctgagacagcacgagatcatccacaccggcgtgaagccctacatctgcaacgtgtgcagcaagaccttcagccacagcacctacctgacccagcaccagagaacccacaccggcgagagaccctacaagtgcaaggagtgcggcaaggccttcagccagagaatccacctgagcatccaccagagagtgcacaccggcgtgaagccctacgagtgcagccactgcggcaaggccttcagacacgacagcagcttcgccaagcaccagagaatccacaccggcgagaagccctacgactgcaacgagtgcggcaaggccttcagctgcagcagcagcctgatcagacactgcaagacccacctgagaaacaccttcagcaacgtggtgtag

SEQ ID NO: 10864 - DNA, 5499 bp, Artificial Sequence
  Description of Artificial Sequence: Synthetic coding sequence
atggaggacaccccccccagcctgagctgcagcgactgccagagacacttccccagcctgcccgagctgagcagacacagagagctgctgcaccccagccccaaccaggacagcgaggaggccgacagcatccccagaccctacagatgccagcagtgcggcagaggctacagacaccccggcagcctggtgaaccacagaagaacccacgagaccggcctgttcccctgcaccacctgcggcaaggacttcagcaaccccatggccctgaagagccacatgagaacccacgcccccgagggcagaagaagacacagaccccccagacccaaggaggccaccccccacctgcagggcgagaccgtgagcaccgacagctggggccagagactgggcagcagcgagggctgggagaaccagaccaagcacaccgaggagacccccgactgcgagagcgtgcccgaccccagagccgccagcggcacctgggaggacctgcccaccagacagagagagggcctggccagccaccccggccccgaggacggcgccgacggctggggccccagcaccaacagcgccagagccccccccctgcccatccccgccagcagcctgctgagcaacctggagcagtacctggccgagagcgtggtgaacttcaccggcggccaggagcccacccagagcccccccgccgaggaggagagaagatacaagtgcagccagtgcggcaagacctacaagcacgccggcagcctgaccaaccacagacagagccacaccctgggcatctacccctgcgccatctgcttcaaggagttcagcaacctgatggccctgaagaaccacagcagactgcacgcccagtacagaccctaccactgcccccactgccccagagtgttcagactgcccagagagctgctggagcaccagcagagccacgagggcgagagacaggagcccagatgggaggagaagggcatgcccaccaccaacggccacaccgacgagagcagccaggaccagctgcccagcgcccagatgctgaacggcagcgccgagctgagcaccagcggcgagctggaggacagcggcctggaggagtacagacccttcagatgcggcgactgcggcagaacctacagacacgccggcagcctgatcaaccacagaaagagccaccagaccggcgtgtacccctgcagcctgtgcagcaagcagctgttcaacgccgccgccctgaagaaccacgtgagagcccaccacagacccagacagggcgtgggcgagaacggccagcccagcgtgccccccgcccccctgctgctggccgagaccacccacaaggaggaggaggaccccaccaccaccctggaccacagaccctacaagtgcagcgagtgcggcagagcctacagacacagaggcagcctggtgaaccacagacacagccacagaaccggcgagtaccagtgcagcctgtgccccagaaagtaccccaacctgatggccctgagaaaccacgtgagagtgcactgcaaggccgccagaagaagcgccgacatcggcgccgagggcgcccccagccacctgaaggtggagctgccccccgaccccgtggaggccgaggccgccccccacaccgaccaggaccacgtgtgcaagcacgaggaggaggccaccgacatcacccccgccgccgacaagaccgccgcccacatctgcagcatctgcggcctgctgttcgaggacgccgagagcctggagagacacggcctgacccacggcgccggcgagaaggagaacagcagaaccgagaccaccatgagcccccccagagccttcgcctgcagagactgcggcaagagctacagacacagcggcagcctgatcaaccacagacagacccaccagaccggcgacttcagctgcggcgcctgcgccaagcacttccacaccatggccgccatgaagaaccacctgagaagacacagcagaagaagaagcagaagacacagaaagagagccggcggcgccagcggcggcagagaggccaagctgctggccgccgagagctggaccagagagctggaggacaacgagggcctggagagcccccaggaccccagcggcgagagcccccacggcgccgagggcaacctggagagcgacggcgactgcctgcaggccgagagcgagggcgacaagtgcggcctggagagagacgagacccacttccagggcgacaaggagagcggcggcaccggcgagggcctggagagaaaggacgccagcctgctggacaacctggacatccccggcgaggagggcggcggcacccacttctgcgacagcctgaccggcgtggacgaggaccagaagcccgccaccggccagcccaacagcagcagccacagcgccaacgccgtgaccggctggcaggccggcgccgcccacacctgcagcgactgcggccacagcttcccccacgccaccggcctgctgagccacagaccctgccacccccccggcatctaccagtgcagcctgtgccccaaggagttcgacagcctgcccgccctgagaagccacttccagaaccacagacccggcgaggccaccagcgcccagcccttcctgtgctgcctgtgcggcatgatcttccccggcagagccggctacagactgcacagaagacaggcccacagcagcagcggcatgaccgagggcagcgaggaggagggcgaggaggagggcgtggccgaggccgcccccgccagaagcccccccctgcagctgagcgaggccgagctgctgaaccagctgcagagagaggtggaggccctggacagcgccggctacggccacatctgcggctgctgcggccagacctacgacgacctgggcagcctggagagacaccaccagagccagagcagcggcaccaccgccgacaaggcccccagccccctgggcgtggccggcgacgccatggagatggtggtggacagcgtgctggaggacatcgtgaacagcgtgagcggcgagggcggcgacgccaagagccaggagggcgccggcacccccctgggcgacagcctgtgcatccagggcggcgagagcctgctggaggcccagcccagacccttcagatgcaaccagtgcggcaagacctacagacacggcggcagcctggtgaaccacagaaagatccaccagaccggcgacttcctgtgccccgtgtgcagcagatgctaccccaacctggccgcctacagaaaccacctgagaaaccaccccagatgcaagggcagcgagccccaggtgggccccatccccgaggccgccggcagcagcgagctgcaggtgggccccatccccgagggcggcagcaacaagccccagcacatggccgaggagggccccggccaggccgaggtggagaagctgcaggaggagctgaaggtggagcccctggaggaggtggccagagtgaaggaggaggtgtgggaggagaccaccgtgaagggcgaggagatcgagcccagactggagaccgccgagaagggctgccagaccgaggccagcagcgagagacccttcagctgcgaggtgtgcggcagaagctacaagcacgccggcagcctgatcaaccacagacagagccaccagaccggccacttcggctgccaggcctgcagcaagggcttcagcaacctgatgagcctgaagaaccacagaagaatccacgccgaccccagaagattcagatgcagcgagtgcggcaaggccttcagactgagaaagcagctggccagccaccagagagtgcacatggagagaagaggcggcggcggcaccagaaaggccaccagagaggacagacccttcagatgcggccagtgcggcagaacctacagacacgccggcagcctgctgaaccacagaagaagccacgagaccggccagtacagctgccccacctgccccaagacctacagcaacagaatggccctgaaggaccaccagagactgcacagcgagaacagaagaagaagagccggcagaagcagaagaaccgccgtgagatgcgccctgtgcggcagaagcttccccggcagaggcagcctggagagacacctgagagagcacgaggagaccgagagagagcccgccaacggccagggcggcctggacggcaccgccgccagcgaggccaacctgaccggcagccagggcctggagacccagctgggcggcgccgagcccgtgccccacctggaggacggcgtgcccagacccggcgagagaagccagagccccatcagagccgccagcagcgaggcccccgagcccctgagctggggcgccggcaaggccggcggctggcccgtgggcggcggcctgggcaaccacagcggcggctgggtgccccagttcctgaccagaagcgaggagcccgaggacagcgtgcacagaagcccctgccacgccggcgactgccagctgaacggccccaccctgagccacatggacagctgggacaacagagacaacagcagccagctgcagcccggcagccacagcagctgcagccagtgcggcaagacctactgccagagcggcagcctgctgaaccacaacaccaacaagaccgacagacactactgcctgctgtgcagcaaggagttcctgaaccccgtggccaccaagagccacagccacaaccacatcgacgcccagaccttcgcctgccccgactgcggcaaggccttcgagagccaccaggagctggccagccacctgcaggcccacgccagaggccacagccaggtgcccgcccagatggaggaggccagagaccccaaggccggcaccggcgaggaccaggtggtgctgcccggccagggcaaggcccaggaggcccccagcgagacccccagaggccccggcgagagcgtggagagagccagaggcggccaggccgtgaccagcatggccgccgaggacaaggagagacccttcagatgcacccagtgcggcagaagctacagacacgccggcagcctgctgaaccaccagaaggcccacaccaccggcctgtacccctgcagcctgtgccccaagctgctgcccaacctgctgagcctgaagaaccacagcagaacccacaccgaccccaagagacactgctgcagcatctgcggcaaggccttcagaaccgccgccagactggagggccacggcagagtgcacgcccccagagagggccccttcacctgcccccactgccccagacacttcagaagaagaatcagcttcgtgcagcaccagcagcagcaccaggaggagtggaccgtggccggcagcggcgcccccgtggcccccgtgaccggcagaggcgacctgcccctgccccccccccccacccccaccacccccctgctggaccccagcccccagtggcccgccgacctgagcttcagcctgtag

SEQ ID NO: 10865 - DNA, 5490 bp, Artificial Sequence
  Description of Artificial Sequence: Synthetic coding sequence
atggaggacaccccccccagcctgagctgcagcgactgccagagacacttccccagcctgcccgagctgagcagacacagagagctgctgcaccccagccccaaccaggacagcgaggaggccgacagcatccccagaccctacagatgccagcagtgcggcagaggctacagacaccccggcagcctggtgaaccacagaagaacccacgagaccggcctgttcccctgcaccacctgcggcaaggacttcagcaaccccatggccctgaagagccacatgagaacccacgcccccgagggcagaagaagacacagaccccccagacccaaggaggccaccccccacctgcagggcgagaccgtgagcaccgacagctggggccagagactgggcagcagcgagggctgggagaaccagaccaagcacaccgaggagacccccgactgcgagagcgtgcccgaccccagagccgccagcggcacctgggaggacctgcccaccagacagagagagggcctggccagccaccccggccccgaggacggcgccgacggctggggccccagcaccaacagcgccagagccccccccctgcccatccccgccagcagcctgctgagcaacctggagcagtacctggccgagagcgtggtgaacttcaccggcggccaggagcccacccagagcccccccgccgaggaggagagaagatacaagtgcagccagtgcggcaagacctacaagcacgccggcagcctgaccaaccacagacagagccacaccctgggcatctacccctgcgccatctgcttcaaggagttcagcaacctgatggccctgaagaaccacagcagactgcacgcccagtacagaccctaccactgcccccactgccccagagtgttcagactgcccagagagctgctggagcaccagcagagccacgagggcgagagacaggagcccagatgggaggagaagggcatgcccaccaccaacggccacaccgacgagagcagccaggaccagctgcccagcgcccagatgctgaacggcagcgccgagctgagcaccagcggcgagctggaggacagcggcctggaggagtacagacccttcagatgcggcgactgcggcagaacctacagacacgccggcagcctgatcaaccacagaaagagccaccagaccggcgtgtacccctgcagcctgtgcagcaagcagctgttcaacgccgccgccctgaagaaccacgtgagagcccaccacagacccagacagggcgtgggcgagaacggccagcccagcgtgccccccgcccccctgctgctggccgagaccacccacaaggaggaggaggaccccaccaccaccctggaccacagaccctacaagtgcagcgagtgcggcagagcctacagacacagaggcagcctggtgaaccacagacacagccacagaaccggcgagtaccagtgcagcctgtgccccagaaagtaccccaacctgatggccctgagaaaccacgtgagagtgcactgcaaggccgccagaagaagcgccgacatcggcgccgagggcgcccccagccacctgaaggtggagctgccccccgaccccgtggaggccgaggccgccccccacaccgaccaggaccacgtgtgcaagcacgaggaggaggccaccgacatcacccccgccgccgacaagaccgccgcccacatctgcagcatctgcggcctgctgttcgaggacgccgagagcctggagagacacggcctgacccacggcgccggcgagaaggagaacagcagaaccgagaccaccatgagcccccccagagccttcgcctgcagagactgcggcaagagctacagacacagcggcagcctgatcaaccacagacagacccaccagaccggcgacttcagctgcggcgcctgcgccaagcacttccacaccatggccgccatgaagaaccacctgagaagacacagcagaagaagaagcagaagacacagaaagagagccggcggcgccagcggcggcagagaggccaagctgctggccgccgagagctggaccagagagctggaggacaacgagggcctggagagcccccaggaccccagcggcgagagcccccacggcgccgagggcaacctggagagcgacggcgactgcctgcaggccgagagcgagggcgacaagtgcggcctggagagagacgagacccacttccagggcgacaaggagagcggcggcaccggcgagggcctggagagaaaggacgccagcctgctggacaacctggacatccccggcgaggagggcggcggcacccacttctgcgacagcctgaccggcgtggacgaggaccagaagcccgccaccggccagcccaacagcagcagccacagcgccaacgccgtgaccggctggcaggccggcgccgcccacacctgcagcgactgcggccacagcttcccccacgccaccggcctgctgagccacagaccctgccacccccccggcatctaccagtgcagcctgtgccccaaggagttcgacagcctgcccgccctgagaagccacttccagaaccacagacccggcgaggccaccagcgcccagcccttcctgtgctgcctgtgcggcatgatcttccccggcagagccggctacagactgcacagaagacaggcccacagcagcagcggcatgaccgagggcagcgaggaggagggcgaggaggagggcgtggccgaggccgcccccgccagaagcccccccctgcagctgagcgaggccgagctgctgaaccagctgcagagagaggtggaggccctggacagcgccggctacggccacatctgcggctgctgcggccagacctacgacgacctgggcagcctggagagacaccaccagagccagagcagcggcaccaccgccgacaaggcccccagccccctgggcgtggccggcgacgccatggagatggtggtggacagcgtgctggaggacatcgtgaacagcgtgagcggcgagggcggcgacgccaagagccaggagggcgccggcacccccctgggcgacagcctgtgcatccagggcggcgagagcctgctggaggcccagcccagacccttcagatgcaaccagtgcggcaagacctacagacacggcggcagcctggtgaaccacagaaagatccaccagaccggcgacttcctgtgccccgtgtgcagcagatgctaccccaacctggccgcctacagaaaccacctgagaaaccaccccagatgcaagggcagcgagccccaggtgggccccatccccgaggccgccggcagcagcgagctgcaggtgggccccatccccgagggcggcagcaacaagccccagcacatggccgaggagggccccggccaggccgaggtggagaagctgcaggaggagctgaaggtggagcccctggaggaggtggccagagtgaaggaggaggtgtgggaggagaccaccgtgaagggcgaggagatcgagcccagactggagaccgccgagaagggctgccagaccgaggccagcagcgagagacccttcagctgcgaggtgtgcggcagaagctacaagcacgccggcagcctgatcaaccacagacagagccaccagaccggccacttcggctgccaggcctgcagcaagggcttcagcaacctgatgagcctgaagaaccacagaagaatccacgccgaccccagaagattcagatgcagcgagtgcggcaaggccttcagactgagaaagcagctggccagccaccagagagtgcacatggagagaagaggcggcggcggcaccagaaaggccaccagagaggacagacccttcagatgcggccagtgcggcagaacctacagacacgccggcagcctgctgaaccacagaagaagccacgagaccggccagtacagctgccccacctgccccaagacctacagcaacagaatggccctgaaggaccaccagagactgcacagcgagaacagaagaagaagagccggcagaagcagaagaaccgccgtgagatgcgccctgtgcggcagaagcttccccggcagaggcagcctggagagacacctgagagagcacgaggagaccgagagagagcccgccaacggccagggcggcctggacggcaccgccgccagcgaggccaacctgaccggcagccagggcctggagacccagctgggcggcgccgagcccgtgccccacctggaggacggcgtgcccagacccggcgagagaagccagagccccatcagagccgccagcagcgaggcccccgagcccctgagctggggcgccggcaaggccggcggctggcccgtgggcggcggcctgggcaaccacagcggcggctgggtgccccagttcctgaccagaagcgaggagcccgaggacagcgtgcacagaagcccctgccacgccggcgactgccagctgaacggccccaccctgagccacatggacagctgggacaacagagacaacagcagccagctgcagcccggcagccacagcagctgcagccagtgcggcaagacctactgccagagcggcagcctgctgaaccacaacaccaacaagaccgacagacactactgcctgctgtgcagcaaggagttcctgaaccccgtggccaccaagagccacagccacaaccacatcgacgcccagaccttcgcctgccccgactgcggcaaggccttcgagagccaccaggagctggccagccacctgcaggcccacgccagaggccacagccaggtgcccgcccagatggaggaggccagagaccccaaggccggcaccggcgaggaccaggtggtgctgcccggccagggcaaggcccaggaggcccccagcgagacccccagaggccccggcgagagcgtggagagagccagaggcggccaggccgtgaccagcatggccgccgaggacaaggagagacccttcagatgcacccagtgcggcagaagctacagacacgccggcagcctgctgaaccaccagaaggcccacaccaccggcctgtacccctgcagcctgtgccccaagctgctgcccaacctgctgagcctgaagaaccacagcagaacccacaccgaccccaagagacactgctgcagcatctgcggcaaggccttcagaaccgccgccagactggagggccacggcagagtgcacgcccccagagagggccccttcacctgcccccactgccccagacacttcagaagaagaatcagcttcgtgcagcaccagcagcagcaccaggaggagtggaccgtggccggcagcggcagaggccacgagggcagccaggaggaggtgggcacccagtggagaggcaagagcagccccaaggtgggcggcggcgccagaagcgagagaagagagcccagaggcttctag

SEQ ID NO: 10866 - DNA, 723 bp, Artificial Sequence
  Description of Artificial Sequence: Synthetic coding sequence
atggaggacaccccccccagcctgagctgcagcgactgccagagacacttccccagcctgcccgagctgagcagacacagagagctgctgcaccccagccccaaccaggacagcgaggaggccgacagcatccccagaccctacagatgccagcagtgcggcagaggctacagacaccccggcagcctggtgaaccacagaagaacccacgagaccggcctgttcccctgcaccacctgcggcaaggacttcagcaaccccatggccctgaagagccacatgagaacccacgcccccgagggcagaagaagacacagaccccccagacccaaggaggccaccccccacctgcagggcgagaccgtgagcaccgacagctggggccagagactgggcagcagcgagggctgggagaaccagaccaagcacaccgaggagacccccgactgcgagagcgtgcccgaccccagagccgccagcggcacctgggaggacctgcccaccagacagagagagggcctggccagccaccccggccccgaggacggcgccgacggctggggccccagcaccaacagcgccagagccccccccctgcccatccccgccagcagcctgctgagcaacctggagcagtacctggccgagagcgtggtgaacttcaccggcggccaggagcccacccagagcccccccgccgaggaggagagaagatacaagtag

SEQ ID NO: 10867 - DNA, 582 bp, Artificial Sequence
  Description of Artificial Sequence: Synthetic coding sequence
gagagaagatacaagtgcagccagtgcggcaagacctacaagcacgccggcagcctgaccaaccacagacagagccacaccctgggcatctacccctgcgccatctgcttcaaggagttcagcaacctgatggccctgaagaaccacagcagactgcacgcccagtacagaccctaccactgcccccactgccccagagtgttcagactgcccagagagctgctggagcaccagcagagccacgaggccgccagacccttcagctgcgaggtgtgcggcagaagctacaagcacgccggcagcctgatcaaccacagacagagccaccagaccggccacttcggctgccaggcctgcagcaagggcttcagcaacctgatgagcctgaagaaccacagaagaatccacgccgaccccagaagattcagatgcagcgagtgcggcaaggccttcagactgagaaagcagctggccagccaccagagagtgcacatggagagacacagacccttcagatgcggccagtgcggcagaacctacagacacgccggcagcctgctgaaccacagaagaagccactag

SEQ ID NO: 10868 - DNA, 1707 bp, Artificial Sequence
  Description of Artificial Sequence: Synthetic coding sequence
atggcccaggtggacagccaggacagatggggcgaggccagccccctgagcagcctgaccgaggaggcccacgacacccagatgctgagcatgaacctggagagcgacgacgaggacggcggcgaggccgagaaggagggcaccgccgaccccgtggcctgccccagaggcagcagccccgtgacccacgagaaccccgacctgccctggccccaccccctgggcaaggaggaggagaagttcagcgacagcagcagcgccggcggcatgggccagaagcccgtggagatgagcggcaaggccagctggagcagagacgtgaccaagatcaacgagacccagggcagccccggcgccagcagagccctgggcagcctgcccagcggcctggcccacaagctgctgggccagatgcagcccctgggcgacagactgcccgccggcgacgacggctacagcggcgccaaccaggacgccgtgctggacgtgccccccagcttccccagcaacggcaagtacctgtgcgcccacaagagcgtggacaccagcgccggcaacagcagcctgctgtgcttccccagacccggcagcaactgggacctgcccacccaggagacccacacccccgcccaggccagcgccacccccgccagcctggccgccgccgtgctggccaaggccagaaacagcagaaaggtgcagaaccaggccggcagaagagagggcggcgaggccgaggccagaccctacagatgcctgagaggcggcagagccttccagaagcccagcaagcccctgagccccgccgagaccagaggcggcgccgccaagagatacgcctgcgagctgtgcggcaaggcctacagccacagaggcaccctgcagcagcacagaagactgcacaccggcgagagaccctaccagtgcagcttctgcgacaaggcctacacctggagcagcgaccacagaaagcacatcagaacccacaccggcgagaagccctacccctgccccgactgcggcaaggccttcgtgagaagcagcgacctgagaaagcaccagagaaacatgcacagcaacaacaagcccttcccctgcagcgagtgcggcctgaccttcaacaagcccctgagcctgctgagacaccagagaacccacctgggcgccaagcccttcagatgccccgcctgcgacagagagttcgccgtggccagcagaatggtggagcaccagagagtgcacagcggcgagagacccttcccctgccccacctgcggcaagtgcttcaccaagagcagcaacctgagcgagcaccagaccctgcacaccggccagagacccttcaagtgcgccgactgcggcgtggccttcgcccagcccagcagactggtgagacaccagagaatccacaccggcgagagacccttcccctgcacccagtgcggccaggccttcgccagaagcagcaccctgaagagacaccagcagatccacagcggcgagaagggcttcctgtgcgccgagtgcggcagagccttcagaatcgccagcgagctggcccagcacatcagaatgcacaacggcgagagaccctaccagtgcgaggactgcggccaggccttcaccagaagcaaccacctgcagagacacagagccaagcacggcacctgcaagaaggagcccatccccagcagcagcgacgagtag

SEQ ID NO: 10869 - DNA, 1821 bp, Artificial Sequence
  Description of Artificial Sequence: Synthetic coding sequence
atgagccacaccgccagcagctgccaggagctggtggagaactgcgccgtgcacgtggccggcatggcccaggaggacagcagaagaggccaggtgcccagcagcttctaccacggcgccaaccaggagctggacctgagcaccaaggtgtacaagagagagagcggcagcccctacagcgtgctggtggacaccaagatgagcaagccccacctgcacgagaccgaggagcagccctacttcagagagaccagagccgtgagcgacgtgcacgccgtgaaggaggacagagagaacagcgacgacaccgaggaggaggaggaggaggtgagctacaagagagagcagatcatcgtggaggtgaacctgaacaaccagaccctgaacgtgagcaagggcgagaagggcgtgagcagccagagcaaggagacccccgtgctgaagaccagcagcgaggaggaggaggaggagagcgaggaggaggccaccgacgacagcaacgactacggcgagaacgagaagcagaagaagaaggagaagatcgtggagaaggtgagcgtgacccagagaagaaccagaagagccgccagcgtggccgccgccaccaccagccccacccccagaaccaccagaggcagaagaaagagcgtggagccccccaagagaaagaagagagccaccaaggagcccaaggcccccgtgcagaaggccaagtgcgaggagaaggagaccctgacctgcgagaagtgccccagagtgttcaacaccagatggtacctggagaagcacatgaacgtgacccacagaagaatgcagatctgcgacaagtgcggcaagaagttcgtgctggagagcgagctgagcctgcaccagcagaccgactgcgagaagaacatccagtgcgtgagctgcaacaagagcttcaagaagctgtggagcctgcacgagcacatcaagatcgtgcacggctacgccgagaagaagttcagctgcgagatctgcgagaagaagttctacaccatggcccacgtgagaaagcacatggtggcccacaccaaggacatgcccttcacctgcgagacctgcggcaagagcttcaagagaagcatgagcctgaaggtgcacagcctgcagcacagcggcgagaagcccttcagatgcgagaactgcgacgagagattccagtacaagtaccagctgagaagccacatgagcatccacatcggccacaagcagttcatgtgccagtggtgcggcaaggacttcaacatgaagcagtacttcgacgagcacatgaagacccacaccggcgagaagcccttcatctgcgagatctgcggcaagagcttcaccagcagacccaacatgaagagacacagaagaacccacaccggcgagaagccctacccctgcgacgtgtgcggccagagattcagattcagcaacatgctgaaggcccacaaggagaagtgcttcagagtgaccagccccgtgaacgtgccccccgccgtgcagatccccctgaccaccagccccgccacccccgtgcccagcgtggtgaacaccgccaccacccccaccccccccatcaacatgaaccccgtgagcaccctgccccccagacccatcccccaccccttcagccacctgcacatccacccccacccccaccacccccaccacctgcccatcccccccgtgccccacctgccccccccccccgccctgttcaagagcgagcccctgaaccacagaggccagagcgaggacaacttcctgagacacctggccgagaagaacagcagcgcccagcaccactag

SEQ ID NO: 10870 - DNA, 1821 bp, Artificial Sequence; identical to SEQ ID NO: 10869
  Description of Artificial Sequence: Synthetic coding sequence

SEQ ID NO: 10871 - DNA, 1281 bp, Artificial Sequence
  Description of Artificial Sequence: Synthetic coding sequence
atgagccacaccgccagcagctgccaggagctggtggagaactgcgccgtgcacgtggccggcatggcccaggaggacagcagaagaggccaggtgcccagcagcttctaccacggcgccaaccaggagctggacctgagcaccaaggtgtacaagagagagagcggcagcccctacagcgtgctggtggacaccaagatgagcaagccccacctgcacgagaccgaggagcagccctacttcagagagaccagagccgtgagcgacgtgcacgccgtgaaggaggacagagagaacagcgacgacaccgaggaggaggaggaggaggtgagctacaagagagagcagatcatcgtggagtgcgtgagctgcaacaagagcttcaagaagctgtggagcctgcacgagcacatcaagatcgtgcacggctacgccgagaagaagttcagctgcgagatctgcgagaagaagttctacaccatggcccacgtgagaaagcacatggtggcccacaccaaggacatgcccttcacctgcgagacctgcggcaagagcttcaagagaagcatgagcctgaaggtgcacagcctgcagcacagcggcgagaagcccttcagatgcgagaactgcgacgagagattccagtacaagtaccagctgagaagccacatgagcatccacatcggccacaagcagttcatgtgccagtggtgcggcaaggacttcaacatgaagcagtacttcgacgagcacatgaagacccacaccggcgagaagcccttcatctgcgagatctgcggcaagagcttcaccagcagacccaacatgaagagacacagaagaacccacaccggcgagaagccctacccctgcgacgtgtgcggccagagattcagattcagcaacatgctgaaggcccacaaggagaagtgcttcagagtgaccagccccgtgaacgtgccccccgccgtgcagatccccctgaccaccagccccgccacccccgtgcccagcgtggtgaacaccgccaccacccccaccccccccatcaacatgaaccccgtgagcaccctgccccccagacccatcccccaccccttcagccacctgcacatccacccccacccccaccacccccaccacctgcccatcccccccgtgccccacctgccccccccccccgccctgttcaagagcgagcccctgaaccacagaggccagagcgaggacaacttcctgagacacctggccgagaagaacagcagcgcccagcaccactag
